United States Patent 9,328,346 (POLYCOMB-ASSOCIATED NON-CODING RNAS) - sequence listing, part 25

SEQ ID NO: 4158 - RNA, 235810 nt, Mus musculus
cgccccgcguaccaggcccgcuuuacacccucggacuacaagcccacagcucaguaaucaacugcacccugacuccgcccccgcccaccaggcccugccccgugcuaggccccgcccccaccccgugcacgcgccugcggcccguauuucucagugccagaucuuggugcucaggcaccuaaaacuuguguaccguuccccguugcugucugcaguuugcaagcuggugaguuuuggggcacuguguggggcccucucuggagagagccgaaguccagggagacagucguggcucugaguuguccuaaggacuccuuccuuucucuaggaccucagccccuucuguacaggcugcccuacuucccuuggccccgggguucgugggcaagucugccuggugacugggcaugucuccugccacaccuccagaugcccaacacuucucaagucucugcuggauccaugcagguccccuggccauacucuuucccuucacuggugaccaggggguggggaucccgcuucaccuuucuuucaggaagcuuccagaagcuccucagcuuguagcucagaucugcuuguaguaggcccauacuucucauagcuccuucuuucuugagaguaggagaaaauaaccaggccccgggguccugcaacaucauggcuggugcuaggcacaccugguuaaaaccucagagaguaaacaaacaguacauucgcuccgcgcccagugggucuagguuuuuguucuguacauuuuauucugagcugccucauccagacccugauugugaguucagagaaguaagguuugaguguacgugugcgugcacacguuuggcuggacccuccucagacacagacaggagcuuguggaaaggguauucuacaaccugcagagucucuguagacagaccugcucuucauuucacuucccugacaggugaucccagaugauuuuaacuucaugugucucucaguaucugcagcacuugucguagggugcugggugugggggaugugagaagccuggccuguggucaguguccuguaagcuuaggcaugucaucugagcauuugacaggaccuagagccugagaguggcuggacagaauggucugcacaaaugcccugccugaggcuccacccacucugggccacucuggguauugacauaguuugguacugucugaggucuagaggagccaggccacaaggaucuaugggaguaauuuuuuuuucaauuagagggaaaaaucugucauaauaagaguuugacuaauaugugguaugucuuugaagaaguuucugcuguuaccaugguuuaagaagcagagucucagguguugugguaagguggcugugucuuguacagcaacuucuuucuguggagagcaaaaggcaccgaucuuuggguccuguucuagaucagugggccccaucugagccugucucuacucccucacugggccugccagugugcggaguguccuuggcuuaguuuucuauggcuuccucagaacaccaugacuaaggagucuuggggaggggagggcuuauuugguuuacauauccugauaacgguuccccaugacgggaaggcagggccggaagucaagaagggaaggaaccuggaggcagggacugaagcaaagacuauggaggaaugcuguuuauuggcuugcuccucgugacuuacucagccugauuucuuacacacccccggacugugugcccaggcacccauagugagcugggucuguccacagcagucauaagugaagaaaauacagcagagauuugcucucaggccagucugauggaggcguuuucuuaguugaaguucccucuuccuaggugaccugagcgugugucaaguugacuauauauauacauauacauauauguauauauauuuuuugagcgugugucaaguugacuauauauacacauauauauuauauauaauauauuauauauauuauauauacacauuguauauauuauauauacauauauuuuugagcaugugucaaguugacuauauauauauacauaucuuacucagccugauuucuuacacacccccggacugugugcccaggcacccauagugagcugggccuguccacagcagucauaagugaagaaaauacagcagagauuugcucucaggccagucugauggaggcguuuucuuaguugaaguucccucuuucuaggugaccugagcgugugucaaguugacuauauauauaauacauauacauauauguauauauauuuuuugagcgugugucaaguugacuauauauacacauauauauuauauauaauauauauaauauauauacauauuguauauauuauauauacauauauuuuugagcgugugucaaguugacuauauauguacauauauuauauauauuacuauauaauauauauuauauacauuauauauuaccauauaauauauauuauauauauaauauauauuuuuugagcaugugucaaguugacuauauauauacauauacguauauguauauauauuuuuuguuagaugcaaacuguggcggcucaagcuuguaaucccagcacuugagaggcugaaucaagaggauugucaggaaagguuguguagucacuccuugaaacucugucuucaaaacacaaccagccaggcgaccaaacaaggcacuuaagugaucauaacuguucuuauuuuaaggagcacaaaugcuuaggauccaagggucagaccauuaagacccucuccuagucugugccuuucuuagauguugguuuugauaggaagugacgaaagcauaacuguuguguggauuccauuuucuccuuaucaaaggcccacucacgugcuccuguacuugagauaugaccaccccuuaccccugaguaagcugaaaacacuguaaguuaaaaaaaaaaaaaaaagcucucugagcguaguaaaccaugcuccagacucgaaucccacccaacgauuugacacgcauuacauuuucagcuauaaaguucacacuugaaaaucauacaguugaguuaccaaaaaaaaaaaucucauaauacuuuaauaaguuuguaaucuuuuguugggccacauuuguaguuguccugagccacauguggccagugaggcacaguuugaauggaccuacuuaugucuaaucuacuuaugucuguggcuucucuuggcuggaaggaucacaaaccauuagcccugaaagaggucaaaguucaacacacacacucggugucuacugagaccauaaugcuuuauaccaugggaaaguaaaacaaaaaaauggguguuucaugaaaguuggggacaguccugucucuucacaugucauugugacccugccaaugucccacccugguauaaagugccuucuguauauccacuuuccuccaggccuuuggguacaugccacacaugaauaucucagacccuggaggacccuggcuuggcugcgaccacaggucugccuggccauguuuugguguguggcuggccuugcccaaguucuuacugaaggcguugaugucugacuguaggcucuuguuuaacuaaaaccugaagguucacaccagacgccuauagaccagcauucaucugagcagaguggccugucagccugcccacagacacugauaaacagacuggccuacaccacuucugggucugaaguggaagcgacaggauuugucuaggagggaguaggucagagccuugccggcaggaggcucugccaagguugacaggauggauuuucuuguucuguuugcuguggaggccugugcuggacauggauagauaaaaguuggaggcucagcauugcagccugaguguggugugguguguguccuuguucagccauuagccaguggcaacagucaagcucucugacuuaaauauugguaguaauaaaaggcacauugaggagggcuaugugguuuggggaaaaaaaccacauaaugaaugugugggacauagugagggacuuacuccuuucuguagcuguucaaaugauuugccuuaagaagggggcuaaauccucuggugaccuucugugaccuugaaggaaacagugccuugacagauuuaguuuccagguggagggguccaugggcugggucuaccaugauaccaggcaucccuggguuaggccagccuccuagaccuugcaccagagucugccccagcaaagcaaccaaauagacaggcucucuccagggaccacagcccaguggugacacucuuguugauggcugaaacuuguuuucugcacucccagcuggaguaaacucauuuuggucuucaacguacaagucggaccaguuaaacaaauuccauaggaaacaucuuacggcuuuuauuuguccucacguacaaccacaaaaggaacagcgagagagcgauaagugccugcuguguccacuccgcugcuaaaauuuucuuguuagaauaauuuucuacccauaacacuugugaagucagccccacauccagcucagcucuggggcccauucccagaagucugagggugacacggaaugcacaguccaccaauggcauggcucguaaaagcaggcacuuguuaaaucuauuuguuuuuauuauagacaucgaucugccaguugcaauaaugcauuuauggacauuuuucugcaagcacagcgcugguggcaguuuuuacugacaaauugagucguauggauaguaguucagagcacucuuagccuauugacagauugggugaucccaacacugauuucuguacccuagugggugaggagagagaauggcucuggaacgaaguuggagcuggggcuuuagacaugggggugcuaguuagauagagagauggaguagagaacauacaguuauuucucaucugugaacugagcugaauuauaacccagacaaaugguggggagccaggaguaucaccuucagguuggucugcuguugguauauauggucagauccucccaacauggcccccagcaagguugaauguggcaacuuugcucuccaugagugagugaguguucauaggcugacccaaagguggucugaacucuguugguaucagaauuuaugagagcccugguccccaagguggguguucuggcagguuuuaugagccaacuugacacaggcuggaguuaucacagagaaaggagcuucaguuagggaagugccuccaugagauccagcuguaaggcauuuucucaauuagugaucaagggggaaaggccccuugugggugggaccaucccugggcugguagucuuggauucuauaagagagcaggcugagcaagccaguggaagcaagccaguaaggaacaucccuccauggccucugcaucagcuccugcuuccugaccugcuugaguuccaguccugacuuccuuuggugaugaacagcaauguggaaguguaagcugaauaaacccuguccuccccaacuugcuucuuggucaugaugcuucagggucacagauguucucagucaacuucugguagggccucucaggggauagccaugccaggcucuuaucuguaagcacaacauaacaucaguaauagugucaggccuugguuacccccccccccaugagauggaccccaaguugggccggucauuagaccguuuuuuccuucagucucuuuuccaauuuugucccuguaguucuuuuaaacaggaacaguucugggucagaaauuuugacugugaguuaguaaccaugucccuccgcuugaggcccugucuaucuaucugcuggagguggacucuccgaguucccucuccccaguguugggcauuuuggcuaaggucacacccauugaguccuuagagucucucaccuuccaggucucugguacccccacccccccaugcugcuuaucuccauucauucuguuggcccucggggcuucucuccugucccccccccaauaugugauccuguuucccuuuucaccuuccucucuccucucccauccagaucccucccucccucugccuccugugauuauuuccuuccccuuucuaaguggaguggaagcauccucacacggaccuuucucccuguuacacuucuuaccaucuguggguauucuccuagguacucuguacuuuugggcaaauauccacuaaucagugagugcaugccauauguguccuuugcugucugaguuaccucacucaggaugauauuuucuaguuccauccauuugccugcaaaagucaugauguccuccuuuuuaauagcugauaauuguguaaauguaccacauuuucuguauccauucuuugguugaggggaaucuggguuauuuccggcuuuuggcuacuacaaauaaggcugcugugaacauaguggagcauguguccuugggguaggguggggcaucuuuuggguauauaaccacgaguauauagcugggucuucagguagaucuauuuccaauuuucugaggaaccaccagauugguuuccagaguuguuaucaguuugcaaucccacuagcaaugaaggaguguuccucuuauuccacacccucaccaggaugugcuaucacuugaguuuuugaucuuagccauucugauugguauaagguggaaucucaggguuguuuugauuugcguuucucugaugaguauugaggacuuugaacaucucuuuaagugcuucuuggccaucucaagauucugucgugaauucucuguuuaacucuguaccccauuuuuuaaaauugagcuauuugguuuuucagagguuaacuucuugaguucuuuauauauuuuggauauuagcccucugucagauguagaagauuuuuuuucccauucuguagguugccaauuuuauugauggcuucuuuugccuuacagaagcuuuuuggcuucuugagguccuauuuaucaauuguugaucuuagagucugacucauugguguucuguucaggaaauuucucccugugccaaugaguuugaggcucuuacccacuuuuucuucuauuagagucaguguaucugguuuuauguugaaguccuugauccaccuggacuugagcuuugugccaggugauaaauacgggucuauuuucauucuccuacauacagaccgccaguuagaccagcgccauuuauugaagaugcuuucuuuuuuuccccacuguauguuuuuggcuucuuugucaaagaucaaggguucauagguauguggacuuacuuuugggucuuugauugauccaccuuucugucucuguacaaauaccaugcaguuguuaucacugcugcuuuguaguuacagcuugagacuggggauggugauuuccuuggaaguucuuuuguuguugaaaauuguuuuggcuauccuggauuuuuuguuuuuccauaugaaguugagaauugcucuuuccaugucugugaagaguugugugaggauuuugaaggggauugcauugaaucuguagacugcuguugguaagauggcuauuuuuacuacguuaauucuaccaaaccaugaguaugggaggucuuuucaucuucugaggucugauuuauuuuuuucugggauuuguaguucuggucauacagcucuuucaguugcuuguuaggaguuacaccaauauauuuuauauuauuuguggcuauugugaaggguguuguuuuuauacuuucucagcccguuucucauuuguguaaaggaaggcuacugauuuguuugaguuaauuuuauauccugccacuuugcugaaguuguuuaucagguguaggaguucucuaguggaauuuugggggucgcuuguguauacuaucauaccaucaggaaauagugauaucuugacuuccccuuuccaauuuguauccccuuggucuccuuuuguugccuagcugcucuggcuagaacuucaaguacucuauuaaauagauagggagauagugggcaguguugucuuguccuggauuuuuagugagauugcuucuaguuucucuauuuaauuugauguuggcuauugguuugcuauauauugcuuuuauuaugcuuaguuauaugcuaugaauuccugaccuguauuuugucauugacuuuuucagcauuuaaugagaugauaaagugaccuuuuuccuugaguuuguuuacauaguguauuauguugauggauuuuuguauauugaaccaucccugcauuccugggaugaagccuacaugaucuuggugaaugaugguuuugguguguucuuggauucaguuugugagaauuuaauugaguacuuuugcaucgauauucauagugagauuggucuaaaguucuuucugugguuuaggugucagaguaacuguggcuucauagaaugaauuagguaguguuccuucuguuucuauuuuguggaauaguuugaggaguauugguauuaggucuucuuugaaggucugguagaauucugcacuaaacccaccuggcccugggcuuuuucugguugggagauuuuugaugacuauuucuauuuccuuagggguuaugggacuauuuagauaguuuaucuugauuuaacuuugguaugugguaucugucuagaaaaucauccauuucaucuagauuuuccaguuuuguaguauauacgcuuuuguaguagguucugaugauuuuuugaauuuccuccauuuuuguuaucuuucccuuuuuauuucugauuuuguuaauuuggauacugucucuaugauguuuaguuuggcuagagguuuaucuaucuuguugauuuucucaaaagagccaguucuugguuuuguugauucuuuguauccuucucuuuguuucuaccugguugauuucagcuccgaguuugacuauuuccugccaucaacuccuccuggccuuguuuacuucuuucuguucuagagcuuucaggugugcuuaugugggaucucugcaauuucuuuaugaaggcccuuagugcuaugaauuuuccucuuaagauugcuuucauuguaucccguaaguuuagguaugaugugucuucauuuucauugaauucuauacaguccuugauuucuuuauuucuucccugaccaaguuuucauugaguggagaguuguuuuguuuccaugaguguuuuguuccaugaguaggugggcuuucuguuguuuuaguuguuauugaagucucgccuuagucuguggugaucuaauagagugcgugggauuauuucaaucuucuuguaucuguuuuuguuugauuauauggucaguuuuggagaagguucuccaaaugagaugagaugaugagaagaaggcauauucucuuguuugggggugaaauguuuuguagauaucuguuaaauccacuugguucauaacuucuauuagucucacuguaucucuguugaguuuguuucaaugagcuguccauuggugagagugggguggugacaucucccacuauuauuguagguucaauguguguuuugagauuuaguaacauuccuuuuaugaaugugggugcuuuugcacuugaggcauagauguucagaauugagacuuccucuugguggaauuuuccuuugaugaauaugaaguguccuuccccaaucucauuugauaacuuuugguugaaaguguauuuuauuggcaguuagaguggcaacuccagcuuguuucuugggaccauuugcuuggaaaacuuuuuuccagccuuuuacucugagguaguuuuugucacugagguguguuucuuuuaugcaccaaaauguuggauccuauuuacacauucaguuucuuagccuguguauuuuauugggaaguugagcccauugauguugagagauauuaaagacagaugauuguuaguucuuguuauuuuuguuacuggaggugguauuauguguauaugauucucuucuuuuggguuuauucugaaauguuuaauuucuuguguuuucuuggguguaguuacccuccuuguauuggagauuuuguuccaguauccucucucgggcuggauuaguagaacaauauuguuuaacauggaauauuuugguuucuccacauauggugauugagaguuuugcuggguauaguauccuggguuggaauuuguguucucuugggaucugacugacaucuguccacgaucuucuggcuuuuagagucucuguugagauguaugguauaauucugauaggccugccuuuauauguuacuuggccuuuuucccuuacaucuuuuaauauucuuucuuuauucugugcauuuaguguuuugauuacuauguaccaggaggaacuucuuuucugguccagucuauuuaguguucuguaggcuucuuguacauuuauagccaugucuuucuuuagguuggggaaguuuucuuguaugauuuuguugaagauguuuucuggcccuuugagcugagagucuuuaccucuauuccuuuuauucuuagauuucaucuuuucauugugucuugaauuucccagauauuuuggguuaggagcuuuuuacacuguauuuucuuugaccgaugugucaauauuuucuaugguaucuuauauaccugagauucucucuucuaucucuuauauucuguuggugaugcuugcaucuguaucuccugaucucuuucuuaaguuguccaucucuaggguugcuucccuuuguguuuucuuuauuguugcuauuuccacuuuuaguucuaggguuauuuuguuaaauucuuuuaccugcuugaucguauuuuccuguauuucuuuaaaggguuuauuucuuuccucuuuaagggcuucuaccuguuugccuguguuuuccuguauuucuuuagggaaguucuuuauauccuccuuaaaggccucuaucaucuucaugagauuagauuuuaagucauuaucuugcuuuucaggggugguauccaagacuugcugugguggcagaacuggguucccaugguaccaggcugcauuggguucuaucaccuaugauucugugcuugccucuggccaucugguuaucucugguguuaacuggccuggaugucucuggcuagagucagucuccuuggagauagguagagccauucuccuugaaggcaggcaggugggcaucuugugucucugguuagagcaggccuccugugucccugguuacugcagaccucuugggaggcaggcaggcugugucccugguuacuuuggcucuccugggaggcagacaggcuguaggguaugggaagguaucaggucugcugcucuggcccagguggagacgagaucaguaggaagguggagcucagcaggcgggugggcccugugucuucugggcucuguaucuuuggauauuguggaccuccuaggaggcaagcaagcuauaaugugggugggugggaggguaucuggccucugaccuggcauggguaggaauccggccggaagaaggguggagcucaggggugggaucgugggggagguggguuccucguccacugucaacugggcccccaugguugucccagcuguuguggauauuugggugagauucucaccugugucuuugauucacuguggaucuccugggaggcaugcaggcaguagguaugggcagguaucuacccuggccaggguaggaagcugaggcccagcuuucaaauacaaacccaaagacauuuuuguggaacugaaagggguuuuauauagcaaggguuagaaccacauguagacacagcaaugaagugauguugauggagucagauaaugagugagaugggcagcuguuagccaacccauuccagguguuuccuugucuguccgaugagaaugauugacuuauucugacuacccggguaggaaccacauuauguaauaagugaauguuuguuuuauaaauaaaaagcacaaugcagguggaagccuucucucaagccuauaguuuugguuaaaagccuuuuuuuuccuuccaggucagccagcacacacacagcccuucgguccauucaacaaccuaguuuccccguagcccaguguaccggcugguuuuaugugucaacuugacacaagccgaaguuaucacagagaaaggagccucaguugaggaaaugccuccaugagauccagcuguaaggcauuuuuuuucaacuagugaucaagggggaagaacccagccccuuguggguggugccaucccugcgcugguagucuuggguucuauaagagagcaggcugagcaagccaggggaagcaagccaguaaggagcaucccuucguggccucugcaucagcuccugcuuccugaccugcuugagguccaguccugacuuccuuggugauaagcagcaguauggaaguguaagcugaauaaacccuuuccuccccaacuugcaucuuggucaugauguuugcaggaauagaaacccugacuaagacuuccagucagcaugcuuguuuucuucagugaacgucuuuguuuccuuugacucaaccagaacuuacaucaccaacucucaucccccaagccccuagguuaguagcacagggguccucugcaaaaucccuggagacaagauggcugccgggaguuugagaacggugacucuagggcuuggucucauacuguggggugugauggagguaauaucguaaggcaucuugguggccaggcccuggugagcucugaguagugauaacaguugcuuugggaugaccuuaauugacagucacaaagcugugcuugguggagcaggacuagaggcuguagaagccccucgucaucaggucuguguguuggguguggcuccucugaggugcuggguuucuuaagguuuuguuuguggagcuggugcacucuguugccgguucugaucuuuguuauugagaguuaucaaagcgcuuggccucaugaucccucuguucaggaggucaacuucagcugggcccugagaggauauauacucagauauacucauuauuggugccaagagcuagcggcuuugccucccauguucuccuaauguccugccagugccagccagccccaggcuugacaucuccagucuauuauguuaaaagaauauccugaaggaccagacacaugaucccacaugaugacccuggucaggaucaggaguggcacuagccugucuagccuuuucccucaugugacugcccauaccauagcaucaagggguaaccuaggucugcuggguaaguuuugucaaaaaacagugauuugaaguacggcuugcugugcauaccugaagccccagugcuuaggagauggaggcgagaauaggaguucagguccauccucggcuacauagugaacucaaggggagccugggcuacaugaaauuuugucucaaaaccacuuugugaugguuaauuuuuuuuuuccaagucuguaucucacuauauggugcuggauggccuagaucuucuuauguagaccugguuggccuccagcucacagagauccuuuuccucugcuuccugaguacugggguuaaagguguguaccaccauaccuggugugugacguuuaaucuugauggucaacuucauggacuuuagaaucuccagaggaagcacgccucugggcaugucugugagggaauuuuuagauugaguugacaugagaagaccuacccuaaaugugggugacauuguuccaugggcugcagucccagccuucauuacucugccucuugacuauggauacagugugaucagccaccuccuaccaccaugccuuccccaccagagagcauuguauccccuagaacuguaagccaggauauacaggaaaguagcuugcgugugcucccugaaccuccaguauaucagagcucuguacacauuuuagcggguagggaauagauuuuauuuaaguggcuuuucacccuugggugucacaugucauuguggaauguugaaggcauauuuucuguguugcuuuaccuagccaugguguccagcuuuuugacauugugacaugcuguuguauggaacugcauuccaagccuuuauaugucgguccagcuaaagguuggcuguguucucucguaguucaucuuaccaaagccucagucguagcugaaagaaugggcaaguaguagcuuucuuuuuucucuuuacaugugacgaagcuggguuucagugguacaugggacagagagcucuguaacucagauguguuggccgaccacaggcagguuccuucucgccauuguguggugcuuucuuugcugggagucggcugagagggugcuggaaagccuuugugcggaggaacaggauaucugcaaagacauguuuguguauucaaugaaggcuucuggccagugucaccagucuuuguccuuggcaaagaagcaaagcauguaucugagucugcuccuaaugaugguucucagaaccccaugaggaauguguagcacuucagccgggaugagugcagugcagauggaauggcaagacccugccuguaggcacuuggcuccugugguccaucucugccccacacccauuagugaguggagagcaaaugcacuggggcuggaggaggaagggagcauccaagcgcuagccauggaccuuaccacuucuccgcuggacaaggacccuugcguaauccuuguccgcgggccucuggagcagcuucugagauuucuugacgaugggggauguugggggcaggggugggagauuccagguagagcccugggcagugaacucugggguguaucuuggggccugucagcagggaguucaguuugaguguagggguagcuaacgaggagggcuggagaggugguggggccugucccaugcugagggguguggggauaacaggccauugcugugaucccuaggaagaucagugagggguggugccuguggaggucauguggggucuggcagugaaggggugguaccuguggagguuguggcaacaaccuugucagcugacugagagguacaugugacuggggagacgaguuagaaaagacaacugcauauaagaucauuuuucuguguuucuuuuuguucuuuuauuuugcuuugauuuuuaagacaggucucauguagccuagguuggccucgaacucaccaugucugcaagaaauaaccuggaccuccuaauccuccugucucuaccuuccaaagggugggguuauaggcuagaaccaccuagccggggucauucuccuugcucuggaaggaggaaauguuuggcggauguucuuuuauuuaacauggguuuugaagaagcacgcugucugccuugccuggcauuugggcucugaggggggagauugccuuauuuuaacugcucauucaggcagagaugucagcggggaggaaggcggcucauuaacaggcaccuccacccccagucugagcucugugggggggcaaccuguacuuccuguacguaggccuggaauccuuaaaccacacugacaaguuuuagguguacagucacaucagagugcaaauuaaaccuagagccugugcuugccuugcuuacauaaagaccaugggaaguucccacuggguggucgauuccuguggggcucuguugguguuccuaaugcaggaagauacucucugagggccaguggggucagaggccuguuuuccagcgcuguaacagaauacccgagacuggguaguguauaaggaaagagcuuuugggcucccaguauuggagcugggaugcuggauaucagggucauaggugguaaggaccuugugcugcuucaacuccuguugaaaagcaggggugcaggcacugaccuauuucugagagaaagaccccaugaaguuguucccuacagucuaaagccuucccacugggcacuaccuucccguaccgcacagugaaauuguucuaguacauaggagaagacauagcaggcuugugcuagcccuugucuuagauggcuguguucuugaagguuugggucaauaagacuggguagacgauauguauuuguauuucuguguguuggugagggcaucaggaagacaguagagaauuuggccuucauggagggguguuagugguggaauguauuuguaugcguuguauuuuuguuuuuguuuucuuuucuuuuccuuucuuuccuuuucuuuguguguguguaugugugugcugugugugaccaagagcccaagugaaugauuuaaaggaaaguuuguuucagcucauguuuucagaggccuccagugagugacuccguuguuucugagccucugacagagguagagaaucaggguggucaagaaacagagacagaaugaagugggggagggagagaaagggaaauaggguagagucgagugucuucccaggguaugccccagugaccuacuuccaaugagucuuuuccuucucguacugucauaguguaaauccaucaguggaugagucuauugauuaggucagagcccuuaggauccaaucauauucuagugauuggaaccaccagcugaggaccaaacuuuugacacuugaguauucuggggacacuucacaucuaaaccaucauaguuugaaacagcccuucugaauguaugguuucugaguagagauuuaagcgugagagguaggcagccacugggagaucuggggagaggucucuggaggcaggaacuguagcuguagagccuugggagaucagggucggugugguaaauggacacaugguugggucagaguggugcagaggagcuggagcccacaggcuguacuccuuuaugugguagaugccagaguucauggaaggucucagaaacauagauugagaaucuccguguuccuagauugucaucuaguuaagauaaugccagccaugauuccugugccugugucaggugacagggaaucaaaugagcaagcaugucauguccucagcacagcggugguaggagcucuguucuggguacgcugcuguucuuguuaguaaggcgucuagcacucaaggggaaguuucuagaauaaugggcaaagaaaagaaaugauauauuuccaaaaguuacugaauuuagccagcuaucccaagaagacccagguguacuauucuuuauugugcagaaaaaaauuuguuucugucaccauugcguuagcaucagauuaagcugucgagucagauggaugcagggcgucgugugggcucucugcugauuaacaggcucccugcgccuccuccagcccauccgucucugggcugagcagggguuugggaacugacugguagcuggugggaacggaguccccuugggucaaagucaggagacuaggggaggcugcuuucagaaugcugcuucugacagauaaccagaaaguuuuuuaaagaaagaugagcagguguaaacauggguaaaucuuaucaagcuuauccguccuccugaccggguuaagagggcagguucugagaguugcugccuuuccuuggaugugggggaccagacauagguaagugggccuuucaaucauaagcuagauacaucucaggcauacuggggucgcuggcaugcuaaaguuuucacuccccagcucuccuggacgugaugguugugacuuugucacuagcuggaguugcccuuggucuugagucuagcucaguaguuuuguuuucuuucugucuucaaaagcauggggcuuaaaaaacucugccuagcucagaaugaggcuuccugaggaauuaacuguuuccaggguauauuaagcuguggggccaugcagacucuuuugcuguggucuuggaguccugugaguccaaguucucuaugggccuuguggguuguguguaucuuaagguccugggaauccagagugcugugggcauaggggcuguaugagaccgaggccuguguggaccugaggugggucuggguuucgagugggauggaagaggaagucugaagugagaacacugguuugugcucuagccucaccaugccuuguuuccauucccauuuacugcccucuuucccuggaaucaccuagaagcuucuagaaauaccagacuucacaaauucuguacaaguguggagcauggcugcccaguacaguauguugcuuagcgagauccugguguagagacacuugcccuguuuccuucccaucacucuucucuucugcugaagacaagcucuagcugacccuccugcucagauccaaggcaaagcgcauuuauaccuggcucauuuggaccucccuggccccacgcaugcccagugggcacuuuaucagccucugcuuauccagccuugacccugaguugcaugugugugugugugugugugugugggggguacucaagagucaccuucucucuguacuuugaugaccuccuuugucccaagacccaaacccagaagcacucugcugucagcccucaaaccuucccagucucaaguuugagaugucuucacccuugugcuccuucccgaacauuccauuacacuuucuuucaccuucuugguacuggguuuauccugcaguguuggaaggcuggaucaggagcuuucugcacuguggacacaaugugaccgcaggcugugcuuugcugggcauggacucuggucucacuguguccagggucagcgguuacagcugugugcagugaggcuguguuugagaccaggucuucagaagagcugcauggccagauuguuaagguaaagcgaggucacaggaugagguggaucccagccccauaaguccaggccuuguaggguggguuguagcugcucugccaauaugccagggaaagagcucucugcaggagccuagguagccaagcuucugagcuguugucccaucuagacagaguugacuaagugccugucauuuaagccagccuguguggcugugugcucugccagccagaguugaccaaauauggugauugugcgggaggcuggaguuugggggugaagauagaucucuugauacuggaaaauuuggggguccuucuuguagguucucaggcucauuaguagaauaguuuaccaacagauagagaaggaaguugcuggaccaucagaguuuguuagagaaacagcaggccaggugagcuaggaaucuuggcagcuguugcugaggagggagcuggagaaagggggaggggaaagccgugccugcgggaguuaggggcuaugaguuuggggccaaaagccugcauguuagcugugcagacauguggcaaauggaggguuucaaagaaagagagaggaugucccgaggucagagaaagagacaguuugacaguuuugcuaagaagaguagugggcucguaaacugagggaaaagucccaaaagcccggaucaagaagccaggaccaagaggccugugacccucuacagggugucaucuagacuacccaucuucucugcugcagccuccccccccccucuguuccauaccugaggacagcggucuuuccuaaguuaauccuguaguguucucacuccagaccccuaguuccuauuugugugcguguguugcauauggaaugcagaucauaagcuuuuucauacuauuuccgagugcuuccugcucgcuaucccauagaugaacaccaugccccuaggcccuauguugggagcccauuauggcccagagagaaacugcuauaugaagccagagcccuggguuggggaauguguugugaauauuaaaauacagagcugaguuauucuugguuaucauuuauuuauuuauuuauuuacuuacuuauuuauuuuuauuagcagcuguuuacuguuuacuuccacagccgagagucggcaagaauaugauuaacccugagggccauuuucuaauguaauuauuaaugacugauucugcuuauccugggaaucaauaagggggguggggaauaguggccugguguguacuuggacuugauuucuagcauuucauaaacaugauuccaggacagcguuccuauuggcuuauuacucagaguguguuuggugaaccugaagugugugauuacuuccacauaaucaucuugauagguuguguucaguaugugacuuauguuaauauggcaaguacugcugaagucucccgccacuaaugguuagggcggggauggauaguaauugaucuuccugggagugcugcaauguaaaaacaauccgggcuguuggaaguauauuuuacaagugugcauugggccuuugggauguuauauugaaaaacccaauuguacaguuaccaugggaacccaauuagaauagauugcuuuuuuuuuuuuuccuuuugucuuucaucuugaccaaaaaaucuaauguauuuuaagcguuuucguauggaacuguguuccucuacugaugcguucugccacaggacucuuuuuuuacccccagcuuuagcuuggcauggugguauucuuuaguggugcuguguggagaugccucccagagagauuuaaucacauuuuuaugggaaaguuugugugcauagugguggaggucuuggcauuuuuaaaaguggggugagggguaucuuccugagacuauagacaaggcaccaccaccccugugucccucuccagugggagaucuaggguaucccacugagcucguguguguaguuaggggauuaugucccuuaaaaguccuggguugcacagugcuagagaugacagaugagugcucuaagccuggggaccccaagcuuggucucagaguuugucugugcucuuaaaauuuguuaggguucccaagagcuucugugagcaguacacagaggccgcucaguuuucacacaauuggcccgggucugccuucgcaugccaaccuccagggauccuuucuguaaagaagcauggcguuugugccuagccuaucauaccuuccaucgggcuuugaaccacuuagaaauuucugucuuuauuaguaaauuuuguuuuuuuucauaccuccauauauguauacuguguauuuuguucccuuugucuucacgacuuucccccucuaaauuuuuaaaagcauccauugcaacauaacuaucuaaauaaauaaggaaauucaauaaggaaaaaauuauauauguuugguacacguaauauccucccccaaauuccaguuaaugugugggcuaaauccuugaauguggagguacagauggccgacucuauugcuguauuagaguuaacacugagaaauugaaaaguauuuauuaauucaugugaacagccauaacccauucgauuucugcauaaagagcauuuuucaguggaaggcaguuuuauuuuccauaaaaagcaauuagcagcaggaguguuacuggucugccuuuguuucaagccuucuuaauaucugguuagauagacagcagcgaggugcucagaucagcgucuguauucagacugccuggauauguggcuuugguucaggccuacagagaagcuggccuugcucaguggaguagauggaaaagggaccagcaauuuaggcuuucaggugcauguggcuguccuagagccccauuacaaggggccgacuuuugagauguggcaggguggaauccaguccugugccuucccaucuuccaucugccagugcugacuuuaguauuaggugauuacuguaguuugaaaugaacauccccaaaaguccauguguggaagaucaagucccuagaaggucccuauuagacaccugguccugaggaguuacuguucuucugcuccaucaggccccaugaggcacaguccuauggcuuucugcaggccugccucuuuugugauuaggaugcaggugaggccgcuggcacgagugcauccuucugcauacugcugguauuguuuuaccuuuaaauguugucuagaguuuaccugggaagcuguuuaagcgugcagucuucuccaaguacuuacugcaaaucuaggaccauuuuucuuccuaguaugugccuguuuguaccacuuauucuucuugagacuuuuuucuuucuuuucuuuuuguauuuuugaagacauuugacccuuucguuuaaguuguugaauuuauuggcugaagcagcuccccuguuccuuuguugucucuuauguguaugugggggguucagucucucccuugccuuccuuucuuucuuucuuucuuucuuucuuucuuucuuucuuucuuucuuucuuucuuucuuucuuucuuugagauagagucucacuauauagcucuagcuguccuuuaacucacucuguagaucagacugacuuugaacucacaggaauccuccugccucugccucuggcaugcugggauuauagguguaggccaagaugcccaacuaguagucgucuuuuaaaaauauaaaauucauuuacuuggaaguuuccauuacuuuagcucugaguagauccuaauuuuaaucuaguaugcauguguacauacauguauauacauguguauguguggauacacauguaugauauauaugcaggaugcauaugcaugugugugugugucauauauauacguguguguguguguguguguguguguguguguguauuacacucagagauuaaaccugaacgaucuggauccacuuaguacuucuuggugcaggucugcaggcaugagucaucucacuucuguuuuugcuguuucuaaagugaucuuugcuuccccgaauccuugugucacucacagaacucugggcugaagugcugggaagacuguccguccaccauauccuuccugacauaacuucagauagucaguuguucucacucuucaucuugugccucggugcgggguuuaucuuugugccuucccuccagccgcaguucaguucugucugucauuuguuuucagccguaggauugucugccuggcguacuugucggcaucuucuucugcuugggcuccacugagugucuggugucugugaugucaggcuuuucagcgguuaacgccccucacgucugagcccugagagccccacucugugccaagcuucaugguccuguucccgucucagugacaucugcaugucuucuucaccucauuauuucuuagcauguggcuaguaaagagagauacuugucaccacccccucugccucaucuaaccuuuugaucacagccaguguguuucuugugacacaucuguguaagugccauugaugcggccuacuucucuuucuucuacguuuagggauuuguucuguugaguaauuuuucucuuaguugugggcccugaauauacauguccuuauguauguauguauuaguggauccaggguaucuacaaugcuguuguugaauguuauauuuuauaaagggcuuugcucugguaaagauaagucacauuauaugcuuucaaggcuuaauuuuaagcauuauuaggugggucuggaauaggcuuucauccagaauaaguuagccuaacuauuagggcaaugacuugauuugacagguacacacacaaacacacauacacagauggaugggugcacacacauguguaugcauuuauguaugugcacauauauguauaugaauguguguguugauaugguguguaugauauagauuaucgcauuggcucccagccugugauggugugacuuagguuucugcugguuacccuguguuuucugagaccccaguguaagucacguagcaccugaacauuagaugaaguggccaugagauccguucuccacgaauucuguguaaggaagacuuugcaugcagccuggcaaggggaugaaucaucuuugcaauggcacugcaguguagauccuugugcuaaccccugagcagcaccuucucugguaccagccgucuguuccuagcaguuugcucuucucagugucuuuuuuuuaaauuaauuuuuauaguauaaaauauauuuugaucguguuuauccucccucccuaacuguuccccauuucccuucccacccaacuuuauguucucuuucccucuaguacaaaaacaaaugccaaagaacuccacaaaaccacaaagcuagcugggagguaguggcacucgccuuuaaugccagcagucaggagacagagucaggcaggcacaagucuguaaauuugaggccagccugaccuacagagugacuuccaagacagccauggcugcacagaaaaaccuugcuccaccuccagcccccaaagauuauagacaaaauaagauaaaaaaaaaaaucuaugaaaaccaaccaugggccgggaagugguggcgcacgccuuuaaucccagcagaggcaggcggauuucugaguucgaggccagccuggucuacagagugaguuccaggacagccagggcuacacagagaaacccugucucgaaaaacaaaaaaacaaaaaccaaccccccccaaacaacaacaacaacaacaacaaaccccaaccauggaguuuguuuugugcugcccagcuacuccugggcuugggacuguccuaaaguguggauucuauacccaacaacuuuccauuggaaaagcugauuuuuccuuuguuagcaaguaacaguugcaacuucuugauuagggguggaaguccuugcccacuuuccccucucggagcugggacccugucuggcuugacccugugcaggcccagugcauacugcacaguuaugcaucaguccuccuguguccggugacaccauuucuauccccuuuggcucuuacaguuucuccuccucuuccacacagcagccugagcauugaguugggggugggguaggggcugacaagauaucccaauaggacugagugcuuggcguguccagcuuggucuugaugugaaugcagagauggagggaagucgucuguaauuuacauuccuuuucuggucauuguugaguuucaagugucacaccauucucugccgugucgugucucuucucuaacaaguccccugacagaacaauuuaaagaaaagaagaguuuacuuugggacccacuuccacaggguuuaguccacaguugcuuggccugugcacuugggcuguggugaagggugucuucaauuucuuauggauaaaacaacagaaagaagcuacgggaagaggaccggacaaggacaagagcaagacacaaccccugaggacauaccuccagugaccuagguccucaaaugucccaccuccugccuuucaccugcugcagauaacaccaucauagagggagucugucaaagguucuaaaaagugauaggucagagcccuagugacccagugcucccuagauccaccaucacagacaaccucagaugugugcuuuaccuacugcagcugcgucuuagucccagcagggaagaggaugacaguugacccacauguccuuuucuacuuuucauguuguccuccaugagaacaagcauaggagagcucacaggccauugcacuuccaccucaagcaguucagacuucaucuuuccagccucgaagugguaccaaagcuguccagcccugaugcugcugucugcugggaggagaaccaucaggccugacuugguuccuguuggcaagguaacaaagcccccaauacacccaagaaaguaagaacgggugugaauccugggugagcguuuuagggucaggucaaugguuugguuggcuugccaaugagcucaugguuuuucugaacaauaagcaguggguuagcaaaggccucaguggguaaggcuccugccacaagccuacugaguuggguccucagaaaccagaugauagaagaagagaauaacuccuguacaugauccugugagguuccauaguguauaaacacacacacacacacauuugugcaugcacacaaauagguauguaaacagauaaauguacuuuuuaaaaagaacauagauaauauugucuuugugagcuguauuaugcuuccuugugaugacuucucccccucccacccccucuuuucagcuucugucuuccugccgcaucccccacaaauccgguuccaggauggagccaccacaccugggugaucaccugacuuucuaagcaugacucucauuagacaugaaugccugggauguuguauaucugguugcuauggaaauaaaagagggaggguguuuccuauaagguuuuggauuacacauaauguuuauauuguauauacagugauccuguguguguguguguguguguguguguguguguguguauagaggugagaggagagaagacagaggaagagagcacgagaauaucuugguucacaugaaaugcucauguuauauaggauuagacuuuguugucuuugugaacuugaccuccuucggcccccagcucuuuuacgucuuauuauguuuccuuuuuugucuucuuuucuucucuguccuuuuuugcuaaguuauacauugucccaggcaugcuagagaaugcacaagaucuuauaaauccuaggacacuggcuggagaaugccuagcacagcacccacccugugagguaggcucugcuuccuguucugcuuggccccaccccuaugaugucacuggucugaaaguuauauuuauguaguuuaccuauaugugcuuguuucucagaacuucauccacagcugcauuuggccagucucugugugcuacccgcuguccacugugacacuggccucugugacugucauaugguuugauggcauccuucuuuguuccccuguuagagacauuuggaccagccccagguuucucuaggcuccacaguugugaugacucuggcauguggcucuagcacacagugaaacaguuucucuccucuguguacucaggcagagucguuggccugaaguggcucugugguaccacacuuugugaaaacagcuaaagccgacgagacccuauuaacgauucauuccuaaaguuacccuacaauggaugcuugcuagccuacuguguggcaagaaagaucucacugugaucugcauggggaugugguaccucagcgugcucuugcuagcauuucuccaaugguggaggcggaaaccucuuuccacauugccagcaggucagcacucugccucugugagaugccuguucauacccaggcuggccucagacuagccauggagcugaggagcuccuugaacuugggauccuccugccuuuacaugccgaguccugggaucacgugcacaccuggacuugaugggagccagagauggaguccacagcgucauggaugcuagcaggcacucugcugacguaguuauguccccagcccguauucauacauaccccucugcccauauucuaaugacuuguccuuucuuauucauuuguagaacuguuuuauauauucuggauuuuaauucauugucagugaucccuaguaagggauccacuuugucauuuucuugaugguaacuuagguggguaagauuuccuaguuuuaauauaguuacauauaauuggcuuuggguuuuuuuccuuuaaaacuugcacauucugugcuuuacuuccaagagcccuucccuuuccuccauaaaagugcugcuuuauauucucuuguagaaauaucaauuuuccucuuccuauucaaguacguacaccauuuggaauuaauuuucgucugugguauggaguggaaauccaauucuugacugugagcaguuuugauuuccuguggcuccuugcuuguucuuucucucaucauuaacucuuguuuauuuacauacuucauaaacacucauuuccuauuuuauguugguaucuguaaguaucuagaaccuuuccuuccagcacgggcuccaaccugccugucauauucuuacaccucucacacaugacagccugguccuuuucggucugagaccggacugaacucgucugaauugagucucaccauuggacuccuccucaggaagacuuuggcuagagaugcuuucuucauguccauuaggggcacugggcaccugcagccacucaggcagcacucagccaugucgucugcuuuucugguauuaugaggggagguccacacccugugccuggaugcucuaacugcagcugucacaugucauggucacccugugcucauuugguucccucuccucgucccuccuggguuguuucuguuugcuagagaggccagcaugaauuuagaaauugucauuuguucaauaucuaguauauuagaaccccuuaauccaguuuucucaaaaagaaauggguugauacauuuuugccuaaagcuaucauaaguuaaauauagacaaaaucuugaagauugagaaaaguaauuuucaaaucaauuccuagguagguucaggucaguuucugcaaaugcaugggcagguggaugccaucaccuggggccuggggucccauuggucaaaucuuggggccucugcugcaacccaggcuucauuugcacagcuucccacaguggccuaucagagccaacugccuuuaggaacaaacuccccugccacacaucuggccucagaagcacucuacagcuguggaggaagagucuaccaccacuuuccucaugcauucuucaugguucuaaagccagaaccauugagcaacauugccacguucagcugccaguuugggauaugaacccugcauccuuugaaccacauuuguggcagcuuuuguaugcucuugcuuuguaggaacagaacagccuuaggcuuuccguucauaagcugggugcuuagcugggugggauauuauccugaggacacccuuccuuucuucugcuaagaaucaggucucuccuuaauggggcuaaucuccuuaccaauugcagccucucuuccagcacaagccuugccuggagcaugaagcuugucuguguucuuuuucucuccaaacugugcauccuguuuuucugcucccgcuugcucuuuuucucuguagaccugcaugggagugauuguuuguaaccaagagacagggucaauauuaggcugucuugaaaucuccucugccaaguuuaucuuuaggcagauacuuaggaaaaggguggaaaacagccacauucuuugccaaaauaucaugggaaugcucuguagcccagaucuauaauguggcaaggggguaccugguggguccauagguauccccaagguaucccccugagcaaucacaccauacaacagaucugguguaagggaguuucucugggcgaggggaugaggauauggagaagggguagaggcagagaguagaccugggucuuaguuucccuucauagggacaauggccugguuggcuagggcuuucuaggagcauaguagaaaagaaccaugcuguguauauagaagucaagucucacugugaccucugggugcuugcuguguggcuagugcaagcuagaggucagauuucccauuguauuaccuugucauuaccuugaauuugaggagccauguguagguaauaguagcuguguugggaaggguaacccccuggauuugggguguaucagaugguauuucauuauccucaguugauucaaauucugaccuccggguuuaugugccauuuguucucaucagaucgguucugagcaccuagaagcccuuucugugcuaucacaggauccccgcuuucccucugcuaccuaacuaggaaccguacuccagggcagcccauagggagaugaauuuuccccaacaggacaccagcaacaugguacaggccgaaggagaacaggaaaaaaaaagaguauugaugauauuuuguguuacaaauauguaaaaauaaaaugaagauguucuagauucugggcaugcgcugcuauuugguuuuuggcgccccuugacugaauuuuuguuuuguuuuugugaaaauaauuuuaauguuaugaucaugguuuucuuugucaguuuguaagugaaauugguuucuaugagguaggaggaaggugauuucaaguccagaacccaggauucucuugaguguaggcaggauuaauacagcacuggaugcugccauugacaaagucuuuucuuugagucuuaaaauaucugcuuuguaaaacuggguuaaguuauuuuagaacuauaaaugguugcuugguaauuagguguuugguuuuauuuguuaaauagagugcuuauuaaaguucagugcuucccccccaccccuuuucccauggagcugaagcuuuuacuggcugagugguaagagacagccugcguguuucaucuaccggcuuugacaugugugguugauagaugcgcuccugaacuuuuacauuugugccugcuguagagaaacagagcucucaucucucuugauaggccccacuccaaaauucugcucccacuuauauaaucaggcuuccuccgugucacacaggcacucagaggaacaacgaugcgggcacgcucucccugucagacgcauauggaauuuggcccguggugggcuuaucucuucccaccagcuucuuucuuuacacaucuaaaaugacaccggcauguaaguuccugcagaaauagcccugcguugggucagcagcagaagaugccaggccauucccagagcaccccgaggccagagcucuguguccucgacaguguccagugggcugaggaugauggcucucggcugagaagauugauguggccaugggcucucgugcccuccccugugggcugggagugagcacugcagcccuccccguguguaguugucuucagaggagcacagcagugaguaacuucgcauauuugcuguuucggaucugcuuuuuaauuugcccucaaucuuuuuaaaaauuaauuaauuauuuuuuuauguauucacuuuacauccugcuacugccccccuccugcucacccccuccugcaauccuucccccaucccccuucuccuucuccucugagccagggguggggggggggcgucccccuggguauccccucauccuggcacaucaagucucugcuggucuaggcucauccucucccacugagaccaaacaaggcaacccagcuagaagaacauaucucacguugcccucauucuaaaaauuaaacagaauagagucugagaccaagcaccacuacacccugaaagcuacuucaggagcauuuaaggaagucccaacacuaggaauguuuuuguuauaagcccauguccuugcggucugccucuccaaagcugauuggccuccugccuccaugcccugcacucucuguuugccuuuuccauaggauccaauaaaaauaaguacauuuuaaaauuuaugaaaguuuaaugaauggccagcaagaggaggacuacuuucauaacaagauuaauaccuagacuccagggacauaacauuuuaguaaaaucagaauuuguguagcuauccucgcagagcuugcaaccucuggcuuccuuauaaaaaugucuaaauaaaauacuggcggcugucucugcucaggaauucccaucugcuauacaugccccgacccggaaccugucaggguuggcacagcugggacagaaucuccucaaguucugucccuaagcuuguccagagggacacuaucugaugaagcuggagggacaagccaggccuggccuagguguuucugggaaaauccagagagaaacuauagguaacacugagagcucuucuaaauauauguaagcuuuaccuuuuucucuuaauuauuaaacuguaaaaggggucuugcuguauauuuuuuucuccuuaauuuuuuuuucucgugagaagccuuuuggggugggugcuguggagcagauaaugggauugguuucugaagguaaugggagcugcguuucuugaucuaauuuauaaugagaucuaaagcugcuggccagcugacacuaaucuuaauuuaugaucuguuuaaccuuuuuauuucccagccacagcccacacccccgucucuacacaacccguuucagaagcaauaugcagggugacguuucugcgucccacggccuccauggcccuuucugcaaguugauucccuagcuccauccuccaugagacgagacgugcuggauugguccacagugaggggagcagaguagccugcauuuucuuuaucuguugcccguuccccuuccugcuucuacacagccagucuugggggucagagcagaugcagcauguauggaugacaauggauucuuuuucauuuuucuguucucacuuucuuucuucuuucuuuuuuaucucaagauaguuuggggcuuucaggcagauugugccugaggugcagaaagucuuuacuuuagauuccuagucauuuccucucaguauuagcacaguagguggccugaacaguaacugcuauggugacuguuuuguuuucucaccuaugacaauuuccccuccuuucccagaguccuggcaucggaaggcggggccauuggaaagaugaugaggguauggaaggaugaugauuagaaaagaggguagagggccaguggagugaguagugcuaauaaaguggacucaggcgagaugguuacucccugaauugugugaggacuuugugaguaugugccagccacaagccaggaugugaguuuuugccagacauccccucuccaagugugcucuuggacuuugagugacuuucuguuguuuaucaaccaucugugucugagguauaugucuuagccugcugaaggagcugagacgccuggcauguacagguuccccuuuucccucaacccagaccaucggaagagcucuaguggguuguugcuuuuggcucaacugucacuaagguuacuaguguauccugaucagacagaguuugcagcuuggguguagacgugcagcuuucuuacaguacacucugggaugccccucaccaaaugcaugugucuaucauaugcuuacugcuacuggucaccuugaaaccuuaggugagcagaaaccuuacaugcuucuuugcuuuaaaaauguguguuagguuagguagugaugggagaaagaggucagucuccaugaguuaaaagccaacuuguucuacauaguaaguuucagaguacccagggguacaugagacccugucucaaagacaaaccaaaccaaaacaacaaaauucucaaaucagacuuucucauauaugugagagugugccuguguauguauguguuugugugcguuguauaugcauguguguguacaugugcuugcagauacaucugccuguguauguacaugaggucaguaguuuauaucaggaguuguuguuguugucgucgucaucaucaucaucguugucauagucguccuccucuuccuccuccucuucuuuuuuaaagauuucuuuaaaauacaaucccaugugguugcugggauuggaacucaggaccuuuggaagagcagucagugcucuuaaccacugagccaucucuccaacccccagucuucuaucccucucuacauuaugaugaugaugauaaugacgacagugucucuugaugaaccuggaauuuacuguucuaccuagacugauucaccgggaaggccuuggaaucugccugucucuguccaguuucaagcaaccauaccucgcucuuacagagguguuggggauccaaacccagguccuuaggcuugucuagcaagcacuuuaccacacugacgcauagcugaagcucucuaacuacuuuuccucuuccauuauuaagucauuguucccccuugcuucuuaauuagugucuuuuggggagacauuuugagaccaucuuaguuucccccaggaguucacccaguuaacuuggccaccaugacaccuccuuccugcagcaguuacugcuauaagaauugcuucuauuucuuccucucgcucuucgguuccucauuggagauguucuaaagggaagccacacugucgucuucuacuuauuuaacaaaccauuuacccaauaugaguccuggacauuuacuuauggcagcugaccuggugccaucaauccucauauuguuacucaagugaugucuaugucucccuggggagauucuagagauuggauccuaugucuuugggauauaaccaccuuuuucuagaauuuucaucucucggguaccacugcauacucuaguuuaucuuuauuuuuuuuuuauuccugugcucgguuccuuuggguagagaacaccauuuggaagugaagacccaaaugaagaggugugcugguugcugcugacauauuugugcuccuagccuuccucagugcacagaaguuugcaugcucccugaccggugcauguacacauagcugucuguguuucugcaucugaccucugcacuccugauaaccaucacagcuucaucccagggccuccaguaguaaugcccuuccuguuugucguuccuucugcaagcgggaagccugaugcugauggccuucaguaugcuuacguggacagcagcagcuucugucaaaccgugagccaaucauugccuucugcucgcuggcgacaggacagguagccuugcagauaaagcugccuuugaaagagagcauuuccugggcucggugaguggaaaggcuucagucuccaagaagccucuguugacauuuagauuaaacuaaguagcaaacaaaauccuuuuguuguaaacuauaaaccccacggccuuucuaaguagauguaccugcuggcgagcuucucuuuccuguauccacgcaaacacacacugcgugcaaaagaugaaaacagggugaccaaaguccuguguuauuuuacuugggaaacuaaucacuacuguccauugcauucucugaguucgggcuuuucucuucaguuguuugguuucccuuuaauccccucuaaugugugccuuuucaccauccaggacucaauggauuguuuguucucuuugucagaaauggaaauauugaaaaugcauuagaugaccaugaaccucuccaaagaccugccugucccuuaguugucagaaagucugugccacuuagcauucauggcgaggcauuuucauaugugguguggcugggucaguguguagcagguggaagcuuucccugcauaaugggccucucugaggguuuaccuuggcuaaguuugcuggcugcagaggacuaacacacaguuccuaccacucaucacccgcuggauagugcgcaucacugggaacacucaugaaaugacuagaucucgcuucuggaaacaguugaaaaauaauuuggaguuaauuguccugaaaauucacuuauuguauauuaauagguuagguauucccuaauucauucuuucugaagcauggcuucauuuuucuugcccucuuuuuuggcacaaaccuuuuaagaaugggccaauauuacaacucuugggccuggaaaaaggguaaggacuccaguuuuagcauuuuaaaaaugugaucuaucucucucucuuucucugugugugugugugugcgcgcgugcgcacucccaugggagucaugcucaugccaugccaugccauggugcauguguggaggucagaggaugguuuucagcuauugcuuccuuuccuacuuggcuccaagcuggcacuaucuuuuccagugcuacucuggcauggggcuagcuggcuuguaagcuuccaggcaguugucuuauaggaacuguggcuguuacuaauuacuuucaaagugagaacauaucuuuguaugccuuucagaacuggagggucugugcauccuggucuugggugccuuguaggcaugcccuccuagaacuucacagcguuauaagaucugugaccucuuuauuaauagagucggcgugucagcuccguuuccacagugccugcucugcuuuaucugacucuuggcauucuuuguuccccacucccuggguccuucccuuuccauugguucucguguuuucgguuagugagcagucagggcucuucugugacccacagcuagcaagugaugaggugcuguugcaaaguccuuacucacuacuccacacccacaguguucaacuggagagugacgcggagcuucccagcaccacugucaggaaggaggugcucacccgucuucucaggcugccuuugccaugugaucugauuccagucucucuccuacccuuuugucaugugaugacauggagcuuagucugccauucaaagacacacagggcacaaagggccugcucuggaaguuaauacagagcccuggcagcuuugcauuggcacuguuacugucccuucuacucagccuggaguagagugcuaaccaaaguccaggccauggugugugaugguuuggccuugggcacucaucugcuauucugugcuguguucuuggauaaguccuugaccgcucugcuuguguuccugcagagucucugaucuggaucaggugagaugugagggguccgauaaaauaguacacagaaagccuggaccaagaacaagcacgguacacaacauguccccaaccucacauggcccaguggcacacaggugccugccuauggguucagaggagacagaaaaagaaacacugguugcacaguuauuucaucuugccuuauaaaagugagucauugcaggguguaaagagugugugcccaaagcccggauugucacuccuucuuccuaagggaaucugccauugagguccuagggaaagaugggugaccgagagggccagccccuguuauauaauuaaccuugagggaaacacacauggggauucaaccauuucucuuuuuauuuuauguugucacuauguuuuaagaaaguuuugcuguguagccaugucugguuuggaauuuacuaaauagcccaagcugaccuugaacuuaugaugaaccauacaggugagccccuaaccuuuuccccuuuacucuuguuuccuaaauggaauucauuauuuuucuagcaauaccuuuagggugaaacaauaacuagagaccuggaugucaggcuguaguuacucuggguguugugcaguggacgucagagucacagcugaguugaagaacagccagcccacagaggacagagcaugcaugccguuuagagaugccuuuuugcuuuuugugacucuccuucacauuucauuuguauuuagagcagaggugaagaaucugaauacagguauuuagaguuacaggggaaugguguuuaugugcaccggccaguuuguagucccuguauuacauucuaaccgggggagcagcuaacaguuucacccacaucaccaccccccuuuuucuuuuuucuuuuauuauccucuggcuucuguuuuucagguguauagcuauuuuaguauuaugaggaaugauggaugaggcaggaaagucucuccggaagugcgugugauauucugcaaugcacuugggggucagccgcucuugacugauggaugcuuuaucugauggcccugccacuucccgagauaaagcugccgcuuuaucagaggugccagcagcugugauuuagaauuuauaaaccuccaucuccaaauaauuguucugauuacuuucuguccgggcaauaaaaugauaaagguaauugcacacaaaugugagauagcaccaaaauacaauaaaauuaaccugaauuagugugccuucuggaugagaaguaucuaugaaaugcgguguagcaauaagagagagugauauuauggcuggaaggugaguuagcgccuuaauguaauauucuuugaaauauaaaaaggggcuuucugcagagggugagugugcuuuggaaauuaaguugaagugauucuuauaauuggcagcagugaugcauuuugaggguuuugaggauuuuaauaccuuuuauuguguugugucugguugcgcuaccuuucauuuagaagcucuaggcuucagucuuccuaauacaaaaaaauagaagcaguuguggaauugggauggauaagugggcuugggcgucucauuuucuucagcaguguuccuggucugaauguaauggaccuuccuacccccagccccaacccucccuuuuuuugaaauuaacuuacuuagacaucaaaggcuaacauuauaguuaauaaaacaaaguuuuaaggaagacuuuuggaaauguguuuuguuuucugucucaggauguaagcuagagaauugcuuguuguagacagauggcuuucggugguauaacccacuauuccuuuuuaauuauuuuguauuguuuauuuaaaaauauuuuaguuuuuuuuuucuuuugaggcaaggucuuacuauguggcucuggcuggcucugagcuugcuauauagaauagaauggucucaagcucacagagaucaccuaccugugccuuccaagugcuggaauuaagggcaucugacacaguguccagccugaagaauauuuuuauuaacucuguuaauuuaaugcaaugcauuuugaucccuucugucuucaguucccuuccuucacucuucugagauuugcccaucucccugucccccgacuucgaguccucuuuuuuucuuaauuuaauaauucauucacuccagugugcaauacacauuuuuuauaaugcuguguuuuaugaccuucacuucacaccccugacaaugaaauccaugugcugcuuagugagaaacguaaaagaaggaaacgagagugguuacagcgaucgcauagcuggagagcucggccagcaguucccguaagcuuggguauuugaacacuugguccucaguugguugcucuguuuagggagccuuaggaggugcuguauaucacuagggucaggguuugagauuaaaagccucuagccaucuccagugugcacucugcauucugugccugaaaaaugugagcucucagcucucugugccuguuaucaugccugccacuugugcuaugccucgcaccaugauggacccuuagcccacuggagccagaagccagaauaaccuuuuucuuguuuaaguuacccuagucaugcuguuuuuuuuuuuuuuuuuuuuaucauaguaacgggacaguaacuaacccacagauauggcuucuuucuuggaaaaccuugugaaucaaagcaaugaagccaagcaaaccaagccuggcuguguuguuagguggagcuacgcuugggguucugguugacuggagaguggaauguguugcaggcauuaaaaaguaacaaggcaugugccaucgcaguuuaguggugguucacacccuugaucccagcacucagggggcagagacagguggaucucugugaguuggaggccagcuuggucuacauagugaguuccaggccagccuggucuacauagugaguuccaggucagccuggucugcauagugaguuccaagacagccaggucugcauagugagaccuuguauuaaaaaaaaagaaaaaaacaaaacaaaauaagcaaacagaaagcagcagcagcagcaacaacaaaauaacaagaaacucaaggugaccgucuagauacagacucucccauauuucagaacaugcucuuaucagucacaugucaguagcucacagucuuuagaaccgagucccccaugcugaggucucuggagcugccacgccagccaugcugaggucaggucagcguuugcucucucugugcuccugugaugagcuggcagccauuguggcugcccacagaggggcccagaggucaaccgaaagcugccugagcuggguucccugcguucuaagccagcacacuaccucugagcucgccuccagcccugcuucuuuagaguuuguucaguguuacucuuugucuguaacugaugaacucaaacaccaggucucugggucugcgcuguucauguucacuuguucuugcucaugguaucuugcuuccugaguguuucugguucauugauuauacuggacauuguauuuggauaaccauucauuuuuuauaagaacagcaagaaaugugacugucccaagcuagcugcuuguuucagugugucucugagcacccaacccuguuggguuucaugaaacacucagaaggcuuagcgaaauccacccaccucauuguugggccuucguuccugaugucuccguuggcagagucucuucaggagacuaaugguucccagaugggcuggguuuguucucacuggggaugguuuagcucuacuguuugagggauugcuuuugacauucgguggguugaggccaggaugccaguaaacaccagcuaugcauaagacaacuucccucaccccucagcuugagcagaaaaaucaucugggcccagaugucagcaagcuacaauugagaccauuuguuccguacauguucaaggcccauugucccccugccccauucccaccucugucuccuugccuguccugccuuaucagcugugucucacccucuagggagggauuuuucugggaccaucuuugagucauccuccuucugccccuuguuccccagcaaaggagguuugcagucuuguggcuuuucugaaaguucugccucucaacccuuucucgcuacucaggucaggguuaauaaucauccacggcgucucagagcucccguggcuugcugaaguugcacauggcccuuugcucucuugauuggcccucuggcugcuuuagacuugcugccaggcccuagccagccccgccuguugcucuugcucugucuccgugaguccuugcagaagaacuguguggucccugguuugcuuugugcucuuacuuuucucuuauccacccucucuuaaacucgaaucacuguugaacuacugcccccccccccgcacccccaucguuguuggucuuugaauugggauaucuaguuuucccgggugaucuucuugaaacagauuucuugagcaauucaguaguagguaagaugguaacuaccaaagucauuccagcaugugccaugggcauccucccauaagguccugaguaggguuccauucuccuuucugcuauucaguggccguguaaccuugguucugcuguuuggaauccccaagccucuauacucucucuaaaauaugcauucuaaauauggugguccuuggugguuuacaggggagaacuaggugaaacuaugagggcuaggcaagccaacccgggaagauacuugaggggaaaagauggaaaaagccagggaggacaugggauugggguggggguggggggagggaggacauggggagggggaagagcuuguguggagauggggggaagggccagugaggacaggugagcugggucuugguuagcauagagcuaugaauaugguuaucaggaagacagccauauuuguucucauccauuacuacgcaguuuaauuucuuucaggcagaugauaucguaauugguuuuguuuuccauccugcuaguguugauuuaaauuuuuccucuccagucagugugaagucaggcaucaugccuguggaugaagguaacuagaaacuucgggucuuguuuuguggcugggccacaguguuuuuagucagguucugggccgcauggaauauagcuaucccagaccacucugaaguugguuacugagccugaggccaggaucagagagagagggugugggguugggggagagagaaagaaagaaagggaagggaaagaagaaaagaaagaccuuguuuuguugucugaaguaggaggggaggguccuguugagccgaggaugugggcauacacaugaaacuuucuaguuuuucaguaacaggaaagucuuguguucugguaccaggggaagagaguccugugagugggccuagaauggggauuuaugaccugagcuguuggaagcaggcucgcagagccucuggugagugggccaaaaugacaaaugguuucugugcagcuuuuuacuguccagccucacacuggacuuccuacgcacggcuguguuugccaguguuuugauuguauuaguucccugcgagauggagaaaccuuucagcccccaauaaauguggaucugcuuucaauacguuuuaucugucaaaugugaggaaccaggaaacaagucuaaagcuccucuuuauauucuuacuacuguguuucaggguuugaauugagaugaaacauuuacuagaucgcuagauuuggggugggauauuaaguccuuugcaggguuggagugccuucuagaacuauuuguuuucuaggagucuucucucacuuagauggccuucuccuaggugggaugucuaguuuuuauucugauccugucugcaccagagcuguaggugguaauagauucuccuggcaaaaugccacaggguugggucccagauuuucagugaagaaggugugacguuaguauagacugucaaguagacaggaucuagaacuaucugggagacacacugcuggguaugugugugagagagauuuuuccagacuagauugauuaagguggcagccuauguauguguggcaucuuccuuauggggugaagucccggacugaauaaagagaggugaguguccugucugugaauacaauaugaccuggugugccaaguuccugccaacguauuucccuaccaugacugacuaugcuaccuucaaacugugagccaaaauaaacacgcccuuccuuaaguugccccuguuaaguauuuucucacagcaacggggaaauaacuaauacugaagaaucuuccaagugacucucacagccguguccucuuucagaaacggcagagcagcagcagcagcagauccgugcauuacgguaugauaguuggguuuagauaacacauuucccuuacuuagaaucacuugagcaggggaggggggaggagggggaggaaggcgcuacacuugaagaguugucuuguuugguuauugauguggaaggacucagucugccguacugggagugcuaucccuguguaggugagccugggcugugugagaaagcaagcugagcaagcaggagaauuccccucuguuucaguuccugcccugacuucccuugguugauggacuuugaccugaaaguaagccaaauaaacuuuucaugccccaaguugcuucuggucuugguguuuaucacagcagcagaagguggacuagaccuugugguagguguaggcuacuguguagugguuggguccaaggggaagugaguauaggcuggcagguggaggaggggaggggacagaacaccagaaaggacaucagugccuaucagguggccuucaggcaaaacacugcuggugggagaugaggaucagguuuggggcucucagaggggaaggucacguguaucgggaugaauggcagcagcuucccggugcguuucugucaugaagauagaaucuggagccucuguauuuacgucaacgaauaaucgccaaaauaaaaccaguugggcaauuauuuccaaagagcgggucugagagguuagagacugaggcaguugugugaaguucacuugugugaagccacgaguucuugucuggcauuuggcuuuacaaggcuucugguuuuuguuuuuuuuucuuguuguguuggaguuuuuuuuugcuuuccuguaugagauguuuauuacugcgacgcaaaagugucuggaauagauauugcuuuaagcugugggauaaaguucccucucucgaugguuuaauuuuuauugcguucccacaaugugcugccguuguucacaugacacucauggcagugucugcccccagagacugugcucaaaauugcaucugcccgcauuccugcacacagcgcaccucagcacgggcucucccucgcuccauuggccucucuuuuuguuuuccuggcacauuaaugucgccuuguccuccuguagugugucuuuugauguuuucuuuuaaucaaaggagaaagcagggcaccaucaugguagcuagcucuuuuaguuccagguugguuaggguggagccagucuuccacugaaauccugcagagugaugucagcguauccucuuucccucccacucugcacaacacacaucucaaggaccuggugugugaggagaugcacgguguggcagggaaucuccuucugagccuccuuccuuugccuacacccaggagcaggugcagguugugcuggcuuugggucugugggugcauggaggaaguguacccacugagcugaggcggugucauguggcagggcuguguccuggcacagaacaccugugagauggugcaugcaaaugcccuucagagcucuguggcuuaugaaaagcacaggcuggugggcaguucuuagggaaacuucuagaugugguugggugaaaauggguggaauagugagauuuugggaguauggcugacagaacugaaagaaguucguccaacaaguauccauuccuaacaguucuguccacgucagcuggaggcaagagcacccacuccuccuugguagcuaacccaagugugccgugucuauaagagggaauggucuucugccuuaauuauuaggaucagacauuacggcaugggccaaccugggagauauucugcucacugaaaaagccagacaugaaaggcauguguuugcuaugauuccuauuacacgaggcucccagggcaugcaaaguuagagaguuggaauggugauucccagggcuagggguucccgguugugugaaggaaauauggcaucuuuuggagaugaugaacaaguuugggacauggacagaggugaugaccauaugugcugaguuuauuuaauacuccuaaauuaguguauguacaaaauguuuaacaugguguguguguguuuguguguguguuuguguguguauguguauguaugugugugcauaugcugauuuuuaucaucauaaaauuuguauuuccuauuucaaagcugcagacaugucuaggaaguuguaucuaauggacaugaugguuagcaccaguuaccauggaacucucuuggacaggguagguggaugaaccccaacuucaucacuggagugggugcucugugagggcauagucccuccuccaguagaguacaguuggaggugguggucugugagggcaggaguucccuguggagugugggcucugugagggcagguaucuccuggaagacacugggacucugugaggucaggguccccuacagggcacuggggacagaaccuucagucgcuauuucucuguggagacaauggggguuggaaagucuccaccuuguaaagucauccucaaaugacuguaagugccagccugcuaaauauccaucacguggacuuuuguuguucucuucccccagauaagguggaaagcuuguucugccuucccugugccuuuguguccugcugcagcugaugugccagaucccccugaacaguugugggggaaagcaguguaguggucuaaagaagcaggcagcugcaaacucuucuaccacugaaguuuggauucuucucguucaaguuaucuuuagaauuagcacuacaagccugugagguuuucuauugaugaaucuugucugaagaauggauuucuaucuuuguaaagauagagauauuguuggauuuugccauaaugccucaaaguuguacauuuuuguuaguuuuuuaaaaauauacuauugaggguuccuucaugguagcgaggauagguuagugugagggagagauaauugcauuacucaauuaugugaaucaagccaggguagagcuuacagauaauuuuauaauaaucccuauuuccaagaaaaaauauuugcacaauacuuuagucauugugucauuugccaauaaaucaguuacagguuggucucuguuuuuauuacugcggagaucucuguucggauguggguuuuauguaaaccuuucccauauaaauagcaaauagcucaaaucaaauaacuuuagauaagauagugauuuuucuacaguaaacauuuuuuuuuccacuuaaagcccuaaaaucccuccucaucuaaucugauagcuccauccuguuugcugacagcgugucugucagucugagugucagagucucccuggguucaaauguugaaagugagcagcuaaggugacagauuugaugugggggucuuugggaggugaugggucacaaacuguugcccucaggaaugggguuagugcacagaugaaugugucccuaaagaagaucuccuuuuuacaugugagggcacggugagaaagggcaagauuggaaaaugggccugcgauuguccccaaguuugcagaucuuugauccugggcuugauccuggccugccucccuccagaagccagagaaggagccuaguagauuaagagccucuuuccuugggauuuuuuuuuagaggacacagacaguugguccauccuacucaaagggagcuagaugcacaaacucuccugggucuggucagcucucgacucuggcuuguacuuaagccaucuaacaaagccugagaaaggacugggaucuguuccucucugucuuuugacuuccugucauggccgagggacaaaaaggacaguucaggacaggauugcagaggggauucaggaagauaggcugcauagcauccaguagcagacucguuggccgaacugcccgugacauccucuuugggaacacaugugcaggacaggugugugguucaaagcuguuccuucccuaggugcuaaagccccugucaugacugugaccacucugggcucccuaacacuuauaauuuagaauagagagguacuguauugcagauuccauuuuuacugcucuaaguaggagggaguuuacagcuggcuguagauccgugcuucuuccucuaggucaagcuucuagaucuccuggacauggauccuguguaacaccuuguguagaggaguccugaagcuggcucacuuaugggaaaaucaguugagucugagauuugugcccauccccuagauagaauaugcacauccuugcagcaacagcaggcugcagaugcugggugugguuaagacugcuguucuuuuugcugggcugugguggugcaugucuuuaauuccagugcucaagagacagaggcaggcagauuucugugaguuugaggcuagucugaucuacagagugaguucuaggacagucagggcuacucugugugaaagcaacucugucuugaaaaaccaaaacacaagauugugacucuuuaaacauggccaccaggagcuguccagugaguggugugagcacacggggucaaaguacagagugcacgggugggcccgugccuggcagaucaccccacagcaacagacacuagacugcuaggucgacuuccaaguccagaggacuguaauucccuauaggcauuugagugucuguacuucuucuuagagauccguaauaaggaaaaugagcaggauggggauggggauggggaaaagacccagucucaaaugugcugucuaugcaguaugaucacugacuuugaacccaaggcauguuuauaucaccagugcuguggaggugagacagcugcaucucugaggauugcugggcagccaaccuagcauggaaaauuccaguccagcaacagcccuuguuucaaaaaccaagauggauggcuccugaagaaggccacccgagguuuagcuauggcuuucaugugcccccugccaccccaccuacgagccccaccuccauaccuccuaugcgcuguuggcucucucgaacagagagccagaauaaacuucucuuaaguugcuucugagaaaaguaacuacuauagcauucagcuucuauugcauuaauuuuaaucaaaaguucggugcauagaaagaguccagcauccuuuccccauuucacauccuuacagugagaaugaagauguaaccugagugguccgucaucguuuuguuuuggaagcucacccagaagcucacuggucaucugagaugucacuaacacuucaugcacucagcaaaaacgaaacaagccaccagagacacacggggaccuuugagaguuuaaaaacauucaaauugaguaucaguuggugaauguuggcauuagaaauauagacaggcuuccccaagagggaauggcugauggagauaaaggaggaucuguuaaauaagugcucagaucugaggcuaugcauacuccagaugugagcaucaggaagggaacaccauuguguggcugcaggagggaggggcccucuucgcugaguucauaggcagugucaccuagggaguuuuggggugacucauaugggagcucagcugggaugugucucugcugcacucugggaggcuguuagauacugagaggcagacuucaaacuuagcgugcauuuucuauacugguugguauuacuucauuggcaagauggcucccuuagcuuuuguccaaaaaugcagaaugugugucauuugucauuacaagccugggugugccuaagcauccugaagagccgguuuccugccuucuauagucucuccagaguuugcuugguuguguccucucugggguguccacucuuugucuugcuauuuguuccugaccugucaccuuaccguuggugcuuaccugugcccauuuggcugcuuucggaauuguucuaucucaguuuacccuucccauggcucaagcugaccuuugaugagaccauguguaauuaauuacuuucugaugauugguuaguccacgaggagggcuuccggaugccuuuucauucuccccucuuugguccauacaguaucccuguuacaugaggacacgcauuacauaugcucaaggugauccgagaggccauucugagcuccaaaucugaggccuggcuuagucuuguuucuguccauguccagcugucuacuguuacucuagauaaaugcauuuuguauacagcugaggucugcccauugaaugaagucuuccuuugaguuuuccagccuucaaacaggauggauuaugucuuugucaccuguagagagaaugagacccugagacagcuguagcugagguguggcucuggaacacuuauuuauugccugugguuuggggagauaucuaaccucuuugugaucuuagaaggacacucuugauggcuguggguagguuugugacaggccacacugggugccccugugaguguaaggaaugugugaguugcaugugaucaugagcccaguguccaugaucuggguccguauucugugaugguggaaacccaauauauuuuuuguccugugauguguaccuuuuuucccugacacacuuucccccagauacauucuauuuuaugcaagaaaucugaaaauacuuuguaaauuuuaaaauguuagaugcacauggaaaaaugcugaggguuuuauauguaucucuuuguauauagauguguuuacauggcggugacucauacuuuggugaggguuaguuaacacucugugcacagguuucucagccguaagaaggaccaugguguuucuuucuguccaccaaggauugucuagagucccucgccagaggccuguugacugacgggucacuucaggaacccaagaacccaugcuaugaugucauuuuucuguaaacccugaacuauaauaaauugcauuuaacgguuguaauuaagauuuuagacugugaagcugucggagagaggaaggaccugucucuuucucuagagaagaaauuaauuguuagaguguauggucuuugaagaauuuacuguaagauaaaagacugggguuuuauucuugcauuuaugaguguuuaaucaaacagaaagugcacuuucaguguggaaaucuuggcuucgguggcaggcuuagacugaauuauuguuuaaagagcaaaagguauggaauuauauguucaaguuaucaaaccacugauaggcucuggguauaauguaacuaauuuagaacauaaaaucccuggcugugugacuggagccuuggguuaaucgcuuggcagugaguguguuucugaagcaggguggacuuagggcagggugguggcugucccucaaagagugagguugggccugucaaggccuaguauggucauagccacugagcaugucuagaaaucagucucuuccauuuaggaucccaggucauaaauuauugcaggcucuacccccaguauccucugcucuagagccauugagaacuuaguuuuuaagggcaaggggacguaauucuaauucuccuggcucauguacuggggacgagggugacaugcaguggcuuugcaucagggaacaucagaucuucccaccaggaauggaggaaguuggggagggcuagugauuuuguugaugguuagcauggaauucacccaccauuagugggagggagagaaggauaggaacugccucacggggagacaguuuugagaacuggggucugaauauaagagaagccugccacugggcccugugaccugagugguaguugguuuugguggguuggagagagagaggagcuagcuaguggcuugggcugcucagacacaggcaggcccugugugcuggacugaggucauuggacucaauaccaauggggccauuuauccuggauauuccuagguugugugggagagguccuugccuagagucuagggaaggcauggcuaagugguacaagaaucaucuaaacacaguggaagagggcagggcccuugagguauggcuccagacaguauaccaaguuuggucagcccuucauggcuuucaaguacuuacugguuuuauagaaucuaggaguccuggguagugggcaucuagcagaagcugccaaaggaagaagaagguugccaagugacuuauaguaccccccauaucaagcagcagaaaguaucugcaagucucccccaagguguguuccuauacacgcagguaucugccaucuuggcauauugcuggagauugaccagugaaggcugugguggauaccugcuaugaaaacgguuccugggagccuaugccaaugggcuugguuauugagcaugagccaugcauuguaguggguccccaguucuaguugacucgaguggugagugaccugacucagagccccauguuguucauagaacccuacgugcacacauagaggcagccaggcaggucauaauaugugacugcauccacaagggcucuccuggacauggcugguuuuaaccagccuugcuguugaccagcauguguccuccaugccacagcucauucacgauuccccagugaugaggaggcagaggcucuucccccugugugggacaggacuccccagcuuucauaucuuccuaauugggaaaggucaugucuccuucagaccucacucgucccccuccccucugugucuccuaagcagucauuagcuuccuggcuggcaaagcucugcaggaugggaacugugugcugugacacauuugagcugaagcuuuccgagucauggcaacuguaagagcugacacuucacguugagcgcaagccugccaccccuuuuccuccugacagccugucacacguagcucuaucguuagugggaccugaagugcuagaaguuuuccagcccacaaggaaugugcuguuggcagcaagagaugugcggccacacgggggugacccugggugcaacacuaucccagcagaccaaccagucagggaaccuccuguccuucccacgagaggcuucauguuaucguggggggugagcauagcaggcucuaggaggaguaauuuaaaaugaaggaaaccuagguugguuuuuuuuuauuuuuuuuuuuuuuauuuuuuuuucauuuucacagcaaacugaaaaugagccauucuugaucagagcggaaauucagaguguugagaugagaugcaggaaugcuuugggacuugggugucuugggcuuugugcaagcuguuccuuaguuccucuguggaucuucaugcuuguccuggccgggugccuggggaggcgaggcuucucaggucuccgacgguuuggaugccuucuccuguggcgucugauucuaucccgaguugucaggcgguggauuucuuccuucugauuuguucuuuuacuccaggaaaaggaacauuucguuguaaagcacugcagcccugcuggcuugggaggaccaugagaggaggaguugaggaggacuugcugagcaggauuccagauagcacccugaaaccaggagugucuaggcucugcggugcugagggcuacgguuaggguggagugucuucggcaggacuccuuaccacccucagacccgccugcgcguuggagagaguagaaacagccaucucuucgugcccaggugucuuccaggaccugcuaggugaggagacguacaggcgggcguccugcugaagcuggcacacccuuugagccuggagcguagcaaggacggaucagcgggaguuuuaaaagcuaaaaugugguugucagucagucauccuuccaggucuguuguagggaagccuagcaucaucaagguucaaaacagagauuuccagauccuuuuucuuucuugaggucuaaugucuuugaggaacccagucccauagccuugcuggcugguggcuucagagcccagaguacuggcaggaggggcaccuggcuggcuuaggacaugacaucugggggugcuguagaauguccugguagguugugccacacugccuaggccugaguccccugucacacugacccggggaggcucggggagaaggguacuggcagcuugucacucagcagccuuuagauaaggaguuccccugcugcauucugaguuucuugcuggaggucugagucucacugguuuuuguaaucuggcauccuccuugccuacguugauugggccaucagcuggcagaacagccgguccauguuuuguuuaaugauggugacugcuugcuucacugugggguuucagcuccuaguuucaggaaaucacuuuaacacacagggccugagaaaagaacuuuccccaucauuuuucuccuuguuugauuucuaguuuauuguguguuuuuuuuuuuaaguuuuaaauuggguuauagaaacagaauccuaccaguuucauuauguguuccgaguaucguuauuuuuaaguuaauucauuaauuuauuuacauuuuacaucccaaaugcuguucuccccucccacccccccaccccugcuucacagaguccuuuuccuucuccuuggauaggacaggccacccuuuacccccacccuggcacaucaagucucugcaggguuaaagucauccucuuccauugcauccagacaggacagccagaugugcuagaggccuugguccccaucauuuuugaaggugaugggcuaaucagagagaguugaccuaaggcauccagauauuaggucugaggcuaccuaaagcaagucugcuauuuuaccauuaaaaaugugauuuuccagcuauguguaguggcacacaucuugggaggcagaggcagguggaucucugugaguucaaggcgagccucuucuauacaguaaguuccaggacagccauggcuacaaaaauauucuguuuuuuuuuuuuuuaaagugauuuuuuuccccacuuuccuugugcuugguacagaaaugccucuucuacaugaguaacuaaguagaagauugagagugcuuagcccaugauccugacuuuguagucccacugugucauggggcugcuugacacauagagauuggcuucuguugacugugacaacucacaacuccccugggaggcuccuggucuggugggcacugugggugggccuuccccuuguugugguccuucugggcuuucacacuugaccagcuaaucucauucucucccagccucccagggucaguuuuaggauuggguugacaugauacaugguuuucucuuuugugggguuccccaugccucuugcugagguggacaugagaguuggggaccacugcugcuuccuuccuagucccuggcuggcugggaggccucacagggccucuguguuccccacuugcuuuggcaggcccugagaucugucccuuugcuuguccucccugucacaccaguccggcacccacuucccauccccuggcugcuggcaggccuggggacucacauggaagcacuuagggaaaggugcagugcagcagcaagacaguucuggaagggcugcugaagucaggccgagaaggaagggagcugcugccugugggucucuggcucucaguaccuuggugggaacuggccucuggcgccagcugcuuaauucagaacauuguuauuuaaacgcccuucauguuaaagggagaugaaaagaauucacuucauuuuucagaggucuccaaauagccguggaaaaucgauucuuuuucugccaccaauuaaugucagccccucuuguggcuuugguggaugccacagugaugaugucgggaauguagguacaggagccacacucuggguucugcugccaaguggaaagucauaaucccaacuggguccuggaacuggccacagggauaccccggguaggugacucaaccuagaugcugugccuaggacugacauccucggagaacugcaggguggaguacauacagguuuccuguggccucugcugucagcaaacauucaaacaagugggcuguugggggccggagaagugccucaguggcuagaagcauuugcggcucuuccaguggacucuaguucugguucuagcguccacccucguggcucacaagcaccuguuguucuagcucaaggggaccucacacauucuuuuggcuuccaugagcaccacacucaugugcacauacccagacauagacaggcuuauaaaacauugggcagguggagccaccauggcucccaggaucugaccaucaggauuguacaccucuggcugucuccaguuauuuggaccccauguguuuugguuugaugggaauauugauuauacaagcugaaugcccuugcauccagagagcagccuucaagaaggcaagcccgaguucucguguccaggauagcuuguuucaucagccaucagccugugcuuggagucagggcccugagaguuugguauuuccccugcagucugugagcuguuccaaaaguagaauuugaagaaauaggauauggacagaggagccuuuguaaacugugacaaguggcccgaggcugagaucuccuugcagcucauacccugaggcccuggaggagaccccuuucaaauucuugccuguguauguaggaagugaggugcuaugcaggaaagcuugggguacgaugcuacggcuugaguguuauuugggaagcauugguccaugccaggcugaaggggagaggaaaaggaagcaauggaugguucuagaagucugugggugacacagaaaaucacagggcacagaagcaugcgagcacaggacaucccaggcagcguggagcagcacugauggagacuuagugguagucagacaggagaagaugcaaagggggacagccuguagacugggggugcugcagugugguaugugggcuuugggggggggucagcagaccucuuguuugggggacagaggauacauuugguuggucuuggaggccacccugucucugucacgacuuaucagcaaaagaaaagcagcuguagacuguaggugaauaaaggugguugucacuauguucugacaauacacacauucgugcacgggcacggcacucauggaagucauuagcaguugacuuguucugcauacucuguaugaucccaggugaggacugugucacccacucuaaguggugcccagaugaaaagggacugugucacccacucuaaguggugcccagaugaaaugaggcuaaggagcuaaagauaccaggauccaggcuuugagaagcucaggcgcaugaggggaugaccugggagggaguucuaagagaugguuggguccuaauacauuccgugauaacccaugcaagggaacgucuucuggaaggaugaugucuaggcaagguagguagaggucauugucggccaaaaaagcagagacagccauccugcucuaagccuguggccauaggugccguguuuguccgugguguguggggccccaggagggauucugggagucacugguggacaggaagggaaugaguguucucucuuuccuggagucagagaaggaagaggggccuaagagagugcagacauacccagugugcaucuuugcuucuagcucuuuggcauuugcaguuuccauugaaaucaacuuuacagucucuccauggcguccuucauuuccaccuucugcugacuugggugcucuguguccccccugggccagucucacccuucauuuucugugaugcauuucuuauacguccccacgccuugaaacaaaaucugucaugaagaugcaacuagaccuggcacaggcucuacaagcggcccgcgccccgcccccuccugcuacgucuuagccucguacuucacuuuuaaauguacuugauuuaaaauauggaacggcuugucuggcagucaucuuauucuagcaaagcuugcugacgucuagguaguuuaaagagauuuuauauuugcucagccucuucuuagucggcuuuaguuaaggacagcagggggaaauggaggcauuguaauuuuagggggcaaaagagaagggggcacugguugagcgagccagguuacgguggaaaguggcgguauuguaaaaguaccuuaagauuaaaucccaguaggagggaagcuuugguauccggugugcuaaguaaguaaccguugcuucuagugugcuuuauaaaugaccaagcgcuuccaaacacacuuucuuacucgacuuaaaaauugcuucucucuaggaacuuggcagaauggcugagaccugcaaaaugaaauacucaguguuggacagcccuuuggggaagauggagcugucuggcugugagcgaggccugcaugggauacgguugcucagugggaagaccccaaacacugaguaagugugaacaguaaacgugggcaccacacgugugguguguagugaaggcagggguuggaggagcccuggggccucuccccuggucgugaggcaaugcagagccuggugccaccagccacaaacauuagccucucagaaaaggcccgugaauugagggguucuuggcagcucauguauuacccaguaaucuggauagcucauaaccccuggggacaggacucugacgggagcuuccggacauuugauucuuguguucuuuugcagagguguugaaucccaugagcaccaagcauuugcuuuuuuauguguauguguguguaagugugucucuguugggaacaugugucuaugugggaacaugugucuaugugugcccguggaagccagggggcagccucuggugcguuccaccuugguuuuugagacagggucucucauuggcuuggagcugcucauuaggcugaguuagccagcccaccuagacaagccucagggauucgccuggcuuuaccgucucaucacugggauuacaggcagugccacagugcuagcuuuucacauggauucguguggcugaaccuagauccucaugccuauaaggcaagcguguuguugacugagccaccccccccaacauugugauucugaacacaguaaauacagagacggacaacucucaaucaugugacuuaccucugcuauuugagguuuaaaaucagcuggcagggucugucagcugguuaucccacugccagucuagcuugcuuucucugucaggcugcuucccggagugaucacagcuaagguguggaaagagucucuacagugacuucagagcacacugucugggaggacaucuauuccuccuuaugugguccuaaccguauguuucuacuuguaaaaacaaaacaaacaaaaauaaacaaaacaaauuggaagcacuccugagcgucucguucuaaaauguagugcugaacuuccucuguucgcugguugugagugguaaguauuaaaauggcaguucuuguuauuucugagaaaaguauggaaaaggaagaaagaaugaaugauagaaagaaugaaagaagaaagaaaagaaaaagcaggaacuccugggcuggaugucugucuuaacuggcuaauaaacacaaugccaagaacauuagauaaagaaaauacauaagaaacauaaaaauugauuuuaauggaccccugucagagacagccauaaugagcauuguuugguaauaaauuccagcacggcccuccccggccagcuccuccuguagagcugugugcugcaaucaauaucgucuuuaagacuucaagacugaaaaauaagcaaaccuuugaacugcgggaacaagcucuucucaguuucugugagaaccggcuggccgcugugcucagaaaaucacaggcaccaaauaauuuguagggaaaaugucacuuugucucuuagcauguucaguagcccaauaaaucauagaaauuauguguuggcuucuuuugcuuuuggagaaacgguaaaggcucuccuuacuguaaguuugggggaaggaaauguaaaaggcaggcauucugagauacauuuaggggcuggagagauggcucagugguuaaaaucauaugcugcucuugcugaggacucgaguucucuuccuccaugucagcugacauacaacugccuggaaguccagcuugaggggucccagugccucugacauccaagggcaccugcaggcaugcagacaccccucucucuuacacacacacacacacacacacacacacacacacacacacacacacacauacacaaacacacaaacacacacacacaguucauuuccuuaaaucuugaaaaugguauauuugucuaaguaugucugauggauuguguggacugaacaaagaggcugagugaaguuaggacuagauuugacuguggaaauagccccacccccacccuugucguggagaugcagcuggcuuccuucagggaggggcacuuguauguggggagcagaggccagguggcccauguugggguauuccaucuccuccugacaaucuucucaguuccccgcugaggcccugccugaggauacaggccaggccacuaucucaggggagaaauggaaggauugugccucccuucagagggguggcugcugcuuucucuucucccggcccagcacuuggaaagggguaucugugggauaacccaacacuagggaucccugcaaauagcagugagaaguuggauuuuaaggguaugauggucaguuuuguaggauuuagaaucuccauggaaacgaaucucuggcauugucuagauugugagguauugucuagacuggcuuaaccgaggugggaaggcccacccugaaugcggguagcaugauucccuggcugggauccuggacugaauacacuggaguaagagcucugagcaccugcauuuacccgccucuguucccucgcuggcggaggacgcagugugagcaggucaagccccugcugccagccacagcaccucugccuagauggucuuuacgccugaaccgugggucagaauaagcuccauaggccuaggccagaacgguagcugacagggaggcagucggcagccugugcacguguagagcugaucugaugaggcguuuccgaccucguugacucagaauuuaccauuucuaucuugucagcuuaaaaagcugcgguuaaaaaacuucacagugacauuuagauuucagacagaagggucagugagcguuggcaaaagcauccugcugugcagagagcaucccagacaagaucuagaacucucuggaagguucauacucaagccuugcaaaggccucugucgucauuuuccuugagugaauuccaagguaaggaguuacuggauucaguggcguaaacaaugaagguuauaagaguuuguccccccuuugguucugucagguuuuaaaguuuggcuauugagguguagaggaagcaccaccuuacuguggucugaagucccuacaaguucaccaggcacgugagcugguccuguguuuggcuuuuccccccaguguagcuuugaauucacaggcacacuucugccucagccuuccuaguacugacgugacagguacgcgccgccaugcuuggcuuaaacugacgcccugccccaguugcuuauauuuucuguuuucuaaacuuccuuagaugagaaguuuauaauuuugaaaaggucaucugaucaguuuucccuuuacacguagcauccuuuuugucuuuaguaaauacauauguagcuguuugugguggugcacaccuuuaaucccagcuacucgaggcagaggaagguggaucugugugaguucaaggccagccagggcuacacagcagaccuugccucagaacacaacaacaaaauaaaacaaaaucaaaagccccaccaauaguccgcaaaagcccaccauacagaccuacuaugaaaacuuccccaagucuccugcuaugcugucccuuggaagcaugguccuuccuucacuuaugaaggaaguccugggaagguggccaugggggagguacaguugauuuccucaaaugcguacuuaguuuucuauagcuguccaguuauucacuaguuggggcaaacacagcuucccauuccguucgccucggcgcugcucuuggcucuuggcagugccuuucuagggcugcuccuggccccacuggccuuuugucagccccggaguuuguggccagccugagauagugagggccugucucuagcugcugucuuugaccuguuggugccucuauuucuguuuugcuguuguugagaaaggaucuuauguagcccugagggcauggaacuuggggagacguugaacuuccgaucuuccuuucuccaccucuaaguucugugauucgaggggagcacaacccccaccugguucauauggagcugggugucgagccugagguguugugcaugcuagacacacacccuaccuaccuggccacauuucuaccugccuucuagaucuuuauuuuuuaguuauguuuuuauuuaucuaacuuuuauauaaacguauuacguacaauguaguuuuauccccuucccccuccgaggccuccuccaccuccccgucaccccaggccucuuaauuuugcacauugccuugccaguugaaggaucuguuucugcacagguuucuguuggggucugauugagagcuguccguuuccauucuuggcugaguaacagcuucguguuauugacucugucgauuuguggugugauuuaucucugcaucuguuuggguucucuuucauuuuccucagcaggguuuuguaguuuccagcauggagaccucaugugucuuugauaaaauugauuuuuaggcacuuuguucuugauaguauucuaaaucagcuuaaaacuuuuguuaacuuuuaaauuauugcugccgguuguagccauugauuuuuuuuuuuauguugaucuuacguuauacaaacuucugugaauucaugcacaggacccacccaacccuucccugugauuuuauuucuacucuuuguuacccauggccagcuugaauccaggguucagaaauguucguugaaaagucccagaaagaagcugucaugacuuauaagucuuugccauucugucuagugugaugcgucuugggauaugugaugggacauccuaccagcgugggauauguccccauccacccaguguauccauucuggcaaugcugccucccuuuuagacacucagcagcugcaucaguuauuagauuaacuuggucuucuuaucgugcuguguucaagcagcccccuuuacuucacaauggcccaaagcacaugagucuggagauguagauaugcccagacaaacuacaaagugcuuccuuuaagaggucuuucccuccaacaucacaagaguagagagaucacggugauacggcucacagcacgguuacucugacggucugauuuuguacccuccaucccuuacugugccaagucuagaaauuugcauaggcaaauuuguuugauucuacccaccuuuucagguagucuggguuuaggaaugcauccuugugaauaaggggcaggcaggcuggccaaugggggaggguguugaccaucccucauugcaucuguuaugaacccauacaaacuauuuuucugucauuauucuuuaugcagaacauuuaaacaucuguucguguagcauuugcuagguaucauagguggggucugaauguguagccuguggguggauguaaauggccucuacuccgaugcuaccauuuucucugaaggauucagcaucucugagaguuguugugucuguagucccggagccagccccuucuggaggaaggggaaaacaauuauauuuguucuggguguuacuuggaguuccuuaugauuucuguaggaauucacugucuacauagagacaguaugcuucucccugugugauggucaugcuguguguuugugcuguugacacccaccaguaagacauuuauuaaaaaccucaccauccuaguagacggccucccuuuguccugaguaacagaacuccucaguguuucucccuuugucagccuucauucugguauuguuucucagacuacaaccacgaaggaguccucaaacguuuuuuucucugugugcugacauggccgugcuguuuuucuucuucaugcuacacacaugugguagaguuuguugauucaagaaugcuaagcccguuuucaaaugcuggucuguaccaauguguugauuuaaguacacugauaucucugugggcuuuggaauuggagugcuucuaacaacaugcacaaguauggaaguguaccucuguuuuaugaaaaagcaggguauagggugaucuugggucuccccuggaugcuagcuagcuggugugcuguuuggugcuuagaguucauuguauaauaacaguguguauagcccuuacucaccaccagggaacuucugcagcccccucuugggcugaccagaagcugggauaucuugaguaggguauuugcugucacccuccugugugacuugggagucuccacaggcauuucuuauuuuuuuccaagggccuuaagcuuuauuuggugggugacucacaggcuuacuacugauaccuucugcagggggauucuccuugcuucugugcaagccugaccuacacacacacacacacacacacacacacaaacacaccccaggcaugguaucuguuuaagguucuacaccgugaugugauugcugguuuguucuggguaguaccuaucacucccauuaacauuuggaugaagcacauugguugagaaguagcuuuauguagcaguuuuauuugaugcccuccuauccacaucucccagaugucagucauuaauccccugggguguagcuugaucuggucuuugcaagagccugacugauguccucuaugcuguccuauagcuguggagcucugaccuccucaguuugcccugcagugcuuaagauauagccagaggguuauggggucuauuuauuuuccuuaugugaacuuaagccaugcuuagcaucccauaaaguugaucacacuguuugauuacuugaaacaauaacugugcugugaaucacacuuagaguacacagacagcagcaaguagacuuuggcucucaggcaccaggacaaaccaaguguggcucaucuuuaauauauuacacccccuucauuuuuucuuucaauguaaaccuuguaauagcaguaaggaaauguaggcucacuaaacucauauaacaucuuuuguaucuugaaugugugaaccgcuuacaguccauuuucuacuuugcagaacuugacugccucuucuggcaaugcuggcagcgauucauuuaugauguuugcagacaugcugugguguuuuucuggccagcucuaauguggagccuguugggguagaaucagagagcauccagcugguccuucagguccaaccuuacaagcaggcuugccaugugccuuuggaguggugcacgguacaccggaaacagcagauaccagcucuguuaggcagaccacaguugaugccagaucuuuguaguugguccauaguccucagauagagcuguauggucauagaagggaagaguauauaaguugugaaguuguguggcuucugaucuagaaaaugguauugaugccucuugacuucgcuuccuaccuacuuugugcuaaccugauauuagacagaaggcagagacagguuuuacuaggacccaaaguccuuauguucuggacccagauaugcaaaaagcaaaaccuuaaagcuuugccucuggacuuugugacuccuggaaggcagggcuggaaaacgugaaugccuguguuggugagucaggggcaagccuguuacuucauucuggaucauccuggcgagagaaaaggaugguugaaugacagcuuuuuauauuuaagaaaaaaaagugugcaucuaaaauaugaacugucugucagcccaggauauauuuuuuuuugaguuuccaacccuuggaguaaugcacuuuaggguaacagagcuaaacugguuagcuucaagcagagguggguagauguucccccucuaaggcauauugggauaaaaauccuuaaauccauuagucuuaaccauaagcugcuuugagaggcgucuuacacacugcuguuugugcuugugugaaggggaagucggcaggaagaggcaccuguccccaucacuuacacaucgagcccugcauagguugggcagucuacacaaguuuagaaaucaaacugggccaugugcccucaguggagggaaaguccaugccaccagguguccagggccugugugucacagguuguagcagcaggacuguguacacccgcaaguuaccagauacuacuuccugaccaaggacugggccucucgggauuccauucugcaguaacuuucaccccaggagaagaccccaggguuguagggaggcuguugggguuuguagcucaaaccuagaauccugucagaguugugucuaugucauagccauuccugguggaauuagcugugacagugcucugccuugaugagcuggggaccuuuggaguuggucccuggcccuugcugccuguaguguagacagacuagagcugauauuguggccaugcuggccuaagugugcaguccuuucuaguggauguucacaugccaggguguagcugccugccuucaccacacugcucacuuuguucucuugcuucccucagccugucucaucuccaguaucucaggagggguggcuuugagaaauccaguuggcaggugugugaguuauuuuccucaucuuugugaccagaaggcugacaggaagccaucuaaggaaaagggggauugugauggcagaaguaguggccugcuauggcaguggcaguaagaggcugcuugcucacaucuggguggacaggaggcagagugcggggagcuggcuucaucccuuuucuccuuuguuuauucugggcccccagcuuaugggaugcugcugcccacauuuuggaggggcucuuuccuccaaacuuuaacuuuaauuuuucucuggaaaaauccucacagacacacccaagggugugucuccuaggugauucuaaaccuaguccaguuagccaugaagagugggucacacuggcuugcuugaauuguucuguaaaugaguucauuuaagccucuaaaccgagcaucuuaaguggcuacuguaacacccagaggccauuuuucuuuuugccugcaguuugcaggugagggagggaggucaguccacaucuccccuggagccaggcagcacagauuucccuugcuuggugucaccugucccauccagaagaauccaucuguugggguugcagcccugcauccuuuagucacucccaaggagaggaaguggacgcguuggggagaggcaaguggcagggucucaggaguucuaaggaaggcgcagacauacuuaccucuacucaccugagccucuagucacacugccacucacagagugcccauucuccccaggugagguucugccucagccccaucacucccagauguugggacccugggguaguccugaggcaaguggcugggugccaguggcuguaaaggaaaaucuuucacagugaaaggauucaggccuaggagggagggagcaggcucacucgccuucuuuguguaaagccacagccuguuggaagcuuugucagcuccugcagcuaggugagcaggggagauacccagccauuucugugcucuguggaugcccuccaccagcccggcaggcuccuccugacgucacuugugaggcacagcugugugcuguccaagacccacaucccuuucuuaggcuggacugaaguucaauuccagaauccccucuuguuccuagugucucuucaguguccccugauguugcagaggucucugcuuccacuguguuuucaggauguuaaaaucauugacacucgaaacucaaaccauacuuuguuugcuaaaucauuuccuuuaacaccggagcaguaauuagaugggcuauguguuucugguguguaggauaguuccuacacgccauuagcucagaauuuuaauugagcugaagguuaaauggauuuaaaauuucgaauuaaauugaagcauugucuuauguuagacuugucuggaauuuuuauuuccagucaccuuucagguaguagaaguggaucuuuuugaccuaagaacguugaauaaguuuaggauucacugaggacuucauuuacccucucauucucagaacauagggaucucacacaugucacagcuaugugacaggcccuagggggaugccacagcaaggaguauguagcacuggccugcagggagcccaacccugcucagggauaggcacugggaaaugcucuauggguguccugagaguggaguucauucaaguggggaucaccuggagccaggccccaagacucuggcaguaggaauggguacugcugacuaaguaagaacauuaugccacaaccucugauggaugggcuaaggguggcauggcagagggagaguauucagaggugggcccugacugcgugguuaagcaguggugauuucgcuaaacacugaggcagaagcaagcacggaccccagagaagccaccaugacauggagggacauuuuauuuuuucuuuuugagauuacaauauaauuuuaacauuucucccuucccuucucuuccuuccaaaugcuuucauuugccucucuugcucucuuucaaauccaugguuucuuuucucauaaguuguuguaacauguaugugcguauacauauauacauauauauucccagguauaaacuguucagucaguauaaaguuaccuccaugucuguuuucggggcugaccgguugguauuggauaacgaauuggugugcucuucccuggagaagacuuucucccacguggagaauuccccuguugucuggaguucucuguguaggguugaggccuccugggcuuugcccauuuacuuuagcaugucuguuguugcuggcccuauucagcucacauuagguggucauguuggugugaauuaugggguagcuucugacauuccuaggacauacagucucacagaaaaaaaccuccuugagcaaagagucacuguaacauggacuggccaccaagaauccccagacaggacugaaggaaaacacucagaggcagagaacagggacaggggagucuggggccccaguggaggaggcagcagaugggucucugcaagauagcuuuggagcauccacacccucuuugcuuugcaguauguugaaguucauucagauuuuccucacuugugaaaaagauuucucuggccuuggccuucaugaagccuagcaugccuugccuaauuaccguugccacgcuggauuuggcuaggcacugucugcucucugcaucucugagauagaagucauuugguuccagccaagccagaccugaguugucacaccuguggcaagcuguaggucgucccagcaggaacugaguucuauacacaccagggucugauaggcugaggcuggggagacagugcucuaggaagaacacuagaagucuguuuggcucgccuccucugaggaacuuuuguuuccuccuggcuuggccacccuucccaaauagauguaaagucagaguccaaaaccaccaagagaaguguucacuucuacucuacagcccucucagucuggaguuauagucccagucucucucugucucugucuguuucucacuuaguaugaugucuuuccaugccuagggcaucuuagagcucaggaucaucgaaccucagccuccugaggaccacgguuauaagcauacaacccuguaauccuggcuggggucauaguuuucuucagagauggcugcuaguagaguggcugucaucuccaaguugcuuuccuugggccucuuuuuguuuuguuuuguuuuguuuuuccuuccugggauguuguccuuccuuucuuuuguaguaugggccgaggcuguacgacggacgaggcuguagaaagugcugucucuuggcagcuuccuucccuagggacccuggggcguauuuucaaccucagauugggcagcaucuaacccuguuguagggugacugugucuuuucacagccaccuucagaauggccugaaugaugauagggcugaggucacagugucaggaagugacacucuccauccugcuguggaagcagacguggugccacagugucuuccucacuguguguacaucgauccaggggcuccugacagcgaguucucucacaguagaacaugaccauucuagccgcaguguuucgccuggguacugagacaagcuaaaaagagaauauaaaccccuguagaagggugucauuaugaggagagaaacuuuuaagacagccuauuacaauaggaagcuagagauuuggggagcgcugauuauuuguuucucggcuagaaaggcacugcgugcucaguaugcaggagggcgugucuguacauauaguaccgcacucuggccuuuuccauccugccucucauucccuuugcuaagagugcacacuucuccuagaaaaagaaguuguuuauccuucugaauuauuacauaccccaaagguaaccacccccagaugcugccuucucguuucuaaauucaucugcaaaacuauggaguuucugguccauacuucauccaguuugcuggcucuccuuggaagaguuauuguauauccaagcacagauuuuauuaaaaagaacugggccacuuauuuccuucaaaguuuucugguguguuuaaaucuucccuggguaaacaaaacuuuuauuggaaauaauauuuugagaugugacaccuuuugcccaggcaguggugcugaauaugcugggcuucagcagccggggccaggcucugugaccacggcugggcaaaggguggguuugucccaugggaaaggguccuguccaaaccuuugaggaggguuucucaugcacauggaagugcagccgaggccauagugggaaucucuggugcaaugguacagcuucaggcucauaaagguacaggugugcaccacuuauaccuggugugagcaccucugggaaucacagagccucagacauccuaggcacgggcucugucaauggaguuauguuccccagccuuagcaguauuuccgggcccucagcugcugaccugcagagucuguucuugacucuaggagccagggucccuaccgacucaggagucaguggugggugcuuaugugaacauaggaaagcaacugugaagagagcagacuugaggaauguccagccuguugugaugugacgggaccaccagcucacauggugucuguuuaugcugugucugauucucugugacauucauucccgggaauuuuugaaccuuuaggcacucagccaugaggaacuugccaaaucgugucaccgucuguaccugcggcagcugaaccauuugcuuggaugcauggccugcccagaauggccagcauaauguugguguacaaccuguguucuaggacuucuggacaucagggcauggugagggcuggucaggccacuucccucaucuacccucucuuuggacaucuaccaccgaguagauacaaaaaucuagagaagagaaguggaaggcacuaugguccuucccuguaaguauuuuauguuuuucuuuauauacauauguaaccuuuuagccuuguuucuggcuuuuucguuaauguauguaaaaauauuaaaaggcccuguauauuacauucaaaacuaugucagcuacccggcuuuuuucuauuuauuaaaacuuuucaagcaguaaaaacauuuuacuuguuaaugaggggaaugggagaguuaaugacacagagccccgauccuccacgaugccucuuccuaaccaugcgcggcaacucucccaccccaugucguuuaauuucuucgacgggguucaguagacacaugcaaacagauuucagaucaucccucaguuuaauagcaucugauauuugggucaaagacucucucuuuggagaguggcauaguaucuagagcgaaauguauuaauguuagugauauuagguuaugcugaguggagagagauggauguucuuaucaucagacugucuuugcuugugguggggcaggagcugguaaaggagaccacugggaacugcauccuuuugccugugaagugauguauaucccgggaggugauccgggcccccagccccuggugaacaguagccacccagggcauggaagccuaaggagccauuagcauaugguucucuugcugaggcucaaggaaggaagaaauuaaaaucagaucaccuccucuguggcuggcugcgccuggauuuugagguccuugaacauggggccucgucuuccugcuuccuaaggcagccauuggaggacccaguguugugcuccagagagccaaaaggauugagucauugcaaagucaggaacugauggaaaguauucuucaugagagguggcacaauuaugaacguggagccagggaguuucacaggagcugccagucagcagugucaucccaguggggagucuccaaagucacaugagcuacacccugggacaaagggagccacaugguagcugggacuucucaggacagugaaucccccaccccacuggcuugggaaugacaggcagcugugaaaauuguagcuuccuugaggcucugcagugcauauucagaguccaggugacucuugccaugaccaugauaguguuaaagacucaauccugguuuacccuuugccuccaccuguagacaaagugacaaaguggaguuucacugucuuaucaucuacucucuugauuccagugugaguacuugaguugaaguccggaucauaauguguguauggaguuggcauaggguccaugcguguaaagggagaugcguccaucuccuguaaagggagaugagaguggacacagacacauugucucacagagcccucauccuugcuaagguggcccuagcguaugguugaagcacauaaaaacugugugauuguggaguuuaggauugucuuuuccucguugccauggagauaugcuagggaugaaguuguucagccauccuggucagcucuguuucuggaccuaccacuguugucugaacagaauggguuccuugggcaccucaggacauagauuauuugaacauaauuaaaauggaguuuuaaguaagaagaugaaguugaaaacacccgucuuucaaguacacaaguaggagcugauguuggugagaccugucucuccuucauggacauuuccaagccucuguggccuagugggguggcuuucccggaucugauggacuggcuuuagagagaggucuagagguugcaugaggucuagagguugcauggugcuggagggaggcaggacuguuacggucugcugaacaagcguguaacugugacuuccugguguuucgcaaagcgugguguucuguagucucugcucucucuauccauacauccuuuuuacucuguggucccuaaggugcagagacaccccauaccucuucauuuuccaaauacccaauauauacaaauauauugcuuucucucccuucggaaagccugcugcaugagucugccccugggagcgguugcggagugccauguaggaugaacguccuggaucuuggcugguccccaggguguucugucacgaggucugcuugagaaaauuggugagccuuuuccuugggcaucuucccaccuuuucuuaagggcuuagcccaucuggcaucauuaggucagucucagccugggacuugggguugaauuuugauaucuucggugucuuaaacaucguacuccaaggcuuguguguguugcacguuucuugcauacuagaaauuaguuugccuccagcacucuuagaaucuugcacacuagauguccauguaacuccugaguuuagugaauguuaauuaacucauuggugcugaguucugauuauguagaaaccucugaaucuuuacagcucuccaaguuuccccuggcuauggggcaccuggucccaucucacccccaucaugauggugaccgcugaugucuaccagguuuuggaaaucauuguagagguuggguuuuguuuuaccucuuaagaugaagugggaaaccaucauaacuucccccuauuaccuuggcaggguagccccccauccuguauuugaaaacucccucucuaaacauuuucaggagugaauuguuagauuaggagaagggagugccuagguuuguuuucagccuuguagaagaacagaauggaguuguggauuuacagugaugcauauucuaaaauaauggugcaagaaugugagcucuucuaaggugcugcaagcucucucuugccaugugccuaucuccuucuggcaagcauccaggcauauuccagcaagcgggagcaucaggacuuagcacaggccuggagaaugucuggaugugggaggggcguuuuccaggaauugggcuucagaguccguuuaaaauugaaagcuuauccguuuuugauaaacggccaaauauaaaugauaacaccuugguuaauaggcugugaugaaguugaaggugggcuuuucugggaaauccuuauugaaauacuacccauuugagugaaucugauagacccugagcccgaagcucacagggaauauuauggaaugcaaaugggcagauugguguguguguuuucuccccgaguugucgcucucuccacagaagugaagaauaucgauguuuuauggccuuccuccagguugucugccuauuacuagauaugcagcuuggccccagccuugagggcgcuugcuugcuccucaccuucgugaugcgcagcccaucgucuggugccgagguacgauuucgccagagucagcuaauuuccuguuuuuuccccuccucagugcuuccaccuggagauuggaaaucccauuucagcucuucaguggcuacugugacaaucuucugugacuuuucuuauugcuaccccgugccaugcccaagagaugcaccgaugccgcuugcucuuuggcgucuacucucaggauccuacuuccuauaccugaaauguagucagcuuagagcuuugcucaaagugugucggaucgguucugcauguuuucuuuucuuucaacuuucucucauuuuccauuuuccauuucugucucggaugcccuuggucgggucucagcucgaugcuaggucuucccguugucguauggugccugguugcaucucacucacaucgugaugauggcagacaguguucaguuuggaaggugagauucuggugagcagugcugggucucugaaggcauuugcaugauagucaggugcuacuccagaccucugagaaucuuugcaucuaccaggacuaaauauuauuauuagcaugagucacacuaggaacacugggcaucuuaggcuagacaguguugccaucuuugcuuuuucuuuauuaauguggucaccuaaauccuguaucuucuuaguggaaugacuucauggauaaccuaagugauuaaacuaacaggauguguuguguggacucagaccuuagggugaccuauauacuguguauccaguauuuauucagaauggcuucuuucaaauaucuaauaagaauggauaguugaaugcacaguagccaucucgccuuaccccuugaucccauaagaucuuggaagcugaaacuaguuugggcccuuuagggauucauagaaauuagguaugucugcacaugaaaagggcugguaugguggaaaaaaaaauugaguccuuaaguaauuugcgauucccagugauaauuagagaacucugcccuagcucuuucuucccgaccacuuuuuuuccugguguuuuuagggcgaaucuugagucuuagcagcugaucucuuuuccuugcugugugaucccacuguaagguaaguggucuuggcaugucguguugccuugauggguuauuaaauugucacuccucagagaugaaugcgggccacagaguguguugucucauauaucauucaaggcgucaggacuauucuagaaagaugaggaaggguacauuuuuucaaauuuaugauuggaauuaggaauuuuauuaaguccucaaaaagaaggggggaaaaacccuacaaacuuuaaaagucuuucuuaaaauguacaucuuuguucuccagaauggugugcacacggcccucaucugucuuugggaaggacugcgccuucgcucaugggcaugcccuccuauacacugaugcggggcugaucacugggcagucugcaaggaagguugaucuguucaagauuuacuguacaucaucccggccgucauucccauaaguauuaauuuuaacuccacuaauaagaaacugaagaaaaguggaauuauggguucaguaguauccugugaaaggucaguuguuaaaaaggcagagccugacauucugugaaaaaggugccugcauuaaucaucucgaugggagagugcaggguguucuugaccaguauccaugaaccuugcaagguaagguuucgggcuccgugugcggguuuuuauguaaaacaaugauuagauguacauugagacaguucguaggaucguguacuuuaggagucugaagguugcuugugaaguaggaaaucuuagggugugugucucacacauaguuuuacagguaaccugcugugguacacagguguuccagguagagauggguuucucauugcaaguccccauucucaaaucguggugggauuccguuggcugcuucaguguuccugauggcugaagaguuugacuguucugugaaacagucugcuucuccaucccccacggcucuuuuauuuccaugagagccucagaauaccuacuauguacacagagccuagucagagguuuggaguuaaauuaccugcguauuuuauguguccugucaauucgguguuaaaguucaacacaaauauauaaauuauuaagcaguuaggcgcugacacauucaucagcugagcaucuuuuauuguggccuguugacagauuaguuucauucggccauuaaagcggggcugcugcugcugcugcugcugcucccaggcuccuuuugucuuuguugccgcuacuggaaaguaucuauguagcaggcgaacauagaacucccaggaucuguccuugggaucacaccauugcagacauuugcuccgacacugauucugcaaagaccaaauuauuccucuucucaucuagucccaucucucggguucugugagagcaguaacgcgagcaugcauggguuuggggcagcucuucuuucugaacacaccugcuuccaguugguacuugggaaaauuugacuccugaaggucaugcuccauucuucauucaggucaucggauggcaucugauguuuuugcugugugaauuguuagagugcaggagacagcuaccuaacuugcacccugccugccaggagaccccuguauuaucucugucaauauagacagugccugaggugggccaggguauagacccauaaaagagaacauggccaguggcuguuagccccccgccccgccccauggugccagcuuugccauccuggaccuaggguaggagcauaaacuugcacacaccugucucugucagcccaaacaccaccuuaccugugucacagcccuuuggccauuaaagacuugccacucugacauuuuuaucaaauugaaaguuaaauaguacuuucccucuugccccauggccaaaguuauaauugucuuugaagacguggacuccacucgcaagccuagaauuaugcacgggaagguuuugaucagacagaguuccuuggaguccacagacagcgcaaacugcuucgucugcaauguuacgauccucuuccuuaucgucauaauuuuugcuuaauggcuguuugugcuacauuggccaggucuauggguugcuuaacauaaaugauuacauuugcuuaugauuaaaaacuuccuccauuagaaauaccgugccaggacuuguaaaugacuuguuauuacagccuuauacuucauuagccacaucgcgggcuccacggagucauugucuaagaguuaggaacacuugaaaugagcuguguaaugcggacccuccgacagaaugcaggaaggaacggugucuucuaggagccgcuuagccagcagauaagaggcccugggcugcaggaagacaccaggcuauggcagaggaggcugagugcauucugaugggcagugguguggacgaaugaaguacuuuaugacuggagcaagacuugcuguaaaaaauuauauaccauucaugaccaaaauccuucagcaugcugggccaccgcuccucucugaacccagcagcuuaagcucuaagcaucuugcgagucucuuggcauagcauuuaaaaacacaagucugcaacggaauucuuagggguugccuuuguaggccugcuugcugugguucccagucuccuguguaucuaggcauugcuaggguaccccugggaguugggaaugugggucuguggucugcuuccccucaggguauuuaaacaccaggcaggaaggggaaggcagagugugggacuggggcagaaccugguuugguuccaagugaguacuggaagaaagaaggccuucuccgcacacagcucuuuauguccagugaagaucuccaucuggggucauccuucaugaaggagacaguccuugcuugcccagccuguuuuaguugaugguggaugugaaugcauacaccuuacucagggugaaccaaggaucaaauaccuuuugagggaaggacugcccaggaagggaagcucauuggcugaacacucggcgccuaucuagauaccuuauuagcauggagaucuccugguuuucauucuacagaacugauuggcacgguccucucaguggggugucaugguucugugucccagaacagguagaguuuggcagggaacuggcuccgcucacuccugcuguucucaguucucagauucccuggggucugagccugcucaaacuuaccaguucuucugucuggugccacgguccacuugucccacagaggggccuuggguugggauggguuugguggagggcaacucuccugggcuuucucugcaguuaccuguguggcaagcgcugcauguggaaggagguguucagggcacaugccuugagcugcccuccccucuuugcagucacacacacagcccgccauggaugcucuggagagucgcuuuccauguauuguggucucagcacccccccccauagguuuuauuuuguucauuuauuuagacgaucuuccuuauuacuauaacugauaauaaggcuuuugcuguuguuuucggcaauggaaguuaguuuuagcaaaugcuguugugcaagccucccaaauccaucuuuccuuucauccucagaggcaaggucaggcgucacguggugcuggugagggaaguuugucauucauggauugguaacuuggaguacugcgguacaauuaaguauacugaacauuaaaauuacacggaccaugauugaaucugagucacagguuguuucuuguucuugcaaggucuuucuuugaugcagucuuagcuaagacgagguguccuuagucugcugggagcagacucuugugaugguccaagugcucagucccuggucucugaggccuugcccacucugugucuaucuggagcaucuugaggaaggugggaucggaacccuuugucuacucuuccccuggugagccaggcuguggacacgugggcugagugcugggagaacuacggacagauguggacgaggaccugcagccuaauggccucugucucccaguguugggagagcuacuuccuccugaucuaggguccugcuucaguagccgcacauuguucuguuacagacccacaacugagccagcccuccaguauuccagugugcggacccguuccaacccacccgaggccugauccauguggucacgguggaggacaucucuccaacaggccuucacucaucuaaauccgcuucuucuuucccugcaacaaagugccuccauaaagacagaaagccuguaacccugccacucccuagaaaugugcuccagacagccugggaacucagcaggcauaaggaaaugcuacccaggcacauugaaaaccuccugcuucacagggacucugcucaaacccagggccagcagagaacaguagucagcaacagacuuccgaagacccaucccaccgugucaugugacuuccucauguggaagcugaagaauuauggauaccuugagcuucugacagguaaaagacaguaaaaaaauagugaaagacacaaucuacccucugaacugaucuacaaggcuaugaaaacaucacuuugaauaauaugcauuggguguuagaaaaauguggugcugguguguggaccccucagccuuuuugaugagggcuguaauauaucuugcugagugaugaauaugcgacuguaggcuucaacuguucgugucucgugccugggagaaaaaaauaucgaaaaugaauauaaaauauugaaauuuagaagugguugggcccauccauaauuucuuguuccuuuggaugagguagacacauugcuaauuauacagugugcaggcaccuaugccaggugccucacgugauaugguguauaaauucugacucagccuguauacugccuccaccacaagaacauugaauacagugugcagaaaugaguucugggcagugcaucccuggaauuuggccucaaauaugaggucuuuccuuaaacuuuacuugagcauuacuugacguggcucauuuggggguacaguauuagggugucaucuccuaguguuuugugcuuuuuuugcuauguuccagacaagguauggugaaguuacaguggccucagcuugugcuuuggcuccugauuggugggucuacugcacugaccucucucuuagauguccugguucugggcuuauagccugauauaguuugaaucugagugggccucagacucugccaaaauuguguauugaaggcgagauccucuuuagaagcagugugcuuuuauaugaggucuagcuuuuggagaagugacuggauucagagggcucuacauucacuucagaaauaacuccugggagaugauggagccaugggggugaggccugguucugggacaucagucauacacuguuggaaagaugaucuaucuuuuccugcucauccugucaugugcuugccauccacuaugguaugagcacccuggcgccaucugcuccuggcuauuauggugugccucacugugggcccagaagcuguaaggucagcgaaccacagacugaagagucugaagcuuccagccuaaguuuuccucucuguguguuugucuguguuaaguguucggucaccacaguaaaaaguaacuuaagccaccacugaauugacuuucucacaaggccuuagugggcuaggggaucugccuggcuuugcaauacagacccucuuucuccucugggccuuacaagcccauguacauggcuccacccuccuguggacugcuuccuguggcuucugucuccagucucucuucucuguuucucuggacagacccuauguagagcagcacuguuguuaucccaggaauauagguguuacacacagagcccgucuuguuauuuacaaaaaaaaaaaaaaaaucauuuuugacaugugauuguuaccauauauucauguuggagauuucaagucccaccucuacugacucaugggccuuauauauacuugguuucguggcugugauuuuuuuuacugagaggaacacagagccaaacuaugaaagagaugaggcacaugggaaggggcuggaaacaguggcaagagcuuuuauuuuucuagaauguucucuguuagguaccaggucucuguagcagcauguuauggaaaugcgcgaaggguugccaacuccuugcggucacaccacccagauuuuuuuauugguugguugcauugagacacugccuggcauagaauggugguuuugaugccuuggagagaagcagcugucuauaaaaacuacauggcuuauacaaacagcucaguuguagauagccaagcuugucaggaaauggucagagcucuguccaagucuacgugcccagacaccaaccagggucagcuuugugcacaggcuuuccugaggauggcaguuuggggccaucugcuaggucuuuguggagcacaucaagagcuggagucgauuaucugucuuuugaauccagacuggcuuggagacuucacuuggucacuacaagguggcagaacugacauuguuggcugaugucccugugccuuucugggcuucauagauugcauguugaaagccuacaacugccaaauagaugaaacuuagccaaccuccaugagggcaagaaucucaccagcaaggcgacacccauggugaauguugggaggagcuucguggaucauccuguugccaggaguguccuauccaugcccaccuacaaccauuugugacucuuuaggcaauguucagaggagccggccagcucugguccuuuuucccugugauuccagcucuucauaugguggugugaauucaggaggcaccacacacuuacaugcacauaaaugugcucuaccauguaauacaucaagcucagguugguacggugaaugaaugaaaugaucaugcuaugccucuuuuguaguguguacccagcugugggcauugaaguccugaggcaggagaugccaugguggcuugguauauuaugucugggucauaggcaguguguuuagcccauagauagaaacucagaauaguuguaaauacccugucuaaugagugacuaauuagagccagccacagugugguggauuucacaacagggaaagggaugcaaccucuaucacaacaugcucuguccuuucagugaacuucuuuguucuuuaucuagacuucccaguuaacuugcgcucucuaagagaggagggauguuggguugguccagagcugcuuaugggaaggcuuuuagcaucaugaggggcugauaugugcaugcucuguugagaggaugauucaugucccuuggaugauugacauuugugcauguagcauuguguuuggggaguuauaguugugggagucuggaacagggucccuuucucugcuccaucuuccuuuuguaccagaauccagggugucucuuuaugacagcuccuuggaccccugggaucuuucacucuucagucugccuaugagaccuggucagccaccuccagcuuguagccucuugucuuuccccaaaggagugacuguuccuagccaccccagaucauagcuccaucacagacucaggauuucagacaucucuggauagccagaggcuuugcugacugagacaugugucugucagagaguaaccaauacuucaacaagugccacugguuauuugugaucucagaagccacccccccccaaaaaagaacugucuccccaggaagacucagaaggagugagguaccucuccaguauuaaaacccugucugcagucacaagcagcgaguggcaaccuuauucaaggaaaaagccuggcagaguccagccucaguaucucaguggcaauaaagcuagugcagauuuacuggccuaggaguucccuguaauacuguggaacgguggguuauuuuguguucaagaggcacauuuaucacaaaaaugaugauauacaaaucacuuccauaucacaaaauguucuuggucaaaauuggcuugaggcaagugauaucuucgaguaaaccguauaugaagaccauaucuuaaaaugauagaucaccuaauuuuguucugacagagguuuuugcugcaacaaacaucugucauugaaauaccaauucagagauauggaagccaaauuguagagcuguucuuggauuugucaccccuaacuuaagcaugcuacuguuccacacugugguuuuuauauaagacauuagacauuacuggacuuuaaggcacguuacaaugaaauaaacaauugagagaaacgugcuuaugcuuuaaaugcaaaccacucauugugaacaaguagggacccagcagagcagccccggcuguuuacaagggagacgccaccuaaagcugugacauuagauugugaggcccagugcgaaucuccuaaaggugaugauacuuggcacagugggcucugggcauugcacaucuuuuccuggcaagguauaguuuuuaaaaaaugaaccaugauuaugauguuagucuugaacuuugaaaugguaccugugugccccccugaugggauuagauuacaccgagggacaauggugaugucauggggccuccuuuuucuuggcauucuuccuugucaagaugccacauucagggaaccccaugcagggacaacugucuugggauuugaguggcaugaaucagauguuuccagagggagcucugacuagacuucaugcucucuuuuuccaaaugagaaaaaaaaaaaaaaaaaagaaauugaucucgauccaaaagcuaaugauaugauuuuuaaagaaagaaagcaggguuuagggaguacgugggggacauucuagaauugaccauuggugacuguauuaauuaccccucauguccuugcauggcagaaacagcuuaaggaaggaaagguuucuuuuggcucacaguuugagagugcaguauaucuuggagggugaagggauagcaucaggaaaucuaggcagcugcucacacuauccacagucaggaugcagagaugcaugcuggugcucaccgcauguccuccuuuuuguuugcucaggacccaguguaagggguggagucaccuacuguugggaugggucuucccaucucagcuaauccaauuuagaaacuuccuuauagccauggccggaggcaucaaguugauaguaguaaccaucacagggaccgacuuguaaguugcuuaaaaaaaaaaaaaggucacgucccuuguaaagucuuuuaugacccugaauguucuggaagcuaauacagaggacuaccacauccugcagcagcuaccccaagccuggaagggucuggcuccuugcaucaguauacauggcucccccuucaaccucuugguuacagugucacaacagcucucuuaagcuuaaggcauuucaaccaaccaacccuccucaugcuggggaccagaguaagugcccuggggucuugucuuucagaaugguccauuccuuccuuucaucauaaaguaugaguagugccuuaaagggcaccuuucacauuuagcuuuuauaucccauuacuuggaggcuuuggugaugucuucuagcauuugaccucaugaggcaagagauuggccugacauugagcugggagaagugagaguccagcucugucaucccuuggcuauuucugccaacuuccaucuauuguguagcuuagagcugcagcuuccuccucuacugaaguuggcccuagcacagccccuacguguucaaaccugagugugugugauccaucugacccacaaaugccugaagagucucuugauaccaagguaguggcagugacaaugguugucaucauuuucauguuugagauuauccugugguuggcuggggacgagcccaaagcacaccagcuuuuaggauucacugucuuucuaaauuuaacuuucuggagucacugauuuuguaauacucagaucugauguucacucuucucaguguacuaaguuccugccauugcugcauuuaugguaaaccucaccuuccuuugcuuuucaucagaccagaugagcaaugguucuaugaccaccaauccccccaugagauaaccaguguauugcauggaguauucccaugaaguugcugggucauaggcacaugaaugaaauagcccuucacuucaugugacaguagaggggugcagagagaauagagugaagauggagacauauuuucagauugugucugauggguccuagugggacagucccucuacagacagguuagugccucuggccuucugguccuaacagacacaggugucucuguccugaagggacuguugccccugcaggguuugaagaguugguuucugcuuucaaaugcaacagagcauucccacaaaggugugguugcccuaugacuuugucaagaauuccacgucuuggcuucugagggcagcauacucuguagcugugcuuagaaucuagggcuugcccugacaccuuugucuucuucaucaacuuauuuguagccccauggacacaccucccccggguaucugcaagugccuuucuguucagcccauaggugccucauuagaagaccacccuugacccucuugucaccaguaaucacaguucaacugguccaugacucaacgaugaguggcacugaaggaugugauguuccucuguaugauuggguaggacuauauacgugugccagccugugaguggugugccugcggaggccccgagcugauaucguagcacaaguuacugugaaauacuggagugagcucaucagaacugguaaaagcuggugaauuagaguaaaaauacugcuacgaaaauuauuuuaguguaacguaaugacuucuguuuuucauaucuggcagauauuucccacaaaauuuaaucugcaguacugagaauuaugccauuuuuuaugauuuguuuaauuuugacugaaaaaaaauugacuauucaucgauucuugaccugcaaguauugaggaaaaaauuuaguuaauaagacuuuucaugagguauagauuuaaauguaugaggauccugccuauccuacgguaccaugacuauuaauuuuacaauccuguaagagccugagggccaggguagcugaaggaagaccacacgggagucagagguucaaggcgggcacaccccacauggguaacucuggaggacuucaauuaugucucaguucuugguccuauauggcuaagcaccauuaggaucuggccaagggagggggugaaaaggaauuuaaaucuuuuaaaauauguuuuccuugugaagugcuuagucucaguauagcccagaguagcaacuagaagucagagccaaccauuagcagccacagugugcagcagaaaguuucugcaucccauccccaaaccccgccaccccaacauccgcuguucagagggggcugcaaagagggcaugaaaaaugaaagaucugaauacugaaguuggagagugggagugaaugacagauucuuuacacaccucaacugucaacauuucuaaucaaaucacccagccuccuuucuucuuaaacgaugcacacaguacuuccaguaauaaacaccccuaagucuaaugagaagcccugaggcaaccucaaauguaugaauucauuguaauugaaccacauagucuucaggccagacaugccugcucccacucucuuaacuucccagggcugggguguuuuaugaaaaauguuacacguuuuguuuacaacgucuggcugcuguuugaaguauuguaugcuccuguacuauaagauggggccgcauaauggagggaaaaucaaggaggcaaucuuucauuuuguucuuguaugaaaaauucaaaagacuggaaacucacccagagaaauuucgcaagcauauuauuuuccaauguuucgaucaauuugucugucaaccaagcugagagguggaagggccagcaaaagcaauuuagcuugugagguccaaaauagaaauguuuuagggacuccugucacauguuauuucuuuauauuagaaccgccguguguuuuauuugcuggucauauuaugaagagaaauugauaucaaucaucuaaggaagcuaugaauaccugauauaaauaucacuuuuauaugcaugcaucagaacaaaauauaaauuaaccucuuaauguaugcgagaguccuccgugugacaacaggccucuugguuuggguguuugcauuuaacaauuugcagugcauucuaauugauuguacccaagugacacuccauagaaacaucuagcauacgaacauuacugacccugccaggguuuuaauuaagcuauaaucuuccuacagucgguacaucugggauugauaaacacauccaaaccaugcuuacaacccaaagauugcuuuuaaaaaauuggugcagauauaggaguuuuaaauaacgggcauugauuuaauuucuccuuaaauuuuucaugggaccugcaaccaaguuauaugaaguauaguuaguuauauaguuauaagguagaccuuuaauuucagcaaaacuugcccugagaacaguguuauucugugucuuaaucuguguggccuagcacuuuucuccaaauuuugaacugagagggguuuaucagagaagcuguaucucagcaaauuaauugugccuauugguugacagaaaucacagcauauugauccugucaagggaaguccucucacaguagccuuccucugaauagcuagccauucuggcuggguagcuggcuaccauucacagagcaggacucacuagcaggcuugcuuaaugcagcuagucuuuccgaauguggaauggagccuaguaggggagugugcagaacucucuguaagugcuaaugagugggaauagccggguacagaucaagucagagcucucuuuaguucaugcagauauuuauauuaaaucuuguucagguaggaaaauguguuaaaacacaagucgcaguuaauuaugucaguuuagagacugcaucuucugacaguuguuuuagcaugauucaaagggcuacacuugcagugcuugccuggaaauguuguugugcgcuuauguguccaaauacgacauugauccugacaagcccccauuaacacgucgucuucuuggauuuuuuuuuuuuaaaucggugcuguuuucacuguuguuuggagcuauuuugagcaaaguuaauuacgcgcauccuucuguagccaucucuguacuuggcaaggugugcagaauggauccugagaagcagaauuuuaaauuucaacgucaucucauuacuuucauuucugguauuuuaauuaaagucaaacaucuuaccccguuuauuauucacugggauuucuuuggcaaaacccuugccuuuuuuuuuuuuuccugagacaggguuucucuguguagacccagcuguccuggaacuaggucuguagaccaggcuggccucaaacuuacagaaaucugccugccucugccucccaagugcugggaugaaaggugugcgccaccaugccuggcccuuggcuaguuuugaauucgguuauuuugucucauuauugauuaguaagaacuuuuuacauauaaagaaagauuguuacuucuaugguuuuccccuguggaaucuuuuucucuaacuuaauauauguagccagauuuaaaaaaaacaaaaaaaaaaacuuuaaauuuggggauaguuuuagaauuaaugaaaaguuguaaaagauugugugaaaagccauaguugagucagguuccagcuugugcuaauguugacaguuuauauaaucaugaaacauuuguuaauuuuagguuuucagaacuggcacacuugcugauggcuccacucaggcaugggucuuuucucggguuuguaacuaccacagcaaguuuaugcaaagaacucguaguugugagaccuuuagaugaugacgucagucaucaucaguauuuucuguugcuucuucggcuuuagcucuugcuuuugguuuauuugaagucccguguuugguuagaaccaucuuuauuucuauccugacaaggcagacucucugguggcccacauguacaaagaugagaagcaagagcuuccugcuuccuuuuauuccaggggccauggucuuccuccugcgauggcuaauaugaaucuuuccaggaaagagugaggacaguuagguuguuugggacucauaucccaguccuucuaagaucauuggguuggcaccuuuucccucucauccugaaaggaauguguuuuagguuuagcuauugggucuguaugucagaaagucauucuaugucaauuucaaggaagugggaaggaagcucugacuaaguaugacaguuagguauugucugcagucacagauagaggaaaggguguucuggacucaaaaaucaaauaaucccucaaguucagggucuggccuugugauggugaccugcccuagaagguucuguaccugcuauaaaagguguguguaugggcuuuuuauugcugugaagagacaccauggccacaacaacuuuuauaaaggaaaacauuuaauugagacugacguacaguuucagagguucacuccguuaucaucauguugggaagcguggcagccugcaggcagacguagugcuagagaaggagcugagaguucuacaucuuguucuacaggcagcagaaggagccugccacauugggcauagcuugaacauaagagacuuucccacaggcagcagaaggggugugucuccugcaggcagccaggaggaggcucugauuccgcacuggguauagcuugaacuuauauaugagaccucauagccugcccccacagugacauacuuccucuaacaaagccacaccuauucuuauaaagccacaccuacugaauggugccacucccuauagccaagcauccaagcacaugugucucugggggggccauuccuauucaagccaccacccuguuuuuccuuuaggcugcgcucauaucugaauaaauggcauagugaauucugaguaaggaguuugaacuguaccuguggcuucuuaacuuuuccagaaacaaacaaacaaacaaacaaacaaacaaaccaauaaacaaccaccaccacuaccaccaccaacaaaagcccuuccaauuugaaagaugaucuuagaggaguuugacucaaacacacauuucuuuauuugggccuugggucgggcgcugccugaagcagguuuacuguccuacuacucuuugcugacaguuuauucaucuuuuaaucuuaaagccagacuuuaguccuuaacaaacucaccauuaucgaaccauuucugggaaacauuaggaagcuuuugccaggauauuggauagaucuuggcucauauaugaauugauuguauuuuguugcugaguuuaaucuuugacugguugaucgauugauuaauugauugauugauugaugauuaaggcagggucuuucugcauagcccuggcuaaccuggagcuaacuguuuagucuaaaaagcuagccuuaaacucauggcaguucuccugccuccauucucaaguguggaaauacagucauguauggccaaagauagcaagcuucuacaaauguagguacaaaacuuugagguaaggagggcaugaacacguucucugcagacgguauuucgaucaugguucugccuucccucauauacuggaagcagguuguccuauaggcccaacuguggucucugucucugcagugaguucuacuagcaacuuaggagguucacacaggcucuccucauucaccgucucaucuaaggcuuugaucaggaucacucugucccugugauucucaucuuggugucucaacuccuuugagggucaaaugacccauucauggggaucuccuaagaccauaggaaaaacagauacuuauauuuugaucccuaacaauaacaaaacuacacuuaugaaguaggaacaaaaauaauguuaugguugggggucaccacaacaugaggaacuguauugaagggucucagcauucacaaguuugagaagcaguguucuaggacuugcuuauagaugcauacacuacagccauuuucuccaagccaucuggcuuuaggaacugugacccaucacuguccccgacaugcuuccaaaucaucuuuuccucuugucucugaguucuuccaucaaugaccuucccaauagaccuucccauuuuuuagaugaaaaaagaaauaaauaaaaagaaacuagcuuaggguuagcucaguugguaaagagcucaauucacaaaugugagggcccauguuuuaucccccaggacggacacaaaaguguuggguguguuguucuaugcuuguaguucccaugucacuggggaagcagugacagggugaaccccauggucuguuggccugucuagucucauuggucgguucuaggccaaugggagaccccaucucaagauaaguaaauggugguuccuaaggaugagacccaagguuguuccccuggcggccucauacacauacccccacgcauggacauagacacagauacacacaagcaugagcacacaugggagcccuggcaccccuggcagaguguaacucagcagcuuaucucugacauuuuuaguccuguuacugcuacauagaaaacaugaaaguucagagagucuuuauauacacauauaaacuaaagguacauaguccucagcuggucaucgaggaagccacucuaccucuccacacaugcagcugucaagcugucagaccagcaguauagcaucugcuccccggcccaagccuuacuucucuuggccgagcucccuacccuagggucaggugggccuacugugugagucuucagugcucagcuggaacuauuccuuucucgaggaaugcugagguuguaacuggugccauucaaaggaacuuccuucacacugccaugggccuuucucacugcaugauggguucccgaagcccagguccuugccuggcuucuugccuaacagugcccuccccucuugccacagaacucaugugaccacuguguacugauuugaaagugcuggugagccccauggucuguugucagugauugcucuaagugaccucuuagugucaagucuggccaucacacuagguauuuccagacuguguuagguuaggggcagacguggaugcaaacauuguauuuucaguucuuaacguauagaauuugcugccauguucuuuaaaaccuuucacugggagcucuucagaccugcguucucaguaugcagggaccugcaguguauggucagguucuugcauuuagaggcgagugcauuagugcauaagguguguccuggcccuguguguguguguguguguguguguguguguguguguguguguguguguguguguaguggaucugagaggaaaaaauacaagagguaagauaagucuggugcugauggcauuuguuccagaacaguaaaugccuucguccucucacuggccccuccuguccucugaagcuuguggguuuuacuguaguagugggcuccggguuccucccagugccaggccggaccacagugauggccacucugcugcucacauauugacugcaggccccgucgcucuggagagugauuucuuuuuuagaggaaagauauuuaugacugaaaacagugcuaaaaacaugagaauauugaucaugguuuugagagaugcucgcggugaaucaccugauauaccuaaauaucggcuuuauuccaucuuuccuaagagauggauugccagcacaaaagaugaacaacugugagggggaaaaucuuacaucuuucugauaggcugucucgcuucucuccauaacaacagcgagaugagaagucuucguggccucugcaaauaaagcaagcguaauaagcuguaugccagaagaggaugugaacugcccugggugugcuugauuuaacucggagucgugaguuaaauuggcaucagaugaaaacucaaauagcucaacauuuaaccagcuuacaauaaacaauuauucuaaaaucaacauccaaauagagaugaaggaaggacccguuugaggaccaaauuccauguguuccaagguagucugucugucccuggacacaugauggaagggacacacacacagcuuguuguuuacccaucagacauuuuugucaggcagguacuuuuuucugucauuugcuuuuucucaaaguugggccuguuugagaucuagauuaugugcugcucuuuagacuuaaggagaaggguagagaggcaggcuugucuucccgaggaagcugaagaguauggauucguagggauaugguccuuaggcuuccuggguagcaguuuggagccugcccuuccugugcccaaaccuuuauuuuauaucaucugagagagggucucacaguauaaccccucuggucuagaucucuagcuguuguccuaaagacuauauccaggcuggcuuugaacucacagagauccaccugugucugccuccugagugcugagaucaaagguguccaccaacaugcccagcuuauuuuugaaugcuuuuuuauuuuuaacuguguguauguguuuguaugugucuaugcaucuuugugcaggggccuucaguggccagaagacaacaucuuagccaacccgaaugcugagaaacaaacuuggcuucucuguaggagcaguacacacucuugacuaucaagguaucucuccagcccuucuagaaccuuuccauauaccuauugccaacauccccauaggcagugugaaugacccugacuuugcagcagcuuuguccuaugcaacacggcaguccugcccucaugccuagaaagguaaagguaaucccagcuccagacaggacgcagcuuuaaccauggccuugucuuugaccugcaaaccuaguauauugaccacuguggucugucugccugcuugugauggcacuaaguuguagaagauaggccccagaguauguauuugaguaagcuggggcagguuauuggcucccuaggagaugggcugggcugcacaccaagguaucauagccaagagcgcaugaucccgagagaugguaugcucacagagccaagaaaccucccaggaagagggaagaugacauauccauaggggcagugugucaaagugcugacuuuggagagaagaggucagccaguacacccagggagccccagccaucuccuggcagaguagguaccaaccaccacagagacaguucuugggccuacaaaacauaguucugggaucuuuuguagggcagcccuauagagcugugcccuuugguuaauuccagcauggcccuagaauuacaaguccuuggccucucggcuugcugcaauuugcagauggugguugcugggccugcucacugggggccccauuugcuaguggugaguuuuaauuucuaacacauaaaaaugggggauacucuuuuuuuuuucaaccaucauagagcaucuuuauuuucuuucucuucuaaucuaggacuucuuuuuacagauuuauugagauguguucacauagucuaaaauucuucuguuuaaggguaaguauuaguauaguuugugucuauugcuacaguguaauacuagaauauuuuaacagucuccaaaacaauggucccagggucgauugagcccuuauguccucuuuccucuccagucaccaggcaggcauugguccuuuucugccauugugacguucuauuuuggauauucuguguacuuggagucaugcaguauagggauauuugugaccuuuuuccuccccugccaaguaugaugcuuuuaagguccagccaugucauaguggguaaguaguuuguuucuuuuuauggcaacacucuucaugugaccagaucaucuugcuuaugucauuggauagccaugcaggugucucagccuucuggcuguuguaagugaagcugccaggaacauuccuguguguauauguuuuccuucuucuugguuauguauguuguuggaggacuaccggaucauaagauaauuccacacugagaauuuugagaaagaugcagcauucuaaacuagcugagccauuuugcauuccugucuguagaggggccaugcuccagguagaggggccgagcucccuuucuucauaugcucaccaguuucuacacauuguaucuuuuuuauuuuaaccauucccaagcagugcaaagugucuguucauuguguuaaacgggagucccccugggaacagcaaacaggaugccggugagauccauagcuacagaaggcugcagggggaacacucucauaaaguaccauugcuaaagcacacuccagaaagcacucaucaccaucagggcauccuaauucccugucacuuccucgacgucuuccaggccauccuacuguugcuagcaacuauuucuuguucagauaugccuuaguuucaguuuuuuagaaucuuaaacggacauaaauacauguaaaauuauacauuauauuuggguaaaauguuacaguuucauccauggacuccucuaugguacagucuuuuuuacuugucugauaacuucuugcauaugcuacgugugucugucuuuguugaacauuguuccacugaacauaccacugcugacucaccagcuauagacagaggauuuuucuuugaauauuggcagcaaacaaauaaugcuguuauaaacauuuaugaagacaucauuguaacacauacauucuuauuucgguaggguuaacagcuaggugcuaaucaugugauuguuggauugcaaacugguuuuugagggcuucuccaucuuccuuccccuacucguagugggcaagagucuccagucucuccuuccuccccuucaugggguucuucuuguccuucucccugggggcuccucaucuuguguacauccgcuggugauggauucuuuggucuugcauguuagacaaaucauuucaaugauaaugaugaaaagaugaccuucgaaguauagguuucuucgguuguaauuuucuccugcaugucuuagcugucucuuguuccacugccccauggcuuucaucucucucucucuuuuuuuuuuuuuagcagacaucuguuguuuuuuuuuuuucuuuuuuguuccugcguguuguaucucccucaccuuguuuuaagaucuucuugggcuagcacucaugcacacuaagaauugcccacuccccacucccucauaccuuuuucugauuggcuggcaccagcuucagccuguaagcaaaagaccauauuuaccccagagaaaugaaaugauaaaauugugaugccuuaagccauugagugugauuugugauacaguaguuugucacacagcaauagagagaugacauaguauacagcaccucccauuauuuaaaagguuucauuaaugaguuuuaggucaaugggcuggauauuuuuaugucaucuugguacaagcuagaguuaucugaauggaaggaaccucaguuaagaaaaugccuccauaggauccagcuggaggcuauuuucuuaguacuugaugggagaggguccagcccguugugggugguacuauccuucggcuggugauccugggaucuauagaaagcaggcugagcaagcugugaggagaaagucaguaagcagcauacauccauggccucuguaucaucaucugccuccagguuucuguucuguuugaauuccuguccucacuuccgucauugaugaacugaaaugugggugcggaaaccaaauaaacccuuuccuccccaaguugcuuuuuuuuuuuuuugucaugguguugcauugcaucaguggaagcccugagagacccaccaucccacacugauacagcguaaaaucaguuucgugccucucugucuuaugcuuauguuuacucgucacauuacuaagacugggagcccguggaucaauguaacuggauucauaaagaugcccaugaaguaugugagugucgagggagcauggaugggcugcaguccuaccuauauugggaugcaucucuaaccauaaaccagcuccuucgguccucacuaccucugggagagaugccuagcaauacgucugugccacaggguaucugggaaacagucaguauugugcagucuacccaguaguuguggcaagaagagccaucaucuuggaaguuacuuggcuccugcucacauuacagcuugcauggugugagguaggaugugaagucuguguuuuuugagcccucuguagacucgcuugugauggcuagcauucauugucaacuugagaaucuggaaucaccagggguugagccuguggaauuauguugauuggauuaauugaggugggaaggcuugccuacuguggacaacccaugacuaggauacaggacaguguaagugcagaaagggaggauugaaauaucuuaacagaucagaucaaggugaccccacuugcauguguaaugagguguucuuacuagaguagcacaucuguugggcaggccacuaugcacuugacaccuuagcagcugcuuuaugcacauaggucucccacucucauccaaggccuggcuuccugcuguccauacccccuuuaccccauuuauuaccucugggucaccacacuugucuccugaucccugcuucucugaaucauuucucuugccucucaucagguggggauucccacucuuaugaauuccaggucccauuuaccuccgucugaugcuguuuggcccauccuuggauguuagaauuagccuuugucaucugucuucccagagcauaauuuuucaaaaagcuaugaucccacgaugcaggucucaaccucaguuguuggugaucaaaauagccaggcaggcuagcauuguguaucuguuagacucccucucauccaaaggccugacaccugccugccagccauuucuugcuuggcaucaucucuuugauauauacaauagguuuaaaguaaaaaauagaguucacuuuauagacacuuugagcauguuccguaaaguguaauguguuucuauggcucuuuccuggaaaagugccuaaagcccggggugugcauggucugagcacuucaguuuggaauuuucauucauuagauggcccacucagcacuauuuaaauucuaauaaagaggcuggacacauugugagcaaauuugccuguaucauuugugaaucuccaucagagcaaaagaagagucucucccuaucuuucaaugaauaguuuuuagccauggaauugcuggcagaggcaagaaaguaugaaucuuauuuuuguggaucuagccaggaaggagaacguaaacuuugaaaagugugucauuuaccauucacagucuaaugaaaaacugagagaggcuaggaacucucuauaaaaauuccgauaucagcauuuaggacacaucgagagaggguacacagcauuuaagggaaucacagucgccaguuuacaggcacucuaaacgcugugaaucuugugcuggcaaucacaaucuggauuuuauuaccaaaaaggacccccuuaugaggaauaugcuggugccgugugcagguuagcaaacagaaaugcugucuccuccuuccccagcugaaggaagaaaggggcucaauuauccuugccagugcaaagggcccuugcucccacaagaauggcuacucuguccaaaaauuucugaaaacuguauaguaguugaaaccugaaugaacugcgaaucagacagugauucuggucagcaagcauuuguggacaccagaggggcugggcagcugagcaggguaaagcagcuagggucaggggacaugauacuccccgcagaagaaaggcuggguagcgcucuguuucuacaugaugaaccaccaucccuuucauuucuuauuguuuguugcugaaaguccccaagguuggaugguuuguugucccacagaccuuguauaagcagaguucucaaagauaaucugggacagcuuggaagcaccagaagaagugacuuuugucucugggauccuuccccaaagaauccaugggucuggacagauguuguugguacucaugcacaugugucuucuagaucagaggaucuucacucugcugcucccuguggcugugugaccuacaugccagucugcucuugugaauuacuaauacaugcucuauagcgaugcuuggcacuuuuacaaauauuacccggggaugggaagggagcugguguuccugagcauggaccacagugugacaacugcccuucuggucucacugugaccuuuaaggagugccauacuguagagaaguuuugagcagcuguuugggauauguccuccaugucucuucuuuuuuuguucaacauuucccuucccaccuuuagcaacuggacugguaucuaccaaagaucucaaauguggaggcccuggguugcugacagaucuaaaggagaugucugccaccugcucucuuuaggccuugagggcugaacugcuuugaauccuugauuauuuaaacaacgacaacaauaacaacaacaacaacaacacccaauccuguuauaucacguuuugguacucucaagcuccaggaaaugacagaaagguuggccccauucugcuuuuuaaaggugagcugucaguacuuaauagacauucucaguucugaaccaggaggcaguccauguucugaaaguauuaauaacccaagcaagcguuucuugaaaaauuaggacuucuuuuaaaucagauugguaaggcgugcuuagaggcaugcagcuguuucucuugcacuguuuugaauucccgaguuauuccucuaagaggcucggaggauauugccuuugaaagcugagucugaaugcucugacaugcuuugcucuggucauuaugggcccugaaguacaugcaauauaaacuuacuucucaauguugaagcaccaggaggcaggucuucagaagaggggccaugugguuccucggaacuagaugcugcuaucuagcgguaugcuaguuauugugagagugggcgugucucgcucucauacaauucucucccaucacuugccuuuccguguucugcuaugagaugaugaugaaggcccuugcuccuagaugcgcccaaccucuauaacugugagccacauaaacuucucuuugugggcugcucgggcccaaacagcaccaggaccacuuaauggccucaggacauaugcuucucucuugcuaaugcaccagagaaaguguaaaccuguaauaucauauauaucauacgguaacaacacuccuuacaaguguggucaggcugcagacuugagaaccucuguagcaucuucuggcuaucaaaaggcucuccagccuaggaacaggcccugaaggccgccauccucauccaugaguucccacugccuccucaguugagcuggaccacagcaucuauugcuguugugauguggugaaaaacacaacaugguauuugagcauguguuacuuucacagcugcaucugacccaguuacauuguaaaaugccugugucuuugguacaggauggagaaggugggaaacaguuuguguuucccuucucaucccuaggguauccucaagguuguuguauaugaauucugauacacuugcaccuugauuagugcucuguggccgaguguugguucacucucaacauuacacaggaauguauauuguuucaaguucuucuauaggacccuuggggcagaaaggccagcaaacacaggaacguccagaagucucugcuguggccaugucugucacuguaguuaaggcaucugauacaucuggcuucuaucuccuaauugugagcagucuucacgccgcgugucuccuauacauuucucuucugagcugggacuccagaguggucuaggaucagaggauuucccaaaggaaguuugcacagcugugugugugcuggcaccugcaccuggcacaggggcuguguggcccaguucugcaguguauccaccucacagugccacugacaaaugaaccaacaucucaaacuguacucuuugcaaucuucagaggagccagaauuacccagaaucagucaagauguggugaugacaugugcagaugugcgcaucccagcguuguucuuaggacagggccugaggcuuccuuaaauuuuuagaagggguccauguggccacauaucuauaaguuuagagccaccagaccacagguucaaguuuccaugcccauaauaaaucucugauguugucacauugggucacuuaaaacugucauugugcaugagaugauuggaacugucacccuguuguuggugagagaucaggggucccugcccgcucugggcucacacauuggaaagaccaccuucagaauuuaauucucaccuuugaagucuuuuuuucuuggggaauuguaaaaagauucaaaacggggaugggggugggauggaaaucauccuguuuuucuguugccauggugaaacaacuugaggaagaacacuuuucuuuaauguuacacuuaaagguaguagccuaacacugagggacgucaggccaggaaaucaaggcaggaaccuggagcagagacuauaguguagaguagugggccuuagucucuaggggaucgaauaacccuuucacagaggucaccuaagaccuuggaagaccuauaacaguagcaagauuacaaugaugaaguagcacugugggucaccaaaacaugaagaacuguguuaaagggucacagcuuuaggaaguugagaagcacggcuguagagaaaggcugcuuaguggcuugcucacuccguuucugucuguucgucaucuugagucuuucgcaagaugaaggacggagcccacucuggcucauguccucauucaugucuuacuaacuuccuuaugcagacuaggaccaaugcccagggaaaacuucaauccuuggugagcugggcugcugggcccugccccaucaauuaucaguguagcuaauuccuuacgggcaugacaacaagccagcuugauggaaguaagucuucaguugagguuuccucuccccaaguagcucuagguuaugacaagguggcaagaaaaccuaagcaguaaggacaagauugcuuaagaaaaccaccuggauggaccaggaggcaacgcugcuucuucagcugaguuaacucugugagcuggaagaaucuccaguugcacuaggcggcucaugucccuuacuuucccagaucacuaagguagacgguaagcccuaccaccuuguuauuuucauuggggucuuauuuuccgccagguuacugcuaugguauggauacaguucgaguauaacccuguuacauuuugaauaugggcugaccuccguaggcucauguguuugaauacuugcucccuaacuguuugugcuauucaggaaggcuguggaaacuuugggggaccgagccuugauggaagcauaccuucagguuuaaaagccgagucccacuuuguguguagucucugcuuccugccccuguacacauugugaccagcuaucuugcacugucacugugcuauaccuuccuccucaggauggacuguauccuuucuuaaacugugagcuaaaauaagccauuccuccuuuaaguuacuucuuggucccaccagugauaaaaguagugugggaagcuugggccaggagugcgguugcuggugugaggaaacugaccaugccauucucaguaagccuugggaacagguuugcacggcagugcagggugaaauugggaccguguccuagaaaagccuaggcuguugucaucggagcuuaauggggcauuuuuguaggguuucagaagaucagaauacugacagaaaugugugcaauggaagucuaguuccugagacaccauuggggccugugcuggagacuagaaucugacuagcaucaucauuagcuaaauacuuagauuuuauagcucauauuuguguuccccauuuuuaaacuucaugcauaggggaaaaaguccaagauacccaaaacgggcuugcaaagaggacuucuauguggaaguuuccuguaucugcucaacccagaaugucccgucagguugccucccuggaagagggaguagggaaggcuuuggaggcuucugaggacaguucugcuguguguagaagaaugcauacuggggaagaguccugagcauagaaaacguucucaccccaaccaguacaccacaggaacaacaggcuggacccugcugcaagggacucaagaugaagagaauaguuuucccaaagaugcccagcucuggaugugguacuagauccggcugccaccuuucacaggacuugacccugugggugugauuauaagauuccugccucaacucuuagcucccccagacugauucagaguggaguugaaauaaccuugaaaguaacugucucuugccaauguacagagaugguaccacagggucuguguugccaagcagaaagaaaagagggcugcgaccagggcccccaguacgcauucccagcaggcuuccuuuaaaguuuaucuaauuguccucuccccuggcccuugaguaugcagggaggcacuggagagccaaugguccuugagcuacaucagggagaggguuuuccagagcaccauguagggauucacgucccagggagucucacaggccugcgcuccagagcugcgcaggaaccugccuuguaaaucgcaccgcuuucguggccacguucugguggaaaguucaucugggucucagccucgcgugaaauugcagagcugcggcuggaaagccagacaccuuuggggacuucccgagacaguggagucagaauugaguaaacucgaggggcacaauugacacacguuuugguguguggaagaagcuagauuuuagcuuguuuuuauugccuacuuuuucaggucaguguuuuuuuuuuuuuuuuuuaaagucagaagcaccaucauuuuuggcuuauaacgaucucuggaaacaucauuuaauaagaagccaccuuugugacucugguucuucucucaagcuuugucuuguagugugcagaacccagaguggcaugguaccucagcauggccaacaucuugacccuugugacacucggcagcugacuuacauacauggagauaugugcaaaaaugugcuaaaggucaaauaugugucccauguacaguaggugcagccaguaaguuagcacuucuguucucacaaaaaaaaaaaagcaggacugggugcagaacugggagccucuuguccaaaucagcugaccauucuguccugagucacggaggcagcauguuuccugauagacuuaggcccauauggagccuuggccaggccccuuccuuacaggaaaacagcggccagguuccuuguccuuuuugcaagguaguuucaacaugccuaccucacacaguagacaggagugguccugcccucggggcuagacauuuaggcccugugcaugcugacacugccucaggcccaguuuccuuugaggcgauuguguucccaugugacugcugcugguuccggagcgaaaggacacuacucuccagggugaacaaacacaacagccuggaagugcacacaggaaggcagagggcugcuacgucgguggcccuuugcuuaaccuggccauuuccagacucuucucucaauaaaguuagugucuuccucuuacguaguggugcacuuccucauguugugcugaccucauccauaaaauuauuuucgucacuacuucguaacucuaauuuuguguaaacuuguaaaaaucaaaguguaaacuugagauaugcaggguauucgauuugugaccccugugaaggagaccugugacccacaaagggcucaagacccacagguugagaaccauggcucuaaugggcauugacacguuugccuuguguguuacaacuccagugucuccuggucuuuguuugcacaggggcccucauuccugagguucacuccuucuuauuccucucucuuuccugcccuuccucuuuccacacagcuuguaccccucuuaauucacaccagucuuccugcaugguugcaauugcaagguuuggacauugccuucaggcacagcaucuugcuaucugcuugacauacuguuuguuuguuuguuuguuuguuuuuacuuuucucacucaucuucucuagggucaacuguucagauccacccaauccugucuucuagucaaacaaaacccaaggugugccuaguaaaguauuccgaccacgaucugauuuauucuucucucuccuuccaaagcaaggugacaaccccccuccccgccccagagauaacucuccagugacuuacaguaacccacacagguguuugcaugcuuacgucauucacugagcuuccugugacagucagccugucuucuccuuugagaggccauuuuuauauugccucucgugacaguggcuacuguucuuauccugccucuucuuccuugccacagaauagugagugucuugacaaauuugggggagaaggaaucacauggacuguucuuccacccaugcguucaccccaccuuggucuuucucaacucccguucuccuggguguguguuacagaucugacguuucuucucuuaaggcugggagaagccauuuuccacuuacuuacuuacacaguguugugauacggcaaagcaccguagccucgagccucuguugacacggaagcaggguaucaugugucuggauagccugcgacucagccucaggaucacuauagccugaaccaucuccgagcccaucaccucccuguccacagauccauggccaccaucuuguggagagcgugggucccagagaaccccuugcuggggucuguggucaaaugcucugugcacuuccccaguuguuuagguuccagccacaugugguggaucagagaauauaaauagaaggcgcuggagaugacagaccaggaggcagccaguccagcaugcguucuauaagcuaugcauuaucacacuggaaaaccgugcccugggcaguucagcuagguagcacaugcccacucuggaggcagcuuuucaaagaaggggccaaguagguagucccccucccugguuuuuuuguuuuuguuuuucccucugugaacuugcaagagcaacucauuccuuuccuuugacuauucauuuccaaauuaaauuaagcagauuaaguagaugugugcauugccucuugagacccaggcaggcugcccucagaauagccugcuuggcucucagcuguuguauagcauccugcgugcaggaacuggcugugaccugccuagguggccaccuuagaugugauccauuucccauacaucuccugacuuaauagggaccuagcugcauugucugauggcuuccugggaagcugugauuagaaaacauuuuuccauagcaaauccaagguguagcuauccagagaaauugggucuuucaaaauacuccuaguugguuagugaaacauuaguauuaaugacaaauuaauauuaauaucaauaucaguguugagcacguagccuuugggaagggaaaggaaaggcuccacgaaccagauuuaaguagccccacacgccuuccugggcggcagcauuuuucaucugaaagcguuuuuuuuguaacuccaaaacuuagauguaaaaaauucaacacaucgggaagaggcgucaacauuugaacuguggaugauuaaaccuuuaugacugaaguaauagguuuggcccugucuucccagcggagcagcaggcaggguccuuucuaguuugcaaagcgcaacuggcaaacacaguccagaccuguggguguggucggagggaugggguagcagcugcuaguguagaccuguggguguggucggagggacgggguagcagcugcuaguguagccagugcuuuugcuuggguuucugaguguuuucuguuucaucaaggcuuccuagugacguggaggcuggccgguguguaagcucaggcauuaggcuggcucagagcuguacuucaaagaugcgguucaggggaaggggugaacgucaccagcacuugccuggcucucgcccuuuguguggggacuuuggacacuuagcgacccuuccuuucagguuucccuagaggggcccccacaccaugcuggauccuaguguuaaauuccugguaggggucccuuauaauucucuuuaauaagguccucaauagacaggucuuugacgaugucaccgaggagccgucucccacgugaccuucaucuugaaaauaacaaguuggcauucaaaaucgucccaagcuucccaguagaucuuggacaagagauccacacucucacgacucccacggucacugcaguaaaaucagagucgauuuugucacagugguauauuacagacauggaaauuccccgcaguucagugguccgugaccagcagacauccccgugggccgacaauuaaucagacucugcugagccuuugacuggcgacaguugcacaugucaccucaugcgaaaaguuaaaccuagccuuccucuggaaggaaaaaaguuucuucucccuucuaaaacuguuaccuauucgucccaugacccaguauuccuaucagugaaucaggcauggugaggagagaauuaugacuagagaaaaaugcuaaggacaucccuuguccagcuguucagaagaacauguguccuccgaccuucaagugugaugagaccguugacagcucuggggccacaguaucuuaaguugacaggucugcccaaguagaccugugaagguucugggagauucacaaguugguugauggaccucugucugagcagauucagagacugugugcuugggaaguucagccugcagucugcacuggaaucaaaaugauggugggugccggugguacugaaguuaccacacaggguaacuagggacaacacgcucuguugucuuccccauuuccuccugccacccggcagccagaucauugcaacugggauacagagaaaggacaacauguuggaagagagccagagaagaguggccaggcuuccucuccugucacucaacccuggggugaacuuuuugcugugauuuacgugucuuucuggugucugcacggauuucuggguggccucagaaaugucacacacugcucaggguaugugugccaguguguuuuaugcauuuuuaccuuguaacucggagucaucuuccagaguguguggaaacugagguuuggcaggaaguauacaaagagggccuuuaaaucagugggcauugaaccaguaauauuuuauaaucuccccaaacccaguucuuagaaugcucacugaaacuuuagaauauguuugcaggcucacauaugcaggaaauggacgcaacuggaauucuugucacauauucauugcgcuaucagcugaaauuuuuuaagugacaagaaccaaaauaaucauuaauuuuuauagggcaaggaucuggcuuuuugucugacacaaagcuuuauaaaaaacugcuucugauuuuaugcacauuguuuuuaguuaaugauuuucagcuguuuguuguuccucugauagcaugaaaauguuccauaugcucagccaaaagacaaaugauuagcaaaugaaauuccggacagcugucugacugagcgcguuggguugauagcauucugcuaucauaauuagcuuaagcuuuggguuaauuaacuuucuaccuggauaugcauaauaauagccaacugcaaaaagcaaggagcuuucaguacaucaacaacauugcugucuuuuuuauuugguauuucaagagcauauuagaauuucaagagugauuaauccugggaauauugucaucuacuguagauuuuauuugcaagccagauaauacugaaacaauuggaaucuauuauggagcagaaauagcauuuuaaaauuguaauuaaaguuucuaaaagcaauugcuaauuucaaaugccuuuguuggcaagaauauuaggcacaccgccucuuguaugggcagcuuguugggcacaaaaaaauaccagcacuaaccccgcaaagcagcaaacuuuccuuuauuuaagugcuguauugaaaucaccaauuauuuuuauguaauuugaaacugagauuauugugucguuugaaaggugcugcuuaugcuaacgauugccggugauaacugcgcugugcuccgauggcuuccuuaucuuuguuaacugcgcuguggaaggcuggcaguggggugagugagguaccgggugcaccaucucauccgacugggagcgcaggaggucuggauuuuagaaagcagccggugcuaugcauuuguagcuugguauuuguuugcuacccaaagcaguuuauaaaucaauuuacugauuuuaugaaauggggagagaaauggcuuugucuccucccugcuccuugguugcgugauuuaccaaagcgcucucuaagaugcucaucaucuuaaaggggcugcucagggccuuuggagagcacaagcuagugaaguggauuguggauuugaaguaaaaauuguaguuuacauuuccccaagcaccagagagccuagcacuuaauucugaaauaagucaugccuguuguuacacucagaaaaaaaauauuuuaccuucugaaaaaaaaaauucuuugcauaugcaguggacagugaaggcuugguggcagcagaucugccugggcugcagaggguuccacuuccuuucaggaucagcgauggcuaaugugcgcuuucucagacguguggcugguggucagugugugggcucugaagcacccacucggucacuucaugcaaguuuuauagggcugucagaagccauuuuucaaaauuggcuucauuugcagacauacuggggcaucuacuugcucugugugguuccugaaagaggguccccuagggcucuguguacucugggggacccaacugaaccugguuagaagagagguacuccugaauguacccuaagucugcccugcacuuaggcugugaccaccaggccuucuagugcuuucuuucauagugguaucucuagccgucuccagugagacugacaaagacuuccuuuuuuuguuuagucuaccccaagcugcauaaucaaagauggcggcaauggaaucuaagagaagaugggaucuaaucagggcuuggguguggugcccuuaaauuuggggcccagcuucuccacuggguagcaaaccuaugauuaauucuacucuggccucugagaccuugugauguuuggcuaaauuaaacaugagcagauucaacaugcaaaucuugagcacguguuguuuuuaaacuaaaaaagaaaagcuguaaaagacaagaugugggaccucuggguaggugauauuuuaaguagcuuauuuuuucaguccuugaaaagaagaaaagaaaagacaacuccagaccccauuugggggcuacauuuacugacuauuuuaaaugccauuucaaacacguuguaaaguuaaugauauuauuucuuuaaaaaaaaaacguauucuacuauuugcggugcuugauuuuuaauuucuuuuaaugucaaaauuauuuauuuggcuuguuccauuccagaugugacuguggagggcacauuaauuuauauuccguuuucaugggccccuguccccaucuguacaucuuucugaauuccgucuuccccccagagaguucaccuauucauaguguagguuucauuugcuguguaaacagaauaaacagacaaugcaaggauucccuauaauaccagaaaauaauucuuuucaacaacacaguggaucauauuuaaaaaaaaccuggagaaugcacuccgugugugcagcuacauuucccgcuuuuauuguccucggggggagaggcuggcguuauggccacaugcuucccuuggauuugauaaguucauuuuuauuaaaaauacauccaaaacagcauuuuacagcaauccucgaacacguguuguggacauuucuuuguuuugccugugagcgugguccugaggccucacuucaaaugucuuacucaacuaguguguaugugugcaaacacacacacacacacacacacacacacacacacacacgcgcgcgcgcgagacuagccucccauuccaugaaaagcaacauuaaagaacggggauuuuuuuuucuuucugacauuuacaaauaaagagggacaugaguuauuuaugcuccacaguugcugcaaaguccuuaucuccgcguggcacuaaacaaggauuuguugugggauuugcaagggccgcgcagugcuuguguguuaagcacccaaaacucuaggggacuggcacuaauuuccucucucucguaaaacaacguaguauucauaacaacucaagaggcuugacauaaguaaugacggcaugugccggcgaagauuaccacccaacaguguaaucaaggugcuagguacuaaugcaaguuaaauugagacaauaaugcuggaacuugcacugugggauuaggaggguacuugaaaugcugacgugagcacaccccgccuuccuccugucugccuuuccguuccuguuuauacuuaaugaccucaaaauuuguaugucguuaacaccguguacugaagugggagagaacaugguuugggagggagaagacccccugucuucguugacuuuugucucuuuugguaauugguggcuuuuccugccauaccagggagcagcucgcucagcagugaggccccugaggucuccguaaacaugcugugggcaccaagugcuccgagccuggcgcugccgguaauuuacauacuuugaaugaaaagucauuugugccugcaaaauuguuauugcuggaacaaauuuaaauacuagucauauggaaauuugaaauaaagucauauuaaauuuugaugcucagaucaauauuguggagcccagguaauuaaaguggguuuguuuauuuggcuccuuauaaauaaaaagggcuuaauauagacuaauuacacagaaucuuucgucuacgguaggauaauaauggcagcaauuuaaagugauauuaaaugagaauuaauaaaggaauauugagucucuuugacuguauuaagcuguggagugauucuucauucccauuucacuuucugucgagcagagugauugauaagcagugggguuuuguggggugacacagaacaguauuugaaugcaguuuuucauuaauaauugugguacuuuugacuuuaucauguuuaaagagggucagaagugucccuucucacuugcaaguuuauggaaccauucagaggguacaggccagucuuuggugucagaggguccuaaguaaggcugcuuguguuggggggguguuguggcacccagagacaguucuaaacaauaaggaaauaauuuauuagagucuaggaaccugaaccaaacuuaaauugugggaaggaagagggcacuucugcucuugaaggaccauugaagaagauucccuaagagggauaaguguguacgugcaggugugcaagcauauugugugggccuguauacauaauuguguguguguguguguguguuccuaaguuuagaucccuugcacccuugugaaaagucaggcacaguaguacaaaccucuaaucccagcacuggggaggcagagacaagaggauucugggagcuugccagccagccagucuagcugaaucacuguauuauucuagggucagugagaagcccugucuuaaaacuaagguagaagggcugcagagguagcuagcaguuaagugauugcuacucuuucagaggacuuaaauuugguucccggcauccacauuaggugacucacaauugccuauaaacucagcuucggggaaucugacaccuucuccaugcuuguccacaugugugcuggggucacagugaauugucccauugcguuuuaacuuaagggccgguuacuuugugcaugaauagcaucugaaaaggucuuuucguguucugucucugacccuaagcaguuucaggagccuuccgggccagugcccaggcugugaccauuaaguaacuugcagguggguuaccugcugccaccagggugucuguauuuugcuuuguuuccagagcaaggcguguaauuuccuccccagugugccgcacagcaugucacauccacguuagcaugucuacccuuuuaaaggguccugcugaaggccaagaccuugcgccgaacacccuuuuuauauauauuacaaauugcuggaauuguucauuaauuucugccuuugaaaugucauguugaaccucuaaaggaauucacaaugccagugucccuuggacagcuucucaccaugguccagugcgaauuucugaugaaauuacaggugcagggaaaugcagaauuagaaauauaucugauguugcaguacuggugaagcuauagcuuuguugaugacaggacaauuccauuuuugacaguuuaauuuacuguugccaguggacaagagcaagaggagagugugggguuagccaccugccccuugugccguguuucacacacgagguugcaaaaucauggcucccucaaccugucgggcucaaaugagaagguuuucagcugggaaaauggaauauaugagugcauguaauauugccugaccucauaaaacaaaaaggaaaauugcagauucugacagccauuaugaaucuuguaucagcaucuagaacgacucggagccgggguacaguacauguuuauaauagaaaaaaaacaggguugccacguugacucgcaauacgggacgaaaaaaugacuugucaguaauucguucucagauguuaaagaggcuguugaauuuacuaguauauacacagaagaauguuuagcccggagcagaguguggaauagucucuacacagaggggccugcucaaguuagucauacauggaguugggcuguaauggaagguagacagggagaaaucccgaguuagcugggcggcugugucgguggagcagauuucucauuauaagauguacuccagcccuuuuccccucacccaggguaaauguauaaauaauaagacgucucaaauaaagcaagcaacacggcuuugaaauucuaagaccggcuuggacugagugcauucuguuggaaagcugguguaccaaggcaugccuuuuuaucuuacguuuaaaauguuuuauuuguauuaaaaacaaggcuuaaucuccuugaguuuaauuugaugcacuccaauuuagcauuucugcuuaauagucugcuccuucaccuucuugcccauuucuuuauguuauuccuuaaacacauucuuaagugugguaauuaccucagccguuuuugcuaauucuuaaauggggaaugugggaucauucugcaggcaagaggagugagacuccuuccaccuucuucaaccaugcuguguguagaauccagagacuucuuugaucucacuugccaucuguguguagugaguggccgccaaucuaagugaagugcagccugcuuaacgaacacggugucccuguggggugcacacuugaucauuggcugcugguggcuagaagaagcuguguccucagcacgcuuagugucuaggccuucucagggcagguguggcugagagaugcugagcagcugacagaaggacagaguugugcugaaaugguaguguuagccccgaccagaggugacucucagaaacaaguaagaugcauggucuggggauacuguggcacucuuaugccacucccuuuucugugcagauuaacuggaugauggcaugugugugauaauggugugugugugugaugauagaguguguguguguguauugcuaaaacaagagcacugcucugcccucagcaagccuuaugauuguggcaggagcaccaggcugcuugagggucaaagcacuugacggguguuuccauuuaucaccaggguuagaucugagcucggaaaucauauuggaaguacacacugagugagguacggacuggccaucaggagagugaaaugccacaucacuaugccuggagacuggccaccaaaggcagcaugcuugaggaagacugggaagcugauggcaaccuaacaggaaaacaaagacucagagacucugagggacuuugguuugcuuugggguuugaaaagcaaagaaaaggcauggaaagaaagccacaggcagauccuggcaccugccacauacauguuuucuugacacacagauugccagugaauucuccaguaguagguucuuauccagugauacaaccucuagucuugguauaacauucuuugaaaauggagacugugcuaggcagugguggcgcaugccuuuaauccuaguacuugggaggcagaggcaggcggauuucugaguuugaggccagucuggucuauagaguggguuccaggacagccagggcuauacagagaaacccugucucgaaaaacaaacaaacaaaaaaagacaaaaaaaggaaggaaggaaggaaggaaggaaggaaggaaggaagaaagaaagaaagaaagaaagaaagaaagaaagaaagaaagaaagaggaaaagaaagaaagaaaaagaaaguggaagauauuuuaaaauauuuaacguuagaacaugcugauugauuuuuuuaagacagugugaucucgucaaaguaucucuucaguguccauaacuggucaccauugauugccacacuaaagccagggagaccuuacgaaaggcugcuggccccuauggccaccuggcucaagguacucuucuugucucuguaagccgccucccuuucccucggucuccgcccacaccacgccucucuccuggcuguuccuuaggcuugucagguaugucccacccgugcuaugcuugccuuguacccggcuguccauguggcugcuccgucaucacccaugugcauuccccuuuauguccccacucugcgucucacugccuagcacagggggcugucugucagcagcgcugaggcuaaccacugcuuugugaacaugggucuguuggaacgcagccaugaacacuugaucgcacguggacacgcuuuguuccaaagucagacugagagaguugcaacaagacagugugacccgaaaaccugaagccuuguguggacgauguugcccuuucggaaacacucgcaaagccucagacuggcaugcaacaucuugauucauuugcuucuguuccauuagacuacggucucuagggagaaugagucuuuggcagauucacugcugcauugagggcccacagcaguguacuggcacaaaguagguccucaggaaauauuuacaugucaugugcacagcaugaauugaugcaccaaaucaaagaagccaagggguacaugcucccuggaaacaggcuguuguauagagcugcauguaugugaggguuuaguccucaguugauaccaggaacacacagcauggcuagacuggagaaaauugagccuuuuaugguaugugggcuacagcugagguguuugccuguccugcacagagcuuugcuacuggagggagcuuuagaaacaucccaaagggauaugaggaggcugggcuuacuguccccauggcagcccagccaugaacaaggguggagcugcugucagcccagagaccggauaugaaguacaggcccuggaaaguuuuggcagguaccacuggauauuaaauuaaaguaguuuccaaucuuuuuauauuccaggaggccggagaaugccaguuaguucauggagaguaacagugagccucuaucaaagucuccuuuucucuguagcugucuuagaggacaucagcagcuacuguaagcagccaugcugagggcuuguucugugccugucagagcuguaguagcaucugauaacagggcuuggugugugcacugcacauacggcuguuacuguagcugagugaagacaucguggacauggcccaucuaaaacauuacauuuuguuuaaccacgcugcacacuaugugagaauguuggggugagcaggaccagccaggugagcggguuugcuuuagaagauacagaugggauagaucugucucuaauuaggucuaauuaggucuaguggggaagcugagggaggucucugggaucuguuagaagucucucagaguauccugguaaguccagaugcuccauguaugucaaaaugaacauggugcaaacaggagaggugguuucaggaucucaugguuauccuuggauuaguguggacuuggucucagugggcccuauccugggcagguuacccauccucaaguuuccacaauaguguguuucucaaccugugggacaugaccccuuugaggggaguucagacgacccucucacagggcucacauaccagauuuuacauuacaauucauaacaguagcaaaacuacagucauggcguagaaauaaaaauaauuuuaugguugugggggggucauaucaacaugagaaaguguauuaaaauguugcagcaguaggaagguugagaaugacugcuguagagcaucucucugaggggcaagccugugucugacugaucuuaaccucucugugucugagaagguugccucccucuuaggugucauuccagagcauuccguguaggaagguccagucuccugcucagauauauauguauucucgaccuccauaaacuauucguauuuguuuuaauuuaaaggguccaagaugucucucucacagccaucuucaggggagacgcugccaugggcccacgugucccauugcccuggacauugucaagcaacucuccagccuugcugggcaucagauaauuccucagcacaaaucuagacuccugccugguaguuguuucuuccuagauaccuggauacucuuuaugcaggaggaaacacugcagugggauggaugaaucagcaucccggcucugcugauucacagugaauacaugguuauuuccaaagaauugacucuuagcuauaguaagugggcagcuuccuggcauucaccacauuuauuuggucuuauaaaccaucacuuaggagugcuccaucccaagccaagaccauccacauuaaauaucaacucugccuucuccagccccgccccccacccccugccccacaucacucagcccucugagucugcccugucugggaaccucaacuaagugggaugauauagucuuaauucaccggcacaauguucagcagguccauuuaugucucagcaggucucuucauucucuuuguuugucaggcucuaucagcgccauccuuuggaagguauuuuccaggugaggagucuguccuggauccuguucugcagguacagugcagacacguggccuggugucuauagugaccaugugcaguuuccaagcauggauacuggcugugcugccagaacccagaucccugcaggguccccaugcuggccacggcaucuuugugugcaguugucaagaguacgagcccaggucugacaugcacguguggcuaguuuuucccucaaagaucagcagccuuggacagcuuccguuucucuggcagccguuucagccugcucugucuugucauuuuagaguucaauaucugcugcucugaaggagugaaaaauggggaugggcuggaccauuguacuuggucuuuugacccuccguguugcccaugagcagugaaggauaacuuuugacgagccaugucagcugugacaggcaaucucguuggguugaguggaaaugugcuguacaaguuugaagccuuggugggggcauuuuucugguguucaaugcauuuaaauugacacgaggauacaguguguuguucauuccaggccaugcuggaggcucaggccuuagccacguggcaagggggacuucuggauccggcccagcacugcgcugcauuuucucuugcuccguuuaugcccaacuuugggugcuguuucucccccaccucugucugaaaccucacaugugauuauguuuaaugcuuucaguugagaaggaaugugaguguacaagaaagagagagcuuuuagggcgugguggggaggggagaagagaguuugauuaaggccaggaagaagaaaauggucacguuucuugucuuuuaacccgagcaacauuuucuacccgagacugaaaggucugcauugacagcugugauuuccagggaaagccauuucccaguuguuucgaauuccuagaaauuagguuugguccaauuucauuguuaaaggggaaaguaucagcuggcaggagcugucacucacucccaccugugccccaccccuguccugcccugcccugcccccaccaccccagguuugaagguggagagccgucugucgggggggggggggggggggggggcagggaggcugcuguuuucuccucugccuucacacuguucuugcuggggaccugaaugcugauuucaucccgaucccugaacuugcagugaggagcuuauaucagcugagagguggcuggcagucucccagggcagcaagucccuaccuaucaucugcuucuuuuccuuaggaaaucccauuuggcuuuauaucagcgugcccagcuuucugggaacacuuuugagcugaaagguguucuucaaccucacuuccacccaucccacccccuaccccuguuuacgcagcccuguguguguccuguguguucaccugcaggcaggcauaguuugacugucagugucccaggacagacacacuguuguaaggugagagaagcuucuuuggggcuucagcuccagcacugaagcauaauuugggcuuuagagauccagucauuugugugaggggagggaccacugcgacaguauuagggacaggaaaaaaaggaagaggaggaagaggcgacgaaaggaggggaaggaagaaggaauuuaaaaaauuuguucaauucuuauauucauauucuuucuuacccuaaaaauaucauuaaugaacauuuaguaccauccauaacugaggauccuauaucuaacguugaauaccaaauuguuucaaaacauauaaaauauucuuugggaauuaagcauaguaaaagagcauaaaauauuaaaaaugaaucauuaagaaauauauucgaaagcccuuauaugauaccaccugacauagugagagaguauugaaaacauauaucuguguauauucucuaaguuuacuuuaaaaagaucuguguuucuaggggagaaauuauuuuaucaguaaguauauuuaaaauuuuucaaaauagcaaaaacucuuugaaguuaaacaugaagaaaaugcuaauuucaagcacagugagaaaaauuaucaauaauauuuccaugauguuuguagaacaugauuuuaauauuuucaacuguuuauauucaacaaacagaauaauuauuuuaagauauauuucguuguugugucucccuuuucauuucuaauuguauuuauuuggaaacugucuuugugcccccugguuagucuggcuaaggguuugucuaucuuauugauuuucucaaagaaccagcucuugguuuuguugauucuuuguauaauucuuguuucuauuugguugauuucagcccugagcuugacuauuucuugcugucuacuccucuugggugaauuugcuucuuuugguucuagagcuuucaggugugcugucaagcugcugguguaagcucucuccaguuucuuugugaaggcacucagagcuaugagguuuccucuuacuacugcuuucauugugucccauaaguuuugguaugaugugucuucauuuucauuaauuucuaaaaacccuuuaauuuuuuuauuucuuccuugaccaaguuaucauugaguagaguguuguucagcuuccauguguaugugugcuuuccauuguuuuuguugguauuuaagaccagccuuaguccauggugcucugauagggugcaugggauucuuguaccuguugaggccuguuuugugaccaauuauauggucaauuuuggagaagauacaauaaggugccgagaagaagguauguucuuugcuuuagggugaaauguucuauagauaucuguuagauccauuugguucauaacuucuguuaguuucacugugucucuguuuaguuccuguuucuaugauguguccauugcugagaguaguguguugaagucucccacuauuauuuuguaucuuuuuugauaacuuuugguuaaaaguugauuuuauuugauauuagaguggcuacuccagcuuguuucuugggaccauuugcuuggaaaauuguuuuccaaccuuuuacucugauguaguaucugccuuugucacugagguguguuuccugcaugcagcaaaaugcugggucuuguuuauguauccagucuguuagucuaugucuuuuuauugggaaauugaguccauugauguuaagagauauuaagggaaagugauuguuacuuccugucauuuuuguuguuagagguggaauuauguuuguguggcuaucuucuuuugaguuaguugaaagauuacuuucuugcuuuuuuuccuagggucuagcuucccuccuuguguugguguuuuccaucuauuauccucuauagggcuggauuuauggaaagcuauuguuaaauuugguuuugucaugaaauaucuuguuuucuccaucuaauuggggaguuuuacuggguuuaguagccugagcuggcauuuguguucucugggggucuguaugacaucugcccaggaugcuuucauaaucucuugugagaagucugguguaauucugauaggucugccuuuauauguuauuuaccuuuuuuccuuacugcuuuuaauauucuuucuuuguuuagugcauuugguguuuugauuauuaugugaagggaggaauuucuuuucugguccagucuauuuagaguucuguaggcuucuuguauguucauaagcaucucucucuuuagguuagggaaguuuucuucuauacuuuuguugaaguuauuuacuggcccuuuaaguuuggaaucuuugcucucuucuauaccuauuauccuuagguuuggucuucucauuguguccuagauuuccuggauguuuuggauuaggagcuauuagcauuuugcauuuucuuugacuguugugucaauguuuucuacugcaucuucugccccugcgauucuuucuucuaucucuuguauucuguucaugaugcuugcaucuauagcuccuguucucuuuccuagguuuucuaacuccaggguugucucccuuugugauuucuuuauuguuucuauuuccauuuuuagauucuggauagauuuguucacuuccaucaccuguuugauuguauguuccuguaauucuuuaagggauuuuuguguuuccucuuuaaaggcuucuagcuguuuaccuguguucuccuauauuucuuuaugggagcuguguccuuaaaguccuucuuaaaguacucuauaaucaucaugagaagugauuuuagauccaaaucuugcuuuuccaaugugaugguguauccaggacuugcuaagugggagaguugcauucuggugaugccaaguaaccuugguuuuuguugcuuaugaucuuaugcuugccucccgccaucucauuaucucuagugcugucugcccucacuauaucugacuggagccuguucuuucugugauccugguugugucagaacuccucagaauucggcugucucugugacccugggauucugggacccugagauccuggcgugaccaagauucuggaaucccagguuugcuagagcgccugggaguggagcuucuuccuucaucuccucucccuccucuaccuaccugcaguucucuuucucuccaguauuguggauuuaucauacucagggccaugcauaugcuaaauaaucaguuaaccauugcgugaacuacaucuccaccccuuuugguuucuacugaaauguuuguguguuuuugccuuugaaucugucaugggaaauuacuagcuauuuuccaguguuuaagcaaaucuuacaugccugugauaaguguacagaaacaaagucaugaguuuguauaugcaugauucuauaugcagagaaauaaugcauauguaaugauguaauguugcugugccuaugaaaauaucuuaagaauuacuuuuguucagaaggaacauugguauacaguuuucuugugacgucuuuuauggacuuuauucagggucaugcugaccucagugccgugagauaaucucccuauuauuguccuucccucucucugucacuccuucccuccugccguccuauauccccccccuucuuuuauucuuccucccucuguugcuuuuauuuuuagccuaaauauuugauggcaucuauuguuuucuuuguaacaguuuuguuacuuauucaacuuaaagauagauacaguaucugcuucuucguaacuugaguuugggugcuugucuuuuccuuccugguguacuauuuccuuccugguguacuauuuccuuccugguguacuauuuccuuccugguguacuauuuccuuccugguguacuauuuccuuccugguguacuauuuccuuccugguguacuauuuccuuccugguguacuauuuccuuccugguguacuauuucucuaucucuguccuuccacaucauuccuguugagguuucaccaucuucucacuuccaacaacagggcuuugcuucuguggagucucuugugcuauuuucaguuuucuguuuuauucauucacauuucuuacuguuuuccccccucuauaauuuauccuguucuaacuuucuaccguagaagcuuuggucauuguuuugaacuuguuuagugauauaaaucuugaaaccuauaaauuaacccccacguuguggccacagacacaucccacaggugcuguuugugguuauucauaacuuugauguauuuuauacccccugcuuuccaucacgauuucugccuucaccuauggaguuaucugacuggucagugugggccaugcuagcaggugcccugugcacauuuguagagcacccccucugcuguugaguuccgcccuccacaguugccugggaucaaguugcugggauucuuugccuggguuucucauguuuucuccaaccucccuucucuuuccacguuugaucgaucacgcucucauagaagggguggguuugucguccucuauuuuuuuaagaaucuauaugugucugagugcuuugccuguguguguguguguguguguguguguguguguguguauucagaggacaggugagagucaguacucuccuuccaccuguuggauuuaagggauugaauucagaguauccucagccuuggccacaggugccuuaccacugagccaucuugcuggucucauucuuuugcuuuuuuuuuuuuuuaaguguuguacugauauagaacuaccuggaaugcuggcaccugccuuucauuugagaugccgugcucaauucacccauaccuguguagaccguagcucaccauguuguacacugcauuccauuucugccuuuuauucucuguucccuccauuccgauuucccuggugcccuuuucauuugagugacaucuugcugauccacuuuggcacuucugugacuuuagaucuaccuuuguugugaauccuuggacgaugucaucaccacccacaaggccugguggugaugaagugacccaugucuacacuguccaggagggaagcaucuggccauguguggcucugaagcaccggauaugugccuggcagaagugagcgaaaugggcacugcauuacuuuccauucagauaaucaagaguaaacauccaguggggaguggcuguugccacguugcaaagugggacuuggagcauuucuaauacucaucaaugacugcacaugaaggaagacucccagagcuguggucagugcuuucacgugcccuucccuguccuucauccaccaaugcuguguguucaccucugugucagacuccacgauguauuauuuacuucagguuguuuauuaauaauuuaaaauaaaauugagauugagcaaaaucuuccuuaacccauuucaucuucggagucuauuagaaggccaccagaggcuguaguggacuuagugggaugaccuguggcauugaugaguaacuggggugacagggcagauggggggcuccgggaggagugugagugugcgagaggucagauuugucuucuuagaagugcaguuagcucguguuacccugacuguccaugagaugcccucuggcuguuggcugaaguacccacauuuucacaccaccuuuuauccagucugauuuucaaaaacuacugcagacacuaaaaaucaggcccucauaccuaaguugaauuagaaaauaucgauuuccugugagucuugaaaagcgccaugcacaggaggaaagcugucugucuagaauuuguaaucuauuaagcaggaaggcaaaccacaaugucaaguugauuauuuuuaugugcccucguauuuauccauuaucccuuaaagagggugguuuguuuuacagccuuugauuaggcgcagugguuuaucauguagauucacuuaauuuccccguuugguccucaauggcaugaggugaugaaaguuuccuagcuuggucuucaguuucacucugagagagaacugcagggcucauugguggcuucugaauggggggagcucugcugcugccucagacuguucagccugggcggcugucgccugcacaccguuucccugcuucgguauuuaagcagaaacuggcucagcucugggagccuaagaagcccuucucuggucagaggauuaccuccguuuugaaguccagaacgugacucuggaaucugauuuuuuguugucagcugcuguggaugaugaaugguagaacacaaugcauccugcuugugcacugcuggcuggauggcaaaguaaaugacagaaaagacagaggacaucagcgcaugccuggacgggucagagauauucaggauauuuaaaauccuugcugacaaauucgauacuguagauaaaugagagggaauucccuuucaaguauggauaaccaacuuucaagacacugagaguuaaacaucuuccuuuuaagagaaacccaggcccguguguugaguucugucagacggugaaggacaaggagcacccagggaagauuugcuuagcagcuucguuuccaaaaccagcugcuccacgaucaagcaaggacgcagaagaaaugaaaacugccacaagugcuguaugagccugggugagcucuggccugucaguuccacgguaaagaacaugccagaagugcaccccugaaucugaaccucagaaggccaguguggggccagcacuugcuccacaagcacaaggacuugaguucaaaucccaagcacucaauuaaagaagccaaacauggcuguguguaucugaaccccuggcauuagguuguggggaggauacagaggcaagcagaucucaagagcucgcuggcaagccagccugguuuaaauggagagcuuccaguuuagcgagagagcuagucucagagaaauaaggcaaaggugaaggaagauuccagaucccaggcucucaguguaggcaugaaggcauaaacacccacucauuuacaugcaugcaccaaacauguaacucacagaaaaaucacacacacacacacgugucauucuccauguuugcagaauaagagguaaaucuguuauuaucucauacaugugcacagugacacucauuagaaaacaccccauuccaguaguuaacagguagaaggcagucacacaggagugaucuucagaaacucccucugugcggugaucgaucgcagacaugugccuguggccuaagugaacacguguauucuucccuccaucucuccuccaguauuaaucaaagcaacuguccuauaucagaccugcggcaugguuuccugggaaagguuauuccuaguccuuucuccaaauccuuccaaaguugugagguuugcagucaguucagaucauugcccaucuuucuguccuaacugauaucucaccacaccaacaucccuuuccucccaacucccagguaugccugaagcuugcuaugcugguaccaggauguagcaggaauccuuuggucaaggggagacucugugcuacaugccagacaauagcaacuacuugugguggaagcuagauagccugccacccugccuuaucugggccuagguguucugagcauaaaggaugccuccccagcuuuugcuucuaaguugguuagaaaguuaggagcugcaagaggacagccuugagucauguguuucaacuguuuuauguucuguguuucuggugagaaaccccugcacaccugcaagcuauuguuccucgaccccacuguggcuaagaagggcauagacuuuauugucacuaagcaaagaugggcaaaguugucauguguguuacauucuugaagaagcaagugcagcaggacuuguaugggcuucuguagugugugacaaguugagaagaauauguauugcuuuuaaaggggaccuuugugcccccucuggccccugccuggaugucuuggccuuaucugggccuccccugccuccuggugaauuccugagcuggacccuuagacagcaccauagcacacccaccaccccauuuuaacccucuuccauuaucugucuaacugugccuugccccaugugaaaagccaaacuggagacacccugauucuggcugcaugaacccaacagccaccugguccaccacuuguaucugaugcgugucugcguugugggggccugcagaaugcuaaccugcaugcccauucuccugaucugggaaguuuuugauguggucaguuauggggcacagcaguguuucaguggguauucuggggugcuuaccccaccugauuuaacuugcauccacauccagaugccccguggcuccgggagcugaggacugugcuucacggauucuugguucaggacuuaacagacugugugaaggacugcacuuauuguaaggugguacaugugguuuucaacaggcauaaaaaccugcuucucaggauagaaucguuagcccaguaaagccacauccauuggagaugcucuaagagcucuuuuuuuguuuguuuguuuuuucgagacagaguuucucuguuuagcccuggcuguccuggaacucacuuuguaaaccaggcuggccuugaacucagaaauccaccugccucugccccucugccccucugccccucugccccucugccccucugccccucugccuccugagugcugggauuaaaggcuugcaccaccacgccuggcugcucugagaacucuugaccaccuuaccccucuagcacaccgcaggaugugcuuucucuccuguuaggcagggcaguacuguggcaggaaugagguugggcucccucggccccuccucucagaaggccccaagugcuguccacucuguccucugaguggugguggcagugauugccccuccucauauccucagcuguggaggaugucaggguagcuuucaugggcuccaccgcagcuuagucaaacuuugccuguuacagagccagagguccacccucauaucccuuggcugauauccuagaugguauccuagaugguauccuagaugauauccuagaugauauccuagaugggccauguuggauaugaggccaugcuuaaagacucuggcgacuguuucuauuggguaaaggugcccuaacauguggccuccuuuauugaaacaacauaaccaaaaacucgcagaauaaagcagaaucugcuccagccccucccccagagcaccaaaugcagcacauuuugcagccaagaauucagugucucacccccaguuguaugcucugagugacccuuuguguucuuggugugggucuuuguuuuuaauaucuucauccagcucugggcccgugacaccuggcacuguguaucaggagaacccugugcacccaaggucuuuacaaagcucccugccacggugccauguaaaaccaucaccuuccugcuagccuguuagugcuucuccagugccucauguuuugcugugguacaaacgccugcucccuuuccgcugaguuaucgcucgcauguauuccacacacacuugacugucauuuaaggguuuacuuuauucccacagccaagaggaaauacaaggagauucuauaaugugauagugggccgugggcucuguucggagcaggugcugggaggagguuacauagcugcugucuccucugugugcagacuucuugucacuucagaguuagcaucgcuuggaaguuacugggccaggugauacucagcaaugaguccacuucagacuugguuuuauuucgauucuauccagggauuaauaaucacuagcauccuaugaaugaagagucuugcucucuguacagauaaaaaugucaccuuaaaagacguuugagaugcuuugggguauuuucuagguaaggugccuuuuuaaaaauuuaguuaauugguguguguguguguguguguguacauguguacauguguacacguaugugguaguuagaagaccauaacccaugugggucccagggaucaaaccccagugaucaggcuuggcaguaagcaccuucacuugcugauuugaggugaugccccaccucucuucugauuuucuggcuuuucagaaaaaaugcaaaccaugauggaaccaggaguucaucaucuuuaggagccggacuccgcuuucucauaaaggaccauaggcaaucauagaaauaaccagaauccaaagauacuuccuaaggcucauuuccuacuugaccccagccccaguacacacauucccuuccagggcacaccagaacccacauuuuugcacgcugcucuccugcagaccucugugagccugcaucuccccaugugucaaauacucacugagcauauauccuggauuugaggccauuccgccaguacugguccucacuccacaucauccuucuggccuucaacuacuagguuuccccauugaugggacccuguuuugaagauccagugcauucuucaggguuacuaggaccaguuacccaucuaugaacgugcccuguaaacccugagugcuucaugauuucagaccauggaaaaaaauguucuaaguauuggucugggcagagauguguugcuucacuggaaaucuuagugccauggucugguaaaauguacauagagucaagaugauuucuguaggccgcgggaagcauuguaaaugucguucugugacaguacacuguaggcuguccagauggagggagaagucuuacacaugaggcuuuccuucaagucugucucuggggaagggauggaguccaaaucuuguguaaggauacaggcacugacagugaccgacauugucugugaacagugucacccccuucuucuucuguaggcauaguuaaaucagcugguguuucugccauagcccacuccugaucucggcucagcccaagggccugaggucugugacucagaagcacagugcaagaacucacagguaggcucugccuggcuuugaggcuugaaaaaggaagauauggugagccggauagaagugguucucuuggguuugucuuggguaauuccaccugacccucuuugggguccagaagacuuaaagagcguaaguguggcuggugauuggcucuggccacagagaugcuaagcagcaucucacaaaacugucauauggauguccgcaucuaaccagaccuggugacccaugauugucaucaggagaagaagugcagcaaguuuggggguagccugggcuacagagugagacccugucauaucccuuaccccacacccauacacacacuggaagaagaugccucguaagauuggugagaggugacaagguuuggcgagugugcucuuugucucucagucucagcaugucuccugucugcauccaccuucugugugcaccagguacccaacauacuuaguuaaucugagauucucucaacaucuuacccccucaggagcaacagguaccuggcgcugguguuguccguccagaugaaagggccuggccacucugauuccaccucucuuugaucucucugcagaaggucggcuugucugccuggagauuccucugaagggcaauuuaaaaguuggauuugagcaacaucaagugaaaugucuucccaucucaugccgugaggagcucuuugguguaguucauggcuggcuaugcaggaagauguuaacccuuccuuggcaacaaacugucuugcaggccgugcuugcuugcuucuuucagagggaacucaaaauaucccaguccuaggaagcuucucagaccuggaggaugaguuacugccuugcuuacgauucauccugagacccacuugucucuaccucguuagugucugggaaaaggggaacaccuggguuaugggcaaagccaguggaaaugacagaaaucaagaaaggguucuauuggcugagccauccauuagcccaagguguggcgaucaauauaaucaccuguuuugaacagugcacaagccagggcugcuaaauagcguugccaggcagaaguggugaagagcguagugauuuuguuuguuuuucaguugcuggaauggcucauucugagaagagugaccaggcggcuucugauaguguacauuuaaagaaaaaccauucaccccaggcuuuguugcuugauuuuguaauguuguagaaaagcacuuuguuguucccaagucuaggucucuguguuuuauucuuaagaggaaggccaagugcuuuggggccucagaccuccuugguaccacgggagcucaagaugacaugggggauggggguggggacguuccaccccuuuugcuuguuucuuuuuguuucucucagguacaaaaagggaaacagugacuuugcuuauagcauugaaugaucucaucuuuacaucaucucuauauuaugugaucucauaucauagaggaguuugcaacucagcugggacagucuggccuaagacagacauggcccccauuggagguagcagugggaggaggguuuagcuguugcccgugcugcaguaaagagcauggugcacagagcagagugggggggggaugaacagaaggcacaguuuacauacccuauagauccuaagcacucgaggcuguuuaaaaauggguuauagauuacugcuuuccuccuauucacuuuuguagcuguaagaaaaauaccagaccaaaagugacuuugggggauaaaggguuuaugugacuuauaauuucagguuaguuuaucacugaggggaagucaaggcaggcaggaaucaaguagcuagucacaaaacaucuguacccuugcugugugcuugaucucagcgagggguggucccucuuucauggugcuagguagaaccuuugucuagagaauagagcuacccacaauaggcuggugcuucacauaucaacaaugaagaaaauaccccacagacacucucaagccaaccugccuuaggcaagcccucauuuagacuguaauucucuauaauucuagcuuggguuugcgcggacuggucaugcuaaccagcacauuugcauggauguuuugauaaacugugagauuaucuaagguccucuuguuugaaaugggaaaguacaaggagaaugaagacaauuuacuuucuugucauggacauaacuuauggagacuuuauugguccugcuucgucuuuuauugucacaacucacuaaauucuaccucugugaauagacccuuauguguacauuguggcguggugggccucuuuacacaacacaaaugaauuggguuuuuaaaauuuuuacuuaaauguguuuauacauuuagauuauauucuuuucuucucccaacuccuuccagguucuccccaccucccuaaacccucauuuuuuucucuuucaauaaagacacacaaaagcccccccaaucuauaagaaaaacauaaaacauagugaaaguccccccaacacacauacauacauacaacaccacuaccaccaauaacaacaacaacaacauggagugcuuuuguguuuguauuagccagaugcuccuguguuugagaccugcccugaaggaugggugauagaccuacccagugacaauacaguaaaaacgagccugauuuccccuuucccagcaaguaucaauucaaaaagacccaugguuuagggguacuauaugugcuguguuuugucugguuugaaucccuugcaggucuugugugacacaaagacuuaugucacagccucucugaggaguugauguguguuaucaugccucuuuugacuagaagaccguuuccuuaguacccuccaccaccucuagcucuuaaaaucuuucugccucucuuucuacagggauuccuugagucuugagggaaagguuugaugaaaacacugaggcacugagugcucagaagucucucacucugugcacaucguccagucccaccaugaauuguaacacacuguuaaaugccuucccuggcuguuggcuggcagccuuaaaaauguaccaucaucuauuuacuguucccuaagaccuugggauuacuugagacaguccuacuuguagucuuggcucuuccagaaugcauuauggcuauuggacuaaccucagacuuacagcaaaauucuugccucugguuccugagugcuaggauuacagguuugggcccaucauucccagguuuaaaauuuuucucuuuuguuuucuuucauuuuguuuucaaguuuucaagacaggguuucuccauguagcccuggcuguccuguaacauguucuguagaucaggcuggucucaaacucagaaaucugauugccucuauuuccugaaugcugggguuaaaugugugcuccaccacccccuggcuauaauuuuacuuguaauaacaccaaaucuggcugguaugcugucucaaaagaagcugccagggucagugggugggauaaaguccuuucuaaugcuguuccugucagugcuugaagccauaaccgugcccaguggggaagagucaucugugucacaaaagaagaaacugaggcucagaaugaguaaaguguauuuugaaacagaacccucuucaguaagacuagaagcacaggauaggucaggaagcugauuucuuauuuuaugcagugcaaacuuaugugcagggagcaccaggcccucuguuggcucugggaguaaaacacaaugaaaguccuugggaaauguuugguucuuuagggucucagcuuaagguuuguuagaauaggugcucagugacuuagcuuggccaguccugcugcugggagcaggcuugaucucagccacauagucauggcuccauuguccccacagacagagcuuuucaauccagauacuccccugcuguggaugugaacauguguaucugcuaaguggauacagagaccugccaaggagcuuugcagccuccucacuaagaagcaucucucucuucaggcaucuggucuaccgacugugccugagccgcucaggcucccuguacuggaagcuccugccucccacaucccccagugcacaccccgugggagcccucaggggggccuuaggucccuggcaucucgcacccucccuucccugcugcguuuuguuugccugugucuugugaaccauuguugaguuuaccuguuuuuuucucucuggcauuaggugggaacuggaauccuauggccaauacuccuucuuucuuggaaggagaaguacacuuggaugcuuuucaaaaacaaaauuaagauaugauuuaauuuaugguuguguuuuuacaguauuuucaugcaguuauaaaaagaaguuugcuuggcccugaacuuuccagaaauuaguuguaccuuuuggaggcagggaggccccacauagaaaucaguaucuauuagugguaugccugucguugguaacuuacacaugaaagaugggauggagcucaaagaccaagcgaaugucucucagagaaaagaaggggccacucucuccaaagaggccacaaggaaagaaacccugcuguaugcaguacaaaagcugcauccagagaggauuuugcucucuuugccucaaaccuggcauauucugaauccuaagucucucucuucuuggccaguacacuagagaaaguguagaggauguuugucuacugacugccaccaccaacucuucccuccucucuuucuucuccuucuccauaggucaugcuuuguaacauuuuaacuccccagaaauucaucucuagaguaagauguuuaucaguacaacacuuugcauugugauuauagaucucugugggucagaacucccaagugugugcuguacuucagccugggacacuggcgucuuaccugagucuagaguggcucuuggaucucccucuuuugcuacaccucaggccugucugaagucagcgucaucaucauggagcccgggccucaggcacuccguguugacugcacuuuccugcucgaccacugagccuuucauacagugguccaucccggacaggaaugaaagguaccuuuguggccucuugagucucccccaccccuguagcaggccauggaucuggugugucuuucugucuccuuuccuagucuuggcucccuggccagggccuuaugggagcuugggguagaaguuaucguuguugguauucuuguguuauugcugaacuugaaagucagagucuggccuaaggggauggcucauuugagaaagugcuuaccacaucucucaauugcuguucugcugcuaugaggagacaccaugaacaaggcaacugugauaguuugaauaggaaugccacccccccccacccccggguucauguauuugaaugcucuagggagugacauuaggaauuguggccuuauuggaguagguauggccuuguugggauagguguggccuuguugggaagugugucucuggagguggcuuugggguuugaaaagcacauguuaaucccagugcuuucuuucuucuuguugucugugggucuagauguagaacucucagcuauuuauccagugcuaugucuuccugccugucgccaugaugacaguggaguaaaccucugaaaauguaagcaaguuccaauuaaaugcuuuccuuuaugaguugccauggucacggcaccucuucacagcaauaaacguugacuaaggcugcagcuuauaagauaaagcauuuaaucgagggcuuucuuacuguuucagggggugagucugugaccaucgugacagguagaaugacagcaugcagggaaaugugucacuggugcaguauuagaaagcgcuuacaucugaaccacaaacaacaggcagacugggagagacuagguaugggcuuuugaacccuucaagcccacuccgaguugacucaccuccuccaucaaggccacaccuccuaauccuucccaaacaguccaccaacugggaaccaaaccuuuaacuguaugagucuauaaaggcccuuucuauucaacccucuauaccaaacaaacaaggaccugaguccacgcucccauagcccacauuaaaaagcuguacaguggcaugaacuuguaacccuagugcugggaggagauagagacaggagggucccuggggcuugguggccagacuggccuaaucaucaagcuucauuucagugagagacacuaucucacaauauaagcaacugaaguagauacacaauaucuuccucuggcuuccaugccuuugcacauaugcacacacacacacacacacacacucgugugcucacacaugcacauacacacaaaugaacuuugagcacuucccugcugagucacugugaguucugaagauugcuuggugggagucccuuuugaaauuagaguaucuuccuuuaaugaggccaauuuccacauuugccuuuguaagaaaagaggaagcgucugcgaauaagacaaauuaagaaagguaaucuguugaguaaaucagaagcuguacaauugagaaaacaaccggcaauuaauuacuugcacguuauuguuuagguuuucaacucauuaugugaacauuggaaggugcgcuuccagucucagcugguuucagcugccaugcacccucacuucagguguugaaggggugccuuucaagcucuuaaggaaaagugccaguguuccccacagguuuugcauucucuggcuuaugcaggcaggcuacccgugucacuaauaauugugguguggcuggcugugucgggcuuaucuggaaagcucugaggggcgugaaugggauccacaccucucauggaggaccuugaauggucacaugagaccagguuucuugagaagggaaggugucuagcaagugggagagucuguauagaggagccggaggaaagugcagggagccagcccuguuuguggcaugagcuuucucuagaagcaaagggcauuccaauggcuuugccauuguugggauugccugaccucagacuuccggacacuugucacauggccacagagguaauccucaucugcucaaggcagguggccaucaguauuucauagugcagggauaagauuaggcaagagggcuauuuauagaucaagguucaaaaauggaaucugucccacucugguuugcguaagcuaacuauaucccccaggguucauaaguuggggucuuggugcucagaaucucagaauaugacugaaccuuuuacaagguauuuaacucauugggguugucauagugggucuuugucuaaucugauacuguccuuuauaagagcauagggguacugggucaagugugcacaugggaguggccaucuguaagccaaagagacagcaucaaagaguacugagguguuuugucuugccuuucccuccagaacagcaagaaaacaaauagguaaauuucaaagaccagccagacaaaauucacauaauuuguuaaaagaaaaaaaaaaaaaaaaaaaaaaagagccaggcagugguggugcaugccuuuaaucccggcacuugggaggcagagguaggcggauuuccuaguuuaaggccagccuggucuacagagugaguuccaggauagccagggcuauaagagaaacccugucuuggaaaaccaaaaagaaaaaagaaaaagaacuucaguaaacagaaagaaagcucaaauaaacccaaaacuguaagaccaguugagugguagauagaguguuuaaaaaacccaguuaagaugauuuugaagaugauuucucccauuauuuuuuuuuucuuggcuggcaauucaacccagggccugagcuaggcucgcacucuaucacugagcuccauccccagcagucucucccauucugaagugcauuguccugauucacagugacucuccgcaaagcaaaaggacuugguacacguacuguauaaguaugacuucugugaguucagcauugccuggcgugguggucaagcagcaggaagagccuggucuacuuacgaaaggagaugaaaaugaucuuggauacaauuagcugauugaauuuggcacuauguggaaccuuagguuuauuucaggcauguaaagaauuuaaugacaggaaaucucuaagggaaugauuuuaaacauuuuaaagaguguaaaacauaacccagcagcuaagauuaaaugaaaugaugagaaaaaucugaauccaaaaaucaggaaguaaaaagagaggagaugggagagaagaggaugggugggaaagggagaggaagagaaggagagaagaagggaaaggaggggaggagagaggaggagaagaaaggggagggggagaaggagacaagagggaaggggagaggagagaaggggaagagaagaaaaaaggagaggaagggagaggggagaaaagaagggagaggagggaaagagaggggaggggaaaagaagagaggggaggggaagggauaggaggaagugaggaaaggaaaggaaggaauaggagaaaggagcggggguggggggaaagaggagcauaagagugaaagaagacaaggugauuaaaaaguuauguucaagccacccucauuaauaauuccauaaggaguaagcacccuaaguccaccacauaggaaacauaacugucgcuuccguguggccagggcacagagaccucacuacaugcugcuuaugagacgcuggcuuagaauggaaagcaggcaaagaagcaccaugcgaucagaggugcucgggugaguggauguuugugaccaauggggacaggcuaugggagacgcaaggugaagcauuaggaguggcggaguggccgagugaccggaaccgcaggugguguguaccugacaguagaauuucgaaaugugcgaaacugagacaggaaggagacauacaugagucugcagugacagaugaggcucaacgauuagaaaagcaaacccuucauuggggacccuguguuccauccaauggaugauugugagcauccacuucuguauuugccagacacuggcauagccucacacgagacagcuauaucaggguccuuucagcaaaaucuugcuggcauaugcaauagugucuggguuuggugguuguuuaugggauggaucuccagguaagggcuagagaaaguacccaaggggcucaaggggucugcaacccuuaggaggaacaacaauaugaacuaaccaguaccccacccccaccccccagagcuugugucucuaguugccuauguaguagaggauggccuaaucagccaucauugguaggagaggcccuugaccuuucaagauucuaugccccaguacaggggaaugccagggccaggaagcaggaguggguggguugggggagcagggugggggaggguauaggggacuuucggagaggaaacuaagaaaggggauagcauuugaaauguaaaugaagaaaauaucaaagagaagagaagagaagagaagagaagagaagagaagagaagagaagagaagagaagccaccaggaaguagacuuuagacaggguuaccaaccaggcugcuguagcagacauuugaacgacacugugucaaaagcuaauuggccuucucucauuuccagcauauguguaucaguuccaagaugggccagaauuucugaauagaauuuaaauuauuagaaucauaucgaguguuuucuaacucuagcagaauucagugagaacuguguagcaggaagaauagggcaggguguuugagcuacacaguguaguucagagucacggggaguuagaaaagaugugaauugcguaaguguagaaccacaaacucccagauccugaaagcugcggcuauggcugugcuuggaggcaaauuuauaccauaaaguuuucaugauaaggacacggagguguuaaacaaugauaaaaacuucuuuuaaaaugcaugaagcugacgagauggcuccgugguuaagagugcuugcugcucuugcagaggacuugaguuuaguucccagcacccacauuaagcaaacaacucccuguaacuacagcuccgggggauccagugcccucuucaggagucucgucaauacacacgcaccuaaagauaaaaauuaaucuuuaauaaguggggggacaaaauaaaagccaaucaccccccaacaggacaggaacacuagagaucaguugaacagaaagcagaaaaaaauagaacacauaaauaaguaaaaaaaaaaaauuauuuaaguaaaaaaaaaaauuauuugagauauguguugaacuuuuaguuucuaccaaaaaugagaaauaaaugagaagaggcaaaacuaacaguauugaugauggcugugugccauuggccaacacaggcaagaaagcauaaagguuccucagcaagaggaauuaaguacccaggcugggacccugucacacuaacugacugacacaggaaaagaaacuucucagcuuagauuguagcucuguugguagagugcuuaccuagcaucugggaaggccuguauccaacaacccuggacuguauaagccaggcaugguggcaccuguaauccuagcacuuaggaggcagagacaggaggaucacaaaaucagggucagccucagccucagaguugaaggccagccugagcuacacgauaucccaaaaggguagcaagguugguuccguaauuauagauucauaaaggcgacuuuccauaaugaaaaacucagccuaauugcuuuuguagggggaauacaugagagcuuuguagaagaaaucguacaauguuauaaaacuauuccagaaaacaaauauaaggacguauuuucuggcuuuuaugauccugauauuguaaccaggaaaagcacuaaaugugagcaacaguaugcugugugugugugugugugugugugugugugugugugugugugugagagagagagagaggggggggggagggagagagagagagagaggaaagagagaaaaaaagaaaaaggggaaguugaugggucagucuaacauucuaauaagaaagcuacauuuuuuuaauaagcuguccaaaauaacuccaacagaacguccgaugcgugugugauaaaauaguugagcguguaauuccuucacacgaucugccuuaaaagcagauaucacacacggucucucuuaggucagagcuuacaaggcuuuuguacaugcugacauuaagcaaaucuucauuuguuauguauugcaguuauuuuccuugaugaucucuuuagcuaacaauugcaacuucugugauuguacuuccucggaguaaaaaccucuuccuccaaacuuccugcuaguaaaccuuugcgauuuuucuggcuugaggauuguaaaauauuuuguauccaacguagugcuccaaacauggcaucugcauaauguaugcagccaugcuaauauuagaagcauguucaaggagcagccugugggguuaauagaguuuaauuugcaagacaaaugaaggcucauuuucuccuaggcacuuugcucucaauccuggcagggccacuuuugaagaagaggaccuugaaucuaagaugagacaggaacagagcugagggcagugacaccaaguuguccucugcaauccggagcuggccacugccugcagcucuucaggggcaguagcaugguucagucgccuaccgcucaggagggcacagggggagaauaaaaacuggcaauuuucuuacccacaaacaaguucuugacuaaaaccaggauucuccgcaaaugagaugauucuccaguuuuuggguuuuuuuuuuuuuuaacaaaauucagagcaaucuuuauaaccaaggugauucuuauuaaaagcaucacaucuaaauguaucaaaaagaaaaagaagcagcugaaagaaaucugcuuaaguauggauaguaucucaggcuggcaagauugugggcugcuuguuuuuaaauggguuuguuuuuguuugcuugcuugcuugcuugcuugcuugcuugacacugaacaugugucuuugaggugugagcaugcuuucucuuacguacacugauuggcccucauggaagugccuggccucaggccuccaucuggaaaugcccaucacacaagaguuguaccuucuaggagcugugucccguucacuaaugcccaggacagauucuagucaccaggacagcuacuacuacuucagugguucucugaacauccugugggcauuaagaaccagagaucagaacugcugaaaagagaguuguaagcugcuuggcaucaugucugccagaagagauuuguguaccauagccugucucaaggaccguaucaugugacgauguuauauucaccuaaguuuguguggcagagucauauggugacgugugucucggcuggcccaagguuaaacaaugcagagcaaaaucaagaacaauaugaaucuuaagaaacauacugugacugauggggaaagccgugcuggcugaacaugcaggagucucagaggcucaguuguuacugauaacuaggggacaacagagcgagcgagcgagcaagugagcuuuguagcugaaaagugacccaucacauuuucaucuuccucacuuugcauccccuucaucgugggggucgcccuuggaguacauuucuccagcuccggaguuuagcacccgcuguacagguaaggcugcucacugagggagaaagcugggcaugguggcuaaaaccagagaauagagaguuugguucaggaaggaaaacuggaguaagcaguuuggaaaagucagauguuuaaaacaugaaaagaaauguaucucugaguugcagugguuugaguuucaugaucuugaugugcccgugacucccugggggcuggcagauccagggggaaggguucaaaggcagagagccuguuugagcuagggcagggcugacuugcugaggaagguggacagccccugagacucuaccuuccugggcauccuuccaaggggcaaggcagggccucuucuugaaccaggacuaauguaugcucugugacucacguagcaggacuccuauguccaccuggaagcagguacgugucaucuucaguguuuaaggcucuaagugcugcuggguucccuggcaccucgguacuuguucuguguucugagaagcaugcuucauuccucuguagucuuagcaccugcucagagcuuaaucauagugcauacugaauaugcaucagcuuggccugugagauguggauguucacaaggcugaacucaucacauuaagagcuucuugccgucccuacaacagagcagaagggacuagggccugugccaaagcucuguagaaaaaaacagguucuugacagaaaugagaguggguuacugugagaacucagacgaaguaguagugacguuucuccugaguucagaacuagggcaugaaggaaggguaaacauucagaagugcacccuccccccaauccucacugagagcuccagcuucaugcuaaccucuguuuuaaagaccuuguacgguacucagccuuaaauaaugcuaaguaaccaaaaccaaauaaaggacuuucgugucccaaaugggcaccuucuaaagcuuugaaaagaauacacuuguaauuaucccucccuaaagaucuugggauguuggcaucagaagaugugaaacaccagagcuuaccguacccagaaguuuccauucaguuuuuuuguguaguauccgugcuggcucuucagggucauuggcaaugcaaacugaauaugcauauugaucccagaaacccaugacccuuggguguuguuugcaggggagcagggagagcuugcucacaggcuccgggggaauugggaagugagagccccggcuuuccuuuuguuugggugugccaugccaaacagccacuggcugucagugaaggacagaguguaaggaaguuguaggccuggccgccaccuuccccuccagcgcugucuuguggcugaggaccugggaggcuaggauuagaccugagaagaggaaauuaauguuucccuuucauuuuccuccuggccauuccuucugggcacgugucaauuugccugccucccucuggaagcuggugucucugccaggcuccacagcuccaguagccaacacgccaagucccauuuacuggggggguuucugcuagugacggcucuaauaggcccuucaccugcucuguggaggugcugagaaauggugguugcucucauuagcuuuggucaccgucacuggcuggaugcuacaggcagcuagggaagggcuaagggcugcaagucccccagccacccgagcccccucugugcacagucuccucgcucaaguauguagcuugccacaggagaucaagaaaugcguuaaaugcauaaaauuaaaggcagugccaugaggcucccuaggugacguugccagaagcuugacacacugugacagcaugugucacuaggaaaugagcccgggggucagcuauggucccccuguggugcuggcuagcuagugugccaaagucaaauuccaaauguuggacuggacguaacaagggccaguuccugcuggaaccugagaaugacaauucugucagcagcccacagacaucagccgggugguuuguguuuuuuuuuuuuuuuucuuaauagaaaauaauagccuauuccaaacaauaaucuuugcaaauccaagaagaaaacacaguucaucucccuuuauagagucuaauuugugucuguucgauuuaaauagcggcagcagaaacacaagugucuucaggugauucuuuccugcucucaccaacagaugacaaucaugucuuaugguuuuugauuugacagaacgguucauuucaucagcuugcuagcagcccauuugauucaauuucccucugcaguguuuuacugaaaaugacaaaaacguucuuuuacauaaagccugugagccugugaaggaacauaaaugcgccgcgcuguuuacauacuaacuuaauuguaauuuaaaugcccuuuucauuccauaaauauagccauaggcuuuucauuuccuucaagccuucagcucacagagcaguuuauauguaaacuggagucaguugcuucauaaagugaauuucuggaagaaauaauauaguauauaucaaaaucuagauagguaaugggaaauugauugugacaauacaauauuagaaacacaucuccauaauauuuuauuuauuacacuuuccaccuuuugcugucaagggaaaauauuucaucuugcaccgcgaacuccagucuguagagauuuugaccucaauauucucacacaaaugaauauaguguguaagguagcacaaucuugccuguguaaaaccaugcauaaaaaacaauucauuuaaagcgucuaaauguuuccaaauuacugcagguaauuuuuacagcuuaauuccuccgagacaccauuuuaaaugaacccauaauucaauuuucagacuuugcauuucaaauuuuuauguugaaaguaauuuccuuucuugcuuaaguugcgcucagaaccagauucauaaaauguguaugauguaugucugaagaagcagugacuguuggaagcuuaauaacaaauaugcaaggaagaauuaaaugaauuuucucuucaguaguucggcuucacuuugauuucuuaaagccacgauucugacuuugcagcuaaguuucuuuuaacaccaccccccgccccccaacauauacacgcacuucuugcuuccuucaaaggauaaagcugcccuucuguauuuugaaagauuuggccuauuuuauuuuucuauuucuuuggacuggaaagagaguccaguggugcuucaaccagauguuggauuuagaugccacuuaagagggucucuggacacuguuccccaagcucaggccuuccugaagacuuuuggccuccugaauuaaucaagagaagcauggauacuguggcguacaccccacuaagauggcuaaaagcauccguggucauggcgaaggaggucugagcacaguggaagauggagccaagcugucacgcauucaguguugcugcuuccagggcuccucuggaaaaaaauccuuugcugguggcugcaggauuucucaaaacccuuuucugcgucugcccuucaauagaacacucaguauccgguuuuauuaauguccagaagcguaaaucacagcccccugcuuugucauuccagucauuuugucacuaaaggauuacuucaagugacugaacucggcuguuaucuguuugaguuuuugcagccaggucaucucaggggacugggaacaagcuuucugcccccuuaacugugucgaguggauggcuucagcugggccacuuuuugugauugauguccauucuggguugcugucucucuuccuggcaacaagccggugcaaacuuuaaaaaauaaaauaaaauguaacggaaaugaugcugaaaguuuuuaaagccagagaugggggccaggagcucugucgcuuguaaaacagaaguugggagaaagucaggcagcuauugucugcagugauggcaggucgagccugcugugggggcagcagcuaucgauugguaauucuuugugggaccuaugaaauguaauuggucacucgucaaagacacaacuggcaagugcagccuggguugccucuccucugucugaaagacugacugagaagccacgguuacggcaccaggagcauaaaucuggacgauguaaauaaaggaccguuauuaggcugaaguuguguugggaugcaguauuuaccugugagacguaugagcaugugaugauagcuguguaauacagcacagcaaaaagcaaaaguuacccaauaaaaauguuaaaugacauguccuccucaucuuuaaauggggcagcuauucuguuuggaauuugucaacauuauuauagcaauuacaauauuuaagcuauuuaucuucccuaccuuuggccucccucgguuucuuuucuucccccuucauguuaaucucauucucuuugccaucuggaaucuuugucucaugcaggcugacauugcagaugcugaagguugcaggaagaaaaacuccuguaguauuaaauaauuauuaauuuguaagagaaacaaaagcauaggcguguggcagacugggggccagaguagccgcuccuccacuugccagugaucauuggguguuacaguuagcugcuacugucaacuagacacagaccucagcaacugaaauuugcccagaucagauuggcuuauggacauguuuuugggcaguuucuuuucuuuucuuuuuuuuuuuuuuuuugguuuuucgagacaggguuucucuguguagcccuggcuguccuggaacucacucuauagaccaggcuggccuccaacucagaaaacugccugccucugccucccaagugcugggauuaaaggcgugcgccaccacgcccggcucauugggcaguuucuuaauugcuaauugauggggguuaggggcggcuagccugagcuguauaagacagguggcugagaaagccaaagaaaacaagccaguaagcagcauccaucugugguuucugccuuaaucuccugucuugaguuccugccuugguuucccuugauaguagacuauaagcugcaagcugaaauaaauccuuucuucccugacuugcuuuuagucaugguuugucacagcaacaaugaaacuaggcuacuagguaagggaaaaagguaauucuacaagagugagcugaagaccacugguagacugggcucacccagcaugguuguuccccgcgauguguguccguagccuugaugugcuugcauggguucauuuugacccugaaugcaaaccagcugccccuagaacuuucuggacacacugccacuguccucauaucucaaucaggcuagcaaaagcagccagcaggcaaguguagcaccagaaccucucguuggccuguggcacccuucauauaagacgcuucaaagccucuccagccagccgccugaagcagugcuagcaugcugugucuccuaaguauugugaacaaagaaaauccugccauugacuacugagccccauuaccccuuuuagagggagggcaccgugggcugccaguuacugccugagagaugauguaaguggggcagucagcguuucccacuggccucugguauucuaccuccuaagaggauucgauccagugcaaggaccagccuagcugcagccaucuugaaggauuuggauuucucugguaaaacagccuucuggagcugaaggggucugcaacccuauugguggaacaacaguaugaacuaaccaguacccccagagcucgugucucuagcugcauauguaucagaagauagccuagccggccaucacugggaagagaggucccuuggucuugcaaacuuuauaugccucaguacaggguaaugccagggccaagaagcaggaguggauggguaggggagcagggcggaggggggguauagggaacuuuccggauagcauuugaaauguauauaaagaaaauaucuaauaaaaaauaaauaaauaaauaauuuaaaaauuuuuuuaaaaaccagccuucuacacauagcaugcugagaaagaucuagauccccgaagccugcguuuguggagauucauuugauguaagcuaguaaaagagcaucgaccuuugcgugcgccugggaacagagcagaaaugguuuguguaagugucuggagagcuugcucccugcuaggagccccugccugucauguccucuucuagguccugaccaggaccuccucugacauugcaguugaugauagccucuagucccauguguccucugcuguggaggggacaguaccaagaccuaauaacgauagcuagaacucaaggauccccaaacccauaugugcacccuaucucuuccugccugacuccucagugccccucucugccuggcacuguguucucuucucugagcacugcuuggauggcuuugcuggcagagauuccucagccccuccccgaggcuggacuccacaacacugcacacauauccuaggauccugggccauguguaccucagccuaaggguaguuaugccaccagagcccaccugcccccagcugcucgugccucagaaaccuacagcauuggcucuuugcauuugcguuuucuccacauuaauuagcaucauggugaucucugguggucaguaaguuaaaggaagaacucauaugagugaauuagaagucauaugacucuacaaaaaccuagcccccaccaaagcauuuuauagaauuguucuguggcagaguaaaacauauugguuuuaacuauggugaacaaaauagccaucuuuagaccagcgaugcccaucccugcauucagccuggcagagcuguccaccuugcaucuucucaggcugaaugauaucaggagcuaauucgcaucagggcugauauggggaaaaucaucacacauaggauuccaauaggcauuuaaaucaggaaggacuuucaucccccauuccuuuggauuguguccccagauguuucuuguuuaaaacauagcuugauuaaaggcaaaauucacccaucaaacgaaaggaauuacccugcugugugugaauuccaugguuugagauccgugaucaaaauaaaagcaaaaaagauauagaauccaaugucuaagccacaccaaucccagacccaacuggauggccucugagugacuucagcagacccacaaggaguucccuggagguaagcggugacaugguuugaguguagagcacugucauccucuuuaugccagugacaguugacaaugucaaaugugaaaggacauccugaagaagcuaauggugcaagucagacuacuggacaguuucuagggauggccagugaccauccugugugggccauaagucaggauagauaaccacaggaaagacacaagucugaguguaagcucuuaggcccgcgucgcuuucucagagccagauaucagucugucuaggaaaccucuucuauugagccugccugagagucucaggacugugaagcucagggucgcucggggucucaagagauagaggagcucuaguacacuucagaggaaaaggccggaggacaaggugagugcaguccccggagacucugccaccuugggaggcucuuucugaucuaagagaaaaugcuaugggaaucagguuuuuuguuuguuuuuuugguuuuugguuuuuuguuuguuuguuuuguuuuguuuuguuuuguuuuguuuuguuuugucacaccacagcagaggcugcacagcaggcccucauuuucaggaggcaaaaucagcaggacaugucuccacuaagagacuaugcauguguccuugggugacugcuauugccucugaccaaggacaaggucagugcaaagaaaagagaggaucuugccuucaacaaaucguaaucugggggauauuggugcaccagcucccaauagcaaccaccuucaguguggggcaucugagagauguuaggugucugacaccuauuuaucagccuguguuccugaacauuccagugccuuucacagcuuauagcccaaccugaugguuucugagucuuuauugaacacugcacugugcgggaagucagcaguccucaaguuccuucccagagggucggggcuggacuuggcagccuccucccaagagccuguagggcugccagguuccauuggaucacacauguccucagccaugugguuaugcagcaguccacugcauauauugugauauauugcccuccaucaucacaucugcuagaucccugucacacuugaagagcuucgugcugagaaaguggugggcacuguccugucagucacgagaccugaucucuggggagucaguguugcacugagaaacugauccuuaaagaucuuaaaaacauccuuaaacucuggccuucacauuugcaaguuggugauuucuaguuuugucucuugaguauggccaggcccuacuugauuugaaaagacuggauuuguaaaguguuugacucagacucccacccuaaaaccuucccaacuaaguccuauaguuggaguguauuuacagucacucugaaggaauaccuccauaaaucagagaggucugacauagggucgaguguauggcucaccugagaaugacauauagcaaggccggccacuuccaagugaugcacagagaugauugaauuaacccuauugcaggcccucaauucugacucaacucaccaacuccaggcuacuuauaaaagugcauuguguuuuaauuguuggggcccacaccuguaaucccuccggaggcuugagacaugguggaauggcaaaaaugagaccugucuggacaaagaaagaaccuuguaugguaagacauaacucuggcaagcaaggaaagccaggcaauguaauagccagucaucggguccugaagucuuuucugcaucucgggcccauagucuagagugcucaagaugcagagcagagaugcccagguguggagggugugagcgggaauucggagcagagguuauaggaaggacugcuaaggagcagcaaagaacauuaucugugggaugagaugggacacauaucuguucuguggaaggagugcuauccaucuguccaggcucucucccgaaggccaacuacacacuuccugguuucugguaacugaacugacaugugguagacaguaguucagccauccuucuguggcucagugccugagggcucagcaaaaucacccaccuuuuaagaagaggccauuaggauccaucucaaggaaggagauggacggagaaguguugaagaagcaggguguagccaggggagcacaccuacguaggaaccucaagccuggcacugaagccaggcagccccugagcacuccagauaccuuagaagcugagccuggacaggagcugaagaguauagcuucuguucuuggcuuugugcucuugcuaguguacuaaacagaucuaaauuccuucacaucagucacuuggauuauuccucugacugccaucuuaaaccucagauggagaaccaaaggcccaacugaggcaaaaagauaggguucaccuggccucguagaacguucuggagccauacggaugggaggccccauggagaggcagggcagguaggagcuggaugagccucuugcgcaugaaagucagccuuuguuggacaguaacagccaagauuagccccucggggguuccauggucccacagucccaugcaaggcaugaucugggagaugcugugacuuccccugcguccccagcacacaggcagcaagguccacuguuaucaaccaucaugugccccuaccagcugcaauggauaugcagauuggcccugagccagucuccucucuagcuuagaauccugccuucugcaggccaggaagcaaggacuccgaaaacaguggcuacucucauacucugggaaaggagucuuuucaucacucuuagaccgcaggcaaacacuguggaauauggaaacuguggaaacacucuggaauauggugcuccagcuaccaaaaagaaauuacagcauaaaacaguaggcacggugaguuucauucucaaaaccaucccgugcuagagguggucaucagccgagauuugugaaucagaugagggcguagcugccagguuuugauaucuguuuacccagagagacuuccaugaacuacaaaucaaauuuuauuuggggauacacaccuuguccugggugcaugccagccuaccugccauggucaacacacugccagcccuaagaguucaugugucccgcuggcucugaguacugcaagccaucaacacauccuuccuuaguaggaaaguuuggaugaaaugucccccauagucuuugggccuuuuggucccuggucgguggcccuguuuguggaggaacuguggcuuuguugaaggaaguaugucacucgcuggaggugggcugaauauuuacaccauuucgacuuugcuccuucugcuucaugccugccguucaagauaugagcuucagcuccugcuaccaugcuugcucucuucugcuugcugccauggcgaacccuuacccuccaauauaaauaaacccuucucuaaguugcccuggucaguaauagaaaacuaacuaauacucguaccaaaaagauccuguucaacuuugagaaauguguaucugggauaacuuuuuguaaaauaucagggagcuaccagcuuguuuaauuaacuugcauaucuaauaagaaccuauggggcccagacaaauggaaguacucuaacccuggcagugccaaauaaucuguuagggguaagcagcagacagguaagaucaauguguaaaauucaaacaaaaaccaagcgccuguaucaugaggcaagagugagagaccagaggcacacacaaaggacuugaccucuccaguccugugaggacaccuuauaugcaaagucuuccugcugaccuucaguuuggccugauuucuugaagugcugguugucauggugacugagaacggaggagguucccacucucuggauucggaaccucccaggaaugaacagccguaaugaccuucccuaauuggcaucucugcacuauuuucuuuggcucagagaauucuuguaaaguauauuuaauguaguguugaaauugguaagauuuuucuuccucauguccugaagaucaucaaaucucucggggucuuucaacaccaaaaagugaucucucuggcccuauuacacuguuuccuuuucugcuuuugggcuguguuuuguuucaguuuuuugaagaucagauuguggaguuugguuccccccccccccuuuaugaagcccuacuugaaaaccucaauggaaaacugccgccuggcucucuccuugcaagagagcaacuacugacugguaacugagcccugaaggcgugggagggagagacuuugcccuagagcagccuggcucuaccacccagucaggggguacagccuccgacaccuccccaccagcacagacauagaucugcucuaccuauuacauacuguaggccuugagcagccccagaacauuaacugagugccaguggguaacucccacugugacugguauguccuacuggcuugcugaugucauuagaaacuuauuugauuguaauuggcuaagauuuuuuuaacccagugcuuggaaaguccauguucuucacauuaacagauguauguuuuuguauauucaaaugcccaguggaauacuuuaagaaguggagcuggcuugccaucaggauaggggaccuccccacuccccggagggucacagggaguugacauguccuggaagaaauuaccuuuaaugaacguaaguuugguugagugagaugagaauaauuccauaugucggugugaucauuuguuuauucaguuggcaggcugcuguugcgccucugcuggccagcauccuuaguccuguggggacccgcucagcaggcugacuccuucccacacugccaagggaugcaccucacccccuauggacccccgagcuucggccucauggauuccccaucuuuauauaugauucugcagugagcugaggcucucucuggccuucauugcugaugccacaucacuaugcucuggaaaucuuguugcaacaauggcaccuucacugggaugaucucccauccauggcaggaggucaccucugccugcuuuuacuuuacaaaugcaucugcuugggaagggcacaggccugaccccagaucuacaguauggacggguggccagcugagucaagcccucccaagagcauggaggauaacucguuuccuugaggacgugccuacuaguuguacauccuacaugugagcccgagcaacaucaguagugcuuacuuaaccgugaaugacuauaugaaaaucuuaauagaaguuuagacauaaaacaccccauuaguguugccacgaaagcuuuuguggaauagaacuugaagaaaauuauaaaauugcuguggugucagucaucuugccuuuaggcaaacuuuuuaaaaaguaugaacugaaguccuacugaaagagaccccuucaaauuuaauaaugagaaaauauacauguguguguaagauuuggacacagucaagguggaggacauuaggucugccucccucugcagugcucucgcuggccucugugacaucaggacugccagcacuugagaccacaucccuuuucacugcauguagaauggacugcugcaggccuucauuccuuggcuucuaacagugaaugguauggugguuugaacaagaggugacccacaggcuuaugcauuugaacacuccaucccagaguuggugucgcugguagggagggguugcuauagaaccuucaggagguggagccuugcuggaggaaguacaucacuuggggacuuuaagaguucagcaauucacucuuguaugcagcuggagccacauguacuccuuuguugauggcuuaguuccugggaauucugggcugggcggggagguggggggguggucaugguugguuaauauuguuguucuuccuaugagauugcaaaacccuucaacuccuucaguccuuucucuaacuccucaauugggcaccccacgcucaguccaaugguuggcugcaaacauccaccucuguauuuguaaggcucuggcagggccucucagaagacugccauaucaggcuucuuucaccauacacuucuuggcauccauaauagugucuggauuugguaacuguauaugggaugaauccccagguggaacagucucuggguggccuuuccuucagucucugcucuacacuuuaucuccguguuugcuccugugaguauuuuguucuaaagaacugaugcacccacacuguggucuuccuucuuauugagcuucauguggucugugaauuguauccugguuuauuuggagcuuuggggcuaguauucacuuuucagugagugcauaccauguguguucuauugugauuggguuaccucacucaggaugauauuuucuaguucuaucuauuugccuaagaauuucaugaauucaccgucuuuaauagcugaguaguacuccauuguguaaaugaaccacauuuucuguauccauuccucugucgaaggacgucuggguucuuucuaguuccaggcuauuauaaauaaggcugcuaugaacauaguggagcauguguucuuauuacauguuggagcaucuucugaguauaugcccaggagugauauagcugggucuuguagcaguacuaugugcaauucuccgaggaaccgccaaacugauuuccagagugguuguaccagcuugcaauaccaccagcaauggaggaguauuguuuuaguugcuuuucucacugcugugaccaagcaucugagaagaagaaaguuuaaaaggagggagagcgguucugguucccaguucaaggaguccauuuuccaucaugguggggaagagaugucaguugacugggaaggccugaugccaggaccaggagccccacugaagggaggaagggaacagucauuuauuaaaucaauaaagcaaaauccaguuuucuuggggaaaggggcaaauuauuagccacuuuauuccaggagaaaaaaaacacaaauauacaaaacaagaauaauaacaaggaaauaaauaggauacagaggaagguuugaaaagcacaagagacuaauuugcaaauaaauauugaaacacauuugaagugcauaauuaggaaagaaucaguuuuacuaaaauuaaccccaguagagacaacaagcuugaauaaaccaauuuacgugcgagaaauggagaacauuuucaaggaacuaccuuacaaaauggucugggcccgauuguauucauaagggaguuuuauuaaaccuguuggacaaaaagucgugaugguacaugaauuguuuaaacacacagaaagagaaacuaauaauuuuauagacuauguguaauguguaacauugaaacuuaagcccgauagaaacgcuacacauuaaaaacaaauauucaucucacgugguaauauugugaauaccagugcagacucuuaaaauacaagugaucagauugcauuagcuuguuaauaauauggcauacaucaacagagaguuuagcccaggaaugcaaggguaguuugauauuaugguugguuagauuguuugagacagagucuuacuuuguagcccuggcuagccugagaccuuaaucaggucugaacuaaaacugcaucaaacuuccugccucagccucccagcuacugguauuucagaugucucccaccacaccuggccuguuaaguguaugccagaugaacauagcuauacaaagaaaagaauaaaugcagugacuuggacuucuguuugagggacgaagacucaguggauauucuccacucuuacagaggaccugaguucaguuuccagcacccacauaagcaguccacagcuuccuguaaugcaggcuaccagagauccagugcccucuucugaccuucaugggcacugauaugcaugugacauacauacauuuagacacacauguaggcuuauaaaaauaaauccuuuaagcuuuuauuuuacacugugugugugucuuugugugugugugugcaugugcauguauuuacauacgugcucacacagccacaugcaugucauugcaugcccuguggagauccaccauguuaauucuagggaucaaacuuggaguaucaggccugacauaaaguguuuccacaguggccaucuugugaauccugcaaauaacuuuuaagacacugcauuaaauguaauuaaagggaaggaaauuacaggcguucuaaugauugcuuuuuguaauguuacaaaggugcuuucgguauauguauaggcuaagcgaauggugacuguguugauuugaggggcacuggugcaggcagagacugguggagcaagagguggcaggaaaagcccugggguugaguagaaguuggcgcugcuagaacgauguuccuaaaguuuacauaaacauucuuaccucuuuaucuaugucuacugcaaagacacagaagcuuacuucuauaauuguccccccugcaaggaccuuguauaauuuggaugaaugguuauuaccaaaucugagcaaggaaaugcaaugagccaagauaauuauuguugggaugagaaggaaccggaaggagggucuagaacgaggaaaggaaggagaacacagcuucguuuuauuuugucuuguugcuuuuguuuuauggaaccaugaacggaacccagagccaggugcaaggccaacacucugucaacuaagccauaucuccagagacgucgguuucuauaacagguggaacaccuggacagaccuuuuaccauaggauguacacaguuagaaacugacuacacagucagcuggacaucacugugacaacaauccuaagcgaagugaaugcagaggaaggacgauguucguggauucagugcugaggagucagcccguggugcaugugcccagcugcucaccgugcugcucucucucacaagagagcuggggacagaguauccccacugaaggcacgcuccaagggccuacuuccuagcucucacagcucccaauagcccuagcacuuuaggugaccaaaacacuaaacuccgguccacagcagcaccugacaguccucguggccccucgaugccugcuuuuagugucauaagcuuccugacuuuaguucuucgugguuuuguuccucucguggcuguagcucagguuugcaugucugugggugacugugacacugaucacaugguuauuguauucauucuugcgcaggucaucccuccuuguuccugaguuagcuuuuaugaauugaucuauggaggacaggagcccuuugcuguuugugaggguugaaaauuucucuacucaucggcucgccuuugcuucuuugugucaccggacagaaauugucagugcuaagcuaguuggauauuguuuaugcuuaugcauuuugggguuucaaggugcuaucuccccuaacaucaaggaagauacugaucauauuuucuuggacaugugcuggcaaacuuccucucgaaauaucuggggcuuugugggccucguauggucucuuucauguccaauuucauguuuagaaugcauuuugggguuucaaggugcuaucuccccuaacagcaaggaagauacugaucauauuuucuuggacaugugcuggcaaacuuccucucgaaauaucuggggcuuugugggccucguauggucucuuucauguccaauuucauguuuagaaugcagucuuuaggaauguuaagcuguccuuagcuucuggcuguggguggccugcagccuucgugguuugcuucguuagagcugagguuauccacucucagguguagagccacaguguguccacccguuguuuggaacgauauagaagugggcaucuguuuaguuaaacgccccuguuuucucuacaucugugcugugaccacucugaucugucucuggguuacauuaguccuucugguuugccuauuuuagucuccuaaacugccgcuucuuaggcuagcaucacucugcaaaagauuuucauaugcaccagagaaauugcguuccuuauucuccuggcacugcuugcauugcuuugugccagguauuaccaauaauguaaacauuucaaaauugguuuauccuaucccauaauaguucuucuagauuuacuuuauauauauguuagugaguggaggcgggcuacugugugauugcaguaccugagguagccagaagagggcgucagaacugggaaccaaacuugggucuucuucgagagcaacuugcacucuugcucucugagccucucuagcccaaaaguaauuuuuuucuuuaauuaagauuugauuugguuugagaaaugcugacgucaucauagcaucucugaauauacuauguugcuuucucuuuuggaguguuaacuuuccucuagaauugaucguuuucuucacagaggucuucucuacacuucauuggauuggugauuacauacaugguggauuuaaauguuacccauuguaaaugguauuauauacgucagucacuuuaugucuucaucaccaaaguuuuucucauccucaaccuuuuuuaaucugaauaguuuagaauggcaacauuuggcaaagcauccagacuauauuucuguuuucauucuuguuaacaacuccgcuagacuguuaaaacaaauauacacaaagcagccagacugcugcugaaaagggcaaucaguacagauccuacaaacauaggaagauggaugaggauguaguuauaaacaauugggcacauaugucaguagcuacugugcaauagaugaaaucauuggaagucagugucagugucuucguugcuuuaagcguaguguggggcacacaggucucuucucaccaagguguacaucuggggaggguggguuuuacuaucccuuaggacagucaacuaugaaagacugaauucauccagaggucaaaagcuuucccacugguagcuuuccacccuucuguaccucugacguccuugugacuaaagggauugagcaucaggaagcuggugucuuccaaaaauagcccauuguuuuuaauuaacaagaauuuaugagccuauuaucagacacacacauugcugaaaguuaaauuauaugaguguacagguaacggcauuguauguagaaauaguacaugcucagagcuuacuccuucugguguuuaucauagccuuagugcaggguugacgugaugugcugugaggauuugcacacucaggcagugcagcccaguagguguugaacaccuguucugaggccaccauccacccucugcccugggauuccugcugggucagagguaggggugggcagugcaacccucagguuccauacuaaauaaucuugaugacaaagcagguucgaaaguucucuuagccugaaucagugggagguggaagucugugggcaguaagcauguuuugaaugccuguguucacacaugcaaucaggcuccaugcagcauugcauguaguuaaguagguuuuuuacugaacaagauucauauuaucaucuaaaugaaaguugguggagaagaaugucucuaacauguaugaugcugucucuauuauguuuuugauuaaaucaagcucaagaaauaagacguaaacaguuugacuuggaaccaaaaucauucaaaugcuuuucauugcaauucugaaguuagaaauuccucuaacugacuaauuucaaaguugugccaugacuaguaguuuggaugccugucacugcucagguguuugcugcagacauagucccucaccucuauucaggagccucagucuccacccugccucaccagccugcucuuuugcagaccauuugccuuuaacugggcugguguucucccauugaccucugggaaagccaaccuagucccagcccuaggcaggggucaggaugagaaccaauaaaaacugugcaggaagggggcagugugcucauuccuuguccucacugacuuuuccuucuuuacccugccugcaccucuugccccgccuccuuggcgaugggcucuccugcuccagccuagaaauauaacauggcuuccugagacauugguguuaacggcaccggccacaagugccuuuccucagacaucacagagaaacuauggucagcggagugacagcuggagagcagcucuccccacacagaacaacaagcaagugcagcuggccucucucuccagagccacucugcucugugugcgaguccauguggaauggacugagauccgcagaaugagaccgugagagggguacgguggcaccaggcucugcacauucacuagacugagccugcagcuggaguuagucuauuuaguagaaaaacaacagaaaagaaucauuugauaauuauaaucacuuuuaaauugacgaauugauucuuuuaaauaaaggcaucauuaugaaaggcuguucuaaaggaaagaccgcacgaggaaaugaaaucuucuaucucauugggaguuuuuugguaaaugugcaaacagaugcauuaaauuaagauuguggaaguauuuaagcaaggaggaugcuuuucauauaggauacagcacugagaaaagcacuccuaccaaaaauaacuuagagggggagggggauuaugugucuuacccuuucuggccacucugccacugagaggagucaggacagaaacucacauaugaacccgaagcagaaaugauagaaguagacugcuuacuggauuauuuguguuuagaucucucucucucucucucuaauauauguguguguguguguguguguguguguguguguguguguguauguauguauguauguauauauacauacauacccugccuggguuuaugugcagauguccucagaggccagaauaugucaauuacaccagaacuggagucacaggugguugugagacacuuggaggugcuguaaacagagccugggucaucuggaagaggggcaagcacuuuuaacuguggagccaucucuccagccccuuagcuagcuuuuuuauacagcccaggaccacucuccuaaaguggaccuuucuauagcaguuaucaaaccaguccuccacaggcauggccacugaccaaucugaaauaggcaguucuccacccgaggcuucuccucucagaugacucuugcuguauuaaggugaccaagaaagauaacccagacaaguaguuugggguuuuuuguuugguugguugguuugguuugguuuguuuguuuuuuauuuguuuuggaaaaagcagagacauuaauaagaauccaugagauccuuauuuggguaagucuaaagugguccccauuuucuaaguagccaaguuggggccugaaacccccugucuguguuacugauggcaaccugaggggacaugguuggauggcucucauuugucaugagaagcaggcugaaggcaguccuucaugccacagacaagugggucacuuuacaugaaauguuuuuaaacaaacucaacagauaugaucuuguuucagcuuaguggucuguucucugagcucagggcauggggcccagcuuuguuuucuguacucagggauguuuucucagaauguauaggauggaaucuaagcauggcugggcuggugcuccauacuccagccccaucucucugcugguuuuacgaggucugcuuuucugaguugacuagauuuagccugugcuagcccaaauucagucugccugcuucucaaucuaagaaucaacagaugccccauucuuuguccuuguggauugcagagagaagccagcugugaggucacgucucauuuccguuucucugaacggggaccaugaugcuccugaaaggaccugugcuaaauuuagaugcuuugguaucuacaggucauuacuggaauuucagcaucagacugcaaggucucgcagcuaccuugacaggcugugaguaccaagccugccuucaccaugagugugccugucaucccccuucguuaaggccuagaaacacuccuuucaggaagcugggugucccuaaaauucaaagagguccaaggaaagaacacauccacagccccacaguaaucacaaaccaucauuucugauugugagcaggacgaaagggcuucaggugacuauuagagaccugccuauugugaaggucaaaaagaagucucugacccuggcauucccuuuguuugcucuuguaguccuguagaugugagagcccacgagggccacuaucagagaauguuucuggaagguggugcugccuggccuggccugcucucuucucugagcaggaacaugugccccgagugucauuugugcaaaccagcaugguguugacacuuggccagucuuguucaucugaucaugccucgugauaggccacauguugccuccaauuaaaagacauuucacauaccaaauaaacaucuuuccaaagacagccacuugucaauugaggcauugggaggcaaaacaaaguauuuauccugaaaccuaaaauguuuguuaaaauguagucaaauguucaggccaagagggaauccacugccuguugcuuuaaugucaccuguggggugaaacaauagacccaccguguuaugugcaguauguacauauaaauaaggcuuaaugcauuugacccaaagccacaauuaaugauuguuaaaaugaaaugcaacuuccuugguacagaggcaggguuacuccuuaguugcaauaucaucagaucagcuauuaaauuggauggauagcuuuuuuuuuuuuuuuuuuuuggagcaaacuuaccagcuaaauuuuacccuuugguauaucuacuucccaaaguuuaaggagccccaguuugcuuugggauguucuaaagcagaacaauauggggagucaaggacagauccaggcuuacuagcucagaccuauaaucccagguacccaagauacuaagacauggggacuguaaauuccagcccaggcaacuuagagagaaagagagagacagagacagagacagagacagagacagagucugagcuuggugacagacucauuuacuugcgugcacaaagccccagguucaauccccagcauuaaaaacauaaaagccaacaucaaccaaacccuggagcaaacccuuuacccaguagaccuuucggaguuugguaccagucagaggucagagggaagagcauccuggcaucucaaaccguguuaugacaacagaccguuuuccucccaaaauauuauagaaaugauacauaauuuuagaggccuguggguacaguuugagaacuguggguauuuuuguagaacuuuaccuaauuauaaagauuucuaaggcauaaccuucuaaguacugaccgucuuaacaaagucacagaacguccugggaguucagagucgggaugcauugugagagguuuuguugcuguuggcuguugagcucagcaaaugcauccacgcuguuuuuaucccagaaugaaagauuuguuugucuuuccagucccggugcccugaggaugcgcaaccauguaacguucucccauaguauggacaggaaaugguuaggcaugagaauccaaccugcauuuaucuacgauucuauugcuuaaaacgccgugaccaaaagcggcuuaggggagagcaggguucauccuggcuuacgguuccaggacagaguucacaauggcagagauggcauagcagcaaaaaagcguuaccagugucaggagcaggaagcuggcucaucacguuuucacacacaguaguguuaaguuucaaacccaggacaaaaaggccucuagauucucccagcaucccucagucccuaccuguuucaggguauggcugcauaccuccaugcuggcucuccaacccaggggcaggguugccuuucccccaaaggcucuuccgcacauaauucaagcauuuggauuacccaccauuuuugaaccuuugcccuccuggcugcuacaccuggccccuucucuacccucucccuuccccuccccuucucuccauauggcccagcucagucauuugacaagucgugucugcucuggacucucccagaugugucuaccuccagcuaugcucuccuucacaucuguaauaagcuuucuccucugccauacuuaggagcagucauguccuuuccuuuccuuuuuauuucuuuucuuucuuuuucuuuuuuuuuuuuucauuuacauaggaagcagagaguaaagcagaaaaugagaagaagcuaaugaccuuuaaggcccaauaccccaaccccacccccagugguguacuucuuccagcaaggccccaccuccuaaaggguccauaaccuccccaaacagcgccaccugcuggagaccgaguacucagaaaaugaaccuguguuggacauuuuuuucuuucaaacccagugcagagcaugcugaaguaagaaguuuaaaccaggcaggacaauuauuggaguauuccugcgugcuucaugggaacaaaaaugucccaaaauguauuucccaaaguuacaguggccacacaaauauuuccucucuccauuauaccauucugaccccacagucuaugugagugauucacuagugaggcagugccuuugggcuacggugugccuugggaacaagauggcuuugagcugcagacccuggguggguacacucucauggccugugccagcaauugcaugccacuguagcacacaaacgagcaucuuuuaaacgugugaugugugcaugcuugguggaacuccaguaagguuggcggauugugugugcaagcugagggaaaccaagacaaaccagcuaaauccauuugcacauccacaagacuuagucuucaugggaccugcaagcauuauguaggaaucagcaaugggcuagcgcuagauucucccacccaagacuucagacaugcgcagaggggcaagcccuucagugcaucaguauuuccugucucuugcauguacacgcccugucccaggaggcaggaacaagagucugguccuauuaaggcacuccuucccaugguuuccucugcuggccaaagcuaaagagguucccuuggcaucuguguggaaagguuccguccccaacaccagugccaaggcaugggacgaaugacaaugggacaucuuucugaggccuucaggcagaacagcaagcagcuccacagcuucacaccagcuuuguuccgagcuuuucucagcacacaucuggaugaugcccuccagcuuggguguagcaacaagcacccccugggugaggcugagggaugugauagcucugcuaagaaaugaggacaacugccugagaggggcagugugaccucuugccugaccuggaggccugguugcuucugcuuugacuauugagcuuuucauuucucaguaguucccccucccccaucucaugggaaguccucaacucccuaaggugucucaguagccuuuugccacaagacuccauaaagcaagcaggcaucuccugucccgugucucugaaccuggccuucuucaaacaucagacacucuguccuggaaucugaaauguccugucgucuucccuucaaacucuuuuaaccaaucccagagggaucucccacaccuacuguguaaggcacgccuagccuucacucaccagugcacgacccuggguccccacugcugccaggugacugucagggaagugugggucacugggaugcuaaugacuguccuuggcacugaacuccuacccuaggcucugcucugccuguuuugugucugagguccccacaggcaguuaugagaggcuugcuugagugcucccuucugucuccacacuggaggugagcaccacgaagaccaaauguuugucagcauggugcccucugcgucccuaugcucacgcaccacagcuacauauuaacauuuucuugacauaugugcacgacuccaguguuguucauacuccuaugaacugguaaucugaauugucuuuuaaaugcuguaaugauaagaagagaauucucgcugaaguccgguuucacugggagaccacagaagcaugucagguccccggccccauggagacugagcauccugaagaauucccagguuuugugacaaagcugcugccaccauucaucucuaaagaauguuagccauccugggcauuugccagaaucgaagucuccauaaaggaugagcauagaccccagaaacugggaggagaugcuuaaaaccccauguccauccaaagucuuguuuccaaaacagccaguuagugccuagaacucagcaguaggcacauaaaccuuacgguuaaaaauuaaguuauuagaacagacacuucaaccaagaggcucaaacaugaugguuagcaggaaccuuauuguggcacugcagagccacgccaaagggcagguggcccuuucuuaugguugagcuuuccugucuccauaggacccugcauuuuuggugcacuuauguccuagaagcaaagacaauacuuuuaaagccacaacaggaaguauugagccacugaugcaugcuacacugucaacugcauuauaccauuagcauccauggcuucauuuaggucagauuugcgagcuaucaaguuuguggugaugggaaagagaugggugguuuguaguacaugugaguaaaugaagaccgagguagauuggacagagaguggguggccacuugaauuagacaguucuguguccugcuuggguugcguguauaugaaucuaaaauguaauaaaaucucauuuaaaggggggacaucacauucguaagcaaacaaaugcuuuaacaagauccaccacuuauuuaucuaugguaugccaaugucugcuucuugauuuuugccaacaugcuaugaggcugggagaaauuuccaucuguggaaacagaauggcugagcugaggaucaugucuuccaucauauuuucuuaagucucuuaggugauuucugaauacaaugauuuuucaaaacucuucuuccuacaagccaauccaaaagaagggguggggcuauggagaaaugaccaagugauuaaaagcaccuccuguucuugcagaggacccagguucaguucccagcacccacauggugacucagagccauuccuaacuccaguuucaggggagccaaugcccacuuaggagcuccucgggcaggaggcacguacaugguacgcauacaugugugcaggcaaaacgauuacgcacauaaauaugucuuuuaacucucaaaaggacacagugaagagugagaagcaggcugggcucugggcugugucuguugggaaaggucccccaugugugugucucccaguugcuguaggcagggauggcucuuguaacaaaagcaaacuccaaagguggaggaugguuucuuauugcagucggggagaaaaggaagcucucagacuagaaaaauaugcucugaccucacugcgguucuuugguuacugcaugauuagccccauuaccccgugcuuaagugacuuauaaauauuuggcccagagcagccgaaagguaaccgccuaagugaccaugagacgugcaugugccuggccaccuuaaacacugagcagauacaaaccgggggaauccuccugacagugaucacauuugaaacuugugcuuucuuaauucagcugguuauugacaguaauauauuuuaacucaaggauguguccauucggugcauauugacucggcuuguuagaguguucacgguacaugugagcauuggauuuccugucauggugacuuacggcaggaggacagcggugagugauuccugccagucaagaacuuuggcuggagcccacuugaaugguaauagccugcuccuguaauugcuguggaaaaggaaaauccuccugagguuuuacaucuaaucauuuauuuauaaauccguagauggcagucugcaguagaugcguugggggucagcuuugugcucaaaacaguugccugauguuuacauuucacaguguaauuuuuuaacgguaccuccagcccccaugaucacaaaaggaccccagcuugccgguagcugcuccgugccacaucccguggcccaggcacuucauuaccagugcuaggcagaggccgguccccucuguauuagcugaaauaugcauguuuuuccaucucauuaauucagccuacauacaauuaauuuuugccuauuaauaaaccccuugguguucgugacagcuaucuagaccacuucaccuaguguggaaagcaaacguguucuuaugguuucugccccuugcugcauuuuuauuguuggguuggcggguucggugcauaaaucaaguuuggcaaggcacugaagguucugggggaucuccauuuacccuggccaaugcugaguccuaugaaauacccaucaacuucacuuccauuuggggcucuuaggcugggggcgggggagcgugugggaggcuggcaugggaaagagaugaccuuucaucuuagacagccuaaccuaccuggucugggcaaucuuuaagaggcucuguucugucuucagaccucagucuuuuuccuuuauuguuuaauuagcauacaaaggaacauguuucccuuaaggcaugcucccaccuacuuaguuuauccuccuuuauaucaguagcuccucucugccuccucccccgcucuccuccuggcuucauaugacacuuucugauguagguucagacaagaucaaucagguccucaauagcucagaaaauagccccccaaauugacaaguugggauauaugaaauuaagaagcaccugccuaacagaaggaacucucagcaaagagaagaaacaccuacagaaugggaggaaaccuugcuaucuguacuucagacaagggcuuaauaucuaaaaaaauagaaaggaauauggaaauuaagcacacaagcaaaaacccaaacugccagucaauaaguggaccaguucacugaacagauaauucuugagaaaaaaaaaaaaaaaaagaucagucuuuuguuuugcuuugcuuuguuuuguuuuuguuuaacaucauuagccaucaagaaaugcaaauuaaaacuacuuugggauuccaguuugccccccgucagaaugucugucauccagaaaacuaaugagagcagaugcuggugagaacauauagagagaaggaccuggaacacucuugcugggauguaaacugcaguagucacuauggaaaucauugcucacaaaguuaaaauuagaacugccacgugacgcgcugcuccacuccucccuguguaccugagggacucuaagccaacaccccacagagauacuugaacccugaucuacugcccuucacaggcaccgagacauggaaccagcuuaaccacuuaggugucucaguccaaacaggugacaucugaugaacaaggaaggaggaaaauggccagggagccuugagguugaaauaagacccccaccaggcccaggguuuccacagacaaaaucguccccagaccuuuggaaucaaucuuuccauagagaacaucucagggcccccagaugaucagcccaaaauauguaauccuaugcagaugcuaagagauuguaggugguuuccuggaauguaggagagaaaaacucacaggcagagucaucuuggaaucccaauggcaggccucugacgaggggacugccuacuggauauggcggguuccauggcuggugaaaggauacuugagaaagcuguagcaugccugcccugguaagucuggagacaugcucacaugaagguuuccagaacacugagaucuagcuggccagugucguugauggguggaguuggauguauauaauaauauuaacuauauauaauauaauaaugauucaguuugcuggcuuuuagaauauauuugauucugaguuaugaugguuaagaggaggucucagccuuaacaggagucugugauaaccugaauuaggcuguuuggucuugacauuuagcuacacacucuuguggaaucugcugagucaccucucuagugugaguagccuugcugguucgguccagcuggcccaaguucugcagaugcagcacugucuucccacuugugcuucacaccuccaaaguguaauuucucccccucaaucucucuucucuucucuucucuuuuccagaggugacccccacugucucuuuaacgugugucccuggaggcgaacagggucuuggcacauacaggccccuccccaaaauccuagucugcucagccuacuucccacggagcaggugugcccaccaccaacugcuacauaccaggaauucacaaaguggcuuuaaaaucagacuuuucaaaucuccaucuaugcuuugaacucuuucaaagagcccaagacaguaagaccuuaucacgggccaugaguagccucucaagaaccuauuccuggcuguugaaaugagcacgaagaugucacccaaggcacagugcugcuguuugucagucuuucucuuccugcacacuacugaauaagaaaugguucuacuucugcucuuauuuaugcagggccauauuuaacccuccccucugcuugaaggacuggccacacaccuuuccuucccccugcucuugauuguucuuaaguuuaagacaaugcacaguggcagguaugcuuagcaaccauguuccgucuacuugacgcuacauguuaaugucaguuacaaagagaaugacuccccugucuucagaaacuuauuuaaaucuccucuaagaaaauugcagcuuuucccccuuaacauccgagaagguggaagcagacacagggagacauccucuggagaguggauaggaacaagucucugccuuuguugaaaaguugagucagcaaaaucaagagccuguaucgugccucagaucccagggcacugucaagauggaccaauaggaaaguggagggcaaggagagcugggugccaucauuaggugagggcauuuugcaggcuggaauguggcuccauuguuagaguacuugccuagcagguaugaaggaucauccugaguauuauccccagaaucucacggaaugagguauucugucagucccagcucuugggaggugguggcaggcugguauuuucuauaugccuguuauuugugagaucucauggacaaauaauauuucaggagacaggaauaauauuugugaagggcaagaugaagcacuggccaguuaccuaugacacgcaauugcacaugugccaucuagccaauagcaacaagaacaaagaguauucugugagugucuagacacaacuccugaccucagccucagcaaagacacuacaauaagauguggaagagcgcugucgccucagugacaccgugugugguauuaggccucugggccaugaguaucuugauucauuauauguaugagugugagcacgugugucuuucuguauguaggugccuauguguauuugaauauacuugcaccugugugcaugaugggggccagaggacuaagccucagguauugguccugagaugccauucgugucgguugguaaaacaguucuucauuggccuugaguaccccagaggcuagcauggcugcccagugaggcccaggcaucugcuuaucucugcucacucaacacugggauuacagaugccgucaccacacaagcguugcuucccuacuguggguaaagugcuuuacugauggaacgagcucucacccuggcccucuuucuuuuucuuuuaauuuuccuuuuucuuuuucuuuuccuuuuccuuuuucuuuucuuuuuccuuuuuuuuccuuuuccuuuuccuuuuucuuuuuuuuuuucuuuuucuuuuuuucagucauuuuaagaauuguuucuuuuggacccuuuauuaauggucaaguugcucauuucuaauuuguguuuuauauuucauuuuccucauaaaauauuuagugaaaauaauaaucggggcaacuacacucucacaaacuccagauccaaugucacucucaguucugguuugguuuuuggaaaaaaaaaaaaauacuugaacuuuguuuaguccuucgcacaguuaccaggaagacauccaauuguuaaguagggaaaagggccuacugaggaccaagaacauggcagcuugugaguuuauuuuuugugacugugugugugucugugucuguauauguaugugugucugucuguguaugucucuauguguguguucaugcacaugugugagccugcagagggaugacaaagauuaaaggucaggugucuuccucaguuucucucuaccuuuuuuuuuuuuuaaacaagaccuuucacugaaccuggaacuaagagauuugaauaaacuggcugacugacaaggccugggagauucucuuuucuccaaucuccaauugugggauuacagauuugaaguccugcacguggcguugacagggacacuggggaucgaccucggguccucaugauugugcagcaagcacuuuacugagugagucccucgguugaggggcaugagcacacccuucuuagcuuuugccuguauucugugauaucacugcucucuuggaggcacugugcuugucggcagagggccacacguguuggaggagcugaagagauucuuggcucagcucauggucauacucagggcaguuagugggacuuggcaagagugaucuugaugcuuugaccuucuggugauuucugugccaaaccuacaaaacaaugcccaggagaggacagaugacaggccaagagccaucugaagcuaugcaauauuuuaaauuaauuuggcccuauagcaugggauggggagauauuaaaaacuaagucuuuaugacucagccagccaggucuuggguccaugaauauccguugacucuuggacucugggugggacugaaacuauccuuauguugcuuaaauaugauucagacugucaguucuugauauuucaaguuuuaaucaaaacagagagguggguaguaaacacucacucagaggcucugacauuuacuucaugcugacuagccugugcucagugagucugagguuagaaguucaauggugagacucucugagacugcaugaagaagucaauugaaaacacuaagacucuuaacaggaacauaaccuggccccagaguacaucacagugcuucggaucacuccagaucucuguaauuauucucacucccaucucuuugccuccaucucucuucaucuugaaguuuucauuuccucauuaacaguucacaaaggcucugaguacaucacaagaggcacuagugccagugagugugaaugguucagagcugccuaaagagaggguggacuugugguaagcucaggaaagcagagagagcauacgagcccacccacacuuguucugcaaggugagguacgccuauguuugcagguucuuggugggccgucuaugcagaagacuggggaaauuagccagcggcugcuguguguguguggcagagaucaggguacagaguuggcaagauaccagccagggagugcagugugcuuggcagaaaucaggguagagaacugggagggcagcauccagagaguuggugcugugugcuuggcaaaggucagggugcaaaucugggagagcgcaggcuaggggcuaccgggggugcuuggcacaaaucagagugcaaagcuggaagggcaucagcuuggggcuacugggugcuuggcaguggucacagcguagaucugggaggagaccaggccaaggagugcuuuauacuuggcagaggcugcagugcaaguguguuagagccaagcccacaccaagggcauuggugucagauagugcagaucucugaguacaugaugcguugcaagaagauuaugagcaggacagagacauggagcccaggggauccaagaauguauguguggguuguggaggugcuguggguauacugaagaguagguggauugguucuaaggcucuugugguuuccaagcccacugagaaugagauugguugacacuaaaggagggagaggcacaaagcggacacacagagaggaucgggaggauuucaggaucagcacugacagcagcagggagccuaggcaugcucugugcuacagaagcuacgugguuuuauauugcaucuggauugacgucacagccagccuacagguggaggucagagcagugguggagcacaggcaucugaugguggugcuccugucuagccuaugcauguucucaggcuaaguucaggcacacccaaagcuagagaguccuccuugagccuuggccaauagucagggugaagccaacagaagugagcugcagaggaaauggugggaggcucagagaagagagacgugauguucucuuguguaagaagaccuuggugcaguaagugggaccaucuccuaccuuggcaaggacagugcucuuggggcuguggguuucaaauaagaggggaggggagcuugcagauaaccaggugauguaccaugagccagaucccuacagacugcaauuguguguaggggaguuaggaggaggaaguccagagaaaguggccuggcaaaaggacccugcagaacaaggcagaguaguauaagaacucugcaugugcaguggcuuuugcgaccugagguucuguguguggaagcaagccuggcugcugaaguuaugccaggacuacccccucaggcucagggcagagucuggcuuuaggucccacucagcuugucauaguuggugccuugaacagggucugguuccacuaaacacuguuuuccuugaaguggaaacuuagguuucuuugcagcgucaguuguguuggacgguguuuugcuggggcaaacaugugaaggaguguuuucaugaagcagacacaagugaaaggauguccugcuaaagcaagcaugugaaaggacaggugaugaauucuuaacuaacuacaugcauguauugauccaccuuacauugcauaguugagcucauuuugucaggacuccauagagagaaaugcaccaaaaagcuucuggugguguucugccauuuccugcugcuuccaauguggacucucagauuggcagaguaacgucagcugagacggacucaaaugcugaggcaagacacgugcugaggcaagaccuguggaggacacgugauguuuggaggguauaaauaggacugugagaggaacuugaggcuuguucauagagcuagcuguuccaagcuucuuggucucguaucuucgcuaaucuucagugagagagacacagcugagaacuuucccugguguuccuguuggcucuggucauuccugcugacuugugccuggauuagacugaggcuuggauguuccugccaggcugugccaucacugcugccaucccaacacaacuaaacuggacugcugguguaucugugaagugugugcgaguggaucaagcugccgcugcugaccuaugaacccaucugcugauuuucugacgacgcagauaggaguugcuccaaagaaccuuuccaaacaaguucacugacccccaucauuucuuuuccacuacaucugguggguggugagcuagaagggaguuuaaagcauuuaagaaccaucauuaaaaguaggcuuugaaaaacuuaaaguuacauuuccugaccagcaaagcccgaauccugacucuagcuccugucucacuauagaacuggauaggaaagggcagggugccggggacccagagcagggauggaucagccagccgucauccagagugacuuguguucuuagugucacccugugcacaggccagggaggcuggacagacuuaacacaaaaguggaguuagggccuaaagacgaagauguauuuggugcauugcaagcaggcacaggguggugggcuuaggcguaauaagccuagcucagugguaucuuccaggcagacaagagggacuauaugagcauaaaucaagagucccagaguccuccugugcagaaccagaucauagaggaauauccuacacaugauucgauuucuguauccagaaacaaaucagcaaggcugagugcugacagaacuuuuuuuuacaaaagcaaguagugagccagguuuagcccauacaggcuugugggccagggaagccuugagaauccuguguaaggaugaaugggaaccagaguacgaggugcuaggaauccaguggcagcugcuguacuggccgaagagagucuggugcaggcuaucggaggggcugagggagaugaggaaaggcaaaagucuuggcauuuucugaaggaaaccaugaaguaacuucugugcggauggaggcagccagggcagcuuuggccugugcaagugcuaaggggggcucugcagcugacuucaaagccuguggccacuccuuaucaccagcccuucaguaugggaggaaagcagcauccaguacuuacuccaggggggacacagcuccgugauaaagcuuaguaggucagggagugagccuccuaaggacugugcacaagacugaacuauuuaaaacacagaggauuuacaucugugaaaggguuucccagaagauggucaugaauguuuauauuuuauacccacagcccugagccagcauuaaccaacugcugcucaagaauacaauaggcagaaaugcagucaaucccucaugaccauacucuugggguagagucuauauuuccagagaucuaagcacuagggcuuguacaagcugggagucugcugcagguaaaaucuuaaacaucuaaccaguauaaacaacaaauggugugucuguggcaaugguuugcaguuggaagaucuuuucacauaagaauuccuuguucuagggcaagggauguagcucaguacagggcuugucuccauguacaaagucuuggcuuccagccccacaucacguacaccucggagugguagugugugcuuguaaucccagcauucaggaggcugaggcaagacguucggguguucaagauuauguccaucuauauaguucuugaggccugccuggaauguaugagacccuauuugagagaggaauggagggagggagagagggagagagggagggacagagggacagagggacagagggaggaaaagacugaaaaguuggauugaccgcaagaacaggcaggcauccguaagaagaugcauaugcuggcgcggaggaccaagguacagggaagcuagaacacuguaccagaguuccuuuggagccuggccucagcaggauggucccuccuuuucuauucaucucugguaccaguggcaaaguccuaaugccaaucuaagaacucagaaaggcuacucuaggcuccagggcuugcgugaagggggcuuuccuuagcuugcugucagaacagcuauaaauaagugucuggcuguuuuggcuagaaagccuugugaccuccccccucccccgggauacccuggaacuagcucaggcucaugguccacagaccugaccaggcugcuugaggugugacagcaucccagagggccacacugacuuuugaaaaugaggagacggcauauaaaauaggacuuugcaagcagcauggggcaggaacugugaaagcgccuacccgguucagcugcucugcagcggggugugcucugcagccagcucccaccccuucacuccugcuuuggaacauaagcaggcuauucccucaguggaguugcuauuggaagggccaaggguguagcugaacugaacuugagucccuggaaggaagacagguccugggagaguggccagcgccaagaccaaagagagggugggcaugcagcugagcccuguuggaagugugaucucaucccagguugaaguccugacuuuuccuuccagugacaauacuucuugaaaaggcacaaauguuuucugcuucuuguaauccacuucuugcaaauaucagugcucuggaagaaagauuuauuuuaauaaugugaguuuuaggguuuuuuuuuccucugugauuaauguuguuuuauuacucuauauucuuugccagaaagugcauuuuaagaguuucaauucaaaauuaaauaugaccucaguguuuuaaaauacaauuacauuaacuguccauuuaauaguugcuuaagauuguuuggccacuaaugcauacucaguaugcuugugugauauuaaauacaguauuuuugacuccacugagcagcuaacaugacuagcuaacauaucccagcugcagcuguuugcgggagauacgagggcuuucucagaagugagcaacggaguguuguccaguggaaaagugugcccuuauguaucacacgcugggcuucucugugaaaacgccacgguguuugauaauagggaacuaucuauuauuuauuuagaacuguacaaaccaauuuacaagucagguaauuugguggcaggauuauuuauuaaugaguccaguacaugaguuaauggggcuaaacccuucggaggucaauccucaucuaacgccucuuggaaaauaaaagaggucucgucuucagcauauuaguuacuauuuuaaauuuuaagucagaugcuccacuauuagaaugaacauuuuuuucucugagcagcaugacggcagagagucagccucucagcuacaugguacuccaguccauagacugaacuggggugaugugcuuuagccgugguaacaucaaaugcauuccucuguguugugggcucaggagaagaagccuguuccuuaacaaaggugacaggugccucuaccugcuugggagagaaagagaugccacaaagagaccuggcuuccuggcccuccugccuucuggggcuagaguggguccugucaccguguucaggugcuuugccucuagggaucuccacccauuuucccuacaucccacacucccauaaggagugggaugaugugccguugugugccaacagugggcugcuacuucaugguccuaacauucuccucugaccuagagaaguugauaccuucagagcaaggcugcugugugccguaggcaguggcaugguuauccccaguaggauuucuucagucuuccucugguaaugauucaguggauuccuuuugccaaauugagaaucaugaugaaaaacugaggauguggcaacauggccuccccugugaccuuuguacccaaugggauucaacacuuucuguacuaacaggaggauaaggcucaaggcuuugcucauagcuguugacuuuugguuuguuuguuuguuuguuuucuacauugggcagucaguggggauguucagacauaaaggaaauccccuucaucuuaugacuucaaaucuguaccauugccaggcuuuaguuguagagucccuugaagcaaaugaaauuggauauaaggccuauucccaggccuuagcaaaccccauuauucugcagccugcaagcaagucugagaaggcugagagauguaacuucuaaugucuaggaaaucucugguuauucucauuacagaguggcucucaagcaaauuuuucacuggagaaauggagucugaaaacaagugcuuugggugcacgugguaggauaggucuccuuaacaacuuugcaccugcauaagacacuuguucaucagacaaauguugugagucaaguauaugcuagaagaaaaucaacagggcugggucugcucuccgaaaauagucuugguggaguguucauggcuuggcuucuuuauaaagccccgcucuaauucgccaucuuguuaugccuuguaaacaggguuauggucuagucaaucugggccucacuucuagaguuucaaaaauugggaaggugauagauuugugacauuuugggaagaggccuauacugugaccuuuucuagggagauguuaacaaacaucugugcuccucagauaagcccccaagaacaggccagagaaacaguuccaaccaaguccaguuuggugaaugagugaguuuauuauaguaccccagagagagcuugaaaaacuccccaguaacaacaucaccaaaaacucaacuccaggauggaugacaagucgaaagagcugcaucucuggagcucccuacccaccucauaggcagcuccacuacagagucuccucucuuucccagugacuguucacuaccugugagcccaguaaggagccucaaggaacugcuuucucagcuucuugagccuugcaaauugcaugagcuuccugagccuuaaggagccuccuuccuuucaggagagauuuuuuuuuuuuuuuuaaguucagaggaaacaucuacacagcaaaaccucuuacuuguguaaaggcguauuauguccuauggacaagucaccagauagcuuuuaaucgcaugccugccauguucuaagccuugcuaguaagcaauggcucuggacagagaguuugccuuggguuguuuuccuggguucagugaguccuaaucuuuaaaagauccugauuucccaaggcuauuuucuuggagucaucugauaugaaugggcuugccacuaggaccucccagucagucaccuugccuauuaaccauguagagagccagaauauaggaucacaugacacuaaaacagccauccuuuaccucucuggacaaacugucuugagguuccccaacuccugcuguuuauucuuaucucucaacucuugcuccuguggaaagcagagacccacugccuggggauucauuccccgacucuuaacaucauauguuccagagcaucuccuagcuagccuugcaaauucuuaagagcauagaccaguuagucuacagcacauaauagccauuugcacuuucauccugccucaugagcagauauugacugccuuuauuacaacauguggagaaaggaagugauuugcuuacucugagggccugugugcacacuggaacuggguagaguaaggcuaggguggaguccuuggaagcccuagaagaugaaacuauggguauauauaaguuaguccaacagagaaaccagaaggcagaggauguucccagcaaguggcucuguuugcagccaugagugccauaaagaagcuaaucagcagggaauaugcaagugguugaccagaugucucauuugagaucccugaaaagauaagguagugguaagcuuuggguauagucaauccacucaugauguuccuuuuucaagggcugggaaagagaauuguuacccaggccccccaaaaaaauucuuugggaacucccuuuuggaaaucccagcaauguggugagccagaggaugacgcuugcauuuuuacagauguguaagcauuuuuauuuuaagaagcuaaauuaaacugugagagaggcaaguaccuucuguggcuagaacauuaaaaagccucucuguuaaaaagcugcuuggcggaaggaagcaaaggcagcauagacgggaggcuauuugaacucuuuauuugccacauuuacaauauuaauaacaguguuuccagaaguugucacaucaaguaaaagaucuucauuccaggcugucuuugggggccaaauugagacuggaugcaugcauuuaauaaauuguagucucaaguagucauuuuuguaaauaauuaguuucagcgaaagaauaaguuagcauauuguaugcgucuaauguugcaggcgcacauacagcaaacuuugcuauuaaucaacagucgagcgcugcaaguggggucucauacauaaugaauugugcuuaagccucauggguuucuugauagaaaaauaaaagaaaacacaaguguagucagcuuuugaauaaaauuuaacuagauugcucugcauccuauaauuguuuuggaaucauuagggaccugaucacucaucuguaguuuuagggaguuuuuaucuucaucugucaaauaguagagacuuuuaaugauaugguaaaguguugauaaaaaagaaauuuucucuuaaugacuuacauuaaaagguauacagguauauauggccuuuuuaaagacauucuaauuguuugcauguaguauuuaaacuaucuuuacaguaugguuuuaauugccaauguguuuuaagacauaaguaucuuuuucagaaaaauaguuaauccuuauggggaagaguuuaaaauuuacauaaacuuuucuuccuuuuuugcagauguuuuaaaacacuauaauaaauucuuuugugguuuuauuuaggaucuggaauuuauucaaccucagauuuugaguuguuugagauaaaggcucauuauauaacucagguugaccuugaacucgggauccuucugccucacuuaucuuaaugagccuaaaauuuugaaggauuggugugcucaugaaaaauugauacccagcuuuagcagcauucuuuuuaccauccaaagccauuaaauggaaaguugcuaaauuucauacugucuaccucauacuguugacccuggaacagauaucauuugauggcuucugaugguauuauaaaaauagaacucaugucagggacaaaggggccaugagccgcacaggaacagcucaaugauguacugcugaguggaugucgggaccgucugcuguaggcaaagggugucacugccuuuccugcaggcuguggcauuucuguuccccaucuagaaauggcugcuuuuguuaccugcuggucugucuggcaugauaggaagccucccauugggugcgaguccuccuuugaaaguaugugcccuguuggucagcuucccgaugcuaugacaaagcaccagggguucagaaguuuuaaagaagggguguuucuuugggccauguuuccagccuguggucacucagccccuauggucucaggccucugugcaguagaacaucaugguagaaacccaugcugagaagucugcucaccucgauacaguugggagaaaggaagaaggggcgccaugucucccauauugcucucaagagcacacccagugacuaaccccuuccaaucaggccucaucugaagauucugcuaccucuuauaguaccacaggcuggugaucaagacuuuaauacaugaaccuuugcaggacauuucagaaccaagccauagcagguaccaaaacaaggcucuuaaaugucauucauaaacucucuuguuaagagugcuguguguucuuguuuuaaaauacuagcuagcauuugauacaugcuaaaauccaucacuguuucacacuuuguccauccuacguuacuuucuguggcuguuauaaaacacugacagaaccagugagagaggaaaggguugguuuggcuuauacuucuccgucacagaccauccugaaggaagucagggcaggaacucaagcaggaacugaguguaggagccgaagcagagcccaccagagagugcugcucaccaguguacucacccugacuugcucaaccugcuuccagauauagagagaaauagauauauagagauacauagagauauagauaguccagggccacuugcccagggcccccacacaguggccugggcucucacacaucaauaguuuaucaagaaagugcccuacauacuugcugaaaggccagucagguggaggcaguuccucagcugagauccccucuucccagguauguaugaacuugacaagaaaguaauugcaacacuuacuuuaauucuccuuaucuuucauuguagaaaauacuguccuuuggguggguggguagaaaaucugugacaccagcuugucuguguagugaggucauuaccagagcccugcuaguguugcugugcaacauaaccccaguacaauacugguucauacuggugcgccuuuguucaccucuggcucaacugcuuucuagggguugcucuuucuuaucauuagcaucagcucuuuaaccggcccuuccccuuuucuauucuauauccuaaaaccccucuggaaaaauggauggucagaucugcauuugaauguugccuggacagcucccaccaccaggcagugcucaggagccaucccucaucaucggucugucauaaacuggcaggaggguggagaguccuuggcagcucccuucaaacaugggguugucugaaaggcacaagugggaggcacugcuguugcccugugugccucaccuucauguccccucuaucugugcaguuggcuacaggugccggaggaaggggccaccuaugugggcacucuccccaguaagccgugagugggaucagaucuucacugaguuggaauggaaaguugaaaggcuuuauucagucuaucuuuuucuaaaaagcggucuuuauugauagcagguagcauaguuuguuucuugucuucaauccuaccccuggaagaaaaaugccuggguuuuagugggaaaacguaauuagaugcaggacacauccaucaaacacaagccacucggcuagagaucuucuaaauuagacauaauugugcgcgugccagcacggcagagcaagucuccacacaguguuuauaaagucaccuuugccgcuguuguaccucagugggccugugaagucuggagcucuaucccagagucccggaugcuccccugcccuccacaccacacacagaaagcuggagaaggcaaggugugcuuggccuuggcaauguucuucaccugaagcugucuagugugcugugguuagccucgcucuccuccuauuaagaacccugccaggaacgccacauggcgccacauggcuuccucuauaucagguugaaggacacagccuacaucggcucauugccagagacuggaagaacucugcucuauagaauucuuuuuguaugacccucuagugucauagugaacauucccgaugcaucgauugaaaagucaucuuagaggguggagaagggagaggcugggccccagaagaaauggcaugagcaucugaucuugucauucugcaugcugguugucccauagcaacaccaccuuaagggugacugacauuacaugguccugucacaugugaaugacucuaaagaaagcauagccuauuuucuuacaucgcaggguguuuaaagcaaguauguuuauuuugcugucuuggggaggaagaagucacugagaaaugagccuuuagugauucucuccuccaaaggacuuccugaagcaucccaagaccuguauaccgaagucucccaugggcugggccauguuucaaauuguugggcgaaucuguacucugggaaagaugggagaagguggugagaggugugcucuuuauguuccccuuguaacauggcaugcgcaugucaucacuugguaaagaauaagaccccaggcaaggcuccuaugagaggcuauggcuuugcaacaccugcugcacagagccuugccaucuccggucuccacucaugguuaacuaacuuuacaagaagacaagaugcacacgccacacagcacuggggccauccacuuuagucuugacagaaucacugucucauaccaaucuuguguucuguuccuggugguauccaugucuuggcaugcaagcuucacccaggaagaacaacucuccucucaugugcuagaagucuggaguggagcuuuggagcuaccuuucuuuacugagugaagagcugaaagacaugaacugcacugccaugcaccgugggccaugcuuucucaaagccaaggaaggcuugaggcccucacacacacacaucugcggcagcacaggugcaugugggcuggucuaugcucuggaauuccaggaggcaguauaugcuugcccuggaaucgcuaacaguuguuaguuucuuagagaaacccucagaacaggccuuaguucacucuccauccuccucugguagaagcugaaggaaguacagucucuuuuuucagcucucagcguucuuccaaugccaaguuaaagagugaaaggggggcuugcaucccagucuucaccacucuauuccuccacggggacagaugacaugcugaccuagagagcuggacuggagucaaccacuaggauuggcgcaaguguuuccaagggaugccaagugcagugcugagcaguucucaggacuuugcaucuuguucugggcuggugcugaggaaaccugaaugugauauuugaaagagugggccacagagccucuaauuguuggaguuucaggguuugucaguagggaggucuggagaaacuccuccaucauaagagcagccguuagcgcugcugucaugccguagcucuuuccuggacgaacagcggggaagguuggaggaagagggcagggcaagagaauaaauuucauuuuauuguagaaauggaaauuugugucauggcuuuaaaaaucugguuuuauguguguguuuaaagccauucauuuuaaauguagccccauaaauccuugcuucggaaucaaagcuguuuaauuacauuucacccauggcuaguuaucuaguaccgaaggaggaagaguuaaaaagagaaccccagagugaaucagaggugagaucuuuagcacaagcauaaaaaaucaauuuaagaugaauuuuacuacuauaaaauuuuuucacguauccuuuuaagaacgggaaaugcuaggaaacacggcuugcccuccacgagguggagggaaggccaccaugggcagcagaggccucugaacagucacugggaaauacagaaaccccagauucaugcuuuaaagugcucagagagagagagagagagagagagagagagagagcgcaucaguguccugagggggccccuaugugcagugcccaucagcaucuagcauccugaccuggauguugagauaguaguuagguaccugucuuaucucuaccuacuguaccccacccaguucuccuguucugugaagaguugguaguuuggugcaagacugaaaagcaaaccuuucccuccuguauccuugguugaggugcacauggacaugaauuucauucacugccagucugaguagguggagugaacccugaagaugacagacugcuugcuggccagaccuaccuaccuccagcagacacaccauuuuccucaguucucccauuauccccagggaccagaagggcaaaguacauuauauauuucuccaucucuccuuuuagacauccuugauacuccauucacuuuaguuagugagcuacagaaccagaauagaaugacugagcauguaucucuaaaauugaguaauaucuaagccaggcacgggcagaaguucucccucccaugaucagacauugcuaauaggaaaagcagucagggcaaugagcaguuccaucuccccaggagacucccaagagaggccuguagucugcauguggaucgagcugucaucccuggggcccacggggcguacacaggcggcagcagcggcuugaacugacacugugccuguuuguucagacucagggcugaacgaggauccugcauagcagcuucagaaaggccugugauagcugcaggauugaccaggucagggcuugguugguuguauguguguagaggcggagggugaagaggauaccguggaugcuggccaucuuuuugagacacuggcuuggaucucaccaagcagaccgggcugucuuucccuccccagcacugggugugcgcacaugccaugggucccagcuuuuucacugggucaccaagagucuaacauagauggcugcgcuucugcaguaagcacuuugccagcuccgcucucuccccaaccccugcaggccugacuacuccccucagccauccacuucugccccaguauccucauggacuguggcuucuuucuccauccaucuucuguucccuccugggggcugaguguuuagacgauuccaaggccuuuucugaaugacuuccugcccucucugagacuagcacaaaggaacccuguuguauauuuguugaaagauacaaggacuuaguggagacacagaauuccucgccaagaugcuguccuaggcaguuaagcaccuacaugggccuguuugcaaggcucugccagacaugugucacugcccugugagagccaaaucuguagugcacaaacaggggagaaacuguaccagcacccugcaucuaucuccucauauguaagauccuuacuuaaagaucucccaacucaugcuugugggacacccuaccauaggaccuucugacccugcuugcccggcuccucuuccugugacuugauucuuucuuguccuaccucugaggucuggcccugcugguuuuugcuuuagucuuuuaucuaaaacugacccacaggagcucugaugacugcagucuguggagcccaucuugccuccaccagcuuuacucaggaagccugacccgaggucuccuggcccucggcugcuccccaaucacaccuguguagggccccauucccaaagcugaguaaaggccuucccuccugccaagguguccauguguggagagagaccuaugaacugggugaaugugccaaccaucaccauauguaggagccaaaggagacuggcaagauuaaccauccagggagccuuugcccucuaagccauccuggccucuccaccgucccaugagcacucgacacugggcugccugagaagucccagagaagcuguauucuccaggcccagaaagucacacggaagcacgcugcaguccagagccugggaaugaagaggagagaaaucaccagagaaaucggauccagugucuaugccucuuggguguggaucccaagaaauugaagcaaaaacugauacugccauaaaacuccaggcucggagcccagaacauagaaauggccuuccuuuacagcauauguuuuagccugugagcacaaccugaagcagaccccagcugagcaugagcaaugggcuucaaaucaaggaacagaaucugaccccaugucggagccguaagaaaccauccaaagcugcuauaaaauauuucaguuuuaaauuccaggacauucaccagaggacaggcacuacagagagugagcaggauaguuuguuacugaagcaccuccaacuagacacccaaggcagaagaggugucaacucacuagccucaaagcauaaaacacacaaggugacgucacuucacaucggugcuagggaauauggguccauagguauacucauaggagcuuccaaagauggagcccaaagccaugugagaagggaugccccucugcuguggggauucagggugagagauagaacguggauaaugcagucuaauugccugauguuuagaggaaaugcuaguggugauuaucugaugaugcugacuuccacacugaaaccagggacaugagauguucccugugucaguuugcagacagugugcaugcagaagcuuggaaugcaugaccugggcucuccgugcacuuaauaaaccugggcauagaaaagcagacaugggaacugcugugccuuccugccccaacaucccucaguggccauuccuguuaucugcaguucucucucugucuggcagagacacacacuggggaguggcuggcagccuucccccauuagcugcaguagguaugcuuuucacacauguggucacuaagcuucuuauccuuuuugcagccccacagaggccccagcuacuccugaggugcucggugggccagagggaguuccagagccucuggugcagugcacagccuggcuggaagccuauuuccgugaacccgcagccacagaggggcuucccuugccugcucuccaucacccuguguuccagcaagguugguaaccacgcugccuuuggggagccugacuuauuaacuauggcugacaucacagcucguuuacugaguacacaggcuuggaauuuucacaucgucuaaacacaggcggcgugcggccaagcugaaggccguaggcuaagagcucacgaccccgcccauuccaagugguuauguuaguuuuggcacauggucacauaauacuuggcaaaagcaguaaaaaugaugcaugcagaucaacucuugacucuggcuuggcugaaagguuuaaaugggaacacaucugaauggcaguaaauucuucaauaagcuuauuguuaacuuaaacucucugccugccaacagcacagaaaaugagccuuguaucuggacagcuagccacuucugugaaguuacucaguaagagggacuucagaggccacuccaccaccgcauuuuccaacuucucacagauacacucugaaggaugaguuuaaaaugcauugcuugcguagaguuugcuaagggcacuugaagccucccaguaacccaagaaaacauugcauuuccuccaaagcugguucggcacagaaauuaauuaccacagcuaagaucauucuagaccuauagcagaaauuuauucugcguagugacuuugauaagaaaucacuuaauauaaauuaguauguauucacauucagacauaugcauggaaauacauaugucuccuuaaggggaaaaaaaaaucugugauuuuuuuuuuaacuaagguaaauguaaagcaaccuugagguuccgagugauguuuacgaaguguaauuuagagguguuugaauugugcuggguuuucaguucacacuugaaaacuggaguugauuaaaaaacaaacaaacuccaaggucaaaagcccucugaugccagaccagaaagugagggguaaaacgggagaucuacuuuacgcaaacaaacugaaaggacagcugggaugcauggccagccuguucuuuccugcguuaucuggaacugucuucucagaaggccacucucagcaggggugccaggauguguuaagggggucucugggagaggugggcggauaucugcagggcucugcguguccagugaccacaccuucauccuccacccacuggggaagagagcuuggccgugugccugccugcccacacuucgagucugucaucuguggcucaggugacugugugucacucuugaacaccuccagcugcccagcccaggggacauauguugcuauggaguucaaggaagugagaaguggagggggacucuuccaaccccacccacaguaucccacugggguuacugccuaaaugguaggggcggggaggaagagggagagcaugagccagcaagccacccuucucuuaggccugccaaggacauccaauaagguucagggucuccgaauagaaaacuaucuuacgaagacagagaugucuguuaaaucccaugagguaguagaugagguaugagcccguaaaauccuaaccuuugccugagauugguuauguggcuucaggaaaacuguagaggccaaaauuguaaggaaaugacucacuuuuggcaagccaggcaguagggucugcuggccuggugccgccaggguccagagaaaagcuuggccuuacacagaccaggccagacagaccuggagaagaugugaugugugucaugucauggucaggguagagugauaaccaagaguggcguuagaacagccaggcgucccucagcaacaauagacucagacuggaucccuuccacccucucugcugcuccugugcgugucagugggcuuccaauugagguaccagacccaaggaguccccaggcuuguccccagcacuucaggagcacaccaagcccacacugaggccacccuaugccagcaggccuuuguggugguuuggaaccaggaagauauauaaccaucagaauaagguggagccaugggccgcccccggcucugcaguacagacgagcacuuccagauagacaaauaugagauagguagaauuagaaagaacucggcuucuuacacacucuucuuccuggugcguuaugaauucuaagacccagucuguuagcucccaaggucacauggaugaggccugccucugauaguuaguggcugcugugggagggggcaggcuuucccacgccccagcaugugcaggccagguuuuuucaauuuaguguagucauuugcuucugggcaaggaccaggugugcagauuuuacaguuugaagaaggaggggguaggguugguuaggguacccuggcuuacauugaauuaauugggucgacuccacauguguaaaugacccacacacacaugcuggcuuuguccaguuugcaucuuguaacgccagggaaguagacagcaauacggaaagucucacugagagagcaucuugggauaucucagugugcuuuggaagcugaggacccuagaccaguccguucagagcaggaagaaaguggguccacucugauauggaauuaguguuuccuuugcccauucuguccucugugcauuuuuaauucuggaguugucugacaugcuuuugcacaucuuugggauggagguguuuguuguggauuauauuugguuuguuuguuuguuuguuuccauauucuucaagauuuagucauggucuguccauuuuuaaaagaagauuaugggcuuggagagauggcucagagggaacagagcuugcuauccaaaccugacuaccugagaccagaucccaagugcccauauaaacgacagacacaguggagcgcaucugcuaucccgguguaccuaugacuucugaugagacaagagaauucucagaagcuacugggccaguuagugugcccagggcccuauacaauguugaagggaggauaagggggucccugccucaaacaagguggaagcaagaaccaaccgacaccaacauugucucugucgacacaugucccauagcaugcacccacccucgcgcauguacaaaccuguacaauuauaaaaugcccuguggcaugcacucaccugcaacauuucacgggaggcauccuagaaccucugggucuccugacccacccuggcuguggccauguagggcugguccuguggaucacagucucccuuagugucuacaaauuucuguauguauuagcagaugugccccucccuaggagacaucagagcccugaugggcaagcacauaccauacuugagaauuagugcucuaaaagaaacuauugaacuugcucuggggaagggagauagcuuaguguuacagugcuuaccuguaguaaagugcuugccuggcaaggccaugaguuuaguccccaacagugccaaaacaaacaaacaaacaaacaaacaaacaggaaguaguuuccaagucuucugauuccugagugcuuugugcaacaugauucacccuguguuggguugauguuuuuuggaagcugugacgcugcacacuauggagugaugugugcugcuguuuguugacagaugacgcucugggcaguguguauguauauaugucuaaccuaggaaugugugcaaucagagcaagaggugugggcauucauuucugucgugagaagaguuagcuaagguuccacauguuaccaaaugcuuccaagucacugcagugguuuagaaguugcccuuagcaucacaggauuacgcccagaaaaacaccguagucaaccaaaaguaucaggauuauguggaugcuucuggcugaaauauguguccccuuuaagauagccugggaaugaugucacagugcuaagggcugugagugaaggaagcaguaagagggaggaagagcggcuccagagccugcauuuuccuuagaacuaucuaagaucgaccuacugcaggggucacugagggcuuaaauacacuacaaugccaucucaggacagaaucauaaccugccaggccccaagaaauugggggggcaggguuauuccuaugcaaagagcccaugaccaaucagcaguugcuaaggcacuaagaaaccuagcaagcagauagcuaggucuggaacuucagaggcagguccagacuuugauccccaaauuccucagaggucuccaugauuagaaaguugagguggugaaggccucugccccaggcugcagagcuccaccacacaacccagcuauguuuaccagaagccugggaaaaagccagccaaauucaaagugcugacacaggaccccaucauaaccaagagcauaaagaauaucugcauucauuauacaugcuacuuuugugggaaaacguuuacuauaauuuaccucuauauuuaccucaggaaaucucugaaagugucuaugaaaaauaaaucccccuugguugugucagcacauacaggggcugucuucaucuucagaauccuaguguuggaccaggguguggcucuucucccgugaccguggguucagauuuccacaggagaaaauacaaaucaccuuacuacagucuucaggagguuuaaauuugcgauuaccuaucaaaucaauauuuauaaaagaaaaauaggucuuucaauuaaaagugguuuuuaaaguuguauuuccacuguuagcuguagauaaaaugugguacucagaaagcgaaugcacagauccuuauauucuguuguccuagaauauuauguguuuguauaugacagguaaccuuaaucauuuaaaauuaguggaauuuauuaaccucauagauaaauaacauuuuaacaaagcauacauggaauugcacugcauauuauaauauuuuaauaaaugauuagccuauacauuaucaauauauuaaauauuggcauucaacuaagaguaaugucaaagauauuaaugauaggagauagaaauguaaaaauauuccuugacuuuaauguuucccugagguugaccuagacuccugaagguucacucucuuaaaaucggagauuuaugagucucucaucuaagagccgccuccauagcuuauggcagaaggaaaagucagauccacagaguaaagaaagcuccccuccuuccuaggguaaccagcagcauggcugauggcucugggaagcugggaaaaccuccaggccuggggaccccgugggcuccccaggccuggccagcccugagccaugauuuuuaugccauauacuaaauuacuucugaagaaaggugaaggacaaaguguggauggggcauuuucaaaugcucauaaauacuuccgcuguuagcucagaucaccugaggguucucuuucaccagaguagucauucgggcaagcaucgggaagucgcaggugagcccugccccucagccagugugaacauagcugcucuguuacuaugguaacaacuuuuuuuuuuuuuggacuaccacuguuaauuagggcacaaaugcguauuguauaaagggaacccauucauaaacuuggguaugauuucacaugugaguuuugucugccuuuaaauaaauaagcaaacauuccugcuugggcugggcuccgcugacccuucccaccccuccaagcagugugcuauuccucuugagcccuuccuuaaguaaauggcuuuaggaagacugagcaacugagccagggugacagcccggcuuauugcagccaagacacacuuuucauagaaauucguaucucuuuccuccucucagaauaaaauaugcaagaacgaacauaaauggcauaucccccuucccuuccccaagaauugggccuuugauguucaagagcagcgaauauuaaaggccagcccuggcaggcugcggaagccauacccauuuaugacaaauguaacacagcacaaaccuagccgaaugcgaugcuaucauuaguuugugagucgcauucuugaaaauaacuguggaggagccaaaucgguuuaaaagaagauaacaaaaugguuuaagcuacuuagguugaaugccaauuauauuuuaauauucaacugagcauauuuuacuaagaaaaaaggcagcguugacgcaugcauaacucauuggcagcgucgaccagcugugccacuguacucuccgaaucacuuugugcauuuuaguagcaugguaauuuaguagaggccuaccugagugauggcauuuucaaugagcagguaaucuacagagaauuuuuauaugguuaugaguucugugcuucagcccagcaacacaaaaauacaucaagaccaauuacgguaucagcuuucagugugauacccucgccacgcaagugcauguauuucugccccaggcauuucaaauugcaucuaauuugaaaucuuugggguuuuaauuaaauuucagaauauauggaauucuucauuaguaccugcucugaauagcagaucccucuucccuccgucucucguuaaggaaguaggcggugguaaauagugugcucaagagccgaucauuuguggggccuggguauuggaacagaaauggugaaaugcaaaauaauaucaaaaagauuauuaguccggggagagucucuugauuuguauuuuaauggaauuuuacauuucucuuaaugauuugcaaauuguccucugauuauaagaugcauuaagcuuuucauuuuaauggcaaagacacagccauuagcagaauauuuuuccagucuucuuuuuagagugcuucccugcagcagauaaauauugaaaccauuaacaccuuuugaugugcacuccagccuucgucauagaucccugcauggccagccaugauggcucacagugaacaccuggccagggacccacuuuccacuugaggacaggaagaggccacaauaccuguuuccucucacuagaaaacaaacuuuguuuucaacauuucauuggguggucauuuguguuaaaacugauccauuuaaauauuaauaaugguccaauuuguauucaaaagucagcccugcuagggucaagacagguggaugcugccccagcuguagccugggguugaccaugaaaagaacagaacagaacagcuucacccuauucuucaggaggcuuccauggaaacccagugcaucgagggagacacagagacuguguuagccggaugaccaaccugaccacacaaccccacacagcaacacuugacuuuugguuggccucugaaugauacuuugccucaaagccaccacgugcugcuucuacaaagcauaugaguacaagggcgaagcagccucccguucugcuccagcagcacccaggccucaggaguuugacugugagguggcucagagggcguguaagaggcucucggguguguggcucuugcucuguguaacccccucauacuagaguucugcuucaugguguagaaauuagggcugagggaguucuaaaaaggcuuugcugaguguggcacgcaguggugaggggaaacugcugucuuguuguagagugcuguccucuaugcaugacaugacaugacauggcaugaccaucaccauuuugaauacgcaauaggaagccuaccccagacugggccuauuuguguuccauguagccaggagugguccacgaagcuccacacuccccccaccccccuucaggauuuauaagcaguuaaugguuucuagcugggaaacauucacaaagcccagcccuuccauaggcuaaauaaacaguuaaugguggcugagagacacuuucuccagugaugcagucacccaugaggaacccaugcuccaguaggcaacaccaaauuaaaucaucgcuucaccaaacuaggcuaggagguuuuuccuuuggccuguuguuggaacgcacucugagugaguaggcauuugucuguccuccucagacaaguucaugcauuuaucacagccagugccucugagcaguuacuacuucucuuaucucaaaguagacacuggauggcugacucuugaggagaugcccagggaguagcauaccuuuuugguugauugguuaguuaguuaguuaguugguuuugguuuuggcuaguuuuggacaucugcaagcagguaccuaucaagaugucuuggaacugagcauaucaccucugccuaggacccugucagcaaagcccuugggaguugaacccauugguguggcuguguaguauagaauacggugacauugccuaaacugccccugaccucaugaccuccgggaaccucucuguucucuggacugccagaauaaagugcuacaaacuucucagagcucuggaggcugagaacccaggaccaaggugucaacagggcugauuucuuccaaggucucugcuuuugaguugccuuagaagaaauggccguccuacaaccaucuuucugcaaccuuuucucaucucuagcaucaaccugacuuccuaaggauaccagccugaugggauaagaauccugugaacuucuucacuucagaaaggcccucccaauguguuguacucugagauccuuagggaagggcuugaauuuauucauuuaguuccccuuucugggccuaacaccuccuaagucacuaacauccugagugaaaacaguaguugugcuauagaaagcugucaugaccuagcacaagaaccacuguaaggcuccagauauguccuuucaagaauccacagucuggagugacucucagcacugagaucugcaugaucugaaacucauagaagccucagccuccaugaugaggggucauucugcaccuccuuugagcuuaccuauguuccuucuguuugcuguguguuacuggcuauaggaaugugguugccacaguccugcagcuuuucagagagcauuugggauaguaucccucucguaaauaagugcuggagacaauuaugacuuucacuugggaaagaauauccugcaaccgauaaguucguuuccuugugcauugugaaguccuagaucacaaauggcuucucaaagacccaugagaugagucugcagccaaaaguucuugcugccacccuugaugacuugggauagugaaaggagagacacaaguccuucaauguccucugacuuucacauacauuccauggcaugcccaugccuauauauaugcccagauacauaucccauuuaaaaauguaauaaaaaguuaagugaaugcuugaagggacuacuggucccgaaaggucauaacuugcacccucuggcaggcuacugccggugacaugguauggcugggccugagucugguucucuaagucagcaugcacagucuuucuccacucuguaguugcucuuccccaauucuacagggaccacguaaccauccagccuguggggugcuuuucccugaauguuuccacugcuccuggcuuucacucugcuauuuacuccuuucagaguccucggcaucaauucuucacuguguacuggacaaaaugaguugcaggaagcagugaugagggacacauaaugcucagcugaguaucgccuccccccuucagccauggugcugccacuuaguugcccugugacccagagugcuguauuuccagcauuuccccuagagguugaacauacaucuugucccugugacccucaggcuguaggcaccagguaugcucaugucucuucuguaccccacucuuguugugaacaugggagaaagaggucacaugauagauguuugcugaguuauugcugucaugagacaggacugucagagcuucccuagagcaguucuagaacacauaugugaagugcaaacaauaaagagccagccacaugugcuccaaccagcacugcaaggccuacccaaggccccagcccugcauggccccuccccuuuccagcaccaagcuuaucauuuaaaugagcagaauaucagugucuuccugaguugcuucuuucaaucaauguguuuaugaaaacagauauuuaaaguccuacagagaccaccaaugucuuaagcuacuguggaaaaucccauguuacaaauacccauccguuuuccccuguccacugucaguggacauggcaguuuuccccagauuuugccuuuaaaacugcugcuguugcuacuguaccugugauagucaucugucuagugucccagcugacugccaucugugggcagguggcggaagaagagggagcugggcugagaaggaguuccaggagucugguguccccuugagccuccugcagaauacugucaugaguguguuuugaaggcaaggcagaagcagaacggcuggcgagcugacugucgagcauucccagagcacugaacauaacuagacccagaaaauauaugggcaaggguggcgaauauuuucucagcauucuuauuuuuaaaauaaucaacuacucacaguaaaauuuauuuuguauuacucccuauuugggguuuuauaauauauguagaaguaaaauacauaacaaguguagcacagaagauaggacuggggacuggaaaugcauugugauauguuucuuauguuccugugagcaaguggggacguuauuuaaggguagauggugauaaaucaugaugcauauuaacaauacuagacugccacugaaaaccaagacauagagcucaaaaugaaaugcuuauuuuuaaaacaaaucuaaaggaaaaccaaggaaaggaagaguagaugggagaaauauugagcuggaagauucuaauccaaccacaucaauaauuacauuaaauguaaauguucuuaagauuccaguaaaauggcauagaugaaaagacuugucuuuaaaaaaaaaaaaaagccagacucuguuaauuauuuucuauaagacauagauacuuuaaaagaaaggaaaucugaggagacagcucuguugguaaauucuuggcuacacaagcaugaggacaugauugccugcucuugcucagcugucagaagccaguguagauauuuaucaucccagaacuagagaggcagagacaggaagauccuuggggccuucuggcuagccaaucuagccaaucagugaacuccagcuucacugaaagacuuucucaaaaccuaugguggagcauaauugaggaugauauccuaaguugaccucugaccuauguacaugagcauauaucuguacccaccuggacacaguuauacaugaaugagcaugcacacacaccaaaaauauaagagaaauaguacuauauaaaacugaaauaaaaggaguauauaucagaaauuauuaaauguagcuguguuuguuuuuaagcuauaugauauauaaaauauccuaaagaauuuugaaaauauuaaauaagugaauucaacaaggugauauauacaagaaugaguucuguuauuguauuauauggaauaacaaaauuaaauaaguauaauauugucauauguaaaguguugauauaugaaauacaugcaauacuucucuacugaaacauauaaacaagacuaagaaaauagauacacauuaucccugaaaccacccaugcugcaaagaggucauuucuuuauaagcuguucucauugcucagcucaaccaggcuuuuaaauucccaacugacaaugauauuuagaaagacccuaggacaccuaaagaaagcuuggaaaauaaaaauugagggcuauggguuuucuucuacugcaaccucaaagaauaccauauguauauaugaaauuguaaaaggauagauagauagauagauagauagauagauagauagauagauagauaguaaaaguuggagagcuuacauuaccugauuuuaaaacguccuucaaauuaugguacugaagacacuuugauagggauccagauuuaaagcagagacccaugcaggcugcaacgguagaaggcucagcagugaggaacacauagugcuguggcagaaggucagaguuugguucccagagcucaugucaggcagcucaaaaaacaccuguuagccccaguccaggaaagaugauaccaucuucuggccuccacagaaacugcacucauaauacacagucacacacacucacacacacacacacacacacacacacacacacacaaaugcauacgcacagacacuuaaaauguaagucuuuuaaaaauagacacguauacuuuuacagucauuuuaucuuugaaauaaauaaauaaauaaauaaaugggaaauaaaggugucucaacaguagugaagcaacuggaugaccaucuuuaaaagaugaccuagcuuaauuccuguuucacaccauaaucaaaaguuaacauaaacucuauaauauauuaaagcauaaaaguuuaaaucguggauaaugcuaugauuuggcuaggcagguauuucacauauccccaaaagauaaaguuaagaaagaaacugccagcauuguugcaaguaaaagcaacugagaaaaugaaugggcaggacacagaggagagaaaucuuuauaaagcauacaucaaagaguuuguuggagggauaugugaagauucaaggacaggauauugucuucacgaagcaguauaugcaaauugucccggagacacaugaaauuagagaaugucuuuggugaaaucccagauaaggcaauuaugaaggaugccugccuaggcccagauggcugaaaugaagaauacucacaguaucaaaugucucugaggauguggaguacuccuccaaugcauguuggaggguuuggaugguagagcaaucuuuaggguuaaggaugcucccaugccuucuuacccaguauucuuagucuuagcacauauaugaaagcugcucucaguaucauuacuuauaauuaccaacaccugggaugacccaacacucaugggggaauguggauuaauggagauaguccacagacaucuaaugccuguuugcaugcucagugacagggacauguggaacuguagcugcauucuacacgagcuugucuugguguaggcugcacaggagccaggccuuugcuuacagaaugucuugcuuugcuuacagaaugaaguucuacaauuagcaaaagcugaucaggggcagaaaaaaaaaaaaaagaaaagcauaacugccucuggggugugcagacagcaacugccuguacaggagaccugagggaugucccagcauaagucuuaacaacaugggcuccauagguacauguauuugucaaaacucaucaggugcccacugaagauguguguuuccuuguacacaaaugcuaccucaaaggagaaaaagaaccagauuggcauugaacucuuaauuaaugacauaugagcuaacuugagaguaacugaugucuucgguugauuuugaaacgugguaaaaauauaagaugggcagugaaguugagcaccagcuagaaugaggaacagcaaaugcaggcacugugagcauauuccuuggaaggcgcgguucuucuguguguuagaagugaauguuacggacuucucuuucuagaaguaaaauucgggagaaagaugaugaacccagcccuucaguucccaaguaaagcugcagcugugcucagcucucugagugacacaucucugucccuuccggcugcacuggaagacauggcuggcagaaaaggaugcugacauuaaccaaagccugugugacacagccauguuugugaaagucacauauaaaagaaauauaucuugaagaccucugcugccaaccuugucccaggcacagagaagaagguggccaaguaugcuggcucugggggugauaguaaucaccccaugaacagauaauacuacacagccgcacagaagacccucuggaaagcaaguaggugucugcuagaguggccagcuggcucucggggccagagccugaugggaugguguggagacugaacacagaaugaagugagagugugggcaaugccaaaauccagguggaaagaguccaaggcagagggccaaacaggcacaaauguucaagaaaguauaauggcuucuagaacaauucaaaugggacagcuaccaucaagcaguugagaaaaaccaucagcagaagcucuggugagugcaugccacacacaauaauacccuaagagccaguggcugugugugauaccggaugugggcaguguggacugugaagaaggaacagaaggugauggagaugucuggauacugucccagaaacaagugacacccaagggacuugcaggaaaggcaggagucuaagugugaugugggucuucuacucugcagcaggucaucugugccccugauguguggguugaaaguugaagacuuaggucaaggguaggguucuguggaacuguguaaaggugagguaccuggggugcacucuggagauccugagcauauguugaaucuguacuggggcagucagcaucagcagugagccuucugcauccacucuguagucugagcuggucuuaggagugagggagagggagccagggcaggccuuugcucucuguagccuguucugauugccaagggacaguuggguaaggaguaugugaccaugucaccaugucaccuugcacuguuccuugguguucccuccagugaccacuucugcugucagaggauucacagugacauccucaggcaucugccccgugcugguuccacuucauugucaguagcuguugacuuaaccaaguaaagacguuugcucaugaauguuucucagugaugccccagcuguuguggaaccuggagaugcuuucaucugcuuaugacuaugaccuaugauugccuggauuucaagaggcaguuugcccaguguuucccaguuaucucuaucccucuucccacugguaugcauacauacaugugugugcauucgccucuguguguguuggggggggggguggaaaggggcuauacaaugcuucuugcuccagcacaaccuugagccguuugaaagugucacauuuggcuaucuccaugcuccuuucuuacccguggguucauaggucuggccguauguuaacuuuuuuccaguuggacugcccccuacacccuuauuugaccauccaccuagcuuugcuuuuccaguagugguaaggagaggcugucaccacucaaaccugcacugcuaauggacacggagggcccacaccaccauucccaggagcucacuguagcuuacuauguuuucugcaucaucuuccuaccauguguucuguugaaacccagugcucugcacagaaccagugugugaagagagcauguuugcuucacucagccacucccaggcacagacuuagugaggcaccuugaacuuuuaacauugaaaaggguuugcccaggacugucauggagcugcagugugagucugcuuccugacacuauagcacaugcugaagaugacuuaggacaaggaaggaugcguuuggcucaguguuggggaucaguccauggucaacugggcuauagaaacagagaacauggaagggggccaaguagcagagagaggagagagaaaggccagugacccguuagcaccuuuagggacauaccccaaugagcuaacauccauuuccuaaagaccacuccuguuaaagaucacaacagcucccuguagugccacagacuggggacugagacauccaacacaggggccuuugggaacacacuacagaacugcacaguaguggucagaagugcccauagucaccugagaaugaagacagagaggggcugugaggugaguggccuggaaaagauggagagacucauagaaaugagaggaaagaggcugaaggagagccuacuggggacacugcucaaauggaguguucagagauggucuugggaaggccguaggaaugagugaggccagcagcugaucuuaucgugguucugccaggggagacaggacaagacagugaaccccauaucauacuucccaaguggcagcagucacugugggugaauucaaccaggucccucaucugagaugauaacaauguuagccccuuacacauuaguaucuuauugccucuaucugugaaauagucagagcauaaaaagcuaaaaaccccuauucccucaggucccaccuacuccccucaccuggcucccuggucccuaauccccucccaccaccacuucccacacuacccugcuccaaggccaucugcccagaagcacuaucucuggccaugccccugcccagcaucccuauaccuaagacucuggucuugguauauauugagccaugaggagcuccaagcagggacacuucacucuuccccagcucucuaagggcaaagacacauggcagaugucaguauacaggggcugcuuugugaaugauucuccauaugugauacugaggaaugaguugacaaauccccuuugccuccgcaugggagaggccauuucucuucagccgcagcagugagccacucccaacaaccacagggccccauagaauggaagucuccacccucgggcacaagaggaaguccagccucugaaccucucucuucccugaugaaggccacuucagggacuggaugugauaacuagugaagaaguuaagugugccaccccacucguauggccuuuguaucccauucucuccagggagguguagggaugcaagugcagucaccaugugugugccaggcuccccuacauggugggcuuccucuugagcaggugcagcccccuucccaucugccugccaucccagcuaccugcccugugugcuccccccucccucaccugcauagccucuuccucauuugaauaggugagaaaccaaagucagcugccccauuugagcuugcuuccauugcucagaauucagucacaacuucuuuugaauuccucagcugccccgaggcagaggcucaauguugguacugagauuaauccccaaagagccccucauuucucugcagagaaauuagagcugccaguuuuccuuucgccuguccuucugacagcucugucaguaaugagaugccuguuccauggcguaauccccauccuacggugaggaauaauucauuaagaaauuaagggcccggcuccuuuccguuggguuggucuucaaaaguuagcuaauggcgacggcggcaugauuaucaaugaaaaauuauucagcauaccucagggccauuccagacacucauccccccucucugggguugucaguguccuagaaauuaaguugggugacauggacugggaggugucugugugagaggccagaagggcaggucaggcacugccccacuuugagagaaguuucuucuaaaauuugggauuacagugugagauugcugcugacagcaguggcaauuucuccccaccccacccaacccacucuauccacccucccacccccaguccuccaaggaagcaggaauaacauucagagaaacuucuagugguugcauauagaaugcacaagacagacagggaggggcugcauauagcucaggguucgggggucauggacaugguuugguuuuauuuuaauguuauauuuucuucuuggguuuugaaauacaguauuagucuagccuaaacugaucucaaauucaagguccuccugccucagucuugcucagugucacuggugugucuaggaaccucuaaguauuuauugugaaauacauggcucugacccuagcuacccagugcucauccuuggagcgcauugaaacccccacaaggaaagggugauuuaaugguagccuugcugucugucgcugacuaugggaagcuaagagccuugaaggugggaaaugccgauaacugaaucagauguucuauggaauguucugugguaugacagggacacggccucuguguauagaccaguaagcaugcaaggcaagguagugucuccuucagagcgaccaguuuagagcucagagcagccuccgucugcagagccuguggcauucugaggaagggaaagaagccaugugcucccaaggagacccuccaggaagguuugugcggggccaggacaucaaauggcgugacagcaagaaaccuuagaguugguuugauuuuccuucauuuuaugauuaaccucaguaguacaguaccgaccccaagucagccuucucuaacacagcucuuccccuuguccuccugcccucuccgacuguguuacacaguguauuucuccguaugucugcuauuguucugacgacauuaacccccgugcaaaagucaguccuucgucugucgagcugaauggcaauuauuugagugguagaggguguuaacguguaauuauucacauucacacccggacagucauagcuuaaucauuucucuguaggcuuccugaaguuugugcuuaaagucuuaagcauaauucuuuuguuaaguauguucgggaggcugggagguaaaugcacauccgcccaggcagagcuucaaggcugccccauccuaccuccugggaaugcuacuugcaggugaaacccccugcugguuccuggcucuuccuugaggcagaagguugguuucuaagggcuaauauuguaaucugucugugagaugagcucagagauuaugucuggggcacuaggacgagacagaacaggccagagagcauuuccauuccugagugcuaagcccugcauagcucuagccuacacugauggacucagcuuaacccuggaggccauggguucuuccaaagcccacugccucuuuaaaauuguuuaggagccaggcguggugggggaggcgcuuuuuaaaaaugagauuuuuuuaaauauauguacauuuaucauauugaaaaucaagcccaauaaucauuuaauauauuuuaaaauaacacuaaauuuacuccccaauagauuucgaugaagcugcacucuguggcaaaugcuuucuaagaaaggcugugucacuuuccaucuuuccagaucucuuuauagcgucuuuauugucugacuugaugacagaagacagccaguuccucagacuggcucuuacuucuuaguugugguggagggggguuaggcauccagguggcccuagacauugggcaaggauggcuuuaaagacaauuuggaccucacagcccacccaccuccuaggccccccucaccacagggagagcuacuauucuuaaguaucaaaaacaaacaaacaaacaaacaaacaaaccaaaacaaucaaacaaacaaaaaaaaacccuuagcccuugaaauccuaguuugcccuuugaagucacacuagaagucccucuuacugccucgcacccaaagccauguggagaugcgugcaacuguggcucgugucauucuauguccccucuccauacuggcugacuuguaucccaaauccagccagcugagaacccuguccccaaggugaaauacugcaacuaacugucaucaggacagggucaguguugucucacaaucucccccaacuuaaccccaguuuuagucagaguccuccaagggaauucuaucauuuuauacucuauguucccauuagccuagcguguucagcugcagaaggugaguguggaguucuaagcugagcccccaguuccagagaaggugcugucuucugggaucagccacacaucagacacuuuggguccacucuuuccaaacuugagagugccucuugccaguuguguccagcccagaacaguuacaacuacaggcuucacguccccacagugccauacacaagagcauaggccaaggccagagagggacccccugaggauagcaugauugggaaaggaccagaggaucugauggagcgccuauccucaccuagugccaaggugaagaaugccuggugagaggggcggaugaaaaugugaauggaaugaccugaaguaaccaugggccauaccucaccauaagacacuugaaacggccuacguaagccuuuacauaauguauacuuuguucaacccaauuugccagaggugauaggagacagcagugaaccaaggcgugggucucuguagaguuggcgaaugaucuuggugggugucggcuguagggaucugaggcggcagcagguccugaugggaccugcacaucccuaaucaugugcagccucagacacauacauccuuugguacaugcagaaggcucaucaagcuuccuccuugccaagcuagaggauaggccaggaugucagccggaccagagcugcucuuucagaagacugcuauucccugacuguccucugcuucccacucacccucucaccccuccagucagacccuguucugguucccagugcugacguuucagaugacacccaugaggccuacaccuugcauucagugagcuguaucugacagacaacucaugauaguguuauugguggucauugaaggugaagcuuacagagguaaagauuaugcagaaaaugugaccaagaugccauuuugaauggaaaggaccauucauucccucgugaacuuuugauuaauaaagcuacugggggaaaggugaauaagaaauggguucaccuuaucuuaucccuaucuuuuugguguguguguguuuauuaacaugucaauguuggcuuuuugagguagguaguuguauagcuuuuaaugcuugccagaugcuauggcuaccacuguaaucacauucagagggggaaguccuucacucuuggcuaguacucuucuguucuuuaccacugggggcuuugugccuuuacaagcucacaacccuggaaucagacaguguuuuaaccuucacagcuuaccuccuuuggcucagcuuacugucuuugagauugguccaagcuuugcacaugucuacagcauacguuuuaacuguuaaguagaguaguacuucaugaugugaauguaccuccuugauucaucuauuugguuuuguguguguaucuguacacacaugugugcauguuuguacaguacguguguguguguguguguguguguguaucaagaggguaggaagcacacaggccagaggacaaccuuaguugucauuccucaggugcugucaccuuuuuuuuuuuuauuacuacugagacaggguaucuugcuggccugagaguccaaccaucuggccauguagcccuauggacccaccuaucucuacuuucccaacacaugagguuacaaggauucagcugucuuuauguccucaugcuuacaaggaaaacacuuuacucgguaaacaaguuucacuaccaaaauuaucuuuuuaaaaauuaauuuuauuuuauuuuauuuuauauauaugaauguuugccuguauaugugugugugcaugcacacagagaccagaagaaagccaaaacacaccaccuuaaaauauaaacaacccaccuugagcaccacaggacaauggaaucucauagugcaaaaugcauucccucugacuauaagaauccccauggucauuuggccuuugaggccaggccugggcaaacacuuucuugggcugcccuuuuccugggggcagaaucucuucuuuccuaugaaucuucacuguuacaagguuaugguuucuguagguagccuuacccucagagaaccuuuaucacccuaucccagaaugugaaguuucuuuguaaugaucucuagcaguugacagugccccugccuuuuccacagcuucacccucauuccaugccucuuucuuuaccaagcugcacaguuuucuucuuucucuaacuguaaaucugacuaagaacagugagcaguaaccaugcuauauagccuagcuauuaugcugucugggaacuuccuucaccaaacaacuuaauuacuuuuuaauucagucuuacucugguuuucaggacaggaacagugugcauccagauaccuugcuggaauggauguaucacaaaugcucucuagacuaguucucaauugaguucccucugaaccuucguguacuaggccuccaaugucuacauuucccuugacauucuagccuccccaacuccuaggcccauuaaguucuaccuacagcaucuucaggcuuuuccaacccaaaauuccaaauuuucccaacauuccuccuacaaccucauuccaaagacccaagaaccacauagguuuguuuggcaaaggaauauugguguuuuuuuuuuuuuuuccaauguuguaucagaaacaaguuucaguaggaaagguuuauucuggcucacagauugaggguacaacucaucaugacagggaugguguagaggccucugcaccucccuccacagcugucacauugcaucagcaguugggaagcagagagggacagugcucagugaggccuuuucuuuuucuucuuguucauuaugagcugcuaacuaauggaugguaccucucacauucagguaggucucuccuuagcuaaaauuccauggaagcacuuucauaggcucauacagaguuguaccuccuaaucgauucuaaaugcacuugagccaagagucaaaggucagcauuacaguuucuuuaaaaguuuaguacaucuugaaaccugucaguaugacaucuucaacuuuuauuguuuuugugaaauauuuggguguuuucagacccuuuuccuuucuguauaaauuuuagaauuuacaacuaggaaucuauaauaaagccuuuugggguuuuuguuggaauggugggaaaucuuuagaucaauuuguagagaauugaaaucugggagaucugagaaucaauuccaugagcccgguaugcugccauuguuuugaaacucuuggucuguggggacuuauaggcuccauucauuuccagaguuacaucugaggaauucaauucucuguccguaggcacaccgcugcacaguacaguaaggaugugucaugcugcaacaugacuagacagacaucucuuucacagccaaccuuuaugaaggaccccagccuccucacuguuguguccuuucuaacuuaaacacauggcuuggggacacaguguuaagucucuauaguaccugauauucauggacuaucauuuucacugcaauaguaucauauauacuaaugucccugucaugguuugaauaugcuuggcccauggaagugcuacuauuaggagguguggccuuguuggaggaaguguguugguguguaggcggucucccagugcuuaagcuucacccagaagagccagucuucuucuggcugcguuuggaucaagauguagaauacucaguuccuucucgaucaccaugccugccuggaugcuaccaugcuucccuccaugaugauaauggacugaaccucugaaacuguaagccagccccaauuaaauguuguccuuuauaagaguuaccuuagccauaugucucuucacagcaaugaaagccuaccuaaguccacauccuggcuuguccucuguacccugccuguucagucucucuucuuccucugcuugcuguguccugacucgauggcucaguuuucucucuguguggcuugagcuuuucuucacuauccuguggucaggaucacacaguaggcgugugcacaguagucuuaugcugucuucuucugcucuaaguucuauguugaaggucccucuguacguaccucuuugcagcucacuagcucgucgaauggcuugcacaaugcauguguaaugccgcuuuguguguauauguuaagaggcacuuugauugcuuacaguuguggcguuaugaacaggccacgaaaaauguugaugggaaaguuugaggacauuaguuuccaaaucaaauggaacgaauaggagcauggucgccagaccacaugguaauguucuguuuaacucuguuuuuaaaaucaucaaccuagccaaauguggugugcacaccuguaauuccagcacucaggagaccuaggcagacaggcugggaguuuaaggccaguggccuacauagcgagauccuuucucaaaaaaauaaaauaaauuaaauuuuuaaaaaauuuaaaaaguuaaaauuaaagggaagaaauaaaaugaagagagaaagaauagaaacccccaacuacuuuccaaaacagccauacaucuguauucccacuacaacgugggaacacuccucuugcuccauuauccagcacacagauuggggaaggaggguuuuagccagucucacggggacguauucgcauguccuuauuuacugugcagcuccaaagacaagcuaugaauaucuuuccauuuucuuaguggucauucacacauaugcuuugauaaagugucuacucacacuugccccuuuuauaguuggguuguuuuccucuuacugcucaaucguaggacuucuuugcauguuuccuguagccuuugucagauguguauuuugcagauguuuucccucggccugugguuuugguuuuuugaaaucuagugugcuuuuacagugugaacagucuuugggcuaauaaagugcagcuuauccaauguuucuuucauggaucacgaacauaaagcucuucaaagcccauggucaccuguaucuccuccucuguuaucuucugaaacuucuccaauuguauucucuggagauaggucgguggccauuuugaguucauuuucauaaaaugucugugagcagacagaaggaugcagagacugaugugcaagcagagcuuuagacugaugauacaggauagauccaaagcuguagaugauguagggacagauggaccaugugagcauccaauggauguugacuccauuuuuggagacuguucuuuuccacugagccuuugccucuuugucaaucaauggcugcauguguuaauucucggucuuugaucugagcaccuguccucaucccagcauugguccauuuacacagcuccaugaauggauucauuuuuuuagaggguaaaucagccuugcuuuccugggagagccaugcuuaauccugaugucuuguccuaucuguaggaugccagauuucacuuuccaauacuuuauugaggguuuuugugcccauguucuuaacagaaguuguucaguuaauaaccaguacuuuuucauuuuucuuuuuuuuuuugagaaauucuuacacauauaaaaugaaauaaaauuuuaucuucccccauguccccuguguuaacuucaguguacuauucccauccaacccuagguccuuuucuauaacccacuagaugcaguagcaucucgugcuuucgugcccuuaugcgcauccacagaagcauggaaauucaaccgguggccacauccuuaagagaaugcuucugccucugccaccucuaucuauugauaguagcuccucaguaaaggguagagccuggaaaguaucuaccccauuuauucugagauuuguucugauuugaucuuguucaggcugcugugagcucaugaauguauugacgugguauauccccacagcagcaccccacagcagcaccccacagcacucugacucaucuugcagcucuuacgcuccuugugccuuuucugagacgcucccuaagccuuggaugcucaguuuuaagccagacaucuguauuaaccccacaaccaccaagacucagggaccuauguuucugauuggugucuuucauucucugguucugcuguugagagcguggucucaaugggaaauuuuuuuucccauuuccucaggaagcugacacugaugucucuucuuuaaucguagggagggugagcucauuucagcccuagagaucccauccucaggagguuugacauuacaaacccagccucuuuaauuguggggcuguucugguuuguaguuucacuuaagcuuguguggauuuauuucacuuaguucuggcuuugguuuggcuuuacuuuggaggaucaucagagaccaguacuagggauugaauccacaucggguaagcacucuacugcucagcuguuagcacacccaccucuccuuucacguuuacucuguuaaccccaccaccaccuguuuggucuuacagagucucaccuguuugcccaggcuggcccuguacuccuuaguacaguacucuagguaggccuuaaacuuuggaucuuuguuccucagcuucauuagucacuaggauuacaaaccaacaggcccaguuugggguuguuauuucuaccucaucccuucagauaucucagggccccuccuggguggauacucugucucucaggauuuauucuucuggggacuuugccccaguguggcuacccaucuugaguuauguaugugauuguucaccaugcaugugucuaggcagggacuuucccuaaguacuuauguguucucagucugaccacagcaccuagaaugaggauagacgucaguaaucaugugucauaugacgccagcuggaaagcggcuguugagaugggcagguagauguguauucaacaaggcaaagcaagauggauagcacagagggggaauuccugcacaguagagguuggguucuggugggacggcuuuugcuuuaccccauuuagaggaaaggacucaaauauuaaaaauucgauuuaaaaaucauccugaaacgugaaagaaauaaauuuaaauuaaucuaagaguauaaauagggacacaacaaaauuuuccucuuaggaaauaggcucuuuaaaauaaacuaacaucuuuaaggcuaagccuacacaauuaaacuggauugaggacugguugguugauugauugauugauugauugauuauugauuuuuuauaugugagauggacaguguauaauaucaucauacaauggaaucaucuuuauauaugagucaguguaaaauaucauacaauggaaucaucuuuauauaugaggcaguguauaauaucauauaauggaaugggaugacguguacagaaccucaguaguuuguaggcuuuacugaguugaaugucuuuaccugaagucauucccaggaacaacuuauaauccugagucuuucuuguucuuucccuggguuccacccaucuuguuggaaguuccucaguuuuaccaguuacuucaaaugacuagcuuucaguuucuuagguuuccucaggcuuccuuuuuccaguuaauuaaguucagccuuuacccuccguauccccuuucauaauguucagguuguuuucauuauuguuucuuaagauaagagcugagauuguuaacaagcagucuuugucuucuaacacagauauugaauacuaugaauugaccucugaguguugcuuuagcuguaugcuaugaacgucaauauuuuauuucauuugcauccugcccaauguauuuuuuuuaauguucuugucuguggugugaguggguauuuuacugucugauguuuuugucugugguguaaguggguauuuuacugucugagguugguagaaucucuugcuaccuuuugauucuuuucuaaucuaauggugugauggucauagaugauuuaucugguuuuauuuacacugcauguauuacagcuuguuauaugaugcaggauaaagcaaacccuuucucuggaucaguggcuccaugggcacuuaaaaagaauauguauucuugggcuacuaacaguagccucaaacaucuaaugaucuguuggugggcauacuaacugguguuaugccacaugacacaagcuugaaaaggagagugccucagaugaggaaaugagguuauagguaacccuauaggacauuuucuuagugauuaauaggggaagacccagcccauugugaguggugcuucuccugucagguggugcuggguucuauaagaaagcaggcagaaagucauguagaacaaaccaguaaguauuccuccauggccucugcaucagcuccugccuccaggucccugcccuguuugaguuccuguccugacuuucuucacugauggacugugaugcagaaguguaagccaaacccccuuucuuccucaagugucuuuggucacgguguuucaucacaauaguagaaaagggacuacgauuaugguucuguuucugagauguuccuucuugcugauuuucugucuucugacuugaugguugacugagaagguguuugagugcugacagguaauuauggauuucucuaauucuccuuucaguuuccccaguuugaguucauguaucugggaacuuugcuauuaggcucaaaacacucaggauggacaaguugcuuuuugaaacuuucuaccugggaauauucuuuacuucuagggcuucuuggucccauauuaauugucuuaacauuuguuuucugugguccuugcuauggcucucauuugaagcagguuucuguaaacagcagguauuccuucuuuuauuuguaccaaaagugucugacucucuuuuaagauuuauuuuuauguuuauguguguagauacccacaguggccagaagaaggugcuguguccccugaagcagaucauugugagccaccucaccuggaugcugggaaacaaauuucaguucucugaaaagacagaaaguauucuuaaccccugagcugucucuccagccugccaguccuguuauuggugugcuuaagccauuucuacuugauauggucagucgagucacugcuguguuugagcuugggucacugauagaaucauugcuaugcuuaggcuugggucacugaugcagucaaugcuguguuugggcuugggucacugaugcagucacugcuguguuugggcuugggucacugaugcagucaaugcuguguuugggcuugggucacugaugcagucacugccgugcuugggcuugggucacugaugcagucacugccguguuuaggcuugggucacugaugcagucacugcuguguuuaggcuugggucacugaugcagucacugcuguguuugggcuugggucacugaugcagucaaugcugugcuuaggcuugggucacugaugcagucacugcugugcuuaggcuugggucacugaugcagucaaugcuguguuugggcuugggucacugaugcagucacugcuguguuugggcuugggucacugaugcagucaaugcugugcuuaggcuugggucacugaugcagucacugccguguuuaggcuugggucacugaugcagucacugcuguguuuaggcuugggucacugaugcagucuuugcuguguuugggcuuagguucaacauucuauuuguucucuguuucuuugcaccucucucccauccuccuuccuuuggaccuauuuuaucaacacuaaggauuuuuuaauuuuauauacuuuuuaacagucucuccuuuuuguagauuuuucuccugauuguuauagaaauugcaacacucacuuucugucaaguuaaaaaucgaccuuuugccauuuuucaugggguguagaaaccucauucccacagagacccucauaucugaggaaugaagagaaaugagguuuggcuccaggucaaauggaagagacuuacuucccuggucaccucucaacacagguguaggaccuuucuaccaacugacugucuguaaccuuuugugucuagauauguugaaaucuuguugugaccauugguacuugcagauguuaaauguauuguuaaacacacacacacacacacagagagagagagagagagagagaaagagagagacagagagagacagagagagacagagagacagagagagacagagacagagagagagacagagagaaacuccuuaagaaccaguaguuugauauccagcccugugugccccaucucucucacccugugugugacugguuaguuuaugauguagggggaggagcuugggcucuccugaaugcuuggaaaguaauuuauccaagauacaccuccagcccuuucuugguuuauccucagacaugauccugcuggauagcccaggaucuuucugccuucccaguagcuggaaucccaggccuguuugccauguuugcccaugcugcuggucuugugguagucucagauucccucuuguucucuuuucucugaauaugggggcuccuacaaguggguuaucucagcuuuucucucuuacccaaaaccuucuucauauguuaauuuuauuccuagggcauuuuaaagacagaauucuggguugucagugccuuuccuucaguguggugaaaaugcugcucugcccuggcaucucucauagaaacccguggcuguucauaucacugcccacuguagaaugaguucuuucuccucaggcuccuucucuguuuuuagcuuucagcagccuggguagggucuacuugagcagggcuucucgaaguguguccuguuugcaguuuacucugcuccuugaaagcuguucuuuaaaacucuuuuccauuccacucauccucuccuccuacuggugaucggacacagaguagaucauuugacuguguccaguuagguuaguccucacacuucuugaagaguuuuguuugcacuagauaagauuucacagugcucagguguggcuacucuuggcuugucugcagauccuugacccuucccucacauaccucugcugucauacgggucccaugaagagcaauuuguaagucaaguuauugacuguuuggggccagacuuucuuccuguucauucuugagaacuucugcuucuuugcggagaccuugugccuugcguuucuuuggagagcguuuccccuucugcagcaucugugugacauagccuuucagguuuugucaaaugaguccggcuucgguaucagccucagccuggcuuaucuuuccccaggcauuagacauguuccuaaccauaagcaugcaccuaauaauuguggauuauagccugaucauccugaauauuacaagacucagccaugguacccucaagauaaacaaguaaaauagaauuuuuuaaaacucuuuuccuccacagccuugcuagugccuucugguucuuggggcuccccuuucaguacccuggaaauagucugggcuuuguucagauucugcugaagacugcucaugccuuagcccagagcuagagccaagcagcagaaagacaagagaaggagaaagccagggcuuuuaccuacucgcacacccauguccaccagagagggucagcuauuccucaggaugcaaguuccuggggccaccacaccucagcaccaguguuugauauccagcccugugcuguccccccagcauaguauuugggggaacaguggaaggacaggguccugggagaucccccugcucuucuguuagucaagggagcaaaccuagccugggaugaaggaaaagcuguaaacugcucaucgucuuggugauauuuccuccaucugccugcuucuggugacaucacagcccucacagagcuacuguauauucugccaaguuccagaaaggugucugauaggagggacugggugucaugugcugccaccggaucuugccucuuuuuguuuccauguuuuagcuucauuccucaaaaacucacucuggggccuccugaagauuggguaucaugaguucaaauggcuguggccugggccaacuucaguaaaguucucuaugagcuacccguugcugccaagggagcagucucugggcaggacccuguguauggcaccugugccucugccugaguguucccuccuuaaagcauagcccuggaugaacucaaggcucaguucugaaagauggcaucuuccaugggcgucagagcugugugacugagagaaaagacccuacccaugcccuuggccaugcaagccagaccccagagcaaggcacucuaggguagggucuaagcuaggucuuaaaggccagcccugugacuguuccauacucaaguggcauaugguagagacaaggacuauccaggcagccccugggaugauugguggaagcccuggaaauaguuggcucaagaaguaagaugggcggagccagacugcugcuuccucccacugcauccccaguguggggucucccuuauuaaaaguagcugagcuucaugggucuaaguccaggaguugggaugacuuuuccuuuuaaggcuauacuuccuacucccuuaacaugcaucuaaagccugugccuuccgcacagcaccaguuugggaagcagcauccuucccgcaucugaggaccucaagaccagguaguguuugauaaauaacucauuuuucacuuagguggcuucuuugcauuacaagccaccagagccauguccuucagagagggagucugagguacaggggagccuccagcagagucguaagccuagcugcaucgacaugacaaggcccucggggcaguggagcaggcuagggaaaggaagaauuugaaagggacaugacagaggggcaagcuuggagaacagcacacuguagcaugcagagaccauuucccacagcauuggagucacuggcuugcucccuguggagagccgcacgggggaaggauggauuucagugggucccuuaggcuacacaacaugacuuggccagccaccaaggauuucuguagccacaucaaccuucagaaauuguguuuucugcauuaacauugagcucagugaucauauuugcuuaugauuggaagaugauccuuaauguagaaacaccuuucgcuucuugcacuuaagugcagaguaaaccugacugugcucgccugcucuaaagcauugucucugagaguggcuuccacuaauuagugcguuugcuccuuacagggugaaggaggaugcucaaguacauuugaaaauguugugcuugacaauaaaacacugcuuccuuagggccauuguucucaaccuguaguuggcaaccccuuuggagaucaaaugacccuuucacaggggucacauaucauauauccugcauaucagauauuuacaguaagauucauaacaauggcaaauuacaguuaugaacuaucaaugaaaauuauuuaugguugggggaaucacuauacuaugaggaacuaugauaaagggucuaagcauuaagaagguugagaaccacuggccuauuguaucauugccuaguguggguuguaggcugguuagguagaaacugguuaccaguccucaggaugcaacuacauugguagagugagagugccuggcuaagaugcacaguacccugguucaauccccaguaccguaugaaaugggacaugaugugcgugucuguaaauucugugucuugaagguagaagaaacauaagggucgggaguucaaggccagucugagcuagaugguaaaaacagaaauuuuuguuagggugugugugugugugugugugugugugugugugugugagagagagagagagagagagagagagagagagagagagagagagaaacugacagcaaagcugcaagugaagcugucaaggugggccagugguuaagagcacuggcugcauuucaggggacccagguucaauucucagcacccacauggccacucacaauagucugcaacuccaguuccaggggauccaacacccuuuuggggcuuccaugaacauguggugcauauacgucuaagcagguaaacacucguacaaauaaaauaaaaacaaguauuuaaaaaaacaaauguauuugauaaucuaugcugauaucugaagauauaaacucuccagucacuuacacaccuggggcaaagaugcuuggugaccugacaaguccuuggucagugucccuauggcauguuggugugacuguuucucccaguuacacugaaaucaguuagacuaucucuugguucaaucccaguagguuuauuaaagcacuaguuuguucuggaaaacaccagccacaauccucucuauaggccacagcaugggcaauagaccacugggucuacauccucugagaaugcccgggcugcuucugccucuugcagugugaggcugccacugcccccuccucaggcagcucccggggagcccucagccucccuucuccuccucugcccacuuccuuuccuucucucagacaacaguaacaauaaguaugauuagcaaggugauuucaagccccuuucagagggcaagacaguaaacagagcuuguuugccuaaggaaccccucccagcacccagccacucaaaccucgccuguuaaugaacccagagccgguaaugcgguuucuucaguuaaauugauucaugaauuuugaagagaacauuaucuaaugaauuuucuuugaauagaaagcaauuaaaaggacaaaucagucugauuaaccccaaagucacccuccugccacaaaugcuguacaguuugaaauuauaucauaaaaaaacuagagcacauuugcugugucugugcccucugcuaauccauguaaauuaaugaacaacaaaguuaauuucuucgaugacccuuuucuaguaucaccuggauuaugcugauguuuaauuugcuuaauguuauaauaaagacuaaacaggguuuugguuuuuuuuuuccagugaggugauuaucauucccuucaguuaagaagugauuuuuauuauuaacacgcauguaaggguguguuuccuuuaaggacuaacucacagucugccagcuuggcaccaagcgugccaagcucuguugagguacacacucccagggucauuccugcccaugggacccuccucucugucguucccuucagaaacuccuaccccaaguguugaaaccccagggauggaagauguggcuuggccucccugcucuccagccagugugucuccucuggaagacaauaggaauccauuuguaggagacuccuccuuguauucugagcuuaugcccuacucaagacacaugcagggaaugagucccaaacccaggggcaucaaaggaaaggagaugaccaugccuugcccucgucauuucugcugcagaacacaaaaugcaugccacuugauacagcuagucagagaaagcagggcugcugccugcagccagggucacccuacaaccugggcauacugguggaggcaucuggcauucacaauggcagaggggauagucccccucccugccgaguguggacgguuacagaagggucccguccagucccuagcuacguccuccuccaucucaaccgaaguuggaaauuaaccaguaguccaaaggcuuccucauaggugggccggcagggacuccucgugccugcuaauugaacugugugcaaaaugcucgccugccuguucacagaaagagcaucacacacagccccacacggaacgugaggaagcuggaaggaaauuaaagaugcgggaagccuucugaggcccgcuugcuuugugccugcuucacucucagcucuccuugccugugccacggugacagagcacuguguggagaccuguguuuuaauugaguauaacaguucuauuugugccauugcauuuccugcuaggggacuggcagcuauuuauauccgagcugcuggagccguuuguccaaaucacgccauucuguuuucuuucuuucagauucauucaccagacagguguuauggaagcugcugaagguugugaaauucggagaaacgguuucuuaccagcaauuagcagcccuggcaggcaaccccaaagcggcucgugcaguaggaggagcaaugagaagcaauccgguaaguuccgcagaugggcagcaggccggauaccugcgucgcagggcuucaaaccacccagggagccaagugucauuugaguacauguauuucagaggccaacuaugcggcugggaucagggcuuuggguuggcaacugcugugacagggaccucuuuguguuccagccacaugagccacaugucauaguagcuccuaccaaagaggaauaagccuagggagugacaagcagacaagagggcagccuagugacuccccacgggagagucuccacgcugagugccuguuguguagcagcacacucuuccauacacuggaaauacaacuguacguccagaggacaagagcccuguggcaccuaccuucugcgaagguuuuagugaaauaguacagcccuaucucccugggucucugcgguaugaugggccuagaugaugacaccgugcaccacagaugucuacuguccuuggguguuagcuccccagggaaaggcucuuccccucagagcucaucaguguuaauuuauguuucuuccuaccacgcugucagaguuuauugagcaccggguucccagccuacaagaagaccaugcuuuuagauacacccuaucguuccacaaaugcaguggggauuuuggcucagccaagggccagcacagccaagggugagaccaaggcccuacuugccugugggaaaucaugucaucacacaguccucggagaauccacacugccuccagggucccugaauguccggagcagccucccuuguggcaguauauguguacugucauguugauacaguuaugccaaucccaacaugauagaaaaagcuacuugaucagaaacguaccucaccuagaagggacauugaggaaugaacagucugugccucuuuguggggaaggggcguguuauagccauggggcuccuugaacucucucuguagaccauauagaacucacaaagaugucugucucugcuaccugaguggugggacuaaagccgugcaucaacauaccaggccacaaagcauuagauuuggcagaagacaaagagacagcuccaauacauguguucugcggcuccaugcaaugccucagaagagcagagaaaggcaagauaguuucugcccuuuucugcugcaucccaauggcuacuguuuuaaacacacauuaacgacucugaccucugaguagauuugguccuucugcgccauccccuccccacccccaucugaaccccucccgaggcuaagggagagguguggacauacauuccccagcccacgucugcaacaagacauauggcuugguauucauccacacuuaaguugggaaccacguuguucuguuuugcaaaguuucccgaguguacucacaugaaguuaaagauggccccaucaguggguaccaacaucacagcuucagcucagagugcagcuaacaccucugcuguaagaacaagcccugcugcccaguguacaugcugguagccauacaauaugcacuauugugaugaguuuucaucucgcacuaccagaaacugguaugaggaggagauucugagacuuggagaaaaggccuggacaguggugagcucugccugccuggugcccaucuugguggguguccccacugacaacagggccaagauggggguggcuguguguguuuaccccggugcugccaaguuggaauauguucauggaaaacauagugcucguguuucuccuaaauaacagcacuugugcugugagcgagagguuguggaaugcccaucgcuggaaacugucccgcaauauuccuuugguggcuuacaguaaccauggccucaugcuggcuggucucacagcugcccaaugcuggguuaaccccuucaagaauaggagguggguuuuguaggaugggcgucuccuccauccuggaacucaacuuaucgaaaguuuuuccucaagugggacucauuggccuugucaggagacaggauagucucuggaaggcaccacacuacccugcaucagggaugcccagugccagaggcuccucaccaccauccccacacacacccucagagaacccccuucugccacauccucagacacaauuugcuaaauguaguucagaggcgaucaauacaagcucggggaguuucccaccuuuuucuaaacacauuccuaaggaguuaguuuauucgcagauugccaugagcaccguugaccccugaguccuguucugccauucacccagauggcuguugauaaagauuuagcaucauguucugagugucaggguugucagcggagcugaaccauuugaccagaagaaaaaaccgcaccgggagcuauugauuacaacuucucggugucacuuguucaccaggauuuagguauugaugaggcugcgagugaaaacaagcuuucucccuugugggcucugcccagaagaacaaaggcaaaguuggaaaaaaaauacucagccaguaucagaaucagagggauuccauuauugauugcaaggcuccuucauguuauuuuuguuggagacaaaucuauggguuuggaaguuuuauagcaguugagaaagggcuggugugagugauggauccggguauuggacaaauuagauuucacagcaugaagauuucaaugaagcugcaauaccaugggcuccuuguguaucgauagcaaucgcaucgcauguagcaggggcucucaagaagagggcagcaaugauacagguccuucagauauggucauggggcccaguaaaucuuaugucuacauaccuacugcuaaccugacgugaagcagggcccauuuuuaaaggugagugugugagcaagucacugguccacagugcauucugagccaacguccucaacacagcacuaauccacagagggaaacagggagaggugugcaugcuacucacucuuagaauuccauauuccauuaaaagggaagaaaagagucaagugggaugaccuaucaaguggaaugguggaauguacaucuagguaguggugagaccagguugauuggcacaccuaugccaaccaaagccaaggguugguaucaucgcccagucuucuaacucuguaucacuauuguauucauucguuuguuuguguguuuguuuuuaaagaaaucagucauaguaauguuccauucucaaaacccuuuauggguccuuucaaggucaaggucagaugcuguccuccacacacaccuggaauuccacuucucaucccaugcagcuccugucuguagagucagcucucuccuuccuggucuucauggcgguugucuuuaaaauuacucauagaccacaucuguacuugucauggugauagacaaacuuggagucaaagcaggguagugucugugaaguuggaagucauguccuccaccucccaagcagugauccacagguccacagagucccaucgccaugucagucacuggacaagagaggcaucaggaagacaggcagcuccagacuccugcugguuagaacugguuuugccuucuaagagccuggugagccaucaagcaagagaagcuccuccucagggcugagggcuggaaugaccccaucugcugggucaugugugcugcaccccagcuagaguccgauagguucagcaggcgaaccauguggcugaaggcaugguggugaucguggcacacauggcugcccacaggaaggcuuugaacagcaaggaagcagcaacagugggaugcacugauucugagcuacagaacucaguuucucagauaccugugccagacggcuuccucuagaccaucagcuggccagaagcugcucacuguguccgacucacuugccgugguagauagaaaaagcaggggugcauuggggguaaagguuucugagccacagggaaaggcagaaaggagaaagaugggauguagaugguacucgccagcaucuguacaguccuuccgcuggagccccgcaggaguggcugucucaucacagcggaacaccagagauaaccucagacuugcacaccccgugucugcaugugucagggcagcucagaaccuuccagaaugagcccugagccuccagagcucaauguagcagguucccagaccucagguuguguucacugaaacuugccaucgcccacagcgaccauuguagcuaugucacaauccauguucccugggccccagucacagugagcucugugggcugcuggcaccacaguggcugcguguuuccuccuuuauccucuaguuaaagcugucucaggaaaugcccguugggaucucagggcaaaaauguccauugaauccacagcauucucuguagcaggcacauaaggaugccccuugccagggcagaugugcaaccauuccugccaggcugaguacagucauacucugacacuguugccccgggagagaaaugaggcgaguccauguggcugcaggcacuguggguuccugaagguuucauggggauguccgucuuuuucugcccaugcuaugaaccagugaggauuaaagguacaaggaugaacacuagauuggaggagauggcacugcccugccaucuucccaguguuucccuccaggaugagguccccucaccagcccugccaucucugaccacccuggcuaaggcauacauugaccuuuuugaaggaaaucaggguauagguaaaucuacagacaugccggcuguucucaucucuucuuccccugcgggaugggagccagugaggccagacgugucucuauccacaaagcaggagggccccaguagcugucaaccacaauagaugauggaccauggagccucaagccauauagcccagccaccugccuaggugaacuaggcaguuaucauuuccuguggaccacugcuaaaauaaacacacucccuaugcagaauccuauccuagugacuggacaucaaagaaugaagccuggacaaggucauagccuuguggcugcagguugaacaucagagucccuuuggucugagcauugcccuggagcccgggcuccaugagcaccuggcauccagaucuuuuggaccccaaugaagaugccugcagguuugcauggugcugagccagggaaauggugggacaguugcuaccauggggcgcaugagauuacagaccccuguuuuggaguuugucggagucaauagaaagaaacacccauuuugauaucucacuggaauuauucccccuguucuuugauuggugugacauauugcaaagcaguugacuaggcgaguggcucagaacacauagacaacaccacagcccaagcauacaugugccuggccaucaucacccuuggucaggucugaccgucaucauccccuugugugcuuugauuccacuaagcaggggccucccuuagaguaaauccauuaugucacaguagaaaagcauccaugcuuagcuuuaugcacaccauuaaggauuggcaagcagccuugguaugccagaccaucugaguugggaggcagcagcaacccuaauaaggacuuccuagucuggagggcuuguugagauagagugacccacugaccauacccggcucugcaugugcugccgagggcaguguguccaggggaaggcauagacacuggaccuugugagacgccauguuuccagaagggaagggaaagaaaaacucccaauagcagaaacaaguuuggccagcuuuuccugugaagggcaacuagggaguauuuugugccaucacaaaccaaccacauguauagcuaaaggcaugcuaguguccaaauaaaacuuuauuuaaaaaaaaagugcagaagguaggcggcugcaaacccuccgccaugguuugcuaaccccuuaggugaacugugccuguuguuauccuugaagauucuagcuacagcuuagcgaugacagagaaaauuguuuccuguauagagcucagaaaugauguuuuuccuucaggaggugaacuugauaaaucacuucccaggugcaaucaggcaucuuccuccuaaaccuggaucccaggaaucccauaucccacacacaccucagagcagguguuccuucuccccgccccggaggauacccucaaggcaaccaaccggcaucgccacugggcccgcagccugcuaacugcagagcuaccugguggugccggacagucgcgguaagaccuugccuguagcacagaaaccuccgcccagauccagacugacagcgacaccccuguuuuccagguccccauccucauccccugccacagggugguucgcagugacggugccaucggccauuacuccggaggagggcaggcugugaaggaguggcuucuggcccaugagggcaucccgaccggacagccagccuccaagggcuugggucugacugggaccuggcucaagucauccuucgagucgaccagcucugagccgucuggccgaaauugaguaaccguuugaaugacacauagauguaacgcgugucggaagcggaugugugguggcaccacuauauuaaaagagcugcaaguguccugggggacgugauguggcugcccuuucuuguuucuacauuuuacagcagaaugaguucagacgacccaccucgagugugucaucaguucccuccucugacaugguuauuguucuauuuuuaaugcccauuaaaaugggggugagcgaggaaggccugaugagccuuagggccccuuuguaugaagggagacacaucugacaccugcaggcaacagcuggcuaccccagcccguccacacuaaacagcugaccccaccccgauagggcccccaacucauccuucaagccauuuacccuguggagauggcagcccccauucaggcccuaaucucccacccuugcuggcuggaggggagacaggcuagcaagcgagugcucuguugggggucucagcauugcucccccaucugccaggaaagugucuuguauccacgguggaugcaagaugauuaagcagaaaauaaaauaguaccaucuuccaaacacugguuuggaaaugcugaauagcagcauuugggucacccucaaauuccagcucuccuuucuuuccuugucuuugaaggcuccuagugguagguggaggagacauggugccuccugggagccucgaggaccaggaaccuguaaaggucccagcagcccauguugaucucaugcauugaagguuauacuaugacucagcacaugcugccaccagcgcuggagacugucuccagaucugccauaaggcaccacacgaugcuucacaauuacaucauccucccaccuucagagucgacuguucccaaaaagggagaggagacucagccaggugcauggcuagguaaaacagcauacgauuggaggaacgagccaccaaccgugcagcggagagcuugguuuuaugguggccucucugacagcaggugccacucauggcaucauggaaucauggccucuacagaacccucauacugcaugcuaccuugacacccacauaaaccucaggccuuucucccuggcuaacaguuuauuauguccucaucuugcauccagccgcacuaacucuguuuuuuuuuuuuuuuuuuuuuuuuuuuuugagaggcaucaccaauaccacacuuucugaauuugguuuucaccuaucaucacagagcaaggugggucucauuuaugugagccccauaacucauaaguuuucaggacagggcugggcaugcacccuggcacccucccaucuggccucgccaggguguuuucugcucauuucaucucucucugacauggccagcaagacccauggaaagggcugggguaauuguaucagaguaacgccacacugguaucucuccagcaccaggaaaucacuguaugauguuuuuuuccucugccugaagagagcagaauucucaaagagccguguauguguguguuccaacagagggcacuguggcugcagugugcuggggagaccccagccuccacucugccuucagaggaguuggaaggugggcaucagggucgaagucaacugguucugagcagguccuccaccccgccgugugggccgucagaccagugccuuguacauaggccuccugugccuggguggccuauguaaugggagcuuuccuugugaucucugcacuuccaaauagauccaggcucuuaagaggagccuggggcuguacagacauccacggccgaacccccagcaugggacagccacaugcggccaggacgccaaccccaucaaagccacaagggcaaccuggcaguuccagguagccuggaaugaugaguggacgugcuugggccugcccuuggagcgaugcgaaagccgugucugcuccccucuccgaggguuuccuuggugcugucauaacagguucauagaugccccgagguagccguugacagcagcaggacucacugcagugaccguguacugcuccaaggauaaacucugcagaggcugacaugaaacaccagcacggucgccuggagccgcucuggcucgggguugcagcgcagcuugugaaaaugagagaaagaggaaaggcauaaagaauuacaaaaauauuuuccaaauaaaaagaaauguugaaaca

SEQ ID NO: 4159 - RNA, 31291 nt, Mus musculus
cgaucucagcgggcguggcuuccccgugcgcagccuccucgcguguccguccggcccuaucgagccuccggcgcucgacugcuggugucuggcggagacagcauggcggcgggggcggccgaggcaggcgaggcagccguggcagugguggaagucggcucugcccagcaguuugaagagcuacugcgccucaaaaccaaguacgcgggggcggcgagagggcccggggaccagagggcggcgggccggggggucacgggacuugggggcggcuucccaacgcggcacguccggagcugagcucgugguccaacggcggcccuacuugggccgcggcgguagccccuccuagggaagcggcccgcggcggcccgcgugcacaauggaccugcccuccggagacccgcauguggcgccuccugaaggaagccuuggcuggcgaccagccugcaggcccagcuagggucccgggcuuuccugaaccaccagccggcuaagggagggucugcggcggccgggugcgcgcgccucgccuuuggccaagccuuccugaggccagcccuggggaugcgugggaaaccaggaccucggcgcucuaggaugcugcccugccuugaucugcaugcagaguggugagggagggguuucagggcccacugccggggauccccaaccucuccuuagccccuuaugugcuuguaauccuggggcaaguuuccuaaccuccccuucggcuuccucccgggugaauggaccgguucuguuaaagcucuguuuugugguuggcguaccggaagcucucuccacuaaugugggggccuugguauccucacugagcagagugggcagguggcagauugacuggcugacaucugcuacuccauacaguauggaggagaauuacaauagcucauucagaggcuggcaguguagcuagugcuuaauacacaagaaacccugaguucaacuucuagcaccgaaaacaacaacucaucuucaucaacaacaaaaccaguccuuuccaacccuuucgcauuucagguuuacuugauuuuaaauuuuuuuccccccaaagaaaagaaaaagggagaaugagaguaacauuaaguagaagcugacuucugauggauccagccaggucguuuaccaggcguuucggaggacgucagagauggccuccugaagugaugagggcuuguguggacauguccugaaaagcuugaacuuaaaucgucugagaagauucuuuuauguguguguguuucacaugcuuaguuugucuuuauguuucauguguuaaacaggccuuaguggguaaaaguuagcaugccauuuauucugcaaguucaaggucaguuugaucuucauagugaguuucaggcuagccagagguauauaaggagacccuauuguaaaaaaucaggaaacaaacauuucuuuccucucaagggggguggggggcaagacaagaacagcaacaaaccgcaaacccaucugcauguauucuugucacuggugucugccugagaugacucgggagacaguguucccgucugcagugacuguucagaaugggucaugggaaaugcugugugacaccuggggagugacaccuggggaaggauaggaagccaucaagaauacuaaauacgggcuggcgagauggcucaguggguaagagcacccgacugcucuuccaaagguccgaaguucaaaucccagcaaccacaugguggcucacaaccacccauaaugagaccugaugcccucuucuggagugucugaagacagcuacaguguacaguguauuuauaauaaauaaauaaaucuuuaaaaaaaaaaaaagaauacuaaauagcacuugugggugcagccauuuccaugucaaggcuuuucaggguugguguggguugaagucuacuuuuuuguuuuauuauuauuuuuucaucauuuuauguguauugcuguaucgccugcaagcagcuguccaccacaagcaugcagugcccucagaggcuagaagagggcguuggcuccccugggauugcaguuacagauuguuguggccccuguguaggugcuaggaauggaacucccuagucuucuguaagagcacuuagugugcucuuaaucauugagccaucuguccagccccaaaauuuucuuuuuauauuaaaauucuaacguauuuacguacuuguaacuuuuucuauauauauuuuuauauaugaaaguucuuaugucuauguaaguuuuauguuuauguaaguuacugaaaucucaguuucugucuauauagugggggugggaaauggguaccagaguuugugcccauucauaaaccacuuuauucauaaacacacacauacacccacacacacacacacacacacacacacacacacagagucuagaguaugguagcgcuuagcauugguaguauaauuugcaagugaauaacuggaguauggagcacuacaguagaacagcaaaugauuauuggcucuaaugguuccauugauggagaaaugagacucauuaugucugcuaaaauauugagauauucugggguguaguguagcucaguggugggguguguguucaaagcucuagguuugagcaccagugcaggguguaagggagccauguuaaugaguauuucaacuccaucuuucuguaaacguuguccuagaacaaugcauuggacauauuggccugucuguuaugaggcagagacugguuccauacaguacacaagagggugacaucccuguuauaugugcaguuggcauuccaugcuuaaguggaaaauaagagcuaggcauguaaacauaagaauaucuugggcaguaaauaaucauucgcauuaaacacaugcagugguguuaucaaagcacuuucuugucugaucuucuaccaacccaggacucuuuauaguuguggguguucaaagcauucaaagccauguuagugccauuggagcaaaacucagcucugugugcauacuuucuucuuccuccugcccuucuuuuugaagccaggacucauaauggaggcuggccuggaacccuagauguagcugaggaagcccuugagcuccugauccucugccuguacuugugagugcugugguuagaggcaggcaucagcacaccucgcucuccucuuuuguuuuucacacuugggcucauacugggaacaaagccuggucucuuguuuuaauuuaauuauuauuauuauuuuuaacucugcuggaauuaagcccagggccugaggcauaccagacucugccaugaguuauaucucuauccaccgacuguaauuuuuaaaagcaagccaauauugucagcauuuacuuaugccauuaaaacuucuuugcaagccaggcgugguggcgcaugccuuuaaucccagcacucgggaggcagaggcaggcggauuucugaguucgaggccagccuggucuacaaagugagugccaggacagccagggcuacacagagaaacccugucucgaaaaaccaaaaaaaaaaaaaccaaaaaacuucuuugcaaauuucuaagguacuuuaaauauuuagaauuacuuuuaauauuuuaaaaguacuuuguuuugguuguuugaaagcuguugugacaugaguuguuuugggauuuuuuuggguguuuucuguaguauuaggaagauacccaucuuccuaaaucuuuguauuuuaauucuuagaguaaauaccuguggguguggacgucgugggaggucuuguuucuaaucucuaccgcaggguaagaaggcgcuucuuccacuuccuuuuagaaauccugacuuuugaaaagaguacccgccucgugugcagcagcagagccuaguggguuuacuugucuuggaagcaggcucuugaacuccuggagccccucagaccgcucaucugucagcggggcuugccuuguucuuggauauguauacauugcaguuucuguccucccuuccuuccuuaggcuccuuugcuccugcagugaauaguagugauuuucaccuuggcaggagcuauagucaccaaaagaccuuuugcuguuugagucaugaaugcagugaugccaguuucagucuuuggaaucuuaauuuuucaagcaguuuauuacaggccauucuguucaauuucugucacguucucuaaacaacuguauuaaguuguauuuguucauaggcugucaugcucacggaguacagguguguggguuuguucagugauucaaugcuagacauguucucaagcuaaaaacaccuuuuuaaaaauugaguaucuugauuuaaucaugucagaaugaaaacuguacugcaugagggcagccaagucuucccucuugugcugcugcuagcuacccucaacacuauaaacugucuuggcuaucaugguauucccccuuucccuaugagauuccuuuaaucuagcaacuuuggcuuggcuuguuuuccagaccugacugugugguuguguguaucucuagaaaagcugcuuggggguggguauaggggacuuucgggauagcauuugaaauguaaaugaagaaaauaucuaauaaaaaauugaaaaaaaauagaaaagcugguuuuguuguuguuuguuauuuuugagacaggguuacucuguguagccuuggcuguccugcuucugccucccaagucugccaccacugaccagcacccucuccccucaauaguugacuuguguuucauuuuuggaguguagggugcuuuguucuaucugugggcauuuggguaaauuauagacugcuuggguguucccugacaaggucuuguuaauuugcuuuucuucuugggaagagguccuuggaugcucucuuggaugcucugcuggccuugggaccucucuuggaugcucugcuggccugggggguguggucagauccugcacaggcuuaugagggaggguuucaguauucuguaggcuguaacucuguucacgguucccagacaacuuuaaggagccugagaaauguugucuagcugaaugggugacugagaggcagcauugcuuggcagagcaguugcuaucagcugaggcccaaguauucuucaaagaucugccagauacaggucugucugguacagauuguaaguacgaugugaccuuucuugccguagguggauccuccuguuugccuuuuguagucucucaaauggcuuucucuuaucguuucuaacuaguuagucucugccuuucauagcugucugccucccuuccaugaccccagcccuaccauuuuugaggugguccuacugacucaggauggucuugaacugacuggacccagucuggcuuagaacugcucguucuuccacccagcugggguuccacgcauguagcuccacacugggccuccauuucuguuucagugugucaucuagcuuuauacuugagcaaacccaggcucucagggaccuucuuucucagcccuccccaccccuacuuuguacaugucauuuaaucugcucuuaauucuuuggcucuggacuggaaggcacuguucucuuugcucuggcugccuuuccccuuuccuaacuucuuggaaaccuugcaccuacagcugccucagauuuucaacccugucugcacuggcauuguuccugcacgauacaaguugauuucuugcaccggaguuaagcuggacgcggugcucuuggauucuucuguguaguccagaucucuugagguugauuucugugguggccacuucuagucagcucccugugcagcugugggcuccuccugcugcugcugcuccucauuuauuuauuuauuuauuuauuuauuuauuuauuuauuuauuuauuuauuuauuuauuuauuuauuauauguaagugcacuguagcugucuucagacaccccagaagagggcauuggaucucauuauggaugguugugagccaccaugugguugcugggagcucaggaccuucggaagagcagucaggcucguaaccgcugagccaccucugcagccccaggcuucugcuucuuuggcaguuggccuuguucacuguuuguugccacuuuagugguguaaccucucccuugccauuaucuugacuucugggaaacugaucuuaaacuccugaagcugucccucuuuccucugucccucuaucuggccugaugcgauguugaugagacccagaaacauggaccuccagguuccucugucccuucugugacaugguuggcucugugucucuagauuuccagaucuauagagagcugaggcucucugcacuugagcccuggcccuaauauuccggcagccuuccuuuccuccuaguaugacacucacugucaguguuuaagucagaacuugcagucaaccuuugaggguuacccuuuccugccccuucuggcuguaaccuuccucaccccauaugugucucuuguggguaggcucccacuucucaucugugcuuuuuuuucuuuuguuuuguuuuuuuauuuauauguguuuuugugugugcccauguauaugugugcaggugcaugugggugccugaggaggccagaaccuuggagcugguguugagauguuugugaacugugugaccugcacgagugauggggcugaccgaggguccuugugauagauagagcagcaagugcugcccugcugagaucuccccagcccucuaucauuucuuauuccacuccuugcugguagguagaaaaguuugcaucuuuuuccauagaacacauuuuuauguguuucccccccaccuuggaggaggguuuuacuugaaauuagaauucuguaaauucaaguuucaguuaaauuagaggugguuucaaacauaggucuuugugaacaguuuuguaugaaaauaauuaagauuguuaacauugcccaggaaucuagugacuccaccgucagcccacauggaggguucucugguaacauaacugcaacagacaucuaugagcagugaucguaguccugcuguccucugccuuaucuguuaagacuuuuuugcucuucugccguuacaguugugucccuuugucacaauauuaugugagauuaauauuaauaauguaucuucaaucauuucucagcagcagcuugcuuguacagaaauucagucuccacuuucaucaugggucugaaaauauaaucgacaugucuguuaguugauauggauggacauuuagaagcacuuacuagggcuuagucuugauuuaagaaaucccaucgacuugacuguuuauccagacagucugaagacuggccgugaugcugcacacugcaguggaauucuuuguuuucuagguagaagaauuugaucuacaccuguauuugcuuccaggaucauuuuaauaaaaaauauguuuuuugauuuacaggucacuccuugugguucauuucugggcaccaugggcuccacaguguguacagaugaacgaugucauggcagaguuagcuaaagaacacccucauguuucauuugugaagguauuauucauuuucagucuuaugucuuuuauuaauaucugacuuaugagauagacaagauuuuauaauguaaaggaagaagcugugaaaucccaguacuugaacuuuguguugaauucuguuauauuugcagcaagcuauuuugacagaucuuuugguuugauuuuuguuuguuuguuuguuuuuccgagucaggguuucucuguauagccguggcuguccuggaacucacuuuguagaccaggcuggccucgaacucagaaauccaccugccucugccucccgagugcugggauuaaaggcgugcacaggcuuuugacagaucuuuugauguugcauuucucacauaguuuaaaaaaaucgcuacagaaugggcaaaggacagaaguguuugagaggacaaacagaccagauaauucccuggauaauuuuggcgugauagcaguugaugaacauugagaagguaguauguugcgaaacgcuucuagaaagugcauguaaacaggccgcuggggucaguucugcccgccucuccugugcacugagcccugcuuuacucaagacuugguuucuacguugccuguuguguuucgagacuaggcuuuaagagggauuggagcgcugugcuggagguuagcaggauuugcuuuuaugcacauguaauucuagucacucgggaagucauacugcuuuagguuuggaaaaaagugaaauauauguugagaauaaugaauuauugggaagggagggauacucucuguauucaaaaguguuaauucuuagaguugauuuauuuacuuugagacagggucucacugcacagguuggccucaagaugucugucaguugccucccaagugcuggagucaguggcuugugccuuuuauccagugcugaauccuuaggauuuaaaacaaaacaagccgggcgugguggcacacgccuuuaaucccagcacucgagcacucgggaggcagaggcaggcguauuucugaguucgaggccagccuggucuacauagugaguuccaggacagccagggcuacacagagaaacccugccucaaaaaaccaaaaaaaaacaaaacaaaaaaacaaaaaacaaaacaaaaacaaaaacccaaaaaccuucauuuuaaaacuaaaaauugugaguucaaaauacauguugacagauagacccauguaugagguuagaaaccaugugaagcuuuggguugccuguaggucagauuucugacguuuccuaaauccuuugcaugguagugauuacauucccugauaguauuugcauagacagaauuugugugcuuugaauugguacuguauucugauggcucaaaaugccaaguaguaucgcaggguggacaccgagaagauucacgccgugucuuugccaacccuuguccgucccuauaaguaaccaguuguauucauuuuguaugaauuuucucaguguuucuuuaugcagauagcacaaauaugaauauaauaguuagcuuuuuaaaauuuaaggacuuacuuaaaauucugaugaaaugcauaauguaacccuagaagguaacccuaaaauguccaguauaaauaauagaagggggcauuaaaacugcauguuuggucagugauaaaagauaaugacuacaagugaaaugaaugauuaaacacuucaaucauagaauuagccaggcucaugguaauugucccaugucugcuuucauacguauccuguuacugguuuagguaacacgcuguucucagcugccaucugaaugacuuauuuaaagucacuauagaauugcuucucacauugguaccagacuuggcaggagauuugaaguuguucaagugcuuaaauguagcagggagccaagaguuguaggugugcuacugcuggauugucggggauaccugagccugacuguuugaggaguuggcagcacuguuuuuguuaagcaggaguucuggaaauuucuggaguaacgcagugaugggguagaauuuuuauaucuuuucuuuuugaguuaggagucucacuagucuugaacucuugaauucaagccagacuucggcuucagccucuuguagcuggcaccucaagaauggucuacuauaccuacguuucuuucauuugauuauuuaaaaaagguguauuaguuuggcuuuuuuuuuuuuuuuggucuuucaauagaggguuucucuguguauccuuggcuguccuauaacucacugugcagaccaggcuggccucgaacucauagagaucuaccugccucugccccucaggugcuaggacugggcaugugccaccacugaccggcuaguuuggcuuuuuacuuauuuauuuauuuuuguuuuuuuguuuuucgagacaggguuucucuguauagcccugguuguccuggaacucacgcuguagaccagacuguccuagaacucagaaauccuccugccucugccucccgagugcuggaauuaaaggugugcaccaccacuccagcuuaguuuggcauuuuugacuugugaaaugaagugauuguuccagucuuuguuaguagagacacaaagucauuuaaauaagugauuuucuuuuaaaugcauauuuuugguuugcauguaaauuauuauuacuacuacuucuucauuuucuuccucuuccuccuccuccucuuaucuugaaacagaaccuuauauauccucggcuggcuuggaacuuacuauguagccauggaugacuuugagauuuugauccuccugccuuugucucacuagugaugggacuguagugugucccaucaugccccaguuauaugguguugagaaucaaaucagggcuuccugcaggcuaggccaguacuguaccagcucagcuauaccccuagccuagaagaugaucuugaguaagguuuuuuaaauugguuauaacuaccaagaacuaguuuucuaauuacuaagauaccagcagcucagacaagccagccacacaucugguaagaguugugcagcuuguuccuaccaggaccgaacgcugacaggcaaggcuuuugcacucuccacugagacccuuguucuccaacgugugacguggcuguaagaugccaccucuaaugggcugggcccuucccugccucagcugcugccauauccaguuagauccuggaaugcggguuuuucuguacgcucuugcaucucuaaccacugugaggaagcacacgaauuacuuccacugguaaaugccuuacaaagagauucaggcuuacuuagaauagagugaaauagcuaauuaaaauauuacgugcuuuuucuuuucaaaauacauagucagaucucuuccuaaaauggaaguacacuuuauugaucuguggauguugaugugucuggguagguggaaggaugaauuuaugauuuuucugccucagccuccuggauacuaaauagacuuguguaccaugcugaugggaauacauauuugccaauuauacaguagaaucuuucagauuaugauguuugggagugagagauaguaggaaagagauagaaauuccacgccuuugucagugagggaaaggugggaaaaaagucagacccuguuuguaggaaauguauccuccccuccugcauaucucauuugcugugugucauaguugcaguccuaaugcugugaugauauacucuggcagaaacaacuuaagggagaaagguuuauuuagcucauaaucccagguccaucauagcagggaagucagcuguagcaacuggaggcagcggcucagauuacagucauauuccuaagagaacaacacaugcuauugcucggcucacuucuccucuuacacagcccgggaucccuugccaagggaucggcaccccaucccccguugggauagucucuucacagucaugccuagaagccagucucucaggguuaacacugcccaucauugacaguuucaugucaguauaaacuuucucagagaucagagucagcuguuuagggagaguuuuaugauguugcucuggucaguauuauuauauuguauggugcauugguuucucacccugugggucgaaacggguucuuugggaguugaaggacccuuucacagggugucacuuaagaccaucaguaaacacagauaauuacauuaugauucauaauaguagcaaaauuauaguuacgaaguagcaaugaaaauaauuuuaugugagcauaacaugaggaaguguauucaagggcgcaggguuaggagguugagaaccgcugguauggugguugcugugcugagagagggcauggaggaguuacaaaguuacagugcugugcuuugcaccccugcaccauccuugugcuguuggggacuguacucaggacuucacaguuacguuaggcaagugcuuacauugcauuagguuacauugagcucuacuguaggaaucaucauggcucagcaguuaagaguacuggauacccuugcuagggaccugguuucaguucccagcaccuacacagugacucauaacugucuguaacugcaguuccaggccauccuguaggcaccaggcaugguaccuacacguauacuuauacauaugcguauacauaugcguauacgcagguaaucacucauacacauaugaucaaaguacauaaaucuuaaaaaaaaacagguuuuuuguaauaucugagaaagccaagcgucauaaagauaguuuaugcuacuuugcagaugucugcacaauugcucuguauaaaacaacugagacgguagugcuggccaauaccaggaguaaauaagugaaucagugcaccaacccccaggcguuaucuagcuuagaguaacucucagcugugugccauuucuagcaugucccugaccuguaaaaugaagucugagagugaggacccugcugggcuuguuggcgcgcaccucuaaucccagcaucagguagacggaucuggaguucugccuucagagguucugaguuugagucuauuuguucuaaggcagccaagacuacauagggaaccccuaucucauaccuccccaaaugagugagacccccuccgcccacccuccauguucuccuguuaccccuucucacaggcacaccaugagaaggcucugaagggcucaguuccccgcagagacaaugugaagaugcaguguggguaaaccagcccagucccuaaagugcagucuuucuucugacuguagcaguagaaagcugcauguggcauaaugacagcagcacagauuuuauuuucaggcuucauuucugagcagcgucauuucucugaauuugacuaugucacccaugucaccuuuuacgugagccaggcuuguccagggaaacagccagugggacauggagaugcgauaaguaagauuuguuuuaggaaggaaucugcucacgcauugaagagcuuuagaagucucuugaagcuggagaagcagggcugcugcuguguggucugccggagaccugugacccaaggagcugauggugcagagcuugagcuccagagcaggagcacaaagacgcaguaauuggggcucuuacuccaggggaggagacagcugugccagccugagaagagagcgggaacucacuuuuccuuugucguuuuuguucugcugaggccuuaugcuguuggguggugcucuugggguuugaggacaggugaguccuuccuugcuuggucugccucuugcuggguggcacucuuagagcuauguccacaaugauuuacagguugguuaucaaguucauucaucucguagaaggguucugguauggagcugguguucaugaaagguagcuuugagcucuuguacauacaugaaggucauuuaaaaguauuuccuguuuucauuacuaagaccauuauacucuauuagagucauauauucaaagaauuugagugcugcaaagauuccuuucugugaugcuaggggucguagggccacaggcaugcuagagaaauccugggagccucuaccccagcucuacaaagguuuuaagacaucagauggugauguuuuggagaacuuuauggcuguagugggaaucccaucaccucuucuguguguuuguguguccccguuaccucuaugaggaagagcuagucuucuggaagcuuaucugagggggggcacuuuuagucgauccuuaggcaagaauggcagcagaaauggagugaacauauguaggccuauguuaagaguuaggguguugucuguugugguggaggaacauguuucuagguguugcucagauguauugcaaguagggucucuuucugagcagcgcucagcuagucagaguugaagaagagagugaacugcugggugacaucauaaccaccauuggucuuacuauggaacugugccuacggaaaaaaauagcacauacauuucuaaagcuguccauucaaaauguuugugucggacuggucucucuuuaaguacucuugaaaaauagaaacaauuaagaacacuuuuguagaaggcacuaaaaguauccuuacaaaaaaagccugagaaaaggugagacccugggucaggccuuaugagacugcagcaggacagugccucugccugccaggacaucacagguagccugacuaguauagcagagacaaaaaucacauuucaagcccaguggaaaucuuucccucuuagagaaauucaguauauauauuuuuaaacacauuuaacaauauaauuuaucaauaaguuuuauuuccuauagguauaaugugaauacaaguuuuuauugguuucaaaguuuauauuaaauugacaguccuaugagagaaaaauauaauauaucuuuguuuucccucaaaguauauuuauaaagacccacguaaauauuuuacaguaauuguguucuaauuaucuggaaauuguguuucuaaaucugcucuaaaccuaugugccagauaccaccacaucauaccaugaggggccccaaggaaauggucagaccaaaugcagucaucuuagucgaaaugaguuuacauguuugaauagacuggagggcaagcaagcaacccagcagacuguuugcauaguguccagcagccaugcagggguuaaaaguaaaauuuaucagacaucaauaguuuauugaagaaauacuccuuuuugcuucauaauuugcagaaagcugcaacugucagucaugauguacugccucuugaaauuagucaauagagcaaacagccagcauugcugugggcagaaaauaagcacuguaaucaugacauaacuggggucagugauuuauggauuucaauauaguaguagcugcauaugauugaaaauuuacuaggucacuagugcaccaaaaauuuuauucacagccuccaggcaucuuuugaaaugugcaacaaaauaaaaaccucugaaccuguuuugacacugcagacuccguggaugacaugccagcccagugagucucauuuaaauguaaaugugucauaaacuuuuguccuguagucuuaaaauaccauggacuugaagggacagugcaugugaaacugauuuacauaucaaaguagaaaaagggccaguaauaaugaagcuuggauucuuuuauuuuucaagcuggaagccgaagcuguuccugaaguaucugaaaaauaugaaauuagcucuguccccaccuuccuguucuucaagguaaggaugaaagaggcgccagagaugguccaucaggaggcuccugggacuguauguuuugguucuuuuauccuuuccuaaccuccuugguugcuccuggccuuguaccuuucucugguacucucucuuuuuuuugcaccgaugaagaucaugcugguugcuugccaugggcagugggcagcccacagcuagaacuggagccucccgaccagucuucuccugcagacucauacucucugacccagguucgaaguggguuauugaggacaugugccuggaugugaggagacaucuggcugguucuaguugauuaaugacuccuugggaaucgagugcaaaucugugcuucagggcacccacggguauuauuaccacuuaccacagcucuccagaacuucauuuguguucaguaggucuauucaagcugcgauuacuuugagaugccugcuuccccagcaugcuccaaaaugaguguuucuaagugagaagcagugcaagcaguugcuaaucauacccucucacugucgcucacagggaugccuuuaaaaugggcuuuagguacuuucuauaaccuuggagucuaaaguguagaugaaggugaagaaaugccacuuuauucuaaaugacauuucaaacuucagaauucucagaaagucgaccgguuagauggugcacaugccccagaguugaccaaaaaaguccagcgacacgugucuagcggagccuuuccuccuaguacuaaugaacaucuuaaagaagaccucagccuucgccugaaaaagcugacucacgcugcccccugcaugcuguucaugaagggaacaccucaagaaccacgcugugguaagaagccgauccugaugauuggaacagaauguccuugccugcaugggugcuguugauguguagaguuaggcuggucacucccugugucaugccagucaucuagcugucagugucuguauacagaggacaugggagccggagggagugggagggagccagagggagcgggucuuuggaaguaacuggguucgaguuuucucuguuuccugucagagucaucagguacaaagauaacuugcucaugugguaguugagcugggggagggauuagguuccagcuaucugucauauugcgucucuauuaaugggucuuuggccuauauagguuuuuuaaaaaggugugugugugugugcguguguaugucuuuguguguauaugugucucuuuguaugugagcauagcauguaggcccaagaggcuagaagaugauguuggauucucuagagcugcaaguagaggcgguugugagcuucccaacaugugugcugagagugaacaacuaguacaagcacucuuaaccucugggucaucccugcagcccagucugucagggugugcaugugguugugcgugugcgcaugccagagaggacaugggagguucuuugucaguuuccacccaucauuugaagcaaugucuggaaccugcuaggcuggcaaggcccagucauauuccugucuccauccucugggagcuggaguuaaaauuguguacugacucagggguugguuguuaugugcacgcugggauauaacuccggucuugaggguugugucgaagcacuuuucucuccugagcaucucuggcuuguguacuuugcucugaacaguuuucuuucuuggcagccucuuucucaucuuuuuguuuagauuucauaauuuaacagcuugagggcuuucucauuggggccugagccugcuuugucuuccugcuucccgucuuguugcgugaugccauuuuucauccacugcugucacuuccaguggauagcugucaguagauuacagaucacugagucuggcuuaucguuccgcgcacucugagcgugagggugcguguacuuucacccuuaaguaagcucuguaaucaucugccccuuacccccuggaauugagcuuauguuguuuucuuuuuacugugucuacuacaacauuauuaugcuacauaauuggguuuuuaaugccuuugaugauuguguugagacucuaaggguguuuauuuauuucagcugcacuagagggguuuauuaagaugggugacuggcaguagaguuggggaugcuguugacaggguuacuguguccagugugacuggagagagcugugcugccaucugagugggcucuacgcuuccuuccucucucucucucucucucucucucucucuuucucuguguguguggucaggaaacaguuuauuucauuaacaguaaaggaucuuguuauguucuauuaaaaagaugaagaagugaugugauuccuucucgcuuccuuucugucugaaagguugcccgggcaguguccuuuugagucagccuuccugggucugcccuugagugaaguagugacagggagcagauauggugcuuuuuuguuacuuuauuuuuauuuauuuuuuaaauuuauuuuauguaugugaguacaccaucacuguauuuacacacaucagaagagggcaucagaucccauuacagcuguucugagccaccaugugguugcugggaauugaacucaggaccucuggaagagcagucagugcucccaaccacugacccaucucuccagccccugauacuuuauuuuuaaugaggguuggaauuauugcccucucuggugcuucaucuugucuagaugaggacguuucuuauuccagucuaaagggcaauaggaaggccuguaaaauaguaaaagccuccauggcagguuauacauagcaaacugucuaugcaguacccuagucuuuuuugaaacucaacaguaccacucuguaaaucucugcugauaagcuagugauauuggcaggaggcaaaauugguuggcauaguguuaccaggcagcagagguggggugcuugugucacuugcuggcuucagcccugccauugaaguuggcccugcucaggaacuagguacaagcuagguacuagaaguaccuuggcuuucagcugcucuggagggugcuggcuggggcuuguuaccgaaggucuuucagugcaggggcuuucuaauauuucaaacaucaguggcaaacagaaguagucauuuuuagaaauuaacuuuuagguucguauacauuggacugagagaggaucuuuaccccucccccaugcuaucucaagccucguccaguuccagcugguucucucccuuccuuugcagcucucugcugcucuccuguugccuguguuucacccucugcuucccuugucagagcuagcgccucuuuuccuccuucucagaauugugacauucccuaugcauguggaugcgugugcgugugcgcgcacacacacacacacacacacacacauacacacacacacacgcacacacgcacacacacacauacacacacacacacacacgcgcacacacauacauacacacacacgcacauacacacacgcgcacauacacacacauacacacacauacacacacauacacacacgcgcgcacauacacacacauacacacacacacacacgcacauacacacauaugcgcacacacacacacacacacacacgcacauacacacacaugcgcacacacacacacaggugcucauauacaauuuuaaaucuaguuucugcauacaaaagaaaauauguuacuugucuuucugaauuuggcuuauuuagaaauaguguauuucccuaaacugaauuucugaccuauugagguuuuuuauguugugacaaucagacuacaaauagaauaaaaaaaaauuuagauauuuuagagcaaugaaaaacaagauauuuaggcauuuagauaaugaaaaaaagguagaauguuagaugcauaaagauuuagcugcuaguucuucuaguucuucuuaggugccgccuuuuuguuuucuaacaguucugcgccuuuuccccugauacuuaguuucuuuuuacgugucuuccuuccugguacauagagcaaagguguguggcuucacuucuguucuugcuugcugagcugccuaguauggaacgaucucuguuccauauugacacuccagugaagagugugugcuagccccuucauaaaacacaggucaucucugaaaucaagucguuucucagaugcagcaggggugauuuugagagcacucugccacucaaacugcuuugcuccuggcucagcaucuguuguggagcagggguacacuugcauuugaaucgguggcccuggccuugguuuguguuacccagaaaacuuuaacauuuguacuccauauccaagaaagugggaaaccguuuccagagccugucuguucuagagcaguagaggcuacagcugccccuucugcucucuggauuccgucugcagaguuuauggcgacuuagaagcacagccccgggucgccugucuucuggcuucucagaaggauaggaagagagcuugcuuacuuucgaggagguuuucagaaucauugagguuccuuagcaggguaaugagguuuuugggggacucccagcuauuguggguaaagcucugguagauguuugccgugggagcuuugggagucggaugcaaagcacaaguguagaaauacucuuagggucuuuuagguaguuauuaaauguggcaguuaggcuuauuacucaugucacaaguggaaaugacugcacauagaaauggugauuuugugguaaaugagauuuuuuuuuuuaaacuuuuaagugcuucuguuacaugcuugcauuuuucuucaggaguguauaaauauuuuguuauuagaauaaagccuuauuacuacuuuauccuuaagcauaacauuuccagucugccacuuuaacccuuaaaaaugaaacccuaccaaucaaucuuucuagucugcauguaauggccuaaagccaaaauaaagccuuuucucagccaguuacaguagaaacgagcuaauauguugggaacagaauaaccaucagcagucagccguuagcuguuuacuaaugaacucccagaugagugaaagcauucaggaacaguguuugacuugaggcugugcaugaacacacacuucagcuugugugcugcacacucuccucgugcuucaucucagccacugcagagcugcagagagcguucggagcucagcucgaggcccauguucuuaauaguaaguguacuuuugggugacgucagguaagaccauugcagcucaucuuauacugaauuucaugauuuguuuuuauuugaaaauaacugcugauguggggaaaucuuaaaggaagaguaguuuacauuccaguggauuaagaguaucuuucaaagaaaggugaagugagaaagaggaaagugguuuggacuuggaggugcuaauugauaagaauuugcagcugggaagaaaagugaccuuuucucagccuggacagauagguucauaagacugaugugaacccuggcagaagauggcuucaccaaacucuaaacuccugggacagauuugucacuauaguguaccuucaaagggaaucaucauccugcacacuaaagggaauguaaauaauuucaacaaaggcugagguggagucacaucagccuguaggugauucauguaacaacaaagagagugugaacacuggcugcugacuucacccaaagagagcacuugugauucugagugccauccauccugcucagacagagguggagaugagaagcgccugcagaaguguguacacaggcucccuggugugguggaaggacugcacuuaggucucacuguagucaagcagugguuaaaacagcuguuucaggcuccuggucaguuucuugaagggagagggagcagccauagagagcuuugucauugucaggguggagccugugguggguuuucaugguucugcucuuugacuaaugcuguguccccaauuaaagggcagcuuugauaaacacacacacuuugcuguaauuaugcucugugugagacucugggucaaacgaauuuuuagcauuuacuuuugucuuaaauuauccaguuauacugauucaaucacugugcaggugaggugggcauuucuguccccuggacaauggguggcaaucacugugcaggugaggugggcauuucuguccccuggacacuggguggcaaucacugugcgggcgagguggcauuucuguccccuggacaaugggugguaaucacugugugggggagguggcauuucuguccccuggacacugggugguaaucacugugugggcgagugggcauuucuguccccuggacacugggugguacgugagagaugcugagucucuacuccuuguucuguugcagguuucagcaagcagaugguggaaauccuucacaaacacaauauucaguucagcagcuuugauaucuucucagaugaagaaguucgacaggggcucaaaacguacucuaauuggcccaccuauccucagcucuauguuucuggagagcuaauaggaggacuugacauaauuaagguuagauucuuauaaagacaguucagagcacacuuuccuaaaagugcuguaauaaauugaaagcacauauuuuguauuguaucucgggguuuacuaaugaacucaguauuucugaucgacguuugucagugucgcacaguggggguggucaggugguuuauguagucacagugugcuucuuucaggagcuggaagcaucagaagagcuggacacgaucugucccaaagcacccaaguuagaggaaaggugagugaugggaacccggcagcagggugcucugugcaucuuagcagucuauacauccuguuagugugcuguucuuucugaguagacaccaaacauuuacuuaguguuuaguuaguauuugggucauaaugugguguuccucaguaccuaguuuugcaaacucuggaugcucucguuuggacuggagauguuuuaccugauuuagcaauuaugaagaguaaguagacuuggugcuguagaaauguuacuuucagugggucagcguccuauuugguucuugcucuuuuguaugagcauagcaccucuguguuuuugugugcagcucagucccuaaaugugguaagaguuuaaugggaaaagcuaggguucucagaggcuuuccugagucauagucacaaaacucaggcagacucuggagcugugaaaccaucuuucuauuuaugagagaguacagccugcuuuagaagucguguagaaaugguggauuuuguuguagagggauauaugaaggagguucuguuguaauaaaugugaauuuauuaguucacguuuuuauauuaauuaauuaaacauaauuuaucuugaaaugcaucagagcucaacaacuguuaguugggccuugaguuuguaauuugcuugcucuuucacauuuugagaauuucuacaaauauuuaauaaagauuguuugucuguacuuaauccaaguacuccuuaggagcaguauucuauagaugucaugcuggccaaugccauuggucugcacccuuuuguaguggugagaagaucgugguguuguggauaccacacggacccuuuuguggucuuuaucauggcccaugauauucccccccccccccccggcugugcugcuucuaggaugguucugcaucucaucccccagauuguccuugcugcuguugccaugucuuaaagugcuguuuacagcucuccccgcuucaggcaugcacagauacauacagcauagaguuguauguuucagguaguaaucuaaagagcucuucucuagugacaugaugaguauuuagacagccgaguggccugugaugcauggaucuaggugguuagauccucuggugagugagcuuggccucugggauuggcauaccugaccagcgucagcuugcuucuacacgauuuugacucgugcugccuccacagaugagaagagagaagagaaaaaugauacgacccauuaucuguacacugauuuuuuuucuaaagauuugugacuaaacuuuguuccaaacuuagguuauuaacaauccugauagagagcaaguuagauugcgcuuuuugacaggugacauauaaaguuaaaaugagaaguguugauuuuuccugguuagugguggguggaggacuaagauuuugcuuucuuaggcucacugcccugcucuggugugaagagcauuaugcacaucgugaugggaagcgcucacugcuucauuuggggaacugguagauggcucgcuauacaggccccccaucgaauaauuccuugcugaauugguuauuauuauuuuuuuaguacuacaaguugaugggcuuaaauugcaacuugaaagaacauucguugccuuaaaaagccauauuauguuuuacaguggcucagggagagaaugaaauaaaggaaagugucaauguuuuugcuuguuuaguaccacucaaagcugugagccgucauccugcuaucccucagauaugccugcuacucaggaagcagagcagaagugguguuuaauaauugagcugagccauuuuauaucaauuuucucucuucaggcucaaagugcugaccaauaaagcuuccgugaugcucuuuaugaaaggaaacaaacagguaaagaacucaaaaacaguuuuauuuguaauuucuuuugauguuaacaucugcagcaaggggacaguuaagccuuuuuuucuaguuuagcuaaugaagcuguaguaguaucaggaaguuauccaggccuuaauuggugcuuauggagaucaaacaaaguaaucuccauuuugcuugacuuuaccaucagcaucucagcagggugcaugucuuucugcugccaaacuuugucagcugaaguggucaacgcugcuagcgcucagccaguaccuuuugugaggcuguggacugugggcagauguccgcccugguucuuugaggcuguggacugugggcagauguccgcccugguucuuugaggcuguggacugugggcagauguccgcccugguagucccgagguaguccuuagguccagaaagugagaaguaacccuggcagugguccucgugcuccgaggugacaugauugcuucuugggguccgauggacguagguacugaacuaguuugguagguccccuugcacucauuaaguggugaaagcugacucucuccuguuagauugguaauuucaaaaagcuaguccugucauuucucuuacauuuugcuguuaacgguuguuucagcuguuuaacuucaggcaggcaaagcugugcaguuugcuuuccucucaggauaaggagacuaaaucucagaagggugaggcaguggagugaggaagcugcccagguacaagccacccugggcaggcaacgccacagaggccccugccgucauugugccuuuuugugaauggaucuguuaaugccauaggacuguuuuaacaucagguugucguaaagguugccaugguaucaacacagugaaggccauuaguuaaaacaacuaauuaguuaauguagcuagugugaugaaguaaugaggaagacauuaauauaaauuuagccuguagauaccacuguguuaggaccuagacuguaacuggggcaaugcacaguguuaauuaaugacuuacaguaaugaugaagcgcacucuugcucugccacuguugaaagcagacuuugauucuccacauuucuugugccugucuaggaagaauuuguaugucuuggaaaugguguccugggagcucuuaaguuguuguguauugucagccuuuucucccaggauagcuggggcuuggggaucuacccaggaauaaagccgaggauuucaaucacuuccaguagcugaugccacagcgccaagaucuggcuuaaccgcguucugacucuuugcuuagagcaagaaaaaggcuggugguucuguguagaugaucuacguuuuauuuaggggaccauccugaccacaaagauuuuaagcugcugcaugucacucaacuuaaaagguuaaagccaaagucagucugaagguugugugggaugaugucagaggggauggaagaagcacaggagccggguccacagagaggucggggugcugacuagagcauucgaaguggccacacucacugggucuguggaaaaaaaauguacuuuuuuuuuuuuaaauucaggaagcaaaauguggauucagcaaacaaauucuggaaauacugaauaguacuggguauguaaaucuuguguuccauucugcuccugauacuucacaguuuuaauguuuaaacauauuugcacaauacuuauuuauugacacacauuucuaauuuuuauaguguauuuugaaugcuuuaacuuggaccaaaaaggacuuuucuggcccuuguucucaccaugcauaaaaaaguacagggagacaaucacauaauuagcauuuuucugaagccuuggcuuucagagcuaggaagauggcucagugguuuaguguguucugcucuuuaagaaguugagaguugguucccagcauccauaucaggcaucucaaagcugccuguaacucagguccuggaggacccgaagccucggccugcuuuguguggaguauggugaacuguuuaagucucugcuccuguguuggagcugcugggcuagagauguccggugggggcucccugauugauuuuugugcuuaaaaccaaauccaucuguguggagcuguuuaguacauguucuuuuggacauuuuuucaaauguuugauuucucuuguuucaugauugcuuuucaaauuacaguauguguucugaucauacuuugaauagauagccuguucucugaaguugcagaucugaaguugcaggguggaaggcaguuauguagcacaguuugaauaugaccuuuaaaaaguggcucuuccuuuuaaagcaggauugggguccagcaagcugggguagaggguguaggugcucaucccccaagacuggugcucugcgugugagccacauaguggaggagagcugacugcuucuacaaguuguccucugacugacacacagaugucuuggucuucuacugugccugagagaaaucugucacgucccacuguagcuagucuuguccauugaaagacugagugauuuuugucuuagaacgacaagccugagaguaaagaucguccccauggcuuuacagcaggcuuccuagaggaaguguguuagcgauggacugcuuuucuugacuguauuaaaaacacuauauagauuuuaugguuuuguuuaaaaugaacaccuaauaaaaaugcuuucuccuuuugcaggguugaauaugaaacuuuugauauacuggaagaugaagaaguaagauauagguuuucuguuucucucucuccuuuuuuugguuuuuguuuuuuguuuuuccaagacaggguuuuucuguguagcccuggcuguccuggaacacacuuuguagaccaggcuggccucgaacucagaaauccaccugccucugccucccaaguacugggauuaaaggcgugcgccaccacgcccggcuagguuuucuguuuuaucccauguuuuagcuuuguucacagggucugaugggaaggauucaggauuucuguuguuccuuuaggugcgucagggauuaaaaacguucucaaauuggccaaccuacccucagcuguaugugagaggggaucuuguuggaggauuggauauugucaagguaagagcuuuucacugcuguucucaagaauugacauacuuguuauguuuaagcauccagcuggggugguguggggcuccuccucuccagccugucaguguaggugcgcgucucaugcuuccuccugcucagcugccaggcagagggaaacgcucuagcugaguguccagaugaccucagaggaccugcugugcuaacuacugcacagcuuccuucccuguuuucuugucugucaguccaucuuuaccugguucccgaaacuuuagguuuucuuguaucuuccguauuuagaucuuuuuaucuccauccuuuggggcccaacuucuuuuguaaauguguauuucuccugcugggaacauuucucugcucuaaaauucuuacugcauuuuuauuuuuuguuaguuguaauuguuucucugggucauuuuccuuuucccuuaaccacccuuaacgugcaggcgugaggaugaagacuaggagaucauggucugucucggccuucccaguucugagauuacggguaugagccaucaaagccggcccuacauuauuacuucaaauccuuccugaugcucuguuuauuuuaggaacuugguaaaugguuauuagacaguuaaaaaacuuacuucuuuugucuuuuaaaugggccuggcauuuccuuuuaguuuuucaagacagaauuucucuguguagccuuggcuguccuggaacuccuucuguaguccaaacuggcuucuaacucagagauugccuaccucugccucuugaguggagacauaccccgccaauaccuggcaauggaccugacauuuugaaaugugcuacaagguggucuuaucuacuaguaacuaacuguguuuauuagcuguguugguugcuguaaacugcagcuuucaugacccuucucuaccccacugcucuccaccuugcucaguguguugaggguguaaccagcagauguuggggcagcuccuccuccaggcaggauagugcccucuggccuucugauuguuucucugaguuuuaaguggaaaaaaaaaauguaaaacauaguuaacauuauacaauaaaagcuuuaaaaacaggcuuucuuaauauggacaaacucuggaccagcuaaccaucaaugaacucagguguaaaggcacagggcaggcuuuauuuccugucaagugcaaaguuugauggcacuuugacaacaagguaugggcaagaauaagguagagauguaguuuucuuaguaaauggucgcauucauggagaaaagaaagcacugcagcuuuuaggagcccugaagcaacaagcuaagugcgcacuugcuccuuucauaucugggugcacacauaucauaugcagguagacauuaagucacaaacugucuuuagauccgagauguucuugagcuuguucuugucugaacgauucacgggccaugccugagccagauaaagggucuuaggaggccaggaagucggugacaccuuuugggaacuguaugacuguaugauuccuguucagaacacaugcugcaaguuggugcugcugcuccuacauugugaacauugugucacaguuugggggacugucacuuuguguuuucugcagggugcagcuuuucaucuguucauuaguacacauuccauaggguaauucugauuggcuucuguuagagcacugguacuuuuuguugacuuaguaacucaaugacuugcucagucugagacccuagaaaaggcaccccugacaggcugcagaugggcugaggagccauuagacuuggggcccuuggcugagggugugugagcuagagaagaugugugagcugccugcccacagaggagagggaagcucuccaggggucucagagggaagaauucuuccuccguagaguucacccacuucccaccauagcuuagcuguaaaucugugacgcagcagagugcucgcuuguguaggaagaccgugaaagacccgaugcuacugaagucuaccugauugaugaguuacggcugccugggccuagugcuuuuguggucacugaucuaucuacugguuuagaacccuuuuaacuuuguccugacauuguuugccagcucuuccucccauuugugaguucuguauuugcagauucaaccacugaagauaaaaaaaauauguuuauguguuuuaauuuauagaagcaagacuugggaguauguacaugccuuuaaucccaacauuugacacacaaaggcaggaagauuuccguaaguuggcugcuuagugaguucuaggacacccagagauuccauaucaaaacaauguuuuuuagucuguagugacauggagugagaggucccugcagguguuacgucaggaggagaaacaaacccggagagggagaaugagacuuucgucagccuggcucaaacuucgggaaucugacgccaggcaguuuauggccaacauaguuaaucccaauauaaauuagaaaaaaguuucccaauacaauauaauucccagugcaaaagaaacucaacucaaaguccaugagguuucuuccagcuggauagguuauagacauagcaaccucuauuagcuaagggccuaaggaaggaucuugccuggauggugaggaggcucuuugggccgucagccaccucugggccuggcugugggagcuuggaggagccucugacuuuacagguaguguaagggucacuuaagcuauuagauguccucagucuuagauguagaagcuucaugaagcuuggucugaaucagcagauccugcagaucaccuaaagccuccucuucucagcuucuggauguaagaacagguuuacauauuucccuuugaaaugauaguccugugugcuuagcauucccagcuuccuggagaucuguggaugcuccuaacaauguaccagcguuuuccuugucauuauuuccaagcaacauuuacauuauaguuuagcaugggaguggugugcacugugucuucuacauauuaucaucuguaaggaaugagcccgaagucagucuccaugaauauaauaaaaaggugacucuauuuaguuuuaaaauaaauucuaaccuacaauuuauguucaguuuuacuugugcagagagaggagggcaaagagagacuugaauuagggccuuggcuguuaggccaguguucuacuccugcaccuuguuuucuaucuuaugguguaagaaugcuggcauguugaaagccuguagguuuaauugaguguguguccuuuuggugucagguacagguaaaaaccucguugcuuaggugcuuuuuccuuugugugaccauauacuuucucucaugcaugcuuuuuuuuccucccucccucccucccucccucccucccucccucccucccucccucucucucucucucucucucucucucucucucuuuaauuuuuaggaacugaaagacaacggugaauugcugccuauacugaaaggagaaaauuagugaacauaagcaugguguccaaggacugcaagaaguaacuaauuaccuuggaacaguugaugauuugguccugagaaguggacuaacaguagagauacaacacacucagccaugcucgaugcgcuucaaaaggugugcugaagaaacaugcuacguucucuacgaagcagagaaggcaauaaacucuucagacucagcuaaaaaugauugcguguagaaugucucuguagugaugcuuguguguagcaugucuguguaaacuuauaaucgcugucacuaauuccuuuaaaucccuuucuuaacacauggaccuccuguagcacuuagggaaggccucuuacaagcagugugcuuuagugcucagcuaacuccuguaccaguccaauagcuccccucacuggccagaggacgccucacagccuggaaaaugcaacccaaaaguuuauccugcagaaagccagauguuguaccaauauccagaagagggagcaguagcgaccaaaggggaagcacccuucagucuucauugcaaugaauauacuaauuuugccuuccaauaggcagagaauauucuaaaagucauggaaaauuuaaauguaguuuuuccacccugacuuguuccaguaagcuuugcugcacaagccuuucuuaggauuucugacuucacagcugugggaucuggguauuggcugccugugggauguucuuaaaugaucauggccugcugaucugggcugugaggcauugcgcagugaaaaggaaagcaguguuugccgguaagugggaugaaagcggccaaggucggagugugaauccagccucuguagaacucggggacugcugcugccuuguagccuggguccuguugcuuaaggugga

SEQ ID NO: 4160 - RNA, 10458 nt, Mus musculus
guugacugguuguggauuuuuuguuuguuuuggcaaaaccacuuaaauuaaacuguuuauuacaggugugccuuuuauucuccuugagaagucauuuagacccuucacuuucaugcugagaauuaacauguagcauagucauuaaacauagcagcaucauuuuggggucagugguauuguguccuuguuguuuccccaagcuuucagcuuugugaguuaaagucuugaugucuccccagguuacccgcuugcuuuucuucuuggaucgucuccucuugauggauuuguugucuagcuucaggugcuucuuuuguccagugcucuccaaggugcucuccggguuggacgaaucggaaggggagccacccgggauuucauucauucuauggaggcuaccaggcccuggugaagcagcagaagguccuggcggcaguggguaaggauuauucggggaaggcuggaguccugggcugggauaugacgcuucaggaguaggauacugcgcuggugguucccaggcccccgguggcacugugacccaugcaacagguggugcuccugacacuggaagaggaggagugggagaugacucuggaaauagauauggcacauuaggaugcugcccucccauuccuggugcccaagguccagaagacauggaucccuguguaccuaaaggaccaacuggaucugugggugcgcuauuuggccuagguagcucuggaaagggcacauuuguugaaacauaugaccuuguggggccagggacucguacagcagggccuggauauggaccacuggguuggggacacgaugguccagaaggaagaaagggugcuggagauccugguaguagucuagcuggagggaugaagggauacauucuuguuggugcugcuccgaaggcacagugcugcacuuagugggaguccagauaacacagcagguggaacucuugaguuacucuaagggcuggauccuggccagccuggaggagauuggccagcuuucggauugcucacagcagagguucugguaggaacuguucaguguucagguagcacaucugccaaugaaaagucaugugguguuuuccagccggaucuaagccuaaggcacagcauauaguggugaugaguccgaugagacaggcaauggagaaccggccugaacaaguugauuguuuaaaucugcuucauaaagggaaauuuucccuaaauaaaacaaaacaaaacaacugguugauuauaucacauucugaaccaugagugaucuggccacuuuaucaaaaugaggaaaaggccuggaaaagacucaaguagaggagacuggauguuuuaggauagagaagaggggcuagcacauagggcacggguugggaauagagaagaggggcuagcacauagggcacggguuggggauagagaagaggggcuagcacauagggcacggguuggggauagagaagaggggcuagcacauagggcacggguuggggauagagaagaggggcuagcacauaggggacagauuggggauagagaagaggggcuagcacauaggggacagauuggggauagagaagaggggcuagcacauaggggacagauuggggauagagaagaggggcuagcacauaggggacagauuggggauagagaagaggggcuagcacacagggcauauagggcaccagagcaaggacagcaucuacagaacagcagugagggaagaggugguucuagaaacgucuccacugcugauucuggaaaaccgucuuguaaacugguuuuaaaagaagggauaguuuuauaguaacuuaguaaaauucgaguaggguagaauucucccaaauuaagaaagaacauuaaaaccaaacaagcaaaccaaaguugccuucuuccguaguggugaaaaaguagauucuucccacuugagaucaggaugggacaaggcuguggagcccaccucaccacuccuacucagcaucacagagccaguccuagccaacaggagaugaaagaauacaggaaggaaauaaaauguggggcuggagaaauggcucagugguuaagagcacugacugcucuucugaagguccugaguucaaaucccagcaaccacaugguggcucacaaccauccauaaugagaucuggcgcccucuucuggugugucuaaagacagcuacaguguacuuacauacaauaauaaauaaaucuuuuuuagaaaauagacuuuuaaaaaaaggaaauaaaguguauguagaucaacaaaggaaacaaaaaagucuuuacucugauuaucccauugucuauguggaaaauuccaacaaaaauaccuccuggaagauauaagugauugcagccaggcuacaggucagagugaccacauaaaagcgauucuuuccuguguaccagcacuauaacccugcauaagcaucgaaagaauuaacaucagaguuccagaaucaucaagaaagcaaugucagaggagcgacacuaacuaacgucaaauaaguucauauggugacaagaggcaaaauagcauuauacuugaaaagauaaauaagaacaauggaguagaguagucagccuaaaaauaggcauacacaagaaucaacagaucucugacaaaggagcuaagauauaacaaugauguaaagaaagucuauuccacaaaagcugcugaaaucuccaauguccacaagccaaaaacauguaacuuagacauagagggaauggauuguagaccuaaaggcaagggcauaauaaacacacaagaucucuuuaaaaaagaaaaaagagaaaagaaaaaaaaacaguaagagacaccuuuguguggcaucggguuuggugaugaguuuuuagacacaauaccaaagccaaaucauaacuuguggaagaaaaacuaagcuggacuucucuaaaauguaaacgugccaucucugagggcuagcuuucaugaagagaagccaugcaagcuuccaagggagggagguaaccaacaguccugcccagcuguggcacuuaugaaccacagcaacaagcagcacggcgcaguaacccaaagggugcagugguggugcgcauaccucggugggaaccagcagcucucuagcuggaccuaagaccaauucaaaaggaagaaaaugacgccuggaacugggaaccuagcuaacuacucagugcucaugaaguuaugauauuggaagaaaaucuauaaccacaaaguuacuaaaccaccauaauucuaacaauaaucuaagcaugugcguauccuuagacccauagauagguacagucuucaucuaucaucaaggaaacuucucuugcaugagauggagacuacagaaaacuacaaccaaucaaaaugcagaguugugaagccuagucccaguggcuacauguacaaaacuguccugcaccuaaggcucagagaauauuguagaagagaggacagaaagauguuaagagccagauaaucaggaaguuaguuugcuucaagagucugucuccugguaacaacagaagcuacacucauaagucuccccgaaacgugagcugaacaaggacagcaaauacagaaguggaugcucacagucaucuauaagauggagcacagggcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagagccaaaaagugggaguggguggguaggggaguggggguggguggguaggggagugggggggaggguaugggggacuuuugggagagcauuggaaauguaaaugaggaaaauaccaaauauuuauuaauuaggguuagccuaaggacaaacggcacauuaucucaugaggagguguaaggggccugagaugcccuggcuggcuucagcaucuaggugaggguuaggcgaguucucauaucucgugaggaaucaugggaaauuucacuaauaguaucagacagauguuggguucuuaaggugacuccagcauaugguuaacauaagggcugaaaggagacaaggaucauuaaagaagggucggccagacauuucagcucagagagacgcuacggcagaagcugccugauggacuaggucucccaaaacaaacugugggcuuagcuucugccugggaggaaccagaacaccucagaccuaagagcaggcacagccauggauguaaucagaccaagagucuuaguccgccuaaauuuccuguuucacacagaacagggacacuuugccuucuccucuaaguugagacuugauuucuacaucaaaauaauaauaagccacaaguaguucaugggauacguuuuuuaucaggacauguacguguuuaccaaaacuucacagccauaaacaagaugccuggccaaaguuaagucuccuauaaagaaagaccugagcccaagagucucauccuugagccagacacagaacaacuagccaugccucagaggcagcccugcguuuucccuagaaccacagagaguagagaccuauugugcuuugugagggcggcugggccaggccaucugucaaggaaugcagacuuguacacacacaccuguccuguacacacacaucuguccugcuuccacucaccuuccuuuccugcucucccuucuuccuucuccauuuccucaucucuggcagcagugagggccaaggucaaaggucagcgcuaggccauguguauagcucggaugcacccugauggccucacuccuacucagacggcuaagauaaaagguuucuguccagggucucacagugggugugcuaguguguauaaauucugccaguuuauaccggcagggcucagccucugaucucaaggaauuucucuuuccaggaugcuuuugugaguacauaauuccaaacagauuuggucucuuccaggacuuccaaagugaucauugaguugcuuccccugucucauccagcagagggcagcagcucccuaaugaagaaagcacaugcugccagcuuugugccuagugaagcuccuacaaaaagggcugguacuuccuucucuggauauagaguauguauccagagaaggaaguaccagcccuuuuuguaggauauaaauauauauauauauuuauauccuauauauaauauauauacauauauauacauauaauauauauauauauauauauauauacacacacacacacacacguguauguacauacguauguuuguauguacauguauguauggacugggccccacaaacaauucccaccucucugaaacucaguaacaaauaucucacugaagccacaaauaaggcuuguguagaauuuugguuaaccuucuggauccuuccuaacuccuuaugcucaaggcuaggaagggucgcuccuaacucuuggugaugaagagacugguucagauacgcuagaaaggcacagguggcacacacuuaugagugagcauauaccugugugguggaguacaccuguaauuccagcacuagaaaggcagaggcagguagggucagaaguucaaugucauccuggacugcauagaguccaaggucagacuggcccacaugagacucuaacaaauggggggggggggggugaggaggcgggagagaggugagacuuccaaucugguggcacagcuucaauuccugacuguugggcuucuggucuuggccacuagggugacaccuucuauaaucaccuggcuccugcacggggaccuggggugcugcuccagccggacacauuaggguaagucccaggcaccaaggucaaguucacaagaccaagcucuugggcacccacuguguuaguucuaagggcucagagaacaggaccuggggccuguugaaaaacacauucuugcuuaucugucccuuccuugauauuuuuacugaggggcaggauccuccacuguaaugagucacuaggcuugguggggguucugauccucaugguggccuguuucuaaaggugacucaugggguagaugacaggugcuaauaugaaggggcugcccuaaaagggcuuuccacagaguaagcaaucagagcugaggcaggagagaggagccugugcucuggggcucuccucagagaagcccucacuccccacaucacaucaaucaagcugacauuuccucccacaagaagaugagacaacuugcauuguuaaggagcuuugauguacaaagagcuuuccccaauauacaggaucccucaguuacuaagauaaauggggaaagauuugacauuuauugugcauaauuuaaguucaaauagguucccagugaagaaaaauugcaaguugcugcgcugggucuguggcuccaguuccaugccuucugucgccguuucggcucugcacugcucuugggcugcccugacuuuauaauuuagagaacaaagccauauugugggauaccgggaagcuguauuucuacuccugagaugaacuuaucuccaucugugaauuauuuguuuuucagaaaaacacuuaaaaugagcaagugguuuuuuucucugacuuuaaaauaugauucaaaaacaucaaauagcugacaauguuuuucuaaaauaagaaaagaaaagcaaagccagguaucuaucacugggagggagaguguccccaagcuucuaggccagccucugagacucucugggcacgaaugugaugaaguauguauucugcuccugauuaaaagccugcuguguugcucuaaaauguggagcagagaagugccugacuauccaugcaucagccaggaugaacaaaccaagcugcaccccaccaugucagcaggacagcagcucucagccucugcuucuacuuuugccuucccuucagacacgggaggaacagcaccguggaggucagagggcagcagaaggggcagaugcacucccauagguaaaugccguggcuuugggaguagguagaaaggccagugcuuuuuccugacaccaggacuugaggauccugaaaguuaagaacuuuguggucaaucuuuauuccuagagaggagguuauggucuaggguaugggaagagcuuagcaguaaaugccugauucauacucuaagcccucaguggccucugacuucccgauggcauacaucuaccagacccaauggauacauauuagguaauucaccugcuucucauacccugggugacacccuagaaauucuagaagucaguagaaucuggccaaaagcaagcucagggauuccaggcaaggaagcaggcaacuggacuagcaacuccagcaagcauauaauugucccaggaccccugccccucaguccccagggcuccucuaugcucaccugaccucugcccuagguucccguccagccccaagaagucccaaagucugacucaggaugggagcuuagacugaaguuagugcugguuuacggcuacaggagucaagcaaguuucuacaacccaaucugcaguuaggccaugacagucagcacuacuuggaagugcaccuacuccacucccgcaccaaagccaccgaacuuuccaugucuaagguuagauaacaugcaccaucucuauccccucaccccuuccucaaccccuaucacccaucaagcucacagaugcuacucaacagcuucagcacccaucuuucuggcuaaaagcccagaaccccaccccaugcuaaguucucaugcacucccuccuaucagcccgcuuacauaguagacagagauggcucagagauggccugcuccugauggacucugagcuccuguacacaaagacuaggucggucucacucaacagacacacaauauuuguuucauuaguuacuaacaguugcuauggagaccuuaagaucacagaaggcaggggcuggagcagaguggcuuaaggucucuaaggaaugacccacaaggguucucggucuaaggacagaaccacauccuuagagaggaggacaaacagacaagagaggaaaaguggauagaguggagguggagaacaaggcagguacccaccccauuccacauuagaguaagcaaucgaaaacgauggggcucgagauggcucagugcaugagagcacuugcuucuccuccagagggcccuaguuugguuccgagcaccuaugucccgcagcucccuacugccuauaacgccaaugcuacaggauccaacacccucuucuggccugggcauagaugugcauauauuuuaaaaaguuaaauuuggccuaugcuggcucauuucaugucaacuugacaggguggggucaucugagaggaggguaccucaauggagaaaaugccucccucagaucuaccugagggcaaaccuguuauuuucuuaauugguaauugauggggaggaguccagccuauuauggguggagccaccucugucccggugguucugggaucuguaagaaagcaggaugagcaagccaugaggagccagccaguaagcagcacacuuccaugaccugcaucagcuccugcuuccaggauccugccaugauguccuucagugauggacuauaauguggaaguguaagccaaauauacugccugccacuaauuauuaaggcagcuacuuacaguucuguccauucggucugucauucuucauuaagaagcaccccaguacacacagacacacaugugacagugcugucuagcuacauaacuuaaacaugcagcuacaauuaggcagauaggaauaucgagaucacuuggcauuacuugagauacccaugccuacauggagucuggauaaacuuaaguuaaaccccaguucugcaagcagucucagaaugcuucuucccaggcuuggaauuccguccucaggcuccucccaaaacguccucccagaacuauacauaugcucuuaacucuccugaugcucuggagugucaucugggugacauuccuauauccucacuacuccaugucucuuauucuucuccauuacucucauacacccagacacaugcagcucauuuuauccuccuacuuaacucagagacaguucuuucagaaacaacccugagugcugcuacugauggaaggcccuauuucuucaugacuuucuccagcucuuggccauagccagcccucucaucagaguucacccccugaaaacagcuuccugcucugucccggaccaccuugccuccacugcuaugacuagccuuccuuggccacuucuguucuccccacagcuucuugcugcccuuuaaacacauuagcaagcuuaggugugcuccgugcuuguaaacccagcgccaacgagguggaaccagacguauuucaauuuagagaccagccucauguuacauggcaagacccuaaucaaagugugugugugcaauugaauuaaaaauaaaacaucggaaagaaaaggucaggguggcccagccugugcacuagcuguucucauuucuagcagccgcccaagacgucagccugagauucuuucuuaucuccucuaauugcucuccuaaagauaccaacugcuccaaucuccuuccccugcuucuguguuguauuuaacucuaguccacuuaacuuuccccagguuuuucuuauugucucuucuccgcugaagaguaaacuccaccaggacagacacaucaccucuacacaagcagcaucccagccaagacugagaauagaaaaagcacuugcuaaaaggcaaaacauuuuugaaguggagaaugcucugguuuggaacaacugcccucuaguggugcaguacgcucacugccaacuucauagugauuucggauaagucaagcccacgaacaaauaauuccucuucaugcuagaaaaacacacccacaaauaaagcaaaugucgagaacgguucccuaggggcuauacugagagcucaaagaaucccugaaguagcacucugaugagaucagugcucagaagcuacgaucaaagauucugggggcaagagagccuggaugaugggcaaaauuacgcacgcaggugcuggguuccaggugcuccggggaucagaggccccgccugcccacggccgagcgcucucuauuggcagauccacggagguuccgcguucccguuggcucagcuguaggaaaggcccaggccuucgagcauccaguccagccggccgcagaagaaagucugaggccuuaagaacguagagggcgucgcguccuagccuugacacgacucgagaaggccgccucuaucugccagcggacuaguccaagacacuccucuccuuggaccgcagcggcuacguagguccaaccucaagacagcucgcgcagacgcag

SEQ ID NO: 4161 - RNA, 37068 nt, Mus musculus
aaaaaagaaaaaaguuuucaauuuauuccaaaguauaaauauccugaauaauuaugugcaacugaaacaaauaaagacugcaguggcauuuggguuuaaaaacacuucacaguguguuguguuuauuaaguagcuccacagaagaugugacggcagugcagugggugaguagagcugccugagccugcucgggcacccacgcaccaugcaccagcggagggugaugcagcccacuggggcuccagggccagagaggaacgugggugguggccacaccauguccaggauaaggcccagggauggauggcagagacagagggaagagcuggagagagauuugaugagcuuuuuuuuuuccucucagauguuaguuuuuuggucuauaaacuggaaaggaaggcucagacuuaaauaaauacauuugaguaauggccuuuauugagcagaguccaccaauucagcuucgagcagguuuucccuucagcagcggcacucaucucuuccgacuccagcugagagcccuucuucuccuguaucuauuagggaaguagaagugcgccacuauucucaauggagaggacaaugccuuuuuugacaggaaaacuaauugaccggcguacauaugcaagacaacacuugguccuccagucaguuuucuuaauuaauuuuguccuggaauauauacaaguuauugguggcagcuacagcaauaaugcucuccauggggugccaggcuguguggaggaucuucuuauugaaguccaaacuguccacgcuaaucucgucuuucuuucucuuacccccuguacauacuuuccggggcuucaggcuggcucgggguuugcuguucucucuugaggcuuccaguguaacaucccuccgaguguuucuaucaaacauucuaaagaaguuguuguaggaccccgucauaauggcacuguuuaggagacaaaagagggacacugaauacccagcggaaucauggcaauggcaugagccaagguaauggcaugaaguuuggacccucuacaggagaaauagaguagauucuccagagaacuucacuuauuuucauguccaaggaagaaaaguaauggauccauaauuuaaauaccugcacaccaaggccagaagaguguguuggaaccccugcuaugucuuacaggugauagugagcugucugacaugggagcugcgagcagaacuccuccauuuuucuuguuuaauuaauguauagaagagggaagaggagagaaaggagaggcagacggguggaggaguagaaagcaggaggagcagggggggggggggagaagaaaacucuguccaagucacuuugcacaugggaggcagagguaggcagaucucugugagucugaggccagccugaucuacagagugaauuccaagacacccaggucuauguaauagagagaucuuguuucaaaaaaguacccccucccacucucccccaaaacccugucugucuuaguaauaaacugacaguuuaccauaagccugaccuucucauuaacaauuaagucaaaacugguuauauuuuagucacauuucccaauggaggcuaacucaguuauuaaaugauaaugauaaauuucuaaguuucuuuuaacguuagguauaguggaggugcacaucuguaauuccaacaucaagacagcugaggcaggagguuaucacaauuugauccaugacuauggaaggggucauuuuuauuuucuauauuuuggaauaugugguuugcaagcugauucuagcuaguaaugggauuacaggcaucugccauaugccgaagauccccaccccauuuuguuuuguguuuggaaacaaguuucauauagcacaggcuggccucaagcuuguuauauaccaggggauggccccaaacuccccauuuuccuuuaaguacaggggacacaggugugugccaacaugccgauuuauacagcaaguuacaggucagcuugggcuacaauauacauagugcuguuucaaaaaacaaaacaaauuuuauguggcccuuugacaucucuggcaaccgaagaccaaccaaccucuucuguccucuccugggaaacccucacccuuuccugcucguguccugaccucgauggucuugcugucucuaguggucuuuacaaugcccaaguccuucaagguacuacuuugcucagggcucuuccaagcugucuguaaauauuuuagcacgugguuaacuuuuccucaaauuccauaccaaauaaaacuuaguuacagcuagucuuauucauucaaaucuguuuauacaagaggcaccaggcaggcuggagaugagaaccaugguuugguacacucuggagauagcaccucaagugagcgcacagaacugugcuugcaggagaggacccucuguuccaguccacaggagugcaaugcuuaugggcguggggauggagccaauagcaaaugcaacaagaacggagagcacagugacgaaaacuguuugucaggaacaagugucguggcaucagcagggguaugaacugcuggugcacugugacaauaacaacaggugccugcucugaggugggcaucuccugaucuacccagcaccugagugcagcaagagaaucaugguagcaugggucaggucugccccacccagggacagaauuaaaacacggagcaggugcugucuuuuuugcugaauaaaacggaacacuuaaaugcagagcuucccagcagcaggcuaccaggcacugacaaaugacugcacuaaagacggcacuccacuccacugacacacagggagacgauucugggcaagaaaugaaugcacggagcaaacaucacuaggagaauguucuguauuccuagggauaugauaugcugcaguauuucagauacauaaagaccauuagcuauaagccaucugauaugguuacauucuacaagguaccuccuagaaagacaccucccacuguccccagaaaggcagucucuccucaaagcagaugggugcauacagcuguauucugaauaguaauagaucuaucacuuaguuacuaacucugugauccaguucccugaugauguaucacacacauaaacaauuuagcugugugcuccucaguggccaauaagcagguugauguuucagguuucuauuuuuuuuuuuuuuaauguacaagaucuucgaaauacacugauguuagcagagugccacaggaggccaggaaguaccacuggcccuacuccuccuugucacuguauaucccauucauucccacuugugaucuuugucuuuucuaaagugaacuagcaguugccaucaucauuugucuucuuuugcaagacagguucuuauccaguguaguucuaacugaccuggaacucaucuuguacacggggugaccuugaacucgagaaccccuccugucuuugucucuuaacugauuaaaaguaugcacacaccugguagccacucucucuuaaacuuguaauucauauauuauggacaugguuacuauuguuguauggauacuuguguguugguaaaugggcacgcccaugucccuggaagccacugguugaucucauauccucucaaucacgccauuaaaaaauauuucacaugugugugggauuugccuuuugaguacaccugugcaccaacuggggccaaaggagagcuucacucagagcucccuagaaaugaacuuuguucuucuggaaaaagaaaugguguuuguaacugcuguguaauuccuccaguuccuccaccuuuuucccccucaggcagggucuuucacuaaacguggcacucccugauuuggcugccuggugcccuucucaagaguugggauuacagcugugcacggucacaccuggcuuuuagguggguacugguccucaggucgucaugcuugcauggaaagcacuuuacugaguuaucuccauagcaucuuuuuuuuuccuauucuuuucagagagucaggguuucucuauguagcccuggcugugccuccuuggcagaaaugugcaugccucugccuccucaguguugggccugaaaauacucccacuauucugggagagcuguucuuuuuauuuuauaaguauuuuauuauuuugugugugggcgugccuacacaccauauacaagcaggagccuaaggagagcauuaguucucaguggguuuaaacugccgaguggguggugggaagucaaugagacccuucugcaagagcacugaguuucugaggccuugugucagaagcucuuccaccuccagacacugcagaggugcuccccuggcauugcagaggugcucccuggauuuuuuccccauuacuuacugcaguguauggaggacucuguccacaaagucacaggcaucggcuuuacuugcagcuggaagccaugcuggcuaccuagaccucuguucugcugcauggcaucccagggcgacuuucuucagcucugacuuccgagcuuucacugguguaugaggguuuccuaacccuuaacaugaguuagcucugugggagcaggcuuugcuugcuuucuuuuuccucuugcuaugugaccuauccaacagcgucaugugaugcucauuagaggcugaacagauaaagcuaccucaucuaggucuuucagucucuaaaacugucagccaaaccacagacuaaacaaaccuuuucuuuagagaaucgccaggcucuaggauccugguguuacacagaacauucaggcaguuucuguggaaaaauaugcucucagccucaacacccacucuacagagacuauguuuucuuuuacagaccacuuuuaagaucucucuauuuuugaugaccuguaauuuuaugaugauguggacagguuaccuuuguacuucuugcuguggaguucugugcuuccuggauaaacuacugaaaacccuggccaucaauauguuugaauuaggauguauuaaccacauaguggaauauuuaauguaaguuuaauacuaccuuuccacaguccuggauuuuuggggaccccucuccacuuggcuguauggcauaucauaucuucucuguaauuuauauuguuuucuucuuuaaauuaaaaaaaauuauuuuacgugcuagggauguuuugcuugcaaguaugcacaugcaccacauaugugccuauggaucaagaaagccagaagacggggucuuccauguccuggaacuugaguuacagaugguugugagcugccugggaauggaacugggauccucuggaagagcagccaguggcucuuaaccaucgcuucagacucagaacacuguugucauuuuaaggacaggcucuugguauguagcccaggccucaguuccccacuguugguguuacaagcauaagccaucaugccaccauuuccuaacucccauguucccuagcucuuuggguaacuucugcucuuccuugccuugaacucaaaauccuuuuaccucauccucuugagugcugggauuagacauguguacuaccuaccacgccuggcauaacauauuaagaguucacauguaaaagguguaagcuacacaguaaaggacagagccaaaaugcugagcagaaaaccauaagacuaauaaaauguucuaagaaauucuagcacaaacaacuuuuagaagaaggaaggucucucacaccaugcagcuaggcuagaccucaaaguaacacaagcgucaaagcaaagacacaguguaggaaugagcaucugagaccgaggcagcaacuuuaguuuaugaggucagcuauuacuuaaagaagccaaugcaguuacuuaggcaguucugagacagggucaugcucuacggcccaagcuguccucaccuggugguucucuggcucuaucacccaaaugcugugguuaaaucugugcuaccaaaucccuagcuguuuauacugaagcguuugacagugccuagucacuuaaauucucaacagaaauucuacaaaaagaugaucuaagagaaucuguaaacaccaucugauauguaucuucucaugggaugauuucaaagacucucagcaacaccaaaaaccaaugugaccugaacaggaaguaaacgaugcagcuacgggcaggcuguguccuaacacagaggcgacugaaugguggccguguggacuaguaaucacuugcugcuuccuuuugauuucacuucucacugagcacucuaaccauaucaugaaccacagagggaagguauguauauucagauaccugguuuccucugagauaccucuuaggacaaauaaaaggccuggaaaacacaacccugucagcaucuugcaacugacugagaccccucccagugugaggggcuugguggagacccuaaaugaaccagcacuuucgggugccggcgugcuaggacgcuggcagccucaccugucugaaccguuccagcagcacucgaacuugucaaagaugcagucguucucauacaaggagcagagcuugcuucgcagguacucauguaccuggugggucuccacaggccugcccuccauguugaggucccagaccuucaccgacagauagucucuggucaucauguaucgaccacuguggcugaacuugacaucagauauagaugagauuauuucugagaagaaggaucuacugcugggaucuucuggcucuucaaaaacugaagaaaacaaaacaaaacaaaaaaacaacccaaaaccaaagugagcacuuucaguuacccugcuaaaucagaagacuaccauccuagagucagcaggggcucagagacccugaagggcucggugccauccucauuucccuagcuuucugauugucuuccccuaccaucagugcccacaaggugcgggccuucaaauccacgcagggcaccaauaccuuaguauacaugggaacaugacgugccaccugccuaucuguccacacugcagggguguauggagcagaggcauagugcucugcucaccuugggaagggccugcucgucagaaggcaaagagucugcaggacugcuagacugcccuggaccuuaagccaacaauccaguggacagguacacaaugggacuacuggacaagaccagacagcaaagacguuugccuuuuguagcgaguggucauuuuccacagugacuugaaugaaagagugucacugcuucuuccacagaaaaacuagcuuugucugcagcagcuaacagcucccucccuccaccuucacccgggacccagggcagggggaggucucacccacgacuacuggacccccgcucaucuccaugcccacgcccucucaugcuuuaggcugggagauacauuuccuuuuccugaagcuucucuagggcuucugaaauucuucucuguguaggaacuugugauggcugcuggcucugcauggggcagacuggaagcaagcuagugccaacacgaagcauuuacucaaacuagugcugagaaggacagcucuucuugaagccuaaauuuguuuacuaaggaagaccaucuggaagacauaggcuacauauaaugauagcacgucauugcagaaacuauaacagagcagcauucucuugacacgccuuggccuuaggaggagcauuuuccggcugauacacauuucacagugccacuccagcgcaggugaggaaggguugccucccuaugugcacaguauaccagcauuggagggcgaagcucucugacagcugcacaugguagcuuacuaagaugauguacuaggacaacauaguaugcuuugaaguuaggugucccuuuucuuuuuuuaaagauauauuuuauguauaugaguacacuaucacugucuucagacaucagaagagggcaucggauuccauuacagacguuugugagccaccaugugguuucugggaauugagcccagaaccucuagaagaacagccagugcucuuaaccacugagucaucuguuuaaccccccugccccacaaccuccauuuuaaaaacacauuuauuugguuuagggagggaacuugcaugucaaagucagagaacaguuuucaggggucaguuuucuucccucauguaggcccagggggucaaucaagcucaggucaccagucucggcagagaguacuuuuacugguuggaccaucucauuggcccuaaacauucauuuuuaagauuuuaggugugcauguguauguggaagggggaaucuauuggaacggagagaguuuucacuauugaggcagugucucacucacuauguagcccuggcugaauguaacuauauagacaauuugccuggaaaucggccugccucugcuuccagagcacuaggauuaagggcaugguuuuuguuuguuuguuuguuuguuuguuuuguuuuguuuugccauaaagcuggcauuacagugguaagccaccugaaauggguaguggaaaccaaacucagguccucugcaagagcaguacacacuuauagcaggcgaaccaucucuccaacccuuuaucccuacccucuuuuuaagauggcccucacacgauccugccucaguuuccugaguagcuuggacuccaggcacacagcacuguuucuguuugauacagacaacacaaguggaaugcacucugauggcuauggcccugguccuaccacauaaaagcagcuaugaugauggcaucccacuggauggacccaggucacaguaagcucaggguagaggacagcugcuggaguacuccuuuauuagcauagcccauggggagccugcccaugccccaagucugcagaggacguggagggccccuaucaggacgaacaggagaucaaggauauuccccagaagacuuacacuuggcaugccugucacauagggcagaggaacgcaugucacacagccugauggugcccuugcugcugcuguaaacaaauacauugcacugauguggguggaacucugcggcagugaugacuucugucagcuccuccauauuagcuggcuugauguccacaaugucuggagcacgauguuaaggcacagugcguagcuguacaggggaaauuugauagaaaacugugcagugaggcauggggaggagcugcaggagacugaccauauaaacugucacagaggagcccauagcaaggggcuucagguggaugcgggacagugcguaagacagagcacacagaaugacauccacaaugaagccaagcagugccaccuacacacauacuucuaacuauaacuaauuaaaaaaacagacagugucaaauuacaaaugauucugccuuccuaauuauuugacuuuuagagcuugguugcuagaauacaaacacagcaggaagucaacuaugaaucagccaauggaaacaaaaugaagggcaaaauucuucucugggccacuguggaaaguugauggacagaguuaucuaccaagagaaacaacuaagaaaaaaaacaauauacaauguaugaguuguauaucucaucacuggaugccacaguggagagacagggacccaucagaacuagagacagcaugagucuuaagcugcccagucagugccagugugcaguagagagagggagcccagcccaacacugauaccuucaaguuaaguagaugggguuacaggguaaaacaccacagaaauaguggggagccaaggcugagaccucacagaagguaagugacgacugaacacaaggacagcaagauggucuggaggcaagaacaaguauugugaccucucuggugacaagaaccacagugccuagaguuccagucagguaggacaugaaugguucaccggagggcuagaaguggagguauauggcaguauuaggagcuagagguagcaguggcugauccaaggagacucaggguuucucacaugaacuuucaggcaaagguuuguaucuuuagggacacucaaucucaaagaacuucuaguugccacuacucucggaaauacugcauucaaaaggucauuguccaagggaccaggguaaagcuguucacgagaaguaauuacacauuaaccaaagaaacaaacagaggcagcacuugguaaaggauacugaagcuucuaucugugauuucuaaaugccauagguuaauucucagaucaucugcagagagauauguuucaugaucacuauuuacugaaauggaauuuaugugauauguaugagcauuugcaaaaauucgucguggacuugcuucuaccauaagguccaugggcuucaauauuggaaccuaaaaauggaaugagaaaggaauuuaaaacaaagaucauaauagcauaagcguccgguauuuagacaaggaaagggacagguuuuuuagagcugugcaacaccucaaaccagaggagagcugcuacagaguacagaguggaaagcugucuggucccagcuauuccuccuuguuccuauuacacaaguacuauggucuucuucuuguuagaaaaaaagaagguaaacugcccuaacuaauguucucuagaucaccaaaacaucacucuccuggguauucucuggcggccauggcugagguuagacaguaacuccuugucuuuguagcugagugcacaaucucggcucucauagcaugggugcucugauucacagugucaacucaugggccacagugguggggcuaugccuauguagggaucaacagacaggaugcggaggaugcuuugggcugagaagcaucuacuaaaacauuuuucugugauuuuaauucucagagcaucugcugagaucugagauguagagcuggcuauagucugaaccgaagugcagcuaguaaccuggaugguguacgggccuuggugccacagucacacaggcuucuggguuaucaguugcucgguguggagagagggaggaggcauggggggggagagggggagagagacagagagagagugagagcgagcgagagacagacagacagacagacagagagaaggaaggaccuggacagagcacuugugccugacacagguacaagagucagucuaaaggagcagcaccaugagacggaagagggaaaggcuccccaccucccuauuauucaggaaugggaagcccaagguuccagagaaagcugaauacuagaguaauuuuuauugcuguaacuagacaccaaggacugaaggcuuagaagaaucuuucaaaugacucuucucuagccaaauucuguaaaaguguuccuggauaaauguguagugaugcuguucucauucuggccuagauaggugcugacuauaccaccugggguuucauagaacaaaaaugccagcuccacaauacgcaggucuaagacacacaccugccaugacccucuacuguuucaagcuaaccaaggcagcagcaacuguaauccuaacugaaagagcccuuuuuauuacauccuuuuucauagaauuaaaauaaaaggaaaaaaaauccuuaaaagaagcagaauaucaggccuagaauuuauuuugguuaauucugucaaagaggccugguaagacccgaguuuccccaaauaagcacaugaccuuauggaauaugcaggggucugaaugagagaaucucggggucuggaaaggcuguguacgcaaaugggaugaagcuggagaggugagccgguuucacagaacuuggcaacaacaccuuacaacaugggggauuuuaaaauguguucacacuaagucacaaaugcaaacagcacuaugccaaaacuaaccuauaguauggaagagaacaucugaguucuuccuaugacucagaucugaacaaagagcaucucuucucuuggcccaguaacagguuaagugguagaggaggaagacugccuuuggacugucagcccaacucugcccacugucuuugugcagggacagcccucauuugccugucaccacacucucuagcuuuaucaagagaaugggucacaacuauauacauuccaacugcugggccugagaugacauccuagagaaggcauaucaaaaaaggcugccacauuucagcagcaccagagauggcuacuuucaaauaauaccacaccuucacuugguuaacaguguaacaaaggcguauuauauuucacugaaaaaccucucaagccacuaucucaaaacauagcugugcucuguuccuacccaggugccacuguuugcacugagcccaccauuuaaaguaucaaugaucaacccaacaggugaagaauuaaaaaaaaaaaaaaaaucagugugcucaagaaauuaacucaagaggaagauucaccagcuccacugcaagugucucacuggucaccagccaccuaccuacagugucaccacaccagcaaauacucuggauucuaccacagaagcucagcuggccuggguacuucucaacaaaagcucuacuaggaaaccaaaugugagcuuuucccucagcaccaucuuaugaccuuggugagacugaagaaucccauuuucaacaaguacacagcaacuaggaccacuaccaccauuauaggaagggaaagccuguuacguuugaaacagaauucucaacagcugauagaacuguuuuggauuauuucugaaaaguacuggaaggguuaaagaaaaugcagcauauacccguagugccguaauucuaaaugggucucgaagucguccaucuucaucuuucaaguuauaaccuucugcucuuuuaucccguucacuuauuuuccauaauuuaauaguuuuaucugaaaauaaaaaccuuauucuuuauauuaaaagaaaaaucauaaguaacaguaucacuaucauuugaccauucuaggaaagcacugccuaggcugccgucuaagcucaggaggccggggguggcucacuggguaagagcagcugauuagcaagcaugagacuccagguucacauuccuagucaugucccuaaaaucuaagugcugucugggguuauuuaaaggaguaagagacugacaguggaggacauccaauggcuuccucuggcuuccagaagcaugcguacguaaguauucacuacauauaugcauaugcaccauauacacacauacagaaacuaaagauguaaacaaauauaugaaauaauacuggucuucuaugcagaauuugaauuuucuagcuauuguuuucagccuagcugauaauucaccuucuccgaaguuuaaagcagaaacaacuucucgaguuauuuaaaauaagaauccauccacacuaaaauuaaaaauaaaucaaacagucauuuacgauucucaccauuuguagagaguagaaaaugagcagcauucuguugcgguaaccaccugauuuuauuaauuuuuucuucaauuucuagacuuuucaaauagucaaacucuggcucaugacucugaaagguacuguaaacauuguacucuccccuagagugagcgcggccuuuauucugcaaggaaacaugauagcuucuuuaaugaaggcagauagauuuugacuaucaacacgagcauuaaaugaucacacauuuuuaaguuaaaaaggucuugacucaaaaaacucuugacgaagcuggcauuaaugcacuuggaagaauaaagaacgcgcaggccuuuucugcacacuuaaaucuuugugggacacgacuaagccugucugugaauuugcccccuucuuccuccuuuuuguuuuuaauugucaaacuggucccaaguccucuaugcuuacagucuaaccaaaguuugagggcccaaguccuaccucugguagccccgccaguuaaccuuggcuaccaguuccaguaugccaguacaaaagaaaaugaggcaagacacagagauuuaauguggccauaucaagggaagcagguaagucuaauggcuaaaagcuuauuuuuugguacugauaugaguuuuaaauuuuaacagagggggaaaaaccugaaucaaagugcaagagauaagugcagucgggcagucuuagccuggguguuuuaucuaguaauuuccauucugguuccgacugcugaggagauggacuggcucucaggaggugcuggauucugcuccauggugcagccuugcccuguggacgauugugcaugucugggguguaguacuauuagcucugcuguucccggaauccaagguuagagacagugaccuaucacugugauuuaaucuuuaauguguguaugcacacauggaagcagguauucaaauacaauagauccagaggaugccauauucucaugcucuuuauaccugccuuauggacccacauaagauaggaaugcuuuuuaacacaaauauauuuuuuaaacauuuauuuauuauuauauguaaguacacuguagcugucuucagacacaccagaagagcgucagaucucaugguugugagccgccaugugggugcugggauauagaaugaaggcagcuuaggaguacucacagggagaagauuucuuccucaucuaccaagguagugcuugaaaaaauauucuacauaauuacugcaacaggacugaguguuaaagaaaacuggauacugaaaacuaugcuuccuuucugguuagcaguaugugcagcauuguagugaugacacucgacuguggacugugaagcacugaccucuuguucccgcuggaaaauaacaacucugccaccuuugucuccuguugcaagaaggucuccagaguaguuaaacucaacgguggagaugaugucggcugucaauagaagacagagucaaucacaacugauguuuuuugugaggaucaaaaaaugaacacauacaaacuuucucuccagauaaacauuccaugaaaauguauauacuucuugucugcuuuaugggucuaagguagaacccgccaguacaugggaagucugagucugauuucacugauccaauuuaccucauaguucugucauacaguaacuuggaugcuuuuauucaaaaaauaagauaagaauuuagaaaaauaauuuuuaaaggaaaacaaaacaccccagguggcuuuagaagaaugguaccuaacuuuaaggugcauacuugaugucaacuuuuaaaauaaaugcuauuuuuuaacuuguaugaauguuugccuguaggcauguaugggugccacauguacgcaguacccucagacagcagaaaaggguaccauuuccccugggacaggugcuggaaacugagccaagguuuucuaccagagaagccagugcucuuuagccacugacuggccucuccagcucccuaaauuugauucuuacauaguaauaggaauguuuuaauauucauauagaaacuuuuugcuagccucugugcaacacuacagaccauggccacccuguucaagacugacaaacugcaaggcuugaagaucuuucucagccccaagguguaggaauagucugugcaguaaauaaauguugugcaugccaccccaggggaaggcaacgggugggggacagggugguaugcuccaugcaugugagugggaaaagcugucauauuuccagacaaaaaucuaggauagacucuggaggauagucuuaagcauuucaacugugccaccugcugccugaauaagaacaaggcucggauacucugaggcaguguggcauauccuguggacuacaucugcaguugauuugccaauacggucagcugauacuacugugagaauggauggugacucugcacguagguggacacuguaaacaaacgccaucugucuggcaccagacagauguggggcagaugugagggugcccaacacccacagagcaagggugauaagcaguuauucuucaaaguaaaaagggugucguccuguaaauuuauuaaaguaaaugagcacacggguauauuaaagucauuaucaggaaagccaagucugguaugucuacauagacuggggaaaagguguagcucccuuaaaauaaaccuaaccagaggaaugcaccgacuaacacugugcugugauggccuagcauccgcucucugacgaccgggguacgacucaaggcaccaaaagcagaaaacuccugacugucucagggauuucagcuuggcuuggucugugguguaaccugcucuagcugcugccuauccauucaagcuaguacucuugucuggaccugacacucuucccauacguuuuaccuggaucuggucuuguccuuugccccuccagcuccccacaccucacuucuguagcuuaacucuggaagcaucuccaggaggcccaccuuuggcuuugcccucuuacuccucugccucucuaccugugcuuuuguuucucaggcuucucugcaauuccuugaauucuacuggggccucucuaaccucuguagccauucuauaaccuauaucuauguagccucuauaaccuacguauauguacagagggauuccuacaugaucuguaaugcacgauucgagcaaugcuauuaguaauuaauuauuaaugacaucaacuaaagaaccagugacugccuuagcuggcugucaaggaaacuacuacaacuugugaauuuauuguuauucaguacacucugacacaguggaaaggcagcaaugcauuugccuguauuucugacagagccacucuuagcacugcacaauagcacuaaucaaauaguugccagaagauuuccaaagacaccucagaguuggcaugacuauaucaguacugccugcugaccccauuuccucaaaaggcuucaguuggaugugguguaaggacaagaauaugucccccacccuuuuugagagagggucuccuguaguucagaccgacugugagugaacgccugauccucuugccuccacuucccaagagcugggauuacaggccgagucuccaugcccagcugaguuacuuuuacuagcaacaccuacccacuccccacucugaaacuggggccucauguauauuaagccacacuccaaucuaucacccuaaaauuacccaaaauaacuuaauaugcuugaaugaaaccagaacuuucuuuacuggcaccaagagacuaaaccuaugauauucauacucagaggauauacaauauuauauaauuaauaguguuaguugucagugauuuucagauuaauuaaaacaagcugaaucuuuugaaagaggaacuccuaagccuaucagugcugagaaauaauuuucauuaagucacaaauuauguuugagucuaaaauuggaaauguucuuuguaauggucagauaagcucgaaagcuaaaauauacacaugaacuaaaugugaacaaauuguaaaaccaguaaaauuuaaaugauuggcaucuacucauugcgauaucuuuuuacaauaaaagguguuacuagaaggaagucagcuauuucuaaauuuccacguuuguugagcuuauucacuuugucuauugugcccacacacaacuccuggcuauaacuucacuguguuggcacaaaggggccacugaggcucuuuguugugagguggugcucuggcugauaccagaaagucuuguuggauauuuagaucacuuuauugcagacaauucaguuauuuugagcaaugucagacuugaagccacuccuaugcccuacguccaaauagcuccaguuaggggaacauucccuggguccaucccauuucauguuccugugacgcugggugaugggcuagcacccccauccugaccccaugauaccucucagagaugccaaagcaagaaugcagaagacagacaguucuccaagaccacuugcucacagaacugucuucacaauggcccuacuuuuaaaacaaaagccacaacucaggaucugcagaugugagaaaagucaaccaaacaaagcaaacacuuagaagaaaacaaauguccacuaguaaaggauccauagugaccacuaacaucuuuagcccuguugucuacuaacagcacuuacugugcuagugucauuguaagcugugccugggaggcagcuacugucauccuggccugucugagaaggcacuuuuaccugaaauguaagcagccuaaaaacugcaaggcgcaagggcagagcacaaacacagcuggaagauggguuucaguggcccauggcccaguugacaguucuaagaugagagagaaaagaagaguaucagaggguuaggaccagagucuccuaggugcaaaggucugcaggccaaagggcugaugagccugcuacaacccaggcauaggugcaggacaaggacauguacacagagcaggaaagaccccaaaaggaagcagagcuaauaguaacacacaguuucagggagauggaugaauacuaaccauccuuaaaacuuuaagaaaccccccccaacaauuucaacuuaagauucuuuaccaagucaaguuuuaauuaaaguugaaaaaaggaaaaaaaaaaaaaaaaaaaaaaggugcccugaaggcaacuuaaauguccacucaggagaacagauauauacgauauauaaucauuacaaaagaacgccacagaacaaugaaaaugaccaaguaacuagcauccacaaucaggauaaaaagcagaagcacauacuaauaguguuaagaucacuuauaucaaauucaaaaccaggaugauugacuauguggguggguggaugggugcuaggugguaacuauagcaguguuacacuccaaaccaaaaaaguccuauuagcuaggucagagcugggguggagccauguuggagagaggaaagucuuggcugugcucacucucacagcagaagcuccugcuguguggucacugcugcaugccugggccuaagccacugugcacaucuaucaagcuacugaguccugcuuacgccagguggccaucuagacccuuaggcccauuaguuguacuccuccaaucugacuccacuccccacauugcaaccuccaccuccuccaagguucucugugccucuuuauucugaaacccaggaacauuuggaagccauuaaccucgccuucuccaacccugcucacauaagcucagauuuccuucaucgccuucuccaacccugcucacauaagcucagauuuccuucaacccuuggauguucuugcacaacugcuccuaccuuuaucugucacugacugcauuauauauaccuuugcugacuucaaacuaccacuggcacacuagaccccuacaguguuacagauucacuuaaaaacauacuagaaggaaacagccaugccuucaccccuaaucuucugcagcaauauucuuauccugcaagaacuugauccuaugaugacccccugagggaccaaacaaaccuucucuuguuucucauugaucuucacaacuccagaggagaaugcuuaguuaagcaagugucugaucucuacuggcuuugccagauaucuuggccaagcauuucuuaauucccucucaucugagggcucuuuacucucaguauuuccugaacagcuccugacuauacugcucagagcuugcccacugaaguucacuuaagccuuggcaaccauuagcagaucaacugucuggcuugugaauaugcaagcagcaggcugaagggaggacauucccuuccuacucugcagcauguauugaggcaaacacaugaugcagagacuuauaggacagaugauucuaauaaagaaucuccaggagaaaaaagucaucugaacauuggcacuuucucacacgcaaacaucuguaagaggaaauuacuacauauucacaaugcaaaguauuaacugcuuuucaguuaugcagaguuuauugaggauaucagguaagccaggcaaugcccacauauucugauauagucauagaggacugggaaagaacacugcacagaaaaauaaaaauuguucuaccaacagaugcauguacacagaguuucuaugugguauuuauuugggguagagggcagggaaucucauaucauccugucucagccucccaaaugcugggauuacaagaguacaccagucaggcuaauuuugucuuuuuuaaauaaaacaguuauuuuauuguauguacagguguucugcuugcaugugugucuauguaccaugugcaugccuggugcccgaggaguucagaagaggguauugggaacccuggaacugaaguuacaggcaguugugagcugccauguggaugcugggaauugaaaugaggaccuuaaucacugaaucaucucuuccacacuucuaacuuugccuuuggauauagaucauccaaaggcaaauguuaucucugcucaaaaggaagacauaaacugagacagcagcuagccaaggugaugcuuacaagcaauuccugcagacaggaggacuacagagaguucaauguaaaccuuggcuccaugagaccuugacucaaagaacaaaagaaaacaacccccaacacaaagcaauagaaguauaauccuccuucaaguaauuuaaaaaggcaaaccaacuauguaagagauguuuauaggaacacuguaaccccaaagcacccaaaaucaaguuucaacugugacuagacuauauuuaaaaacaaagagcucuagagaugauguucugugacacuacaaucaguuuugaauuauauuccauaaguuaacagaagaaaggcuugagauauauuaccccaaaacaggaaaguaacaagggacuaaauuuuaguuucuguuaaaggaacaaauaaaauuuuaaagaaaguauacccaagaaggcaaaguuagccuaacaaauggacacaacuccauguaauauuauauaagaaaguuaaaggacacaauccagucaugaccaccaaugcagacagcacaucugacacauccagaaccuucucagugacaauaaacugaaaacaguagggaacuucuccaaacuguaaaaagacuucuacacaaccacacaagaggacacuuaguggcuaaagucugaagacucuucuaagaucagaaacaaggauguguggguacucgcaugaugucuaguacauauuuuuccaaaggugcuggccaaggcaacuaggcaggaaaaagaaacuguucacagaugaggcuguaguguuuacaaucuuaaaaacaucagggcuaauaaaugaguucagcuaagauucaggauaccaagccaaagcaaaguucacuucaugucuauaaaguagcaaugagcaaccccaaaacaacaacaacagauuucuauuuacuauaugauugacaaauguaagacauauacacagaaauauaaugguauugugaaauaacaauaaauaaaggaucgaaaggcucaagcuuucuuauuucaaaauucacuaaaaagguacaagaaucaacauuguauguaugagacuugcacaaagacagacauauauauauauagucuuauauuuuggucaaccaaaauagugaaucuggacacuuauaauacagaaaucaugcauacuauaaaauaauuuuauaugaaauaaauuuauauuuuguauuuauuuauuuguuuguuuguuuuaaagacaggguuucucuguauauguaauugacugcccugaaacuugcuuuguaaaauaggcuggccuugaacucagagauccaccugccccugccucccagguguugggagaugcaaaggcguaugccaccaacacccaguuuaaaacaaauucuuaaaauaucucaaagccuuaaacaccaauguuacaaaauucuuugaagaaaacaagccggcuaagaggauggcucauuggauaaagugcuugccaugcauccaugacagccuucguucaagccccagaacucagauaaagcugaagagaaccacucuauaaaaaaauuaucccugcccccaaaaggggcgggagagaugguucagugguuaagagcaauggcugcucuuccagaggaccuggguucaauucccagcacaaacauggcagcuuacaacugucuuuaaguucaguuucagggaaucuaacauccucacauagacauacaggcaaaacaacaaccaaugugcauaaaauagauaaauagauaaauaaaucauaaaagaaaaugaacgaagccaggugugauggcacacaccuuuaaucccagcacaugggaggcagaggcuggcagcucucuuguauauugaggaucagccugaucuacauaaguuccuggacagccagggcuacuuggugauaaucugucucaaaaaauaaaaacaaacaaauagaacacuaggaacaaaccucaguccuaguacaccugggagauggagggucaggagagcaagguuuaaggacagacugaacuacauacgaccuuuacaaaaagagaaagaaaaaggucauuaaaaccaggcaaaguauuugaacaaauaauuuucaaaguaugucagugcuuaauaagcauaggaaacagugcucaauaaauaaucacuagggaacuacaaaucaaaacuacgaaauacuucacaacaaucaaaauaguuaaaauuagacaauuaacaaagacugaugaaauguggagaaacuggacccaccguacauccguggugaaauguaaauaaccguucuagaaaacaguugggcaguuaauaaaagauguugaacauggccaaggaccaaacaaguccaugcguagguauaggucaagagaguuaaaaaugcauaccuacuacaucuguagacgauuccuaaccugcauuauucauaggaacuggaggaggaaccucuuuagguagugaguagauuaacacauuguagugcgcccaucaguccauuugaccacuguuuauuggaaagggaaggaagcugaugugccuuagaacagggaugaaccucgagaauacuaccaaguaaaaggagccagaugugaaaagcuacaucucacgugacuuuacguauuaaagaacaggaaaacccauagaaaugggaauuucuaagcauaaaauguacaaugauuuauauagcugggguggagggagaagggggaacaaguauuaaguguucgaggccaguagugaggaccagucccacaaaagguaucauuuaguuucagcuaggcacaguugugugugcaucuuuagucucaguacucuuaguuccaggccugcccggucuaaaaagaauguuccagcagagccaggccacauagagaaaacacauuucaaacaaauaaacaaaaaaagauggcuaugaugacuacaaacucuaugaagagauagauuuuauguaaguaguuuauauuucugcaaagcuguuauaaacaaaauauaaaacaaauugaaucauauuacuaaaagggccuuauaacuuaauuuucacuagcauacuauaaaaaguucacucuuacuuuaugcuuaauuucauuuguagaacuuccuuuuuaaaaugugugugugugcgugcgcgcgggcgcgugcacauguguguacacaugguguucauugaaaaucagaagacuuguuucgucccuucucucuuuccaccauguagggccuggagauugaacuaagguuauccaaaaaaugguagcaaacgcuucuaccuacugaaucaucuuacuaucugcuuagaaguucuaucagugacuuugaaauacagcagucauggcaagucuaauuuguuagucagcaaaggagcagugguacugcccuguaauaccuguggucuuaagaugcgaguuaguuacaagcuagcuaauuggaugccaaauuagaaucaugaaguccauugucuacaauaacaucaacauucuuacuauacucuugaacauuaagcauguauuuuucauauauguaacauucuaccagagcagaucccagcccaugugggaucaccccagccagaguaaucuuugcuuuuuaaacauguuugaucauacaauuuuaacucuuacuguuuuuguacagacuuauaauuucauuuuauucucucauuuacuuucucugaccuauugcccaggccauguucaaauguuccugcuccaagucuucccauguuuucuacuuuucuuugcuccuuucauacaucaaccaugccaugucagccauacucacaacucauuacaggacgucuguacugggucagucuaggaagacucauaacugauucccugcaaggcccccucaacauggcauucaauuagcuaccuaguaagugcugacauuuuaggaccacauguauguagagcaaugccaccaguguuaugcuagcuaacaauaucugcagugaggagucacauaaaaucacucacuuuucuucaggaaagccucucugcaggugcugggauaguaguucaggucuguaauccuagcaccaggaaggugggggcgagaucccaaaaugcaagccauucuggguuccuugucccaaaacaucaagguccuguguucaauuccaaguacuaugaaauuaaaaauuaaaguccucuucacucucucuuuccuguacuuuagacacagcuagauuaccauaacgacccugagauuuccucaucuauauaauagucauuauuuugaggacuguacuaaaaagagaaacaucucauaauuucaggauggaccuuuaaaccugauuauauuagcaacacagggcugcuuaucuuucccaauugcuuauuucuuauucuucaucuuuauuaacauucacuagaaauauaucuaaccugguaagacucuuccauauacuacacauugaaguauguuuaaacauacaugcaggaauucaaaguucuguccaaauugaagaaacuguacaagaaguaaguuugccaacugauaucaauuacacaaaauacauuaggcuuaucaaauuucagguaaaaaaauuaccaaucuuuauuuauccuguaccuuagaaagaaaccgaaguuacuuuuaauuaguucacacagugcaucaacaucuguaccucagacugacuuuaaggaacacacuuguccgaaaacagaacuuuaacucgaauaacaaguucuaagaaacaguguagcaaaaauaugucgagaacucaugcuuucaaagcccucaucugauucugucguaaaaugggaaaguugaaggaagugcugaugccccagcagagacagugggaagaacagaacuucacgcaggacccuagaggcugaguagaggaugccuggcaggagugcaacaagggggagaaaagacugcucaagggcacaaaggucuggcuggggauaaugaaaaaucaggagguacaggcagcugaaaugagcacacaggcccaagaugcagcaacucacgaggcugacuugagagcagccuggucuauacagugagagccugacuggggaaaagacaaacaaacaaacaaaacuucccagcaaagugagaauuuagccgaagacagaggcauacaucuacaguuccagcgucuugggaggccgaggcaagaucauuggcuaacaacaucugcagugaggagaccugaggccaacccgggcaaucagcaagaaccuucacaaaauaaaaaaaggccaaggauguagcucagcaguagaaugcuugccuuguaugucuaaggcccuggguucaaucucuacucucugaagaaaacaaaugaaaugacaaauguagacaguugcuuacucucucacccaaauuucccccuucacagaagggggucuaggucuauuacccagaccacagaaacuauuacaaaaacauucuaaugauguacacugauuacuuuuuuaaacuguuaaauuuugauuuuuuuaaaauaaaagguaagcaaacugaaaacaagcuaaacauuuucuuagugucuguuucaaaugaaugucaccguuuuaauaucugaauuuaucaggauucuaagcagagggaacauuauuucaaggaucugacaucuugaaugcuuuuuugacaacugcuucgcauccuuccugguacaauacacaguagcacaguccauguagggagacauuggcacugaguggcgucaaaguuaacacgagaggagauauggggaaguguaggagaagguccagagaagaugauccuagucagugugcucaagcagaaacuaucugcgcacugacugaccaacucacgcaggggcaagcucucuaggaguucacaggagaucuaccaccuccuggcuauuaccaacaaucucugagucuucuggcuggccuucccucuuuauuauaaaacaaaaggcaccuuggugugcaacaaaaugaaagagauacagaauaagaacaaaagaccucuuccaucaucaccacaggugacauccugccaguagcauccugaccuuggcauuuaccaccauuuacacgggcucacugcuuggaaaugcugucacucagcauaccaugcugcuuucaccaaggaugaagcaugacucagcucccugcuucacugcucuuagaggcaauuagguuucccuguucuguucugcaaagcaccucuuggugaaaugcuagcacauugcuguaagcuucuuacacauggaaccgugggaucucaugcauuuuacuuauuuauuuacacaucuauuuauaacaauaauaaaaauuuaaaaaaacuuaaaaaauuaaaaaaaaauugaguaaaguauaguccugguuguccuggaacucuguguagaucaggcugaccuugaacucagugaacugucugccucugcucccccaaagugcugggauuaaaggcacgugcuaccaagccugaguggggccucaucucuucagacaggugucaaacagcccucuaaaacguaagugaagagagcucuaaaggcaggcagauggauagaaaagacuguauauggccaucacuuguaguaccaaguauagucagucugaugagugagguuaccuauauacaaauucuaugcagcuaccacgaaggauggccuggaacagagggcgacugagcccaucugagccugaccaugagcacagaguuaccugacagcacucccgacuggaacaccuacagcuuccacaagugacccacucacucuuccugggaaucaaguuccucacaugggaaaugacauuaacacaguaguuuuagcucaaugguuguggccaggcgguaaggggccauaaacaaaguuuccugguaagggaccucgaauuauauaguaauaggcaagcuauaaacagaguauggaguucaugagaagagcugauguuuaugaaaaaaagaauaaaaucauaaaauauaaacaaauacaaaggauggcugagaacacacacacacacacacacacacacacacacacacacacacacacacacacacacacagaguuaauuacaagaggggaccuaggagggauuccaggacuaccagagaacacaaggagagucuuuguuuuuucagcuucucugaagcucuaccauuuggcuuucuauuaauaacacuguauuuuuguguucugagacaaaaacaauaaaaucuagccagacaaaagggugugguuguucuuuaaacuugccugguccuggucauuccacuguuagcagcuuccugcauagcaguggucuucaaugcuuggucuguggaaccuucaggaacccuuggaggacccaaggguccaagcuguguuaacaugucacauuugugaucuauagucucaguguuguccuguguguguagggaccccaagcagccuagcaccauggugcagcagcagcccucaaguccugcaggacauccauguggcaaagaaaaggccaagagccaguuuuccuuaggacagacacuggaucacugacuuucacucacuggaccugcuccucauucugcacaaggccuguccuguuucuuuguacacagcugucuccaggaaaggcaccucauugccacuguuuucauagaaugcuaucuucuuuuggaauggcuuaccaauacuggucauucagauuuugacaugugguacaguguuuuuguuuuuuaaaugaggagucucuuacuucggagaagauuauggauaaaauccggggacugaagacauggcucagagguuaagagcacugacugcucuuccagagguccugaguucaauucccagcaaccacaugguggcucacagccauccguaauggaaucugaugcccucuucugguuuaucugaagacagcuacauuauacucauaauaaauaaauaaauaaauaaauaaauaagccugcccucuccgggcuucagagcuccccgacgggaggaggaggugguggugcauaccuuuaaucccucacccaagaggcagagccagcaaaauauuccaaacagagaauaucccucaugaggauggguaaaaaagacuuaacauauauuaauauacuaaaaaaaucaucucagucgggcaugguggcgcacgccuuuaaucccagcacucggguguggauuucugaguuugaggccagccuggucuacaaagugaauuucaggacagccagggcuauacagagaaacccugucuggaaaacccaaaaaaaaaaaaaaaaaaaaaaaacccaaaaaaacaaaaaacaaaaacaacaacaacaaaaaucucaaaagauguacaagugccugaaaacauuccaaauacacccaccauagaaaaguucagcaaaggccggguggugguggcaaaugucuuuaaaucccagaacuagcaaggcagagguaggcuggucucuuugaguucaaggcuagcccagucuacagagcuaguuucacaacagccugggauacacaaagacacaccccuaccccccaccaaauacccaauggcucagauuccaaggaacaucuaaagagcaaagccuugacuaggagcagagcaaccaucauuccuuacaaagaguaauggcuucugcuugaggccagauuugcuuuauuaacuucagcaaagcaagagaccuaaacugggaacagaucuaaggaucagcuagcuguaucuuaacuaaccguuuaaagguggaggacaauaaauaguacucuucaccaaaccuguuucagaaaaaaccguuguuuauuaaaagagcaguauguagagugagcuaaagugaaaaaaaaaaaagaaaauuaagauguacuaauuucaaauacaguaaguauuaauaggucuaagucacacagacagaaguucuaaaaguccucaguuaagacgcccgagagucagcaagguggccagcaagguacgcuguaaagguggcuauggcagcagcaggacugcucauuuugaugagcugcagcuacuauccuuccaccaagcaggucugaggucagcaggcauaggcuugcacucacaucuuugcacaaugccuuucuauguguccugcuuuucuguacucuugacuggcauuaagcugaagaaacaagcaugacacaggacacuggcaaacaaugucucaccaagugaaaaggcagggcagagcgcaaagccugaauuauuuaccauuuggcccuuuguugaaaaguacaaauuccuuagaguuugacuuuuucccuagaaccugugcucugccacccacagccauucuccaaaguccagagugaccuucacacaguuacaauguugccaucucuaaggcucauaaucacuaagcacaacucaaagccuuuggcaugagauucaaaggcuauagcauuuuuacuagcugggcuggccucuugcuucucagcacauuccugccugccaagggguuaaguuggguucucagaaggccuugcuucuuauaccucuccucaagccacccuuuguuuccuucuucuuguugugcucugacuuucucucuccauccccacccucucugugcugugaucgcuccucuccaguucuccacacagcuuagaccuagcaggguugcaauaccuuacucacugacugaauuugauuucuucagugcacuguggcacuucuuuagccccacagaauucuuccuuuucugugucucccacagcagcacagggucagcuccucuauguugcacccuagguaccagauccugugucccugcuugccagaacuuuucagcuucucuggaaauacaucaauucugugaugguuauaggugaagcccccacuuucugaacagggaaacagaaguauucugcuaaguugacacaagcuauuaagaagguaaaaacaggguuugcaccuacaucucugcagugucuuuccauguauucuuccuauucugauuggcaucaaccuaaagacacaagccuaacacaagacauaggacaugccaaacaagguaaaaggauagcccagaguccaaggccaagugugaagagcagcuagacuaaagaucuaccaacauggugcaauuugauggaaggacuggugaaguauugagaauagacaggaaaugaaaagaauaaucuagaacaaaagaaauaggagcaauggugcaaagauggugagacucacagguuaacagugaaaaaaaucaagaugccaggcccagaagacaggauucacuaacugcagagguaaaaacuaaucuauacuuaaacauagcuaaaaucagacauuucaagcugguuauuuaacauccagcucaguacuuuaacugguaacaagaggacuguuccugcccccccacccccuuugaucacauauccuuuggugugauuucuagacaaucaaggcucagaaaaggccuuuauaacuggcaacugcuggacacacucugaacccacaaucucccuucaaacaagaacucuucacaucaaggacuaaagacaguauucaauugcuaugggcaauccaaaugcuguggauaaucuuacaaacaacaugauuauguaacugggaccuuggucacagcuuggucauagacccaacuuuaaagaugcaaguagcugacucaguaaagaugaagaacuacagggaucuugggagaggcaaugucugaucucgcguuccaagcugagguccacugcaaacucaguacuacuugaucacuugcuucaucgaugcucuccccgagauacuuuccuagaggcuuuuuaucaaugaaaaugcugcaacagaguggaaaacucauauuggaaauaauucaacuaaccaaagaccuugugccacugagacuucaaaaaaaagggggggauggaauggggagaaagacccaugauaagcacuaauguccauuuuuuguuauguggaaauaguccuaacacauaaaguuuaugacuaaguguuucuucccugguaccauguucuccacauuuuauuaucucugaaaugggauguaucuuauggucaacaaaacauaguuaccucuagacuucagcccaacuucucuucauucuguuaccuuuugggguuuguuucuuuaaaaacaccaugugaccccuaaggggagauuaucuauuaucuuuuuauuuaucccagaucacccagccuguuaggucacuuuuauaaccaugaagguucacccuggaguuaaacauauagacuguuaguuugacuuuguauuauuuccuuagggagaaaaagauuaaaguugaauucaaggcaauagacuaguucacugaugaagaagaaaguauuacgucagggcuggcaagacggcucaguggagaagacgcacuugcuaccaaacccagugaaccaaggucaaucccuggaagccaugugcaccauuccccuaaauugucuuugauaucuguuuuccaaauauaaaagcuaaaaaaaaaaaaaaaaaaaggaaacagguuauccaauuccauguggucaguacuaaacacaaauauaugggcaacauuacuaaagaaaaagaggucugacaggcaguaagggauuggacuuggaaggggaugaagguauagaaauaauguaaaugaagaaaaaauuacuacaacaaaauaguuaaauaaaaagacgagacauuuacauuuccaagcucugaaaugaaggaaccagauguuaucccucugguugaucuuguaaucaaacacaccaaguucaacaucagacucucuuuuaccaguucccccauuuguucugggaaaacaaaacaaaacaaaaacaaaaaaaaaaaaaaaccaauacacacaaaaagaaugaggauccgagguucccugugagugagcugacuguaaguuauuguuaugcaggguuccaauuugacuuuucuaugaugccuacuuuuuaaguuugagaaaaugacauaacacuugaacucuuauuacugaccuuauuuuaucugauaaacaauccuuuuuaaggcaagcuauucuccuguguuuucaaaggguuaaguucaauugcuggagguacaauuucggcuaacagacagcuggcuccuacaaggcgcuuccccagggcuggcuaaaacacagcacacaguaaagcacgcaggccuucgagacagggagcauaguuucauaccccaucucugcucuaguauagcuauggagcugaacugaccacucuuuggugccuuguuuaugcaucugaaacugggaugaacagccuucagauggguaaagacugaacuaacuggcacagguagugccucugcacaauuucuggaacaccaaguacccaauaauguuaaguaucacugcuuuuuggcuugguccugugcaaggccuaggaaagggaguuaacagccagccuuaaggacucagucuaccaagcacaaacaugaaaagguuguaaugucaugcaguguucacuagcagaaagcauguucagggacagagagcagaggcuggcugcagguuacugcacaccacaaaauuuucccaaauagagcagugagugagcauuccuaagcucaguacuugcaaguccccuggccuggccauuuuguuucuugagucuuugucuacucuccagcaggggaaggagagccaaucacucccucagccaccugcacaucugggcaucagcaucacaauuacuaaucucccugugagcucaguuugcucccauuuucagguaugcaggacucauuuaccacacaaugaaaccaugacuuucagccaaagagcugaccugacucagagcaaaaucuaauucuuauauacauaaaaauaaugcagcaaacugucuacaguucacuacuguauggggguggggguggggguuauuagauuaaaaacacgaaacucaaacagagccauccugcuccgccuggccagccuaucuccacccugcccucuguccccuagacucucugaguacugcuugcuaggucaaaagaccucagacuuaaugucuagggcacaucugacugcuuaugcccaggacugcagaaagacaaaacaggggcagggcuucauggaauuuugcagagcugaacauaaagccucacaagcuacaaguuucaacacauacauuuugccauaccuuaagaccucaaauccaaacaucagcacacgaaauaaaccccuugaaaugccaccuccuaauuaucucuccccaacauuccuucuucaagcuugaguuuggauaagauugggucgugacucuuguugguacaaguccuagcugccaaugacugccuuugcccuuuucaaccaucacugauaaauccaacaauaucaaagcucugucuagcugacaaaaagauggauuaagaaguaacagaaagcggugaacgcauacaauuaaaaagaaaaauacagguaaucgcaugauauuauacacacacacauacauacaaaagacuugcaaauuaaaauuuuaauaauauuauacacacacauacauacaaaagacuugcaaauuaaaauuuuaaaugcacugaaaguuuuacuuaaaaaagguuuaaaaaaaccacaaaaagagccggugcggugguggcgcacgccuuuaauccuagcacuugggaggugggaggcagagguagggggauuucugaguuccaggacagccuggucuacagagugaguuccaggacagccaggacuacacagagaaacccugucucgaaaaaccaaaccccccccccccccaaaaaaaaacaacccacaaaaagcuugggcagugguggcacaugccuuuaaucccagcacucaggaaggcagaggcaggcaggaucucugaguucaaggccagccuggucuacagagccagggcuacacagagaaacccuaucuugaaacaaaacaaaacaaaaacagguaaaacaaaacaauacaauaacaacaacaacaaaaaaaaacccacaaaaaguucuaaucaguuuaacacaagcaacaaaauacuucuguugugguuuuuaagggaaagaaugguauuuuccaaaguauaaagucgguuuaaauucauuuaacugaucaauaaaaaccaaaccaaaccacauagaaacucaaaauuaaggcagccuaaucuuccuacacugcuaucacaaguaggaugaaucacaggaauaaggcugaccugucaccuaccuggcacaagaaaaaugaaacacaguaauacauuuuaugccaauacagaagaaacaaaaucaauaaacuaugccacauaaaagucaccugacuucaaucugaaaccauucaccucugcaacuuuuggagagcaguuucacaggccaagaugaccuguuccggucuugucccugggaccacaggccuccagauguucucaauggucaugagucaagccagacacuuccagaagagacaggguggaggagcaaacaagaagcaggacaggacaucugaggagcgccugcuagugaggaguguggguggagugaacagacgucuuuaaaagaaagugaaagcccaugguuuauuagacacugaacgaguugcuuugagucuaauauaaaaugcuaaugucaaaucucuaagaauaaaucccacagucuucacgcucuccuacuucccugucuaccuacaaugauggcacauuuaaacugugaucaggggaaagaaggcagcagacugaagcuuugaggauaaggaacaguuuuauggaaagcugggcuuugauugcaaugcuugccaauaauuucagaauuugggaaguagaagcagcaggaucaagaauucaaggccaaaguugggcacagcaguuuaugccuuuaaccccggaggucagccuggugcacaaaaccagggcuguucuacagaaaaauccugucucagaaacaaacaguucaaugccagccucagcuauauagggaguuugaggccaaucugagguacaugaaauucuguuucaaaaaacaaaaauaaacuguaaguggguggaugagacugcuuagcagguaaagccauucgcugucaagccugauggccaucccugggacucacgugguaaaaagaaccaacucugcuaaguuguccucuaaccuccacacgugcaggagcacgaacaggcaggccuaugcucaccacacacacacacacacacacacacacacacacacacacacacacacacacaguguguguuugaaaucccaggacuuggcuggaugggacaacaucaaaaaacaaagucuggagaagugacuuuaaagagcagugugggaagagaaaacacuacucaguuaaaaaaagaaaaccgccacuacuguagcgcuucaggagaccccaugacaaauaaguuccucuugcucaacaacaagagguggagauccagggcugaccgacgucuaccuggccagagauuggacuggacagacuagcacaccuacgaccacaaacaggguauccagagcacucggugcuccaucccguccugaguccaguccagcaugggcccccggagacugauaacccugcaugguucuccuuccaccuuauacgggugccagggagauagaugaaagacccuuuauauugcaugggcucccacauuagugucugggaccugauuuaccccacagggccucaagaucaacugccaugccccccuaucucucuccuuucacaaaaauggaccucaccucaccccgugguaccaacuccuagcggaaucccggggucgcugccuagugucuacaguccuuuuucuucacuccguacagacgcuagugagacaugcauuuaagaucguuauacaccccagacuccaaagaccuguggccgcaucuuccuuacauggcucgauaccucugccccggccuuaccuucuuacagacccucgaggccggcguccacggucgucuccccauagccucccgaggcuggccuccauggccaucugugcccaccgaccccugaggccggcgucauggccaucauccccauagccucccaaggcuagcguccaccgccgucuccccaacagauccccgaagcgggacucagccgcagucucuccccagccccgcguccgcagccgucucccuacggacaccccucccucucuucagccgcuggccggccgagggucucccgggacaacgccggucaggcgggcaaaggcggccgcguccggaccggcggcugagcgagcaugaccuugcggggcucggggguugggguggggugucggucgggccucaccuuccgccacguccucgucgacagcgcccuucaccugcgagaagcaccacuggaagucguugccgcccgccgggcagccgccgccuccagcuccugcaacagagcgcgccgucaggccggccccgccccgccccaccaccguccaguccgcccgcccgccccgcucgcucgcucgcgcacggcccucaccugccauggcgcgggcgggacgcgcccagccgagcgcggccgaccgaggcgcuccgagcgcucagccccggccgccaccgccgccgccgcugccgccaccgucgccgccgccggggagggaauuuuuuccccuuuucaaaauggcgcccaaugcccgucgccccgccggaugacgucaucccccuccgccuccuccgacggucagugccgcgggggcugccgggggcgcaccgugcgccgacugcgucugcgcgagcugucuugagguuggaccuacguagccgcugcgguccaaggagaggagugucuuggacuaguccgcuggcagauagaggcggccuucucgagucgugucaaggcuaggacgcgacgcccucuacguucuuaaggccucagacuuucuucugcggccggcuggacuggaugcucgaaggccug

SEQ ID NO: 4162 - RNA, 1720 nt, Mus musculus
guuuuuuuuuuuuuuuuuuuuuuuggagacacagucucuauguagucuaggcuguccuagaacuugcuauguagaccaagcuggccucuugucugccugcaugccagucccugcaaaugcugcugagcccuuagaaaugcagcugccuguacuauccaugccccaguguggccuggcagacagcuucccucacccucagaaaggaacuuuuguacuuccacuucccuagucagcacucugccgugcuccauacagugcuccauacagaggacagcuguaaugcagcacccuuggguauuuucucuaucgccaaggacuggcagcuacaagucacauuaacccacaugacagccuugacucuuuagaacauggcagcugggacaggucuaacaguacuggccuaaaauggaugucaggcacauaacauaaccaccauucgcccauugggucacccuguggucagggcucccaccggaggcccucagcuaagaggaacagugugugagucuggcuaaaagccaguugucacacucagcucugcacaggaagacuuuccagguaugguaccugggccaggacccaagaauaacaguagcgaacugccuuaggcagccaucuucccuccacuuuccgcagcagggaagacuguccuagguccauggggaucgguuccacuuggcaucuguuuuacugaaacugaugaacacaacugucaguguuuugucaaauggcagacugaugcguaaccgcacagaagcauagcuuucauaguuuuucaacacaggguucuggcuggccucaaauuucgagauacacgaaccucugccucucaaaugcugggauuaaaggggugugacaccaccacccagcagaaaaaaaauguaauuaaaaaaccuuuaaaaagaugaaugauuagcuugacuucuguauguguguaugcacgccucguacagucagggcacuggauccccuggagcugggaguuacagcaggcugugagcuguaugugguuucugggaauuaucaagguccucugcaagaagcaggugcucuuaacuucugacucaucucuucagcccuucuuuuaauuuuuaauuaauaaaaacugagacagagucucacuuuguagucuugguuggaacucaagagauccaguagucucugccucuuuugugcugggauaaaaggggucaccaugcuuaggucccccaagccccagggucucauuuagccaaaguuggccuaacucaacucauauaucaguggaugcuuguacuucugcuccuccucccaaguaugugaaucgcaugcaaucaggcaaaaauauauauuuaaauucuaaugcauaagguagcugugcugguacacgccuuugaucccagcgcucuggaggcagaggcaggagaaucuuugugguugaggcuagcuagggcuaggcagugagaccuuguaugaaaacagaaaauaccacacguaugccaaacucaguggugcacuugagaggcaggaacaguuaagacugcuguauuugaugucagccuguuccacagugaugaguuccaggccaguaccacauaguaagaccuggcuuccacuucaaaacaaaauccacaugcuuuuucuugucuagguccucaguccagcagcagagugaugaaacauuagacagaaacugguaucuuaaaggaaacauuuuggaaauguuucuuagaaaugcuag

SEQ ID NO: 4163 - RNA, 19213 nt, Mus musculus
uccuucacaacaucccacagagcucuuaacaccgaauagaucuucuagcccaaaguuccaaaguccuuccacaguccuccccaaaacauggucagguugucacaggaauaccccacuccucguaccaauugucuuaggguuucuauuccugcacaaacaucauaaccaagaagcaagcuggggaggaaaggguuuauucagcuuacacuuccacauugcuguucaucacuaaaggaagucaggacuggaacucaagcaggucaggaagcaggagcugaugcagaggccauggagggauguuccuuacuggcuugcuuccccuggcuugcucagcuugcucucuuauagaaccaagacuaccagcccagagauggucccacccacaaggggccuuucccccuugaucacuaauuaagaaaaugccuuacagcugaaucucauggaggcauuuucucaacugaagcuccuuucucugugauaacuugagccugugucaaguuaacauaaaacuagccaguacagcgaucuaauuucuuacaaaaauacuuuacugaaugaagcaagaaaacaccuauugacuauuacauccuguaggaucuugcuccaaaugaaagggauauaggcuaugucuaguaauuauguaaauauaaacaaaagacuguuaaaaugucacuuuuauuuuagcacaccugaguuaagugugggacagugaaacaaauacaacaggauauauacagcaugucaaggaggcaggcuuuaaaaccaugcuauagaaaagagaagacugggaggacgcccgauuuaagcagcuuuggauccugauuaauggauaugcaaauauaguauucuccaguggauuuggcaaagauuuuguuuuucauuuccagucuuuuaaaguagacagcugauuuucagagcacauaagauuuaaauacaaacaagagaauucagcagagugauaaaggugccugcaacaaaacugaccacccaagguaaugguggacagcaaggcgagaauccucauccugcaaagcaggacgagggggaacugcaaagugggguucguggguaaccuuagcuucuacuugcuacucaguucacaaaguuagaggccuuuacagauaacccgcacgcacccuuuaauuuucugcuauguaauaggauuauaaggccacaauauuccuuuggggaaaacccuuuaaugauuuuaauaucacuuacuuguucuuuugaaguguaaagugucuuaacuggauuaugauuacagaucaguuuuaaauacaccauugcuacuauauuaaaauuauuuauacuauuuauaucuaauauucaaagaaauuuacuauuuauaucuaauauucaaagaaauuuacuaguaaaugcuacaauaggcaucagucugacaugcuuauuaauugaucccauagguauaauuauaggucaugacaagagucuauucugucucacuaaaucaggaacaccgcauuuacagaacaaauuaacacacauagugcaaacacccaaggaccaugcuagcucuucaauuagcugucacagcucagacaugaauccucacugugugaacagaagucagauccaaaucuucaucagaaggugcuaguggaaguugucagacgccuuccaauguagauccuagacagaaaagggauggcagccaaucaggucucacaauucucaggugacuuuacaaagcucaaaggggccaggccaccaugguuacagcuuuuggaagggaacuggccaccuuauacuugauaaaguaugacuguaaucuucucuuuuuuaugauuuuuauuuuauuucuaugugcauugguguuuugccuacauguaugucugugugaggguaucagauccucuugaacuggaguuauacaguuauaaauugccaugugggugcugggaauuaaacccaaguccuccacaagagcaagcagugcuccuaaccacugagccaucuuuccagcacaacugucuacaaucuuuaacaaguguucuuagucaucuaauauguauuucauauuggucuaauuuuucuuacuuaaaauuuaaauucaguuguuucaaacauucuaauaaaacuuacuaauauauuaacaacagaaguugaaacucaguaccugucuaccauguacaaggucccagguucaaauauaaguucaaaccaaacccauauucuaucaccauacagcuuugcauucccuucuguguugucaaauguugucaccacacagcugcaggcaggcuggcuucauauccaguuaguucauuaccucuaaccucaaagcccaaccaaggaauacguaaugaagccucccuuuucugcacucagugaggugggaacugacgaucucaggaaaggagacaggagagaauccuaccuggccaggucuguguggacugggaagaaauaagacugggcagugagcuaucuggacuaaagaggguagcauucaugaaagaauggaaguugccaagagaucuugggugggauggcaucaaguucugagccugggaaggaugaaggacagaagugguagauaggccuauauccagcaaggauucccugaagggaaaacucagcuuguacugaacacagguuccuggcccuguccacagguuucccuuugcugguucuguucuguuuuguuuuuugagaccaggucuccacacguaacccuggcuggccuguaauucagagauuccccuaccuauguuccccaacggccacugaacccuguugcuugcuaguucugagaaaaggguuccaaaccgggcgugguggcgcacgccuuuaaucccagcacucgggaggcagaggcaggcggauuucugaguucgaggccagccuggucuacaaagugaguuccaggacagccagggcuacacagagaaacccugucaagaaagaaagagagagagagaaagagagagagagagaaagagagaaaaagagagagaaagagagagaaagagagagaaggagagagagagagagagaaagagagaaagagagagagaaagagagaaagagagaaagagaaagagagaaagagaaagagaaaaagaaagaaagaaagaaagaaagagagagagagagagagagagagagagagaaagcaagcaagcaaaggguuccaggugauggggaugcaccuguccaugagaccaagugccaggagagaagugguacaggcagguagggcugcaacccaguaagcuaagaggggcguccggcacccaggcagcucuauagggacacugagggucugcagugcaggaaguuaagggcagggaaaacugggauguaccuaugaaacccacaacaucccaagaaauuaaacacgaaacagacugggcauccgccacaugaacagcuuuuggggaaaagaauaugcagacuacagagccucuucugccccaaacauacccccaacuaacacagaccagaagccuacagaggcaucccagccauuccaauagacugcagucacccaacacugucuucauauagagggugagcuuaccccagcguggacggaggguauggauuggcuuaaagaagagaaagggcugggaauuuagcucagcugguagagugcgggaccaugagauuauguaucccugggugggcagcaucuguaaucucagcacucgggagguagacacaggaagaucugaaacccaaucucaucccugcgaggccagcacagaauauacgagucccuuugaugaccugcucuuuagcacuagucccaucuaaagaauccauagcuauacucccuggucuguuucagucuaaacuagauacaaaagcagaaaccuaaaggcggcacagaggcccggcaugagaacccugcgcaaggcaugguggguaaaggcaccuuccacuacacgggauuuuuacuugacuugggaauaaguuugugaaaaugcaccggccuaaaaucaucucucucuccauacaauguagaaauaacuugcuggggccuagacucacccaggucuacccugucacaggguguccacgcucucauagaaacaucacuuaccccaagccaauggccagcagaugagacaguaacagagauggaaggaaaaccuucagaaagucugcugagaaaauucccccuuucuucauaacgcuuguguuucucaugcugagaguagcugugcgcuucggguguuuaaaaaggaacucccuaagguagaaagaaacugccaaucaguguccccuuguuaaaggaaaaaccuugacuaagaauagugaaaacggacuuacuuggggggaauauuuucuggucgacuugaccaaucccauauccaaucugaguuuuucuucaggauacuuucaacuucucuucuucucucaauauaaucuuccucagacuaaggaaaaguaaauauuaaauaaaguaggugagcuuuccacagucacaugaaagacaaagucaguaagcucaacagagaaccccaccugacaugguauuaacuaucccacaacuucaaaugcauuacaaauuaagacauuuaggugguaauguccccucagagauauucuuuuaauaucucaaaauaaaauaugauaaccacugauauucucuuaacugauguuccguuacauggguaauggaaacacaaaucuguauguauaaacacauuuaacaaaacgcaacagaaacacugcacaauuacaauccucauuuguacaccgggucacaugacccuagcagcugauauuuauagcuaccuccucuacuacccauucuguauauauuuccuccacuuucagcaagcacugagggcagugacccacaccuucacuccugaacggucugugcacuuugucauccuaccuagauuagacuguuuggaguuucccacuaucuuuaaucacaggacaugguagcaccaagagacacccuaaaggaucuccugaacccagacagacauaaucuuucucaccuccauuguggagaagcaauccaauuuccccuugguaaucuggaucaaucacccuccuaaaacugucauuccuuucuuagccuguucauuuaagggcacccgaaacucagcuuccaguccaauggaaugguuguuuugacaccuggcauaaguucccccacccccaacacucacacacacacacacacacacacacacacacacacacacacacaccuaggcaaguagaaaaaggucauaggaacagaaugcaaauaaauuccuagugggucacuaggggugauuguuguaacuacuccuuuuucuaccccucgauucuugaacccauggauucugguuaugagagaaacuauaccauauauuggaugcugauuuaaaaaguauaccauugccgggcagugguggagcacgccuuuaaucccagcacuugggaggcagaggcagguggauuucugaguucaaggccagccuggucuacagaguaaguuccaggacagccagagcuacacagagaaauccugucucgaaaaacaaaacaaacaaacaaacaaaauauauaccauuguuagggauccauggguucaaggaauagaaaccaugggcauuuggccauguaacuugcuugugccuucgggaccuacuuggaccugaucagauauauagauagcccuuucacuugauaguggauuguugcuguacacaaucacuuggugggccauauaacauuccacucaugauaggcagcucgggucacaugguaacuugguggcccauugucaaauguucaguuuccacuaaggcccaauaccagaccucauuugaagggaucuuaaucaucuaucucuucuacaaaauaguacacugauucccucuauugaugacauuaugcugguuggaugaagugagaaguggguaggaacuaacuacuuuggacuuguaacacauaugugcacagagaauagaaauaauucaagggcuuucuaccucagugaaguguaagucuggugguaugaggcauuugagauauuccuucuaagaugaaacugcaccaagaaagaacacaauguuuagcaggccuaucuauuagaauucuggaaauggcacauucuucucuuggguauaugauuaacccagcccaacuuugaauggaggcugcagcacaagguucuucaacggauccaggcugcucuacgacuuggacaauaaauaugauccagaagaccagugguacuugagguaucagugcccaguagggaugcuguuggagcccuggauggaucccuaucagugcccaauagggaugcuguuggagcccuggaugggucccuauagauaaaucacagaauggcccccauacacuuagagguuucuauacuuaggaaugccacuccuuggggggauuaggagguguggccuuguuggaggaggugucucacuggcuguauggguuaagagguuucaaaagcccaaaccaagcucuuccucuuccugcugccuacaaauccagacauagaacuuucagugacuuccccaguaccacgugucugccauguuuccuaccaugaugagaauggacuaaaccucugaaacuauaaacaaguuucaauuaaauauuuucuuuaagaguuacuauggucauggugucucuucacagcaauagaacacugacuaagacaggcccugaucucacaacaaugcuaaaggugcucuuuaguuucuacugaguuaauauuagaaaagugagcucauggacugggguacagcucaguuuacagaaugcuugcccagaauccugggcucuagccccacacucacuacauaagccaggcauaguuguacguauuuguaaccaccuuagcacuaggcaaaguagauuccucaauuaauuaauuucuacaagauauuuuuuuaaaugagcugucuggggcuggagagauggcccagggguuaagaguacuugcugcucuuucagagaacccaaauuaguucccauaacccagaccuguugguggacugcugcccguuaauucuaauuccagugccuuuggcuucuggacaccaagacucaugugcacauagcauacagacagacagacacacaauuuaaauuuuuagaaauucuauuaagggaaagugguggaugggacgauggcucaguaaauaaaaugcuugcugcacgagcauuaggacccucaguucauuaggacccccaauaccaguggacaaguuggugcacaucauuaaucacagcacucaggggacagaggcaggaggcuuucugugaguuuaagaccagccuggucuauauagcaaauuccaggcuagacagagugaauagggaauucccugucuuaaaaaaaaaaaaaaugggguuuaaaaugccuccauacauauggcauucucucaaacaaacacacacauaaacauaaauaaaaacuuuaaaaaccacagauccaacacucauguaaaaugccaggcacagugaguggugaguuccauaaccccaggccuggagcagaggcaggaggaucacuggagcucacuagccagcugaucuacacacaaugguaagcuccauguucaaugagauacccuuccucaaaaacuaagagaacaaagacucgcauauguugcaagucuaggagucaguuaccggacucaugauaugcugaaucuuauagcauguuccuaucuauggcuuaccagagugcuguuuuucucgccaaagcuguggcugucuauuucagcucuguugguaucuuguggugucugggagcgaggugggcuugauuaagaaacggauaaaacggagcagcaugucaauugugucauaagcagcauaaauuccaaggggcucuuaccucauuaagggggugguagagacucuccaaagcaugucucuucccuuuugccuaucaccagaccagugccaaacaauuccucagucuucugagcugaucacauaggagccagcuagacagucccuagggaagccccacccuccugcaugaucgguagcauaacccuugcaagcaucugaccuuugaccacugacucucagccacacaccuuggauuugcucccuaguagugcugccuaggaaccgaagccagcuggggacaugaacaaaacugcucagacuugguguucucagugaacagcuucaaaaagggggcagacuuuuguuauuugucucuagguuuaauauagucccucuagacuugagccccagaucacuuccucucagcagacuccagaguuccuuguauaauggaguuacucccaaauguggccucagaccuggcaacccacccacaaaaacaugcacaauugugauuauccaucuacuaggaacaucaacacuguaggagauacccagaaaacauaccugucacagugagaacucuuggagcuacuucguccagauucaugcugggcauccaacaguauuuuuuccaugucaccauuauaaauagagacggaggcuggaacgcugcucccauugccauugcugaagugcaguucuacccaggagccugagagaacaaaaagggcaguuagcaaucugaccacuuguggggcuugaugacuuaaucccagcacucuggguucaaggcuaggcaggacuacacaauaaguacuuguuccaaucaaucacucaaugaauaaacaaacaaagauauagacagacagacagacagacagacccgcccauucacauucccaggaaauaccaaacacaugcauuucugguccucuggccucucucagguuccugaggcugaaaacacuguacucuacgucuggccauuccuuuauuccaugcaguuauucuacaaaucugugauuuaccagaggccaagauggggauccuguuuaaguuggcauaaaaauggaggcccagccccugccucggccucgaccuccugggugcuaggcuuacaaucaugggcuaagauaaggcucgaucuuagugaugcagaggaugaagacuuuuuagaaucaccucuuuccuggaggugcuaaccuaacacauucagguuauuccugaguggccaaaauauuuuccagcaaggcuauaguuaugauaauggaggcuacugaggagcuuccuguccuguuagcagagagaacuuacuaacguguacaaacacuaagucagagaaacugcccuugaacuucacugcagguacaagacagagcagaauguuccagaauuuuccugcugaguuauugaauucauuagcacuggaaaaucugacugcaggcuggagagauggcucagugguuaagaguaccggcugcucuuccgaagguccugaguucaaaucccaaaaagaaagaaaaaaaagccgggcgugguggcgcccucgcgccuuuaaucccagcacucgggaggcagaggcaggaggauuucugaguucgaggccagccuggucuacaaagugaguuccaggacagccaacgcugcccagagaaauccugucucgaaaaaaaaaaaaaaaagagagaagagaagagaaaaggaaagaagaaaaaagaagaggagagaaaagaaaagaaaaucugacugcaaauuuucacaaacagagucucucugaagaacuuuacagaaaaugaaaaguuaaagaaguuuuucagugucuuaacaaccaaugcagauggcaauacugaguucauuucagccguggaaggauuuaaguauccaguguaugcuguccaguggcuuccugagaaagcgcccuuagaguggcagaagcugcaugcuauuucucaugcaccaacugcuaggaagacuucaacucuacucugcagacuguuuucuugcugaagcucgggaaggcagucaccacuuugagaacacacuggaggagacugaacccuuaccuaccaguucugucucguuuacacugcagauauuucuucauuucagcaaucuuuuuuuuuaaacauuuauuuauuauguguaaauacacuguagcugucuucagacacuccagaagagggcgucagaucucauuacagaugguugcgagccaccaugugguugcugggaucugaacucaggaccucuggaagagcagucagugcucuuaccugcugagccaucucgccaagccccauuucagcaaucuuacauguuugacugaaagucuucaauaugguauaauucugugacugaauugcuaacacugcucagggcaguaugagaaagccacacagaugucuuugcugugugccugguucugauucauggcuuaauacaugauuauuuuuuaucagauuugauaaccugacagugagaaagauuagaaauaucaugguguuuuucaugaaaauuccuucuaugucugaagauucuaagauauaaaaaauauaaaaaaaugaacucucaguguacacuuugguucucuaacaccacaauaauaaaugaacucuugguacuguuccaucuauggcuugcuuucaguuuggucugcugaaugcaucuacuaggauaguaaagggcuggugcuauagaucaguggaaguaugcuugccuuauaaaaucauaaggcucuagguucaagccccaacacugccaaauguuuguguguauacauguguaguuuucaacagggcaugguaguacacacccguaaucccaguuauuuaggaggcugaggcaggaggacuaccaagcuggaggucaguuugugcuaacuuguaauaguugaguucucucuuuccaucauuggguccuggggauugaacucagguugccaggcuuggcagcaagccccucccaucucaauggcccuucccaucucaauggccccucccaucucaauggccccuggugcuuucuuugccagaguaagaguguguaugggccucauucugggcccaagauuacuuuucuauuuugacucacgggcccauuugccuguagaaaauccuuuugagcuaaccuguucuacacaucaaauugaagggcagccaggacuacaaagagaaucccuaacaaagaaaugaaauaacugguauuacacagaacagaaagagggagaagacaaccacaaaugacuggaaaaaaauguaugugcuggagaagcugaagaaacaaaucuuguggccacuauaacuuuacuaaauacaguaauaaugacugaguuguucugugucccagguaaugugcuacuauuugaugaugcaacuaaugaagaaagggaaccacuccugaucaagucacugggaguuggggacagagcucagaaguagagcuuguaagaggcccuaccuaguucugaucuccaguaccaaaggggagggaagaaaaaggcaaaaagauugcuucaaguucaaggccagcuugggcuacauugagacucuugucuauaaacuaccccgcacacagauccagaaaaggaaaaaggagcugugcaugguggugcacaccuauaauccaguagaggugggaguucuuaagaguucaggaccauuugggugugguagugcacgccuuuaaucccagcacucguggaggcagaggcagguggauuucugaauucuaggccagccuggucuacagaguauauccaggacagccagggcuacacagagaaacccugucuccaaaaaccaagggggaagaguucagggccaucuccagcuacaguucaagggagccugagagcgcccugugcuaugugugaccucccuaaaaccaacaacacccacuuugaaaagccaggaaugauggggcaucccugaaauccuagaauucaggaggcagaacagaacuguugcaaguuugaggccagccugucacacagaucgagcuccuggucagccaaagcuacauagugagucucaaaagcaaaacacguacauauucucuagaagcaggagcagccacacugcuuuccagagcacuacaaauaaaccugcccucaacuguguacucaaugcagaaugugccacauuaaucagacaaaaaaacaaaaaagcccagaaaucaauuguggauuuaucguuuaugccaccaacaguuucucaguaagauaacaugauuauacaacacaaacuuugaaauaaacaugauuuuccucauuauccucucagauugccucauagagaaagaagcaggccuaguccacaugaaacacaucaccaacucagaagggcagaguccagagccccucugcuguugcauacaggccccagugcccucccucugugaucugcaaauccagccucaugucuuuugcuggaccuccucccuucacugucugcuaacacccagaagccaggaauagugccucacaccuagaaucccugcguuccaagucacuaaggcgggaauguugcucugaguucaagucaagccugggcaacagugugagcuccuaaaccucaccuacuaaauaguacagagcucagcuaugggcaguucccuuugucuaggccaaucuuguauucagaucugagccugucccaauuuaugugaugaagcuuaaugcuacccauaucuuuucuggugucuuacacaaacaguuugaggucauguuuucuucuucccaguaccgcguccugaugccaaauguagaguuuuuccuacacuaacuaccaauuuuccaaaaucaaccaggggaguccaagaauucaauauucccacaauaccuccuaagacucguaccaaaucccauaaauucaaggcugaaacccucaaggaugcugcacaucacacaccagccacaagcagaacacacagacuauccacacuucagcuccguuacaaacuuaaacacaaaaacaagaaagaaaagcucgucucugauuuaaugcugugcugaaguucagaacucaagaaaacauguggcuuaaguuucuaauacagaagaaaacauguugcuuaaguuucuaauacagaagaaaacguguugcuuaaguuucuaauacaguucagaagcaaccacauggaagcacacaccaagggcagagaauaccaccuuccuguugccaacuccaaaaccccgcaaacauucugcucaaagcuggcuauggugacauuuucuuuuauucuuaauagcuuaaccuccaaaucccuccucucccugguauccuaagugucuacccucugacaacuuauuaguuaccaaacucuagccugaggcuauucugggucucaaauaauucaucucauucuugagggcuccuuauaaaguugaccugaauaacaggauaaaacuccuagcuaagagauuugauuuguuucaucuauacauacacacaccccaucacuuccuagcacuugggaguaccaggauuuuagacacuguaguguauaaaguaagacguaucucaauaaauaaauagauagauagauagauagagauagauaaauagauaaauaaauaaauaaaucggacacucaggaagucccacaacuuugagagcuuguauaaggaacuaagucaacagauagauguuuguacucauugcacaaggagcaaccaaaaauggagggagccaacuaucuguacugaucugcacugcuguaacaguaagccacgagcugggugauuuauaaaguauuucucgcacuuguggaagcugacaaacccaaacucuaugcugucuguaaggaagccaguucccuucaucagaagcuucaccugggcucaucacagugcagcagggcccuggcucugcuuuucucauaugggcagcauucauaucauagcaguacuuucaaaaaccaucaggaaauccuggcagugguggcgcacacucgggaggcagaguuacacagaacucugauucagaggccagccuaaucaaguuccaggaaaagcuacccagagaaacccugucucugggggaguagagggcacagaucuguagcaaauaucugcaaaaggccccagcgccuuagaggcggggaaacaaucccauuuggaaugaucuggugcagaacccuugaguccaaacgcuccaggaaugauuuacuagggaaaaaguuuuaucauuaaccugugucuggacaggaacuguaaguccuagaaaacggagaagacuucauuuacauacauccugcagucauucagcagcagcuuccaucguuuuaaacaagcaagaaaggugugaaugugaacuuacaacccuaauagaacauuuagaaguugaaggcgaguuuaaggccagccugggcuacagagugaguuccaggacaaccagagcuauacagagaaacccugucucgggaaaccaccaaaaauaauaauaauaauaauaauaauaauaaauaaaaauauaaaaauaaauuguuuuuaauguuuuuaaaggaaaaaaaaacuuaacaucaaggaaucuccucagucaacacacaauuuauuucauguaauuuaauacauuuaggcuucaagacagcaagcagugccccauuuguuuuccuguccacucucccacuucugaguuacaccaacaagauacacaucaaguccuauauacaucuccugaguguagaaugucugggaacugaacucagguccccuaggaagcagaaugcgcucucauguguagcaguguuuucccugcaguauaugcuguguaccauguaaguggcgcccaguuagacagaagaguguauuagaguguauuagaacuuacagucguaaacaaguguucuuaacugcugagccaucccucuaauccuucauuuggcuucggagacagaaucucacuccauaagccagguuggccauugugcuaguugguuuugucaacuuaacacaauuuagaaacaacugagaaaagagggcuuucuggaguauuugauuugaacuuucaaagacuggcucucuccuucuaccauguggguuucuagggaccaaacucagaucaacagguuuggcagcaagaaccuuugcccgcuuagcuaucuugccaagccuauuggaagugagucuuacugaggaacuaguuagaugaggcuggccuauggguuuauccauaggaacacgaucuugacuguuaguugauauaggaagauccagccccguguaggcaugcuuauuuauggcugagguuuauagaaucacauaaauggugagcuggcgcaugucugucauucuagugcucuagauggugagaaaagaaucaaaguuuaaagucauccuuggcuacuuacuagguuaaaaagucuagcuuaggauauauaaaaccaccucaaaaauuguuuuaacuaaaaaaaagguuaucuuuuuaaaaaagauuuauuuauuuauuuauuuauuuauuuauuuauuauauguaaguacacuguagcugucuucagacaccagaagagggcaccagaucucauuacagaugguugugagccaccaugugguugcugggaauugaacucaggaccauuggaagagcaagcagucaguacucuuaacugcugagccaucucuccagcccaaaaaaagcuuaucuuuaccucagucagacucuggaguacagagauuagaggacugcucuaccauucugcuuuccaaacugcuuauagaaugacaacccugggagugagucccuucucuguauuacccucuauaucccaaggcaaacguguagacugucaaugccuaacaauaacuauacccaaaagagccccaugcagagaaacacagggucccuauucucauguccacgucucaaucauggcuauggaaggagaaucaccuucguugucuuucccauaguuuuccagaagcugaggccaacuugaaaacagaguuagagagccaagcaaauaugcugauaagcucaagcagggacagcacccagccagagcuagcuagcaguccucagaagggagcaggcacccacacaaccuccacacaggaacauaaugccacaggagaacgaugcuauagcauucccagaaagccaagcaagggggcaccaagucugggggaagcacugccccaaaccacacaggacuucuccagaagcagccauugcugucuccacaccuaaacagccccuuggguuaacuuaggaaguuggcaaaugguuccgaacugaaucugccuaguacauaaccuagacuacuggcuuccuuuucagucacauacacaaaugugcauuuuauuggaagugucucaugcaggcugguguuaaacuccugaucuuccugccuccaucucccaaacacuaggaucagaggcuugcaucaucucuguaccuacuggauucuaagacgagugaacuuaucucucugccuauugcuaggcugugccugucugauacauccugagucagguggcuccagguaccccucuggugcugagcagucugugccagguccuuaacugaaguagccauccuuaguuccacuuaaccucuggaucucacuaggacuauuuacagaggcuagagccaaggagaaaccccuucaguguauccauguuuucucuucaugcaagucuguccuugauaguuugccuauaaccaacagaaccacucaucagaaccaguugcagacagggcagcuagcuaagugaagacuuauuaaaucuauacaguggaccuuucaggaaagggcagcaaccaaggcacagaaauaucacaauacuuaucucuccuccagcaugccagaagucauacagaaaagcccugcuccuaaacaccuuucaauaagauggagcagagguaaaaagggaacagaaccaaucaguguuguggguaacgccuucaguaacgcuggucccagagguugcuauggggaauauuugcugucccaccuaccaacaaggcuuccacagcucucagccucagaaguaaacacgaagcggcaaacagaggagcugccucagcucugacuccaagcugggauucacauuucauagggcagcugagauaacccaugugacuaagugaccccuccuacccugagcuagacagugagccagugcugagcugcacguacaccccaaacaauggcccaaauccuuagccugaguuuccacaccguaaccaucuuuuuauagaauaaguaaaagagaaaaacacaaaaccuuaacccuugaaacgucuaaugacaacccccuucugccaaugacucagcagucuggcgugcaugucagcugaguguauguuaaccgagaccucucaggaauacucagaaacuccccuagaugaagucuuaacagcauagugucagaaaucaaauuucaacuagcuacgaaagugacuuuacacaaaacaucacuugaucucuuaagagaaaagacaaaaaaacuucucaaucaaaaaauuccaacuguuugacguuugacauuagggaauaaaaccugaauuacgagauuuuuuuuuuaauguggcuguaguuugaaaauacagauucuguaauguguuaggcugauuaaauucugccuacuaaaaucucguuuaggguaauaaauucagcuaacucagugucucugaaugcaagcuuuuuaaaaacucuuuuaacacaacacugcucugaguuacccuauuccaguacuccaggacacagaaucucuggacagcauagucuacacaaguucuaggacagccagagcuauacagagaaaccacgucuucacacuaaaguggguacuguggcccacaccuuuaaucccagcacuagggagguggaggcaggcagaucucugggaguucacugagagugagacccugccuggggggggggaggggaguugacacuaaagcauucauuuuaaagguuuggaaagccucucucucacguuuacugacaugcguuuuaccuggugaacucuugcuucagagaguacaaaggucaacaggauccuccuccagucucagggccugagacucaacucagacucaacucaggcccaccagguagcucucagaaauggacaauggcacauagcacccaggcuggccuugcaaaacuagcagcugucugcgcagugcuaacagucuguaaaggcugaugcugggagagccuuucuguuauuugugagacagggucuggcuacagagccccgaacuagccugguacgacuguguaguccaggcuaaccuggaauuugucaagacucaacuucacccaccccaugaugggauuuuaggugugucaccacacccagccucacuuccauuuuaaccuacaaucuacuucacugcuugcagugagccuacugaacuaaauuauaagcacuuuacccuccuuuugagcuguuguagcucucuuccacacuaccuccagccauacccccucucuguuuuucucuuuguagacuuggcuguccugaaauucacucuguagaccagguuggccucgaauuuacagaaaucccccugccucugccuccugauugcugggauaaaagguuugugccaccacugugcggcuaucccaccucuuaacucuaaaaccugacagaggucugaaacccuguauccuccucuuccaucaggaaguggcaacaaagcaagccagggguaaagauugggggagaggggacacagcggcaaagccuguuaauuccaaauuccagcuacucuagaggcugaaccaggaggaucacaaguucaagaccaguaugucuuaaagcaauaaaaugaaaacugguaguguugcucgggaaaugagcacuuacccagcacguucagaucugguucuguccccaguaccaaguaggaaaagugaaaggcacuacagucauaaauauuaaugacuucaaucaaagcacugaaaauucaacugcaaccucuaacucacuuaagcaacucugaacaaggggacgccaagggccugaaaucugagcuacucgggaagcugaggaaggaggaucgcagaguucgaggcuccccugaccuacagagucugaaaauacagaacuaugacagugugaagaacagagcaggaaagaaagacccggccugccugugaagguacugucuguaagaugccccgaggcucaccacccagccccggcugcaccgaacugcaucgcggccuccacucaccgcaccccagcccgcgacccuaccgccuccgcggccccucucggcccacugccucacccugcagguucuccuccccgcucugcgacaugguggcucggcaaaggagcccgaacccaacugcgacaggccugggaggcggucaccgagagguagcaggggcagccugcgccgcucaguucugaggccaggcgacacuggacugagggacaaggggc

SEQ ID NO: 4164 - RNA, 19213 nt, Mus musculus
gccccuugucccucaguccagugucgccuggccucagaacugagcggcgcaggcugccccugcuaccucucggugaccgccucccaggccugucgcaguuggguucgggcuccuuugccgagccaccaugucgcagagcggggaggagaaccugcagggugaggcagugggccgagaggggccgcggaggcgguagggucgcgggcuggggugcggugaguggaggccgcgaugcaguucggugcagccggggcuggguggugagccucggggcaucuuacagacaguaccuucacaggcaggccgggucuuucuuuccugcucuguucuucacacugucauaguucuguauuuucagacucuguaggucaggggagccucgaacucugcgauccuccuuccucagcuucccgaguagcucagauuucaggcccuuggcguccccuuguucagaguugcuuaagugaguuagagguugcaguugaauuuucagugcuuugauugaagucauuaauauuuaugacuguagugccuuucacuuuuccuacuugguacuggggacagaaccagaucugaacgugcuggguaagugcucauuucccgagcaacacuaccaguuuucauuuuauugcuuuaagacauacuggucuugaacuugugauccuccugguucagccucuagaguagcuggaauuuggaauuaacaggcuuugccgcuguguccccucucccccaaucuuuaccccuggcuugcuuuguugccacuuccugauggaagaggaggauacaggguuucagaccucugucagguuuuagaguuaagaggugggauagccgcacagugguggcacaaaccuuuuaucccagcaaucaggaggcagaggcagggggauuucuguaaauucgaggccaaccuggucuacagagugaauuucaggacagccaagucuacaaagagaaaaacagagaggggguauggcuggagguaguguggaagagagcuacaacagcucaaaaggaggguaaagugcuuauaauuuaguucaguaggcucacugcaagcagugaaguagauuguagguuaaaauggaagugaggcuggguguggugacacaccuaaaaucccaucauggggugggugaaguugagucuugacaaauuccagguuagccuggacuacacagucguaccaggcuaguucggggcucuguagccagacccugucucacaaauaacagaaaggcucucccagcaucagccuuuacagacuguuagcacugcgcagacagcugcuaguuuugcaaggccagccugggugcuaugugccauuguccauuucugagagcuaccuggugggccugaguugagucugaguugagucucaggcccugagacuggaggaggauccuguugaccuuuguacucucugaagcaagaguucaccagguaaaacgcaugucaguaaacgugagagagaggcuuuccaaaccuuuaaaaugaaugcuuuagugucaacuccccuccccccccccaggcagggucucacucucagugaacucccagagaucugccugccuccaccucccuagugcugggauuaaaggugugggccacaguacccacuuuagugugaagacgugguuucucuguauagcucuggcuguccuagaacuuguguagacuaugcuguccagagauucuguguccuggaguacuggaauaggguaacucagagcaguguuguguuaaaagaguuuuuaaaaagcuugcauucagagacacugaguuagcugaauuuauuacccuaaacgagauuuuaguaggcagaauuuaaucagccuaacacauuacagaaucuguauuuucaaacuacagccacauuaaaaaaaaaaucucguaauucagguuuuauucccuaaugucaaacgucaaacaguuggaauuuuuugauugagaaguuuuuuugucuuuucucuuaagagaucaagugauguuuuguguaaagucacuuucguagcuaguugaaauuugauuucugacacuaugcuguuaagacuucaucuaggggaguuucugaguauuccugagaggucucgguuaacauacacucagcugacaugcacgccagacugcugagucauuggcagaaggggguugucauuagacguuucaaggguuaagguuuuguguuuuucucuuuuacuuauucuauaaaaagaugguuacgguguggaaacucaggcuaaggauuugggccauuguuugggguguacgugcagcucagcacuggcucacugucuagcucaggguaggaggggucacuuagucacauggguuaucucagcugcccuaugaaaugugaaucccagcuuggagucagagcugaggcagcuccucuguuugccgcuucguguuuacuucugaggcugagagcuguggaagccuuguugguaggugggacagcaaauauuccccauagcaaccucugggaccagcguuacugaaggcguuacccacaacacugauugguucuguucccuuuuuaccucugcuccaucuuauugaaagguguuuaggagcagggcuuuucuguaugacuucuggcaugcuggaggagagauaaguauugugauauuucugugccuugguugcugcccuuuccugaaagguccacuguauagauuuaauaagucuucacuuagcuagcugcccugucugcaacugguucugaugagugguucuguugguuauaggcaaacuaucaaggacagacuugcaugaagagaaaacauggauacacugaagggguuucuccuuggcucuagccucuguaaauaguccuagugagauccagagguuaaguggaacuaaggauggcuacuucaguuaaggaccuggcacagacugcucagcaccagagggguaccuggagccaccugacucaggauguaucagacaggcacagccuagcaauaggcagagagauaaguucacucgucuuagaauccaguagguacagagaugaugcaagccucugauccuaguguuugggagauggaggcaggaagaucaggaguuuaacaccagccugcaugagacacuuccaauaaaaugcacauuuguguaugugacugaaaaggaagccaguagucuagguuauguacuaggcagauucaguucggaaccauuugccaacuuccuaaguuaacccaaggggcuguuuagguguggagacagcaauggcugcuucuggagaaguccugugugguuuggggcagugcuucccccagacuuggugcccccuugcuuggcuuucugggaaugcuauagcaucguucuccuguggcauuauguuccuguguggagguugugugggugccugcucccuucugaggacugcuagcuagcucuggcugggugcugucccugcuugagcuuaucagcauauuugcuuggcucucuaacucuguuuucaaguuggccucagcuucuggaaaacuaugggaaagacaacgaaggugauucuccuuccauagccaugauugagacguggacaugagaauagggacccuguguuucucugcauggggcucuuuuggguauaguuauuguuaggcauugacagucuacacguuugccuugggauauagaggguaauacagagaagggacucacucccaggguugucauucuauaagcaguuuggaaagcagaaugguagagcaguccucuaaucucuguacuccagagucugacugagguaaagauaagcuuuuuuugggcuggagagauggcucagcaguuaagaguacugacugcuugcucuuccaaugguccugaguucaauucccagcaaccacaugguggcucacaaccaucuguaaugagaucuggugcccucuucuggugucugaagacagcuacaguguacuuacauauaauaaauaaauaaauaaauaaauaaauaaauaaaucuuuuuuaaaaagauaaccuuuuuuuuaguuaaaacaauuuuugaggugguuuuauauauccuaagcuagacuuuuuaaccuaguaaguagccaaggaugacuuuaaacuuugauucuuuucucaccaucuagagcacuagaaugacagacaugcgccagcucaccauuuaugugauucuauaaaccucagccauaaauaagcaugccuacacggggcuggaucuuccuauaucaacuaacagucaagaucguguuccuauggauaaacccauaggccagccucaucuaacuaguuccucaguaagacucacuuccaauaggcuuggcaagauagcuaagcgggcaaagguucuugcugccaaaccuguugaucugaguuuggucccuagaaacccacaugguagaaggagagagccagucuuugaaaguucaaaucaaauacuccagaaagcccucuuuucucaguuguuucuaaauuguguuaaguugacaaaaccaacuagcacaauggccaaccuggcuuauggagugagauucugucuccgaagccaaaugaaggauuagagggauggcucagcaguuaagaacacuuguuuacgacuguaaguucuaauacacucuaauacacucuucugucuaacugggcgccacuuacaugguacacagcauauacugcagggaaaacacugcuacacaugagagcgcauucugcuuccuaggggaccugaguucaguucccagacauucuacacucaggagauguauauaggacuugauguguaucuuguugguguaacucagaagugggagaguggacaggaaaacaaauggggcacugcuugcugucuugaagccuaaauguauuaaauuacaugaaauaaauuguguguugacugaggagauuccuugauguuaaguuuuuuuuuccuuuaaaaacauuaaaaacaauuuauuuuuauauuuuuauuuauuauuauuauuauuauuauuauuauuuuuggugguuucccgagacaggguuucucuguauagcucugguuguccuggaacucacucuguagcccaggcuggccuuaaacucgccuucaacuucuaaauguucuauuaggguuguaaguucacauucacaccuuucuugcuuguuuaaaacgauggaagcugcugcugaaugacugcaggauguauguaaaugaagucuucuccguuuucuaggacuuacaguuccuguccagacacagguuaaugauaaaacuuuuucccuaguaaaucauuccuggagcguuuggacucaaggguucugcaccagaucauuccaaaugggauuguuuccccgccucuaaggcgcuggggccuuuugcagauauuugcuacagaucugugcccucuacucccccagagacaggguuucucuggguagcuuuuccuggaacuugauuaggcuggccucugaaucagaguucuguguaacucugccucccgagugugcgccaccacugccaggauuuccugaugguuuuugaaaguacugcuaugauaugaaugcugcccauaugagaaaagcagagccagggcccugcugcacugugaugagcccaggugaagcuucugaugaagggaacuggcuuccuuacagacagcauagaguuuggguuugucagcuuccacaagugcgagaaauacuuuauaaaucacccagcucguggcuuacuguuacagcagugcagaucaguacagauaguuggcucccuccauuuuugguugcuccuugugcaaugaguacaaacaucuaucuguugacuuaguuccuuauacaagcucucaaaguugugggacuuccugaguguccgauuuauuuauuuauuuaucuauuuaucuaucucuaucuaucuaucuaucuauuuauuuauugagauacgucuuacuuuauacacuacagugucuaaaauccugguacucccaagugcuaggaagugaugggguguguguauguauagaugaaacaaaucaaaucucuuagcuaggaguuuuauccuguuauucaggucaacuuuauaaggagcccucaagaaugagaugaauuauuugagacccagaauagccucaggcuagaguuugguaacuaauaaguugucagaggguagacacuuaggauaccagggagaggagggauuuggagguuaagcuauuaagaauaaaagaaaaugucaccauagccagcuuugagcagaauguuugcgggguuuuggaguuggcaacaggaaggugguauucucugcccuuggugugugcuuccaugugguugcuucugaacuguauuagaaacuuaagcaacacguuuucuucuguauuagaaacuuaagcaacauguuuucuucuguauuagaaacuuaagccacauguuuucuugaguucugaacuucagcacagcauuaaaucagagacgagcuuuucuuucuuguuuuuguguuuaaguuuguaacggagcugaaguguggauagucuguguguucugcuuguggcuggugugugaugugcagcauccuugaggguuucagccuugaauuuaugggauuugguacgagucuuaggagguauugugggaauauugaauucuuggacuccccugguugauuuuggaaaauugguaguuaguguaggaaaaacucuacauuuggcaucaggacgcgguacugggaagaagaaaacaugaccucaaacuguuuguguaagacaccagaaaagauauggguagcauuaagcuucaucacauaaauugggacaggcucagaucugaauacaagauuggccuagacaaagggaacugcccauagcugagcucuguacuauuuaguaggugagguuuaggagcucacacuguugcccaggcuugacuugaacucagagcaacauucccgccuuagugacuuggaacgcagggauucuaggugugaggcacuauuccuggcuucuggguguuagcagacagugaagggaggagguccagcaaaagacaugaggcuggauuugcagaucacagagggagggcacuggggccuguaugcaacagcagaggggcucuggacucugcccuucugaguuggugauguguuucauguggacuaggccugcuucuuucucuaugaggcaaucugagaggauaaugaggaaaaucauguuuauuucaaaguuuguguuguauaaucauguuaucuuacugagaaacuguugguggcauaaacgauaaauccacaauugauuucugggcuuuuuuguuuuuuugucugauuaauguggcacauucugcauugaguacacaguugagggcagguuuauuuguagugcucuggaaagcaguguggcugcuccugcuucuagagaauauguacguguuuugcuuuugagacucacuauguagcuuuggcugaccaggagcucgaucugugugacaggcuggccucaaacuugcaacaguucuguucugccuccugaauucuaggauuucagggaugccccaucauuccuggcuuuucaaaguggguguuguugguuuuagggaggucacacauagcacagggcgcucucaggcucccuugaacuguagcuggagauggcccugaacucuucccccuugguuuuuggagacaggguuucucuguguagcccuggcuguccuggauauacucuguagaccaggcuggccuagaauucagaaauccaccugccucugccuccacgagugcugggauuaaaggcgugcacuaccacacccaaaugguccugaacucuuaagaacucccaccucuacuggauuauaggugugcaccaccaugcacagcuccuuuuuccuuuucuggaucugugugcgggguaguuuauagacaagagucucaauguagcccaagcuggccuugaacuugaagcaaucuuuuugccuuuuucuucccuccccuuugguacuggagaucagaacuagguagggccucuuacaagcucuacuucugagcucuguccccaacucccagugacuugaucaggagugguucccuuucuucauuaguugcaucaucaaauaguagcacauuaccugggacacagaacaacucagucauuauuacuguauuuaguaaaguuauaguggccacaagauuuguuucuucagcuucuccagcacauacauuuuuuuccagucauuugugguugucuucucccucuuucuguucuguguaauaccaguuauuucauuucuuuguuagggauucucuuuguaguccuggcugcccuucaauuugauguguagaacagguuagcucaaaaggauuuucuacaggcaaaugggcccgugagucaaaauagaaaaguaaucuugggcccagaaugaggcccauacacacucuuacucuggcaaagaaagcaccaggggccauugagaugggaggggccauugagaugggaagggccauugagaugggaggggcuugcugccaagccuggcaaccugaguucaauccccaggacccaaugauggaaagagagaacucaacuauuacaaguuagcacaaacugaccuccagcuugguaguccuccugccucagccuccuaaauaacugggauuacggguguguacuaccaugcccuguugaaaacuacacauguauacacacaaacauuuggcaguguuggggcuugaaccuagagccuuaugauuuuauaaggcaagcauacuuccacugaucuauagcaccagcccuuuacuauccuaguagaugcauucagcagaccaaacugaaagcaagccauagauggaacaguaccaagaguucauuuauuauugugguguuagagaaccaaaguguacacugagaguucauuuuuuuauauuuuuuauaucuuagaaucuucagacauagaaggaauuuucaugaaaaacaccaugauauuucuaaucuuucucacugucagguuaucaaaucugauaaaaaauaaucauguauuaagccaugaaucagaaccaggcacacagcaaagacaucuguguggcuuucucauacugcccugagcaguguuagcaauucagucacagaauuauaccauauugaagacuuucagucaaacauguaagauugcugaaauggggcuuggcgagauggcucagcagguaagagcacugacugcucuuccagagguccugaguucagaucccagcaaccacaugguggcucgcaaccaucuguaaugagaucugacgcccucuucuggagugucugaagacagcuacaguguauuuacacauaauaaauaaauguuuaaaaaaaaagauugcugaaaugaagaaauaucugcaguguaaacgagacagaacugguagguaaggguucagucuccuccaguguguucucaaaguggugacugccuucccgagcuucagcaagaaaacagucugcagaguagaguugaagucuuccuagcaguuggugcaugagaaauagcaugcagcuucugccacucuaagggcgcuuucucaggaagccacuggacagcauacacuggauacuuaaauccuuccacggcugaaaugaacucaguauugccaucugcauugguuguuaagacacugaaaaacuucuuuaacuuuucauuuucuguaaaguucuucagagagacucuguuugugaaaauuugcagucagauuuucuuuucuuuucucuccucuucuuuuuucuucuuuccuuuucucuucucuucucucuuuuuuuuuuuuuuuucgagacaggauuucucugggcagcguuggcuguccuggaacucacuuuguagaccaggcuggccucgaacucagaaauccuccugccucugccucccgagugcugggauuaaaggcgcgagggcgccaccacgcccggcuuuuuuuucuuucuuuuugggauuugaacucaggaccuucggaagagcagccgguacucuuaaccacugagccaucucuccagccugcagucagauuuuccagugcuaaugaauucaauaacucagcaggaaaauucuggaacauucugcucugucuuguaccugcagugaaguucaagggcaguuucucugacuuaguguuuguacacguuaguaaguucucucugcuaacaggacaggaagcuccucaguagccuccauuaucauaacuauagccuugcuggaaaauauuuuggccacucaggaauaaccugaauguguuagguuagcaccuccaggaaagaggugauucuaaaaagucuucauccucugcaucacuaagaucgagccuuaucuuagcccaugauuguaagccuagcacccaggaggucgaggccgaggcaggggcugggccuccauuuuuaugccaacuuaaacaggauccccaucuuggccucugguaaaucacagauuuguagaauaacugcauggaauaaaggaauggccagacguagaguacaguguuuucagccucaggaaccugagagaggccagaggaccagaaaugcauguguuugguauuuccugggaaugugaaugggcgggucugucugucugucugucugucuauaucuuuguuuguuuauucauugagugauugauuggaacaaguacuuauuguguaguccugccuagccuugaacccagagugcugggauuaagucaucaagccccacaaguggucagauugcuaacugcccuuuuuguucucucaggcuccuggguagaacugcacuucagcaauggcaaugggagcagcguuccagccuccgucucuauuuauaauggugacauggaaaaaauacuguuggaugcccagcaugaaucuggacgaaguagcuccaagaguucucacugugacagguauguuuucuggguaucuccuacaguguugauguuccuaguagauggauaaucacaauugugcauguuuuuguggguggguugccaggucugaggccacauuugggaguaacuccauuauacaaggaacucuggagucugcugagaggaagugaucuggggcucaagucuagagggacuauauuaaaccuagagacaaauaacaaaagucugcccccuuuuugaagcuguucacugagaacaccaagucugagcaguuuuguucauguccccagcuggcuucgguuccuaggcagcacuacuagggagcaaauccaagguguguggcugagagucaguggucaaaggucagaugcuugcaaggguuaugcuaccgaucaugcaggaggguggggcuucccuagggacugucuagcuggcuccuaugugaucagcucagaagacugaggaauuguuuggcacuggucuggugauaggcaaaagggaagagacaugcuuuggagagucucuaccacccccuuaaugagguaagagccccuuggaauuuaugcugcuuaugacacaauugacaugcugcuccguuuuauccguuucuuaaucaagcccaccucgcucccagacaccacaagauaccaacagagcugaaauagacagccacagcuuuggcgagaaaaacagcacucugguaagccauagauaggaacaugcuauaagauucagcauaucaugaguccgguaacugacuccuagacuugcaacauaugcgagucuuuguucucuuaguuuuugaggaaggguaucucauugaacauggagcuuaccauuguguguagaucagcuggcuagugagcuccagugauccuccugccucugcuccaggccugggguuauggaacucaccacucacugugccuggcauuuuacaugaguguuggaucugugguuuuuaaaguuuuuauuuauguuuauguguguguuuguuugagagaaugccauauguauggaggcauuuuaaaccccauuuuuuuuuuuuuuaagacagggaauucccuauucacucugucuagccuggaauuugcuauauagaccaggcuggucuuaaacucacagaaagccuccugccucuguccccugagugcugugauuaaugaugugcaccaacuuguccacugguauuggggguccuaaugaacugaggguccuaaugcucgugcagcaagcauuuuauuuacugagccaucgucccauccaccacuuucccuuaauagaauuucuaaaaauuuaaauugugugucugucugucuguaugcuaugugcacaugagucuugguguccagaagccaaaggcacuggaauuagaauuaacgggcagcaguccaccaacaggucuggguuaugggaacuaauuuggguucucugaaagagcagcaaguacucuuaaccccugggccaucucuccagccccagacagcucauuuaaaaaaauaucuuguagaaauuaauuaauugaggaaucuacuuugccuagugcuaaggugguuacaaauacguacaacuaugccuggcuuauguagugaguguggggcuagagcccaggauucugggcaagcauucuguaaacugagcuguaccccaguccaugagcucacuuuucuaauauuaacucaguagaaacuaaagagcaccuuuagcauuguugugagaucagggccugucuuagucaguguucuauugcugugaagagacaccaugaccauaguaacucuuaaagaaaauauuuaauugaaacuuguuuauaguuucagagguuuaguccauucucaucaugguaggaaacauggcagacacgugguacuggggaagucacugaaaguucuaugucuggauuuguaggcagcaggaagaggaagagcuugguuugggcuuuugaaaccucuuaacccauacagccagugagacaccuccuccaacaaggccacaccuccuaauccccccaaggaguggcauuccuaaguauagaaaccucuaaguguaugggggccauucugugauuuaucuauagggacccauccagggcuccaacagcaucccuauugggcacugauagggauccauccagggcuccaacagcaucccuacugggcacugauaccucaaguaccacuggucuucuggaucauauuuauuguccaagucguagagcagccuggauccguugaagaaccuugugcugcagccuccauucaaaguugggcuggguuaaucauauacccaagagaagaaugugccauuuccagaauucuaauagauaggccugcuaaacauuguguucuuucuuggugcaguuucaucuuagaaggaauaucucaaaugccucauaccaccagacuuacacuucacugagguagaaagcccuugaauuauuucuauucucugugcacauauguguuacaaguccaaaguaguuaguuccuacccacuucucacuucauccaaccagcauaaugucaucaauagagggaaucaguguacuauuuuguagaagagauagaugauuaagaucccuucaaaugaggucugguauugggccuuaguggaaacugaacauuugacaaugggccaccaaguuaccaugugacccgagcugccuaucaugaguggaauguuauauggcccaccaagugauuguguacagcaacaauccacuaucaagugaaagggcuaucuauauaucugaucagguccaaguaggucccgaaggcacaagcaaguuacauggccaaaugcccaugguuucuauuccuugaacccauggaucccuaacaaugguauauauuuuguuuguuuguuuguuuuguuuuucgagacaggauuucucuguguagcucuggcuguccuggaacuuacucuguagaccaggcuggccuugaacucagaaauccaccugccucugccucccaagugcugggauuaaaggcgugcuccaccacugcccggcaaugguauacuuuuuaaaucagcauccaauauaugguauaguuucucucauaaccagaauccauggguucaagaaucgagggguagaaaaaggaguaguuacaacaaucaccccuagugacccacuaggaauuuauuugcauucuguuccuaugaccuuuuucuacuugccuaggugugugugugugugugugugugugugugugugugugugugugugaguguugggggugggggaacuuaugccaggugucaaaacaaccauuccauuggacuggaagcugaguuucgggugcccuuaaaugaacaggcuaagaaaggaaugacaguuuuaggagggugauugauccagauuaccaaggggaaauuggauugcuucuccacaauggaggugagaaagauuaugucugucuggguucaggagauccuuuagggugucucuuggugcuaccauguccugugauuaaagauagugggaaacuccaaacagucuaaucuagguaggaugacaaagugcacagaccguucaggagugaaggugugggucacugcccucagugcuugcugaaaguggaggaaauauauacagaauggguaguagaggagguagcuauaaauaucagcugcuagggucaugugacccgguguacaaaugaggauuguaauugugcaguguuucuguugcguuuuguuaaauguguuuauacauacagauuuguguuuccauuacccauguaacggaacaucaguuaagagaauaucagugguuaucauauuuuauuuugagauauuaaaagaauaucucugaggggacauuaccaccuaaaugucuuaauuuguaaugcauuugaaguugugggauaguuaauaccaugucaggugggguucucuguugagcuuacugacuuugucuuucaugugacuguggaaagcucaccuacuuuauuuaauauuuacuuuuccuuagucugaggaagauuauauugagagaagaagagaaguugaaaguauccugaagaaaaacucagauuggauaugggauuggucaagucgaccagaaaauauuccccccaaguaaguccguuuucacuauucuuagucaagguuuuuccuuuaacaaggggacacugauuggcaguuucuuucuaccuuagggaguuccuuuuuaaacacccgaagcgcacagcuacucucagcaugagaaacacaagcguuaugaagaaagggggaauuuucucagcagacuuucugaagguuuuccuuccaucucuguuacugucucaucugcuggccauuggcuugggguaagugauguuucuaugagagcguggacacccugugacaggguagaccugggugagucuaggccccagcaaguuauuucuacauuguauggagagagagaugauuuuaggccggugcauuuucacaaacuuauucccaagucaaguaaaaaucccguguaguggaaggugccuuuacccaccaugccuugcgcaggguucucaugccgggccucugugccgccuuuagguuucugcuuuuguaucuaguuuagacugaaacagaccagggaguauagcuauggauucuuuagaugggacuagugcuaaagagcaggucaucaaagggacucguauauucugugcuggccucgcagggaugagauuggguuucagaucuuccugugucuaccucccgagugcugagauuacagaugcugcccacccagggauacauaaucucauggucccgcacucuaccagcugagcuaaauucccagcccuuucucuucuuuaagccaauccauacccuccguccacgcugggguaagcucacccucuauaugaagacaguguugggugacugcagucuauuggaauggcugggaugccucuguaggcuucuggucuguguuaguuggggguauguuuggggcagaagaggcucuguagucugcauauucuuuuccccaaaagcuguucauguggcggaugcccagucuguuucguguuuaauuucuugggauguuguggguuucauagguacaucccaguuuucccugcccuuaacuuccugcacugcagacccucagugucccuauagagcugccugggugccggacgccccucuuagcuuacuggguugcagcccuaccugccuguaccacuucucuccuggcacuuggucucauggacaggugcauccccaucaccuggaacccuuugcuugcuugcuuucucucucucucucucucucucucucucucuuucuuucuuucuuucuuucuuuuucucuuucucuuucucucuuucucuuucucucuuucucucuuucucucucucuuucucucuuucucucucucucucucuccuucucucucuuucucucucuuucucucucuuuuucucucuuucucucucucucucuuucucucucucucuuucuuucuugacaggguuucucuguguagcccuggcuguccuggaacucacuuuguagaccaggcuggccucgaacucagaaauccgccugccucugccucccgagugcugggauuaaaggcgugcgccaccacgcccgguuuggaacccuuuucucagaacuagcaagcaacaggguucaguggccguuggggaacauagguaggggaaucucugaauuacaggccagccaggguuacguguggagaccuggucucaaaaaacaaaacagaacagaaccagcaaagggaaaccuguggacagggccaggaaccuguguucaguacaagcugaguuuucccuucagggaauccuugcuggauauaggccuaucuaccacuucuguccuucauccuucccaggcucagaacuugaugccaucccacccaagaucucuuggcaacuuccauucuuucaugaaugcuacccucuuuaguccagauagcucacugcccagucuuauuucuucccaguccacacagaccuggccagguaggauucucuccugucuccuuuccugagaucgucaguucccaccucacugagugcagaaaagggaggcuucauuacguauuccuugguugggcuuugagguuagagguaaugaacuaacuggauaugaagccagccugccugcagcuguguggugacaacauuugacaacacagaagggaaugcaaagcuguauggugauagaauauggguuugguuugaacuuauauuugaaccugggaccuuguacaugguagacagguacugaguuucaacuucuguuguuaauauauuaguaaguuuuauuagaauguuugaaacaacugaauuuaaauuuuaaguaagaaaaauuagaccaauaugaaauacauauuagaugacuaagaacacuuguuaaagauuguagacaguugugcuggaaagauggcucagugguuaggagcacugcuugcucuuguggaggacuuggguuuaauucccagcacccacauggcaauuuauaacuguauaacuccaguucaagaggaucugauacccucacacagacauacauguaggcaaaacaccaaugcacauagaaauaaaauaaaaaucauaaaaaagagaagauuacagucauacuuuaucaaguauaagguggccaguucccuuccaaaagcuguaaccaugguggccuggccccuuugagcuuuguaaagucaccugagaauugugagaccugauuggcugccaucccuuuucugucuaggaucuacauuggaaggcgucugacaacuuccacuagcaccuucugaugaagauuuggaucugacuucuguucacacagugaggauucaugucugagcugugacagcuaauugaagagcuagcaugguccuuggguguuugcacuauguguguuaauuuguucuguaaaugcgguguuccugauuuagugagacagaauagacucuugucaugaccuauaauuauaccuaugggaucaauuaauaagcaugucagacugaugccuauuguagcauuuacuaguaaauuucuuugaauauuagauauaaauaguaaauuucuuugaauauuagauauaaauaguauaaauaauuuuaauauaguagcaaugguguauuuaaaacugaucuguaaucauaauccaguuaagacacuuuacacuucaaaagaacaaguaagugauauuaaaaucauuaaaggguuuuccccaaaggaauauuguggccuuauaauccuauuacauagcagaaaauuaaagggugcgugcggguuaucuguaaaggccucuaacuuugugaacugaguagcaaguagaagcuaagguuacccacgaaccccacuuugcaguucccccucguccugcuuugcaggaugaggauucucgccuugcuguccaccauuaccuuggguggucaguuuuguugcaggcaccuuuaucacucugcugaauucucuuguuuguauuuaaaucuuaugugcucugaaaaucagcugucuacuuuaaaagacuggaaaugaaaaacaaaaucuuugccaaauccacuggagaauacuauauuugcauauccauuaaucaggauccaaagcugcuuaaaucgggcguccucccagucuucucuuuucuauagcaugguuuuaaagccugccuccuugacaugcuguauauauccuguuguauuuguuucacugucccacacuuaacucaggugugcuaaaauaaaagugacauuuuaacagucuuuuguuuauauuuacauaauuacuagacauagccuauaucccuuucauuuggagcaagauccuacaggauguaauagucaauagguguuuucuugcuucauucaguaaaguauuuuuguaagaaauuagaucgcuguacuggcuaguuuuauguuaacuugacacaggcucaaguuaucacagagaaaggagcuucaguugagaaaaugccuccaugagauucagcuguaaggcauuuucuuaauuagugaucaagggggaaaggccccuugugggugggaccaucucugggcugguagucuugguucuauaagagagcaagcugagcaagccaggggaagcaagccaguaaggaacaucccuccauggccucugcaucagcuccugcuuccugaccugcuugaguuccaguccugacuuccuuuagugaugaacagcaauguggaaguguaagcugaauaaacccuuuccuccccagcuugcuucuugguuaugauguuugugcaggaauagaaacccuaagacaauugguacgaggagugggguauuccugugacaaccugaccauguuuuggggaggacuguggaaggacuuuggaacuuugggcuagaagaucuauucgguguuaagagcucugugggauguugugaagga

SEQ ID NO: 4165 - RNA, 569 nt, Mus musculus
guuuuguuuuuuuuuaaagauagaucuuuauuuccaacucugaucuaccacauuaguguuucccaccaacucugggggcagagaccuucacaggcuucacaaucuuuuguuuaggugcugccuuugugggggccuuggcagcagccauugcugucuucuuugaugccugcuuagccucuuuugcuuccuuggcagcccugauagccugcucucacugggcuuucuuaaccucugguuucugauuccucuuggccauuauaucagcaagagaugcaccaaugauggcuuguuggaauuugacugcacggcagguucuuuucuuuugaauuucuuccaacugcccuuucuuguguuuucuucuguagaggacaguccaguuuauuugccuaggauuccuuuuggaaaggaaugcggacucacauuuugcauuaagaaacuggaaaaucuucucguaggugcuggcauagugccgcccaugucccggguagaucuuguaccagcugaaacugcacagcucgaccuucauggugauagaugucggccugccgggggaaagauggcgaagagcg

SEQ ID NO: 4166 - RNA, 1405 nt, Mus musculus
uagagcgugugugggcggcucuggaggagcccuccucucuggugaggccacgccuuggagugcacgcaccucuaccuggcucagggaugcugcuucguccccggagguugcccgcuuuuucuccgccgucgccagcuagccccgacgcugagcugcggucggccggggaugucccggugacuacgucugaugccuucgcuacuucgggcgggauggcugaacccggcucgcccaaggcucccguguccccggacucggcgcagcgcacgcccuggagugcccgagagacggagcuacuucugggcacgcugcugcagccggccauguggcgcucacuacugcuggaccgcaggcagacucugccuacuuaccgccgcguguccgccgcacuggcccgucagcaaguucggcgcacgcccgcucagugccgccgucgcuacaaguuccucaaggacaaacuccgagacucccagggccagccguccggacccuucgauaaccagauccgccaacucauggggcuauugggggacgaugggccgccgaggguucgccgccgcucuacuggcccuggacguccccagcgccgcggccgcucgucccucuccgcguuagcacccgcaccugcaccgguggagcaagguaggagcagccaugugggcaagaagggucugggucuccuggggaggggcggagcccugaguugggauuccguacguuccgcgcguuucucucguagaggccgagcugccgcuggcugcggaaaaugacgaaccugccccugcgcucagauucaguucuuccacgacgaagucugcaggugcccaccgcauuaccagcucuccuccucuuacgagcaccgacacucugccuccugagccgggccauaccuucgaauccuccccgacgccaacccccgaccacgacguggagaccccgaaugagccuccuggccuuucccagggccgugcuucuuccccgcagguugcuccccagucguugaauaccgcguugcugcagaccuugacgcacuugggcgacaucucaacaguucugggcccucugcgcgaccagcugucgacccugaaccagcacguggagcaucuacgagguuccuucgaccaaaccguuucucuggcggugggguucauucugggcagugcagccuccgagcggggcauccuuggggacuugcgccaauaaagcuuuguuaucaguccucuucuccagaaacgacucccagucuaccccgaccccuguuacuguccccauccccaucucaaaccuagguucuuaccaaaauaaagauuguguuuucuacuuaauccugugaaugaauucggacuccaggucgcgguaagaauggaacccuaaggguagaggcuaaaagacacagccccucgcc

SEQ ID NO: 4167 - RNA, 1405 nt, Mus musculus
ggcgaggggcugugucuuuuagccucuacccuuaggguuccauucuuaccgcgaccuggaguccgaauucauucacaggauuaaguagaaaacacaaucuuuauuuugguaagaaccuagguuugagauggggauggggacaguaacaggggucgggguagacugggagucguuucuggagaagaggacugauaacaaagcuuuauuggcgcaaguccccaaggaugccccgcucggaggcugcacugcccagaaugaaccccaccgccagagaaacgguuuggucgaaggaaccucguagaugcuccacgugcugguucagggucgacagcuggucgcgcagagggcccagaacuguugagaugucgcccaagugcgucaaggucugcagcaacgcgguauucaacgacuggggagcaaccugcggggaagaagcacggcccugggaaaggccaggaggcucauucggggucuccacgucguggucggggguuggcgucggggaggauucgaagguauggcccggcucaggaggcagagugucggugcucguaagaggaggagagcugguaaugcggugggcaccugcagacuucgucguggaagaacugaaucugagcgcaggggcagguucgucauuuuccgcagccagcggcagcucggccucuacgagagaaacgcgcggaacguacggaaucccaacucagggcuccgccccuccccaggagacccagacccuucuugcccacauggcugcuccuaccuugcuccaccggugcaggugcgggugcuaacgcggagagggacgagcggccgcggcgcuggggacguccagggccaguagagcggcggcgaacccucggcggcccaucgucccccaauagccccaugaguuggcggaucugguuaucgaaggguccggacggcuggcccugggagucucggaguuuguccuugaggaacuuguagcgacggcggcacugagcgggcgugcgccgaacuugcugacgggccagugcggcggacacgcggcgguaaguaggcagagucugccugcgguccagcaguagugagcgccacauggccggcugcagcagcgugcccagaaguagcuccgucucucgggcacuccagggcgugcgcugcgccgaguccggggacacgggagccuugggcgagccggguucagccaucccgcccgaaguagcgaaggcaucagacguagucaccgggacauccccggccgaccgcagcucagcgucggggcuagcuggcgacggcggagaaaaagcgggcaaccuccggggacgaagcagcaucccugagccagguagaggugcgugcacuccaaggcguggccucaccagagaggagggcuccuccagagccgcccacacacgcucua

SEQ ID NO: 4168 - RNA, 20267 nt, Mus musculus
cagugggaagggcacucagaaagaaguaccaggccagugaugaagagaguacuuuguggaaccucuaggguuagugugcuccagaucccaucaugcuuggccucuggcugcucagcgucuuauggacaccaggugagugaugacuacuugauuucaaggagccuauucauugcuugguggugugccuaguggccauguaccaugaucagcucaccuugccucccuggaguuggucuggucccuggguauggagaaaguagguaggaacagaaaaagucagaauugagauuuuuuuuuuuuuucaaaagugaaaugugagagaaauuguuuccugggauuuuucuuuuuucauugagcuaguuacaggaacaguagugacaucacuaggcguggcacuuacaggacagcuucccuugcugcuguaggagucccaggcagcaagguucaccuuugggauccugggggaugcauaacucuagcuaggcggggacagaagcuagaggcacgauggucccaguucucuagcagcaugggauccugccucccacugggaggcuugguuuuccuguccugggaggacccuggcuggaguggucucuucucuuaccucucaacccugggguuaaguggcugugccccuugccuaugcaagagaucagcagguggucucuaaaacuggaccugccuacagauaggugcucucuaaaccagucccccaucaguuguugagcaggaaguuuuccggugggagagaaaagccugagggaggguguguguucaucaguuagcuacgaucauguagcuaaggucaacucuagaugucuggcaggcagaccauagggccuacauguguucugccuguguagguucaaacaggcacuggggaaggguggggugaguggaugagguucuucugggggcacugugcccaggugugcugggcucagacagcuugacucuggugugauggagcuggugguuuaggcacaaagcucuuaucugggccauggggucagaucccauugcuggcacugagccuuguggugaauacccagauaaaagagcuaacucuggcuagacacugcuggaccucugaccccccuuucuccugaagcaguagccccuggaccuccuuugccccaugugaaacaguaugaagugguuuggccucggcgccuagcugcaucccgcucccgcagagcccugcccucccacuggguaagucuacccauuagccuggccacacaaccugugucuuuaaaaggaccggcagucucuggaggcugcccugcgcagcuccagaacuucaaccugucugugcuucugggcauggcgaugguccuccuguguuuaccacuuccuccugccuucugcugccccgcccccagaaaacaggguccuagggcccccaagguagcacuagagcccacucacuuccuugcuccuuuugagaccauuggcccagccuggagaggccucucacccaggaaagguacagcaguuugugcugcccugggccacuccccaguuucaguuggcagugguuuguuagauuagccagcagcugcucacccuaaagcuauguguaugcaucaagaaccucucagcuugggauuuccuggaacugggaacugagaacagccucuagaccuccaggaagauuccuggcccuguccuuguuuggaucuucaggaaacaucucugccugggcuuuccucuuuccugguguaugcugucccuaaggcgagcugguuguacacaugguguaggaguaaaaggucacagaguauggagcacacaccugcucugaaucucuggcuggacaccuuagccagcugaggaauuguggugcugaggagucuguguaccuugccuacucccauguugcccagauuuaguggcugccacuccuauccuguuuacucuuaucauccucaccaucaccuucaccuucaccaucaccaucaccuucaccgucaucaucaccaucauccuugggaauagauugaggaaauggcucaaggagccaucaaacucuuuuuuuuuuuuuuuuuuuuuuuucugcuucaccugggagaguugcuuucccugucagccugcucccagccaucuacuucccucccugaaacuaacgaauccucagggucuagggggucucugcuuggggcuuucugcuaugcaaaucccuggccuuaagcugagaauccccauccagggccaguacccagagagucugagcuaugcucuugggaccagcgggcacguuuucacccugcaccuucgaaagaacagguaagccgauucugguccuuggguagaucucugaguccagugggaaguguaggcuccugugugccagaauccuggcccaggcaucuuaugguggcugcuccgugugaggcagaaucagggaacgucaaugguugucuuccagggaccugcugggcucaagcuacacagagaccuacucagcugccaauggcucugaggugacagagcaacugcaggagcagguauggugccuggccagccuucccugggccagcggaaucaagguggcaaggcucaugacccucucucgcuuccuuaggaccauugccucuaccaaggccauguggaaggguacgagggcucagcugccaguauuagcaccugugcuggccucagguauguacuguagacccaggcaggaagccccauuuuaaagaaggguaaacugaggcagugaaaagggggccuuggcaugagaauucuuucuuucuuucuuucuuucuuucuuucuuucuuucuuucuuucuuucuuucuuucuuucuuucuguuuuuugagacaggguuuuucgguguagcccuggccguccuggcacucacuuuguagaccaggcuggccucgaacucagaaauccgccugccucugccucccgagugcugggaugcuguguuuggaaggguugggacucuuccuuagguuuccauugauaauuaccagccaugucaaacccaugucccuucuugccuccuguaucuacaagccuggucaucccccacaagggugugagguggcuguucuggggcaccugcccucccauguaggaacaugcugaccauacccucuguucaccuggcucuuccccucaggggcuuuuuccgaguuggguccacuguccacuugauugagccucuggaugcugaugaagaggggcaacaugcgauguaucaggcaaagcaucugcaacagaaggcugggaccuguggggucaaagauaccaaccugaaugaccuagggccucgggcauuagaaauauacagggcucagccacgggugagcaacaucauccccuguuggucgguccagucccagaccccaugcuugggcauaggcauggcucucuguagcccugaagcaagcccugugcccagugggugggccagggaaagcccacugcacuggagaugccuagacuuugccucccaacauagaguugggcucugggguaggcuggggucaaggccauaaagacugauuggcuucuuucccuagaacuggcugauacccagagaaacccgcuauguggaguuguaugugguugcagacagccaagagguauggggaugcaggggcugagugggcuggauaaauuggggugggguugccaagucccagacuaaaggucuuauauuuccaguuccagaaguuggggagcagagaggccgugcgccagcgagugcuggagguuguaaaccacguggacaaggugggucgccccaggugugcugacagugaaaagagggugcagcuguuuaggguaggaggggcaggauagccagucaggaaguagggcuaguuccgagcucuauacugagcacagaugaauguaaugccccugcccauccggguuccugcacugacuucaaggggcugcucgcccucugcagcuuuaucaggaacucaguuuucgaguuguccuggugggccuggagaucuggaacaaggacaaauucuacaucagccgcuaugccaacgugacacuggagaacuucuuguccuggagggaacagaacuugcaagggcagcacccacaugacaacgugcaacuuaucacgugagugggugggcacacccacacaccacagugagacagaacuaagcccuagagauauggccuccguacagcccggccuccaggguaggacacccgagcagaguuuugcaggaaugaagaaaggccaggaaccuugucaagggcaugacugucuugucuguuuccagggggguugauuucauugggagcacuguuggacuggcuaaggugucugcccuguguucccgucacuccggagcugugaaucagguaaacucuuacccaagcuucccaaacucucugguggcaggacagucaaacauagugccuagauugugggguacaagugucagccuaggucccugagacaccaugaagcagucaccuacucugggcauguauucaaaaccugguuuauguuaggguguuagcaggaagcagugccaaugggcaugggguggccaaggacacgugguagaugguagcaagacaguagugauaaccauauccucauaggaccacuccaagaacuccauugguguagccuccaccauggcccaugagcugggccacaaccugggcaugagccaugaugaggacauuccaggaugcuacuguccugaaccacgggagggugguggcugcaucaugaccgaaagcaucggguaagguccuguggggcauguugggugggaagggacagaguggcacguggcucuuccuaacguggacauccuuacccauagcuccaaguuccccaggauauucagcagguguagcaagauugaccuagagucauucgugacaaaaccccagacaggcugccugaccaauguuccagaugucaaccgguucguggguggcccuguguguggaaaccuguuuguggagcauggagagcagugugacuguggcacaccucaggucugucucaccccgucccugucccuugcuggucagcuucagcauuagugcaggggccucuaucugagguccuuucgguucagcuagccucccgggccugguauuuugugcccacacuucauauggcccuugaggucauaagucacuacauuucccuugaagccccgaauaaccuauaagggauuuggagguaaauuagcuucgaccccuuccccagugaucaccaaaagccuuuucgcgcuagagccaggucuggcuaggguguagcugcucaaaccguuuuccucccaggacugucaaaaccccugcugcaaugccaccacuugccagcuggucaagggggcagagugugccagugguaccuguugucaugaaugcaagguaaguuggauuuguuucagucaaaccugggggauuggguuuccugugaaggcaucagguggaccugcccuacaguaagccucucugugggaccaggugaagccagcuggagaggugugucgucucaguaaggacaaaugugaccuggaggaguucugugauggccggaagccaacaugucccgaagaugccuuccaacagaauggcacucccugcccagggggcuacugcuuugaugggagcugucccacccuggcacagcagugccgggaucugugggggccaggugaggcagacaugagcauaggauggaggccagcuuguggagugucuaugaccuaaaccagacuaacuucuccuggccccacaggugcucggguagcagccgacuccugcuauaccuuuagcaucccuccgggcugcaaugggaggauguacucuggcagguaagcaucaaggccaaacuguugggagcuggaugugauaugccuucaauagcaaggcugauccacagagauguccccaggaggaagaccugcucugugaggcagguggcucuccuggagucugcucuguuucgagucaucaacccaagcccaacauccuugaaaaaggaaagguccuggggccugucuccugcaccacccagggcccugagccacgcagaguccccaggacacccauggccacagccugccuucugucugcaggaucaaccgguguggagcgcuguacugugagggaggccagaagccccuugaacgcuccuucugcacuuucuccuccaaccauggagucugccaugcucuuggcacaggcagcaacauugacaccuuugagcugguauugcagggcaccaagugcgaggagggaaaggugagugagaugaggagcacucggaagcucuccggggcugaugaagaucaaauaugcccaugugagucucuggcaguguucacacaguguugacugaacggggagggggggcaugugcguggagcuuuuauuaugcccuacuccaaacugagacgguaaccuggcaaguggagacaccugucuagagaccaccauacccaaaggguccccaggaucagccagucuagugccaccucauggcugagggccccuccacacaggcacacacacaaguaugaaggcaguuauccuaaagugugaccacacuagcuguccugaacuuaccuuuagauuugaggauggugggguaagaauugggccuaggccagcuacccgagagccccuuccaccuuccagguuugcauggauggaagcugccaggaccuccguguauacagaucugaaaacugcucugcuaaaugcaacaaccaugggguauguguagccucgggccucaggucacaguacacuuaccagcuggugucuuugagcuagguagcugccaccacuugccuguuaauagaacuuguggcagagacagcuguggguacagcaauguggguucagauuagccuauauccuucuaauggggaugaucaacaaggccucuuuggggcugagguuggauaggugguuuccgcugagcuuguggccacuagucagugugcucauucgggagaacuccuuaugaacucaagauugacauauguggauggauacauggauggauggauggauggauggauggauggauggaugggacccugugugugcugcaaccuccccugcugcccugugggguaccuguccuugaggccccacuuucucuccagguaugcaaccacaagagggagugccacugucacaagggcugggcaccacccaacuguguacagcggcuggcagauguaucagaugaacaagcagguaagguccugaggccacaggagcugguauuugugggguaccagccuuaagggugguuaggauggaucacauugucucuacuucccagaggugacacagggcagugcccuacucaaaacaaggcuacauagccuuggcccaggcaucuagggccacuuacaacccccacagugucuuccuucccaguggucaccgagucugcggcuguccacagcaccacagccucgggaaacuggcuaggccucaacaguggcauuguggggcugggacucaccacuaccacgucuucuaauccauugcuggagagccagaagagcugguguaauguacugggcccacuguuggaguccucaggcacuugaccauaugugggugugggacccaggacauggucaagggggacuaagaaggcugcaucucccaagggcccuccccagcucuugauucaacugguucccaguccuggaugaucauguggccuugugucccacagcgucuacgagccucccagucagugugguuguggucuuggugauccugguggcugcgauggucaucguggcaggcaucgucaucuaccgaaaggcuccgagacaaauccagaggaggugaggacaugcugguugcaacauacuuacaugugagacacauacacuuccuguacgcggaacuugagaaauggcuuugcugcuacuuaagaaagaaaaagcauugcuuccgucagcaagcccaggcagaggcacauaagggaaccuggggcucucuggguguugaacaggccugggugggaagcucaggagacucccgggauugcagccacuaccacugcugcugcagcugcuguuguuucugcucuccaucucuugugcgcucucuuucucucuccuccuccucuucuucuccuccuucuccuccuccuccucccuucccuucccuccuccuccuccuccuuuccucccuccuccucuuccuccuccuucuccuucuucaaggcuguaaugggacagugagagcaaccggcaggugugugauaaauccagaguugagauaaccucccuacuaggccaugaccacauaugauuuccacugugcccugcaccaagaucuugacccccaagcuagcagcuggaagacagcuuuuccaggguccccaagcaccuuccuagcacagcucucaggggauuuguuucuuaaccuccuguacuuacaaaugugccugagucuacagcuagcacucuaugugggguaugccagggcagauaugccagucugacuugggacgcaugcccuggauccucuggcuggaagugaccacaccauucuuaucucuuuuucugccuaggaguguggcacccaagccuaucucggggcucuccaacccccuauucuacacaagggacagcagccugccagcuaagaacaggccuccagacccuucugagacaguuucuaccaaccagcccccaagacccauagugaaaccaaagaggccucccccugcaguaagugcuauccuccuacagguucguggggcugaagugagagagacucaggcucucuaucccucuaccccagagugugacccauuagggaaagugaaggcuucuugugcaaguuaacucaugagccaugcgguagccggagccugaagaacuguuacaaucaccccgagggaggacgaaggacugagucaagacuugucuuuuaaggaucucuauuuggaguuuggguuugaacuuguagguuugcgggcucccagacccgaacugugagaagagaauaaauacccuugugcuucuuaacugaggaaugggcugcuagccuagagagaacaggaaagggggaggggaucccauuugggaaauguaagagcauuggauccaaaagcaagggaccuggugggcaaggguugaggccuuagcacugguucuugggcccaggcucagaucucuauccccucaagccuccaggugcuguguccaguucaccacucccaguuccuguuuaugccccaaagauaccaaaucagguaagccuugggaaacagccacaugcauucuggagacaugaaaaccucuugggggaugagggggcuggagagaugguuaagggcacugacuacucuuccgaagguccuaaguucaaaucccagcaaccacaugguggcucacaaccaucuguaaugaaaucugacuccuucuucuggagugucugaaggcagcuacaguguacuuacauauaauaaauaaguaaauuaauuaauuaauuuaaaaaaauaagaaaaccucuugggaagugauaucugguggcugauucugugggccuggagcccuaaggaaacagcuacuguacagggcaaguuuaauauacugacagugccuagucaggauauuaauugaaccuaaggguugauucagggagccugggagggaaaagauacuacccuaucccccagcucugaacuggucuagucuuugcaucuugauucuuuuuuuccccaauaguuuagaccugauccucccaccaagccccucccagagcugaaacccaagcagguaaggagacagccuugauuuugaggagaccuuccccucuugcaagccgggggcccuuucuuccggagaccagccuccuacagguucccuugggaagaggcuauagggauuuggaaggucucaaaugccaccgacuaaagcuuugaaaguagugguucauucauucauucuuucuuuccuccccacaguguuaguguccuucccagcaggauuccuuggggguucuaggugaacuggaacccuuuucuuagcccuaaaagugggauccuacuucugagagcccaugggcacuaccauagucuuagcccuauaugcugacucuugagucauagcugugaugguggagaacuuguguaugugugugcgugugcaugugcgugcgugcgugcgugcgugcguguguguguguguguguguguguguguguguguguuugccuaucccagggagcaaaugcaauuagcaacaggauggagccccugagcucugccacagggcuuagcugcacaggucagcugucuaucucgugcugcuggccgcccuccugggcaggcaucugugcuccucugaggcagggcuaaggaaucuucuggugagcaagugauaucugagaaggccacaaagugauagagaauuucccaagggucguuugagugggaccugaagagcuaguacguguuccuggcucugccuaggccugguugagaaucuuaucagcucuucugggcacuuguggcucacaaguggcuuucagugcacauucucguguugaaggugcuaguuugcugucuucugagagucccucaguuugucuacuuaucuucuuauuguaaguggaugugggugacauacucucagcaggaauagcaugggaaguaauuacagugggaagugacugaacgacuaugauuuccaugccgagagcuaucuuuguguugaaugaacugaugccuagagagagagaugaaugacuaccuccaagaucaucuggagacuuaaaauccuacaucucgccgggugugguggcacacgccuuuaaucccagcacucgggaggcagaggcagguggauuucugaguucgaggccaaccuggucuacaaagugagcuccaggacagccagcacuauacagagaaacccugucucgaaaaaaacaaaacaaacaaacaaacaaacaaacaaaaauaauccuacaucccgggaaucuuugccacuuaaacacuaacaauugccacugucuuaugcuauagugauuuuuucccugcuuuuuuguuucguuuauuguugugugcaugaugugugugggcacgugugccauggcgcucaugugaagaucagaggaccacucugugagguugaccuuuaccuggguucuggggucaaacucaggucaccagguuugugcagcaagcaccuacuaaaugaucaaucucaguggcccuugcuucuucuucuucuuauuauuauuauuauuauuauuauuauuaucaucauuaguaugggggugguggugguguguguguguguuguggcgugugcaugcacaucacaggaugcaagaagggaucagaggacaaccguguggaauuggucuacuuccacuuuuacaugguucagagacugaaccauaucaccaugcugacaagcgccuuaacccccucagccaucucacaagccccugguuuuuuuuuuguuuuguuuuuguucuuguuuuucuuguuugguuuguuuuuuuagauaggcuuucacucuguagccuauuuuaaaugcuauggaacucacuauguggcccacacuggcccuuaagcucaugacaguccugcugagucagcuuccugaguaaugguuuuauggguaugagccaucacacgugugauuuucuguuuuuccuuuuuuuugggggggggggcgggcuaggaggaugauuuuauuucuuuuucuuacuuuuuuuuuuucuuuugagacaugguaucacuauauagccuugguuggccucuauguagacugggcuggccucaaacuuauaaaguucugccugccucagacuccugagugcugggauuaaaagcaugcaccacuguguccggccagggacuaauuucagacuuauauaagagcugaaaaaucccuuuaaucccaacacuugggaggcagagaccauugaaucucugaauucaaggccagccuggucuacagagugaguccaagauagccagggauauacagaaaaaccuugucucaaacaaaacaaaaggaaaagaaagaaaaggaagaaaaugucauccuagucacagucccggcaggcagaacggagcaggguacgggaauccugggcagggaugaaaggaagcugggggggggggggagggaaaaaugugucuaaagcccaucaugccauguuaccauccucuuuaacaauguggaaacaaaacggguuuuccuaguuaauucuuuccuuuugagcuucuaaagacccauguucugaaagcuucagggcaaugugugggauacuggggaggccgcaagaugauuggcugggacaguuagccaagaagaggagcucugccagguucgggcuuuaucuuccuagcggugaggccaugcagauguuuccuacugagcugcgugcagacagaagccuuccaggcuaggcuggagcugagcaggacagccucaggaugaagcuaagggccguacuuggccuacuuaggagaugcucucagucagcugugucugguuccucccaggucaagccaaccuuugcacccccgacaccaccagucaagcccgggacuggagggacggugccuggagcaacucaggugagccucagagggaaggggaaggggaaggggaagggggaguccaucuugcaggaacccuccugcugacuguggcacuguuucggagggugaguggcuguuuucauuuucuuagcugguaaguuuuagugacauuugaaaaaaaaaaaaaagaaagaaaaaaaaauccucaauaacaggcuugaugucugcuuuauaauuugccagaacuuuccagugcuugcggcuuucgggggcuauggaauuuuccuuuucauauggcuagucuacaguauauaugaaaugcuaguacagucaucuugugaggucgggcccauucuguuguuaggggaaguggaagucuaaauuuaaagaacuggcaauggguauuuucagcuggaccucucucuuaucagguccucuuuaauaucgauuuccuuuuuuucuuggcagggagcuggugagccaaagguugcucugaagguccccauccagaagaggugaccagcuagggcaccccagggccaucguuuguggacguuuggagauaccacugcuccuauaaauguguuccuucagcaacaccacaaccaccacccaggcuggaccugcacacgcuguuccuaccucaggaauaaucuuucuguggcucuugcuguccagaugcccucaugaaccaguggccucucacuggccuuggccagcuuagaccauacaucugcguaugcuaguugcuaggcaggggcgguguacccugcagugggcgugaucaagucugucugucucuggguggacagaaugccaggaguccccucccagcaacuucugcacuggcccucacacagugaccucucuccaaggcacaguuccuguaucuacaucccacucguguaugagacuuaggaaaggaaaagacgucguucuugggguguugggacaagaaguugccgucaucuccggauugaaacagauuaguuguugaaauuaugacuaaacacuauucacuaauaaagauucuauuuuaucaauagauuauagaucacauucuacauggcaguuuguuuuuauuacaccagaucaaacaauuucaccuaccaucucccuucguuuuuuaaccauccaccuugauucagcccgaucucugggcgugcaggaggaccaauccuuccugggaucgagggagggaccagcgcgguuagggccccgccccuuccggcugugccgcgucucccagcaacgguccaaacccgccagguuucuuccgcuguguuucucugcugcacacccacuucucugccaugcucagugcuuccaagccgagcucagcuucguuccugccaacgccuggggauauucauaaccucugcgccuggcuggaccggcucccacucagccgccccaagcgccacuuggcucgggacuucagugaugguggugcgagugagggcgaggcgcuauggggcggaugaugaagaggacucaaagcugagggccacccuugccuccagcccccuaguacggguguggguguugggggaacggagcgguucuugaguccagacucgugcuccuuaggaaagguaguagcaaacagggccuccuguggcucuuccagcucccccugggcucucacgcuguauuagcuucccaggccauccuaccacuuggucugaccuggagucuaggugccgugccagacucggggacaauuaugggcuccccaggaaaagcucguguccuucccacuccauuccaugcaucucauguggucagggauuacaguugcaacccagggucuugaccaggcaagccaaguuccccucgcauucccacagugcugguggccgagauugugaagcacuuccgcccucggcugguggacuugcacagcuacgucccagccugcaguacagaccagaagcugagcaacuggagccuucucaacaggcaaggccugggagcucagcccaccuagguugaccccgggaugcucucuccagccaugggucucugacugccuaacuguggguccuugccuauagaagaguaccacaaccagggguacuagggcacuaguaccccuaguaccacuccugggggugcuagggcagccuaucagcuagccugcucccuuacggaucaguagaguuuuacuucaccuccccaaauguccucagacaagacucugccuguguauaauaagugaucucaaggacagagucgggcagauaugucugauguaguccaaucacagagggcccucgggaagugucugagcagagcaagguggagaaccugugugggcacccccaaaagacuggcucagauuggaauagaaacauugcugggcucaggccugggucuaaucucaugggcuuauguuugagagggaagagaugaaaagagaccucaagggagaugaucaugcugagagggcccagcugcagguuuccagguacuguugagcugucucaacaggauuuaccgagggcaagccaguagagagaugagaaugaaugcagagaacauggccugauagagcaccccauguucugcgaucuccugagacauagcuccaaaggccaagaaugagauagccaugcgccacucaagugcagggcacaaaggggcucucugagaaagcaagaugcugcccaguggcuggaaggcauugcagggagcauagaacuucagggagggcucaacucccaguccuugaugguacugcuuugagaaugugcuccuaccuucuuugcaggaaagucuuucgcaagcugcacuuguguaucucagauaaugauauccaaagggugguauccaacaggccuggaguuaucgagucuauucuaugugcacugagggagaagauggaggccaggacuguucauguaggcucagcugguacagcuguaagugucugcacaucaauucagcaugcaagucugcugugccuucugcccuuugcacucagucagacaauccgucugugugagaauaaaacagagaaaugaaugucccugugguccaaaaagaaaugaaguccauacaugaggcaacaggccucacuuagacucauuccugacuuuccugcugaucuucuggaagggggggggggcucccgaauuuccuuuccagccaaauccaccuacccuggggcagugaaaacacuuaagaguugcuccaaguacaaccaacccaagugcuucccgcucuucuccaguuuccauacuaaccccacccagaguuuguaaugaccaaacaaauucagcccagcuacacuucacuccccaacuuuuguacuuugcaggauccaagacacucugcuguggaugcuguccgacccuggcgggaucuuacccccaacccacauaccucuaagaugcaagauccugauguggauaacagcagcuugucagaaccccucugggacuccgguggagagcaccacucuguucccgaaagcuggguccaugauguugaacucccaaaccuucaaaagaaggcagguaugcucaggcgcauccugggcccagagaggcuagugggcuccugaggaaggcauaauacuuaggguccuggcuccaucaauacccagagagcaaccauucaaggggcagccugugagcuaugcagggaagccauuauucaaacaggagcaccauuccugagguuuccagagcuaugcaaaggucccugaaggcaggauaggaccaaguccuuccaugauaacuucugagucugcuuuaccggcuauggaucauguccccucccucguccauauguccguccugucacuagugggugccuaucagaagcaagguccugagcugauggugucuauuugucauacaggccuacagagcccuccagcccccuccagcacgaagauccuucagaaucaaagggauuuggagaaaaugggcugcugugcuugcagaggguggaccuuuaucucucaaauucuccccgcccaccuccuucugcucccuagccuggacuaaaggucaguguuuaccuuucagggacucaauugaagggcucugggaucaccuggucagcauccagcagcagcuggaggauaaggagcaagcacuagccauucugcaggagacggucaagguaugguccuacugggcaucccuugcuucccggagauucugagcugcaaggaugcagagggacccacugccccagcuucacacuccuuggcugaguuucugaagagccagcacuggcccagugagggcaguauagggagugcagggcccugaccagagagagucaacauucuuuagacauucuuuagauucuuuagaaauuagucaguggccuagcaauggugauucaucaggcuuuaaucccagcacucgggaggcagaggcagauggaugucugugaaucugaguccagucuagcguucagagugaauuccaggacagucaaggcuaccgagagaaacccugucuugaaacuuugaagaagagaagaaaaaaaaaaaaaaaggaaaagaaacagucuguggaucauuucaguccuucucagaggcagaaacaauguggcggauacucaccaccugccucagugaucuguccaucccagacccaagugcugcucaggagugcaagagggcagggcggaccggggcccaucucaggaagcaugggcuggguaaaugccuggaaagcagauagagagaugauggcugaagaggcuccugccugcccucccccauccucaccccaccccccucccacccccccaccccacccccacccccgccaccccagccugaacugggccuugucuuucucuucaucuccaaaagccagggcccucaaaacaacacaccccgggauccucgugagcauuuagaugugcaaugaauaccuaguuuagaggcacaucucguucuauggaacacgcuuagcucugcgugcacgccugccucugugcuacagcuuauucuguagugcacauacggcucugccgugcacaccggguucuguggugugugccugguugugugggcuaaugccugagacugcacaugcacaucugguucuguggauguccuccuggcucugcaaggacacaccuaguccugcaguaucucccugguuggguaguccgugccuugcucucugauggacauuugguucugcaggcacaccucugcucuugcaccaggaacuuccagugccccuuacuauuccuuaccucucccuguauccugggaacacacggacuaagacaauggggaagaacggagacugcaccaaugggcacgggucaugggggcuaucggaaauugcaaugccaucugaguuccugaguauguacccaaaucuugacgaguuaucuucuugugaaaacaggaaagugaugugauauuacuguggcuuuggacuuacagagcaguagagaggaagcgguaaagagaacugaagcuguugccuccaccgcaccgcuugcucacagcgcggcucuccccacuguuucccugacucauagcugaccaagggaaccguaacuuuucacuggagacccagagaggaaacagacccacuugccaccuaaggguugacacucagcuugccauuuaaggauugaauaccacuugcaaauugucacaaagugagcuacgugacuugggaggaauuuguugugauaggcaggccaugggauggacuccauugcugcaucuagccauagcgcccuggcuucuugauuuggaugaggguuggaagcuauccagaacaggacugcaugugcugccugugaacacagcgucacacuccacagguccggggagggaccuugucuuucauugucugcugugaggcuggcuccccacccugaucuacaugccugccuucacacuacaggggaaugagacagacccaguuuuucugccugaggagcaugguggggucuagguuucugaugggagaaaguuugggacaaggucauccuugaagcaggcauggagggaccacagaugccccagcugugccaaagggcucaagcuguuccccccaccccaccccaccccucucauuuugugaagcugaguauagccagaguagccuuaaguuucagugguccccugucucugccuccccgggacuaggacuguagcuguguaccaccauuacuagcuuuagcagccccaucuucauucacuuauguuuuuauuucguuaaaaaaaauuauguguagcugggcauggugacauguguccuuaauuccaggauuucagagguagaggcagaaggauugcugugaauucaaggccagcuuggucuauauagaaaauuccaggauagcaagggcuacauagagagacagagucucaaaaaaaauuuuuuuaaauguuguguacaucuggguaugugcggacagccauggagaccagaugcaucagacucuccuggagcuggggcugcaggugcuugugagugguagcaaccaaacucugaacuucuccaagaggugaccgguauauacacacucgccucaccaacauccuuccgcccuuuuuaaagacagggucucucuacauagcucuggcuguccuugaacucacuauguagaccagacuggccugggauuaaaggcacaugucaccaaacccagcaagaguaugcacuccuaaccuuaaccacugagcaaucuccacccccacccccccccacacacacacacacacaguuauucuugagucaucagcuuuuggaaauacagcaugaacagacagcacaacagccacauaucuacccaucaucugcuguuucugcaaaugugcucugaguaacuucccaauuaggugcuugguucacagcaaagaaggcucagucccucugcagcccugcccugcccagcccugcccugcccuacauuuguccuuucuggcugauacagggaaaccacaggggaggccagggagauucccagcugggagcaggaggagagaaaggagucaucccugugagcuccuugggcucacugacuguaggcuccuccccaagccucuuuuuuuuuuuuuuuuuuugguuuuucgagacaggguuucucuguauagcccugguuguccuggaacucacuuuguagaccaggcuggccucgaacucagaaauccaccugccucugcuucccgagugcugggauuaaaggugugcgccaccacgcccggcucuccccaagcaucuuggugugucucuuucccaguggcccccacaagggcccuugguccuaccccgaagccaucagaccuggaguuguacauucguuccuagagguuagaguugccugaggccuagccggcagguagacagacuucucuagauacuuucagaccuguguguuuuuugaagauuuugcaguugaaggugaugagguuggaacaccugguacagcugaaggaccagcggaucugggagcugaugagaacuggacccgaggagcaucagagcuggaggaggccccacccagagucacucagaccucgauccugagcccaaccggagcuccucacuggucaugcagccuccaugugagacgugagguguggaggccagagcacgcuggggccgcagacgaguuuggacagauuugaguuugguucucccaaccccccaauaucgugucaucaucauugauuuacugcauuugugagcucacaaag

SEQ ID NO: 4169 - RNA, 12656 nt, Mus musculus
gggaaauucggcucaacccugggucuagcauagcucucccaggccguuguguuaggucugcucuagcagaauaggaacccacccagagccaucagcuucuagcugacuccuggcuuuagaguucaagaaaauucgaugugugcagacuacccuaagaaggcucuccccuggugaugcucucagcuacuuaaaacuauuuggucuccaggcccagugcaaccuggggguuugauuugguuuugcuucuacuggcuugccuccuggacugguccuaaucccuugaaggcauucacaaccgaagcagaaagcccuccccuuaccucucacacuuuaccuaucacugccaccaagcuggacagcaguggccagccauaccagagccaucuggauuggggcaucagagaucauugggcuaaggcugugccugaccaguuuucacggaugcuucuuaaggcauuuuucugcuucccacacaaacuuauuuucugaacuuucccgcaaucugccuggcuucagaguuuugcaugucaccccaguuacccagcuguugggcccgccucuccucuggccccgccccaauccauguggcaccgcccggaugacaacacccgcccccuaccaauccugcggccaugguugcgcucaagggcaucccgaaggugcugucuccugagcuguuguucgcgcuugcgcggauggggcauggagacgaaauuggugagcacgaaaagcuggcagcgcggcccucugacaggggugcgauccucguaggagcccuuaacugguagcguucaggaaagacuguggacacugccgcaaucaucuugcccuucggagcaggaagcuauucagcugcuugaggaaagagcugagcugaggccugagauuggaccaggucauagaacuacaagaagggcaaaccagguccaaguucagcggcgggguaauucccagacgucccacaugacuucccaggcuaccgggagaucugcccguuucuugauccguggucaggugcucuagggcaaggcgggaaaacacagaggccucucucucucucucucucucucucucucucucucucucucucucucucucucucuccuucucucuccuucucucuuucuuuuuucuuaaccaucugaaagggauuacgggguggcccacgaucugacccacuaacuggagugagagagauauacuggucuggcuugaggacaucccagaugguggguggacugugcuagugcacagggauguguggcuuguagauaucugugacuauguaaggugaccaucugggagggagaacugcacugauuccagcccaucuuucgccuuucugucuuuccaguccuugcugaugcgaacuucccuaccuccuccaucugccagugcggaccuguggagauccgagcagacggugagcaccacggggcugggguaugagcaccacagggcuggggugcaaacaguccugguuccguggccucucuauccuggccccucauuccgguuggcugguugcuuaaauuuugugguccaaaaaugaaaguuguagacaggugggguugcaggucauggugggagcaaaagccugaacccagcucugcccuccuaggccuggacaucccacagcuucuggaggcugugcugaggcuccugccccuggacaccuacguggaaagcccggugaggaccaaaggcugagcugcugauccgggcccguuuccccuuugcuagauuucauauggcuauauaugccaaaagggcccccucccucagaggagccagggaggugccugaggccgcagagcucaccccugucuccccaggcugcugucauggaccuggugcccagugacaaggagaagggccugcagaccccgauauggaagcguuaugaaucccuucuucucgaagcugacuguaaagugagugcagccccaaccaugggacgcucugucuccuggcaucugggcucugaagggugaaucgugggaguggacagggaagaggugugucugagcccuguggccaccucccucucuucccaagccucuuccccccagaauccugacuuauccuauccgcccugggaguuggucccauuugagccagaggauugugggcuccaggaugggguccccucuaaccuauagauguacacccucacccuaggucuugcucuuugccaccucauucuugcuaaggucugccugucacacagcccacaucccugccuggcaggggacacaccuauucuccaaaggagccguuuggucugagcaggaccccuugaguacucuuguccuaagcaggggacuuugaaggcagauaaaaaaaccaaagauauuuauguaacaauuuguaacaguacaaaauuacaguuauaaaauaguaaugaaaauaaugugguuagaggucacuucagcauaagguauuaaaaaguagucacaacaucaggaagugucuuaggguuucacuacugugaacagacaccgugaccaaggcaaugccuauaaggacaacauuuaauugagcuggcuuacagguucagagguucaguccauuaccaucaaggugggagcauggcagcauccaggcaggcauggugcaggcagagcugagaguucuacaucuucaucugaaggcugcuaguggaagacuggcuuccagugagcuaggaugagaacuuaaagcccaugcccacagugacacaccuacuccaacaaggccacaccuccaaauagugccacuccugggcccaagcauauucaaccaugacaggaagguugagaaucacugaucuaaaggcuugcugagcugaguucauacccaacaggcaccuuguccaucacaggcucagacagagaagagauauaaaagauaccccuugucucuggauccuugaaacuccagcaucaggagaaccagaagauuggagccuagaagaccaggguuccauugcugcugccuccuggcuaucuccugaugagggacucaaaucaggaguccaccuagaggacuuucagacaaggucccuccaaccaugccuuuuugucuucuagaaaacccugaugaagcuagagagauuugaauuuuaugaacgugcaaaaaaggcauuugcugugguugcaaccgggugagugugucugcugcaucugggugacuuauucaggucccugggaaaugccuccacuccugcuuugcccaugaaggugagagggauugcugagcaggugggauagaagcagaaagggaucuguuuucucugagagcaaaguuggagucccagcacccugacccuccugcagggagauggcacucuauggaaacaucauccucaagaagggaacucuugaccucggacccucauagagaccaccuucccuuggcagcaaccagaccuggacaucagccucgggcucaagaagauggcagaucuugagagacucugcugacccugacaaauucccccuuccaugacuugugagauugaucggggagggagucauugucaagcuuuaaucuaaagguuuuguagucaugaacuugucuuguggugaguuccauggaugccaucagcucccaaggaagcauccccuacgugcccgugacgaauccucaguuaggaaauccacauggaaagaagcauggugauuugagggcugggagcugagcaggagcuaggccuggguaggaaccugggagcuggacagggucuguggcuguggccugggccuaggcccagugguugauguugaguaagaugcacagcagggggcuggagcugguugcacuaggcuuguaugggguaggggcuucuguauuagccacuuggauugcaauauacagugauucuugaguaggcccaaucucugagcucggagccagagggcaagugacagccgggccgggcaucuuagauagaaggccucugacacucagagaugacugcucagcugcuaguaaugguaaacuguccucucugguucaaggucagagaggucugggugugggcuggaucccaugcagauguuugguagguugagcaccccacuaccuaugcaugagcagcuauguuaggcccaggaacucagaugcaauguggcugcucccagcuuugaauccucaguugucccaggagguaaaggaucagcugaggcucaguauagccagagaugaggggaagaacccaggcagacaagaaacuguuucccuacugagugcuuggacuggaucuccagcacuugucuacagacaacuggugaauguucguagcagcuuugucuauacuugccaaaaggggcaaaccaacugaguucaguaggugacuagacagucccuuugauagagcaagugcucuuaucucuccagccccaguuacauccuuuaggaggaaauggccccagagguuccuggcucaggcaaaacuagaaugaaaccuggucacagucacccuccugggccaguagaugcuuuuggucccaauaaaacaccaggcacuuggaacaccagcaucugcagguccucuacuuagauucagggaguggggaggugagacagcucaaauuuugaucauggauccaaccucacgggcacuagacagaguguuucacaaggcacuguuuucagaccaccugggccuggguuauucucauggucucuggccaucucuaacuugacggaggagugacaagaagagguuugaucacaaucugcauggucaguucugcucgauugagaauugccuggaaaugcuagcaaagcaucuccgagucgaucuggaggugcucagaggauuaccuaugcaggggaagaccugcccucagcguuuccaggacuaggcuggaggucacgagugcuaauacgagaaaggagagcagcugcggugcccucugggaucuggugcuaccugagaccugagcaggaugcuggcgccucugcagaggcugcucuaccgagggugggccacggacagauucauuuagguccuuagcgggaugacaggugggacuacucugugaugaaggcuagaccuugaggucacugucagagccuggcaguucaucuucaggacccuggacuugucuguaagauggaauguugggcuguaauguggggguacuaaguuuuucuguaaugcggacucaucugcagcgugggagcaaugggaucaaauaguuugaagaccccagauucaacuaugagauagaaccuggguuccugcuuuguggggcuuggaggccaaggugcgcaugaggcuucacucccccgcucauguccuuggaggaguggggacaagagacuuggaagagugugagacugguagauaaccuauguagcugccugggcuuggggugcguugagauggagagcugguggccucuguuaagauguuuguuccgccugagcuaccggggcuggaaaaugugugccucugggccccuuuaaugcguuucacugcacagaugggauugguagucaccuacacacucaucaaccugugucacacacaaccuuaccccucuucaagcaucuccucagacuccuuugugggaaguccaggaugggcuucccuucugaggcugaugcugcuaacuggucuaacugcacugacugcuuggcacaucuaucacuucaucccuauguucagagaauuggacccaaagagaauuguucacgagcugagggucaacuaaaccuugugccccguccaucagaagccucuggugagccauagguaggacagcauaguucuuccuccaagaugcagcuucucugucccagaauuguuggucuuaaagacacgcauuccucccaccaauuuucagguauuuauuuuuuuuuuuuacuagcuggggagacucaguggucacaacagccuagaccucaggaaaggaguggaagagugguuagggcuuucaagaauccuccauagagugggcgagguggucaagguccuccucuggucccugcagcaccugacgauacaggaugggccgugacuggggcacuucuucauccuggacaucgucagacaugggauggucuaugcugucaagauccaguucuggacccugaagaggacugcgaagauggcucaggauauccucagucuccacccaggucauggcaucuguggagaaggagacguagauauagccucccucacaagauccuucccacuagccuccuguccgaaugggccccaugaugugaccucgaucccgcucugaccuggacgcuuuuccucggcagcugcaggcuucuguuuggguucaggaagcaguggccccagcugguuguccuuuucaagaggcuccagggcucuaguaucccagacccugccaacccaaguagaauaagguucacacucagauggggagaguuagacauggcuagccccacuuucaaagacguucucugccccuagacagcugcuggcccugggaagccacuccacacccacccaccuuaccucucuguaaggccugggacaaguucauggcucugugacccuagcaucucuaaugcacuaagagcagggaugggacccaagaagguuagaaccuucccugagcaggguccucaagggcaagggaguagguaauauacuguucuaaaacauggcccauuggaggcugcagggagaacuggaucuggaaaauggccuguggucccugcuccugggagggaacucccaaggagggaugccugugggauuugaguaucacuuccuccuagaagcuucugaauagccauguucuccaauucccccagugcaccagcccacacuugcccucugggacacuuacuucucuguuuccuguucagggaacacauguuugccuuuggucuugacagggaccuaggagagggagucacagguggggauucugcuaguuagugacccaagguuggaggacaccagggagagacccaccaacaggcugggcuucaguucaacuguguuuaacucuaggggaugaggauuaucauggcuaucagaacugcagagagaggauuuaggacaccagccuguucccaaauugccagccuucccaaaacccagccagcuuaggagaaaauagagcucuucugcugguacccagggcucacuguggacucugcacccucacuccaccccaguauuuugcacuaauuaaggcuaugcuugccccuccccauccuggcuaguggcccagaagguagucagcuccucugaaugcaauaccuuaaugaagacaaaguaccaagaaggacgugaggcacagggugacccugggaaagugcccagcuccaagaagcuguggauggcuguggagggugggccucccucauccucuuuuuucugccacaugugcagagugaguggacuuggcccagggcaagcucagugaauuuucagccagggcaacuguuucuagucuauaaaccauccucuaagugagugugcccaggguaguauggagaggacccucucacacagggucuucugaggcauuuggacugccacgucccuacccauaaucaucugugucaugaccaauauccucucauccuggggcugccugaacaccaggaaggaccauguuuucccauccuggggucaccugggugucauggaggcucacauacguccuucugguugcccggcuguuauagagacccauguccucaccgguuaaccucagugucuuggagauuugcccaggagaccccagaagggcucaaacccuucucuuccugaggccccucaucugugcucacauggugccgcuaccagauucaccacacaucccugcuugccucgccagcuuaggggguggagagaaagaaguccuuuccgguauuuccugcuaacuggggcagaggccagcagccaggaauggagcuggacagaggggccccuugcauaccuggugugcuggagcugcgccugccucccacagcagugcagccaccaaacagguggccaggagaaaccuaggggaccagagagagaaugugagguggugagggagucaagaccugcuggagcugcuggugugugugugucauaggcagagagaccaaggucggucucugcugauccauuguuagaucuugacucuggccucacagaaaaggaccugcaggcagaguaagcaagcaaaaugcucaggacaccccugcucugugucuugaugccaagcucuccaccuguggccaagacaccucaugcccugcuaugacaggacacuggcagugcugaagauuccagaggcuacacaaggacacacaugugggcuugcacacacaugcauacauaugccugaaaauguugacaggggugggggauggaggcccuagcacauggccaugccccacaguaucccugaggccacaauccaugguauugggaauaacuucuaguggcuaguagccccagccccaucaugaagacggaagaaauacugaacacgugggucuaaagagaugugcauguaugugaaguauauguguguuuguugguauauggcaugcauguauauacguguguguguguguguguguguguguguguguguguguguguguguguguguugaaugaagccucacagaaaacucucgucucuaugauucagcccuuugggauaggguucaaaggccucagguaaggaccuggacacagacuugaauacacaugucucaccucaggaccacuaggcaaaggccuauuugugugcugggaagagaaauaaacauggagacccucauccuagccuuuguacugcacacacacacacacacacucucucucucucucucucucucucucucucucucucucucucucucucucucucugcuuccuugauaacuaagguccugcaggggacguaggccucccugagacacaaacccuagcuccugggugaccaacucucagguucccugauuccugcacugccucuacccugccaucccucaaaggccugcuacauauuccccugccucgccuaccuugcuacugucccuuuugggacaucacagccuggaauguugcuucuucccaggggagauuuaggaccuaauguuccucuggcucagggaccccaugggacaaaccacccucaugcauaguuggaggccacuuggagguaaacccugagcugcagacccgagggugaguguuuugcagaaaagaggccuuucccucccucccucccucccucccucccucccucccucccuccccuuccuuuuuuccuuccuuccuuccuuccuuccuuccuuccuuccuuccuuccucucacccuccaucccuucuuguuucccucccuuccucccucucuuccuuccucccucuccuccucuaagacccucuccuggaauuagguuuccgguugagauggaguaacucucagggccucucucuaagccagagcuccuagacucagacccaguaugaccguaaccacacagccaggcccacccugaucaaugcccccagcugccagcuuuuaugaguagaaaaguuugggcccagaggccacggcaucaccucuucaugacuggggcuccuuuucagugcucuaggcgaauggcgaagcuguagaucucaggguccaggugccugguccucuuccuucuaacccugguuuuaucuuuccuacaugggugugucugaccagaggucaggggccagcaaucacugagccauaagccacgccugccccaccauguagcgugagcagagagcauagacugagcccccaggagacuuuugaucucccaccugccaguucuaagaccugcccacuuuagcacuagacuuccagccacaaccacagcaccacuaacuaacuccuacauuccccucuccugcauagauaggcacuuggcucuguguccucuguuaugccucagcccucuaugcuauacuccagacugccagccccaauacucuuguagcugaguggucccagagccccaccccuuucuuuugggacuugggauagagcaguuguuacuccaagaagcagcuguaccuugcagugcucccaccaaaucccagguaaaugagcacaucacccucagagaggcaacuauauucaaagcucaggaaauggauguccuccugguggggacaggcagugacugcagauagccagagcuucagggagucccaagaacaaggaagccccuggccugggguaugccccagacuguugaaauucaaagagacaauagugagaagcuacucaaauacacaguaccaaauaugucauuauaacaacccucuucagagugauggggacaggcacagcauuggaagacuaugguccaauguuucuucuguaaguccaagguugccuuguguggugguuuggauaaaaaugucucuuucaugggcuuaugcauuuuaacacaguagccucggcugguggaacuguuugggaaggauuaggagauaaggacuuauuagagugucauugagggcaggcuuugagguuucaaauguccaugcagggccuggugagauggcucagcgguuaagagcgccgacugcucuuccuaagguccugaguucaaaucccagcaaccacauaguggcucaaauguccaugccauucuuaguuaccucucucucucucucucucucucucucucucucucuguguguguguguguguguguguguguguguggugugguguuguguaugucucucuaugugucuguuugugucuauguggugugugugguuugguaucucucugugugugucuaccuuguuauguaugugucuauauggugugcaggucuauguggaguguguaugugugugauaugugugugugguguaugugugugugugguauguaugugucugucucugugucugugugugucuauguggugugugcaugugucuauguggugugugugugguauaugugugucugugugugugugugugucuaugugggguguugugucuaugugguguguguguguguguguguguguguguguggugugccuccuguuuauggaucaaaugcaagcugucaucaccugcuccagcgccaugccugccaccugccaugcuccccaucaggaccgacauagacuccagcccuuugaaacaauaggccccaaauuggacacuuuuauaaguugccuuggucaugugucuugucacagcauuagaaagacacuuggacacugcagugucaugaaagcugcagaccaauaauccuccacaaauaaaauagugucaaguaaaguacacaagaauugaucccaagaguguaaaguuggucuaguguuuaaucuucuaagcuguaaacgaaggacaaagagcaugagcuuuuuuuaagagacagggaaaaagugcacuugacaauuccgguguccauuuaugcuuaaaaugggggugggauggagcuguggcucagcaguugaaaagguacaaagcuugucagaaugucaaaggccaggggguaaacagaggcaggcauggagcugcguugucagugcugauggugaccgacagggucugauggugaccgacagggucugauggugaccaacagggucugcugcugauggcaaccagcagucagagaaaccacucagcacacuggucuccaagggaacgaacaaagcuugauugggccuggcacucagugaccagugagagacucagaacucuuaacugucaggugccaacgagaaagaaaaggaagaaaagaaaauucacacacacacacacacacacacacacacacaggcugagaggaugaagcaaaagcagucucuaauaaugucacacauacaaauauagacagacagacagacauucacacacugaauggauggaacaaagcuccaacaagcagacuccaaccauuucacacauacacauguauacauaaucacauauauacauaacacauauauacauaacacauauauauauuuguacacaugcacaaaugugcgcauguacacacagcuggaggauggaacuccagcacacuuucccuccucucccguagcuuccguagcccagcaaaaucuuucaagcagcacugaauuacaaugggauuaggucccauuuaucuucuagugaaugacgaugaaaaacacaguguguucccccgcaccuuuacagaaauaacauuccgcaguacagguaaagaaaacaacguguucccaagaacucacggacauucauaacuaagcaacuugucauagauuaacaagucugagcaagcagguaguuuccucggccagguucucuuacugacaggcagcaacuugugguuaaaagacagaaucgaguauuuuauuauuuaucuuaaaaaguaauguuauaagaaccuuaaaggaaucgcaaaucuaaacuuuuauauaaaauguaaucagucacaccuacuuuaauuccucagagggcauuacucucaucagcaauuacucgucaauaauuguuaugaaaucaauaaggaagcugaggucaaaaauaaguacaagaaaucaaucaucaccuguccagccucagugagagucacgucacucagugcugcuauuguucuuguucccugaccuuuaaaacgcccuagcuuaaauauuaaaaguaugcuuuucugaacuuca

SEQ ID NO: 4170 - RNA, 11661 nt, Mus musculus
ggaguucaagacauauacauguugaucaauauguauacgcaauaugcauaugagauggcuuaaaaauaaguaucacauuacugugagaauaaaugacaagucuucaucucaguauaagauauuaggcuuuaaacacaucuacuacaacucgaaugaacucagaggauauuugucuuagcuuagacuucugacaugcuacaacucaauggauuaacuucucacaguucuagaagcaagaagucgaaggagauuugcugucugguggagacagacuuccuggcccuuccucaccccuucucauuucaacuucauaggaaaagggcuacaagaguuccuucagggucuuacaaauccacucaugaauccuacccaacuuuuagcauuuuaagaacaucaccuugagagagguguguguguuggggggggggggaauacugugcauugcuuuauacaagcaccauaacaauuacucuaauuccacuuuuuuuuuguuuuuuuguuuguuuuuuuuuuuuuuugagacaggguuucucuguauagcucuggcuguucugaaacucacucuguagaccaggcugggcuugaacucagaaauccaccugccucugccucccaagugcugggauuaaaggcaugcgccaccacugccuggcuucuaauuucacccuugaggcaccuggagucaucccauucucauaaaguaaaaggguuggugccagaggcugugaagugggguugggagucagugucuaacagagacaguuuuagcuugggaagaugaaggucuagagaccagagccccagagcaugaugguggggauggcugcacacugauucuaaaguguuugacgcuguaugugguuaagaugaugaaguuaaaaacacacaaauaguuacggcaugguuaguauacaccuuuaaucccaacacuuggaaaacagagacuggcuggucucugugaguucaaggucaaccuggucuauauaguaacuuccaggcagccagggauacacagugaaaccuuagccauaagaaaauagcaauaauaauuuuaaaaaaccacauuggcucucuagagacaacuacaggugagucgaaacuaaacugugaaguaguuacuuucauugaauucuugaguugggaaucagcagagagggccacuucccucuugaagcucacaucuugagcuaugagcugcggagaaugcacaggggaguggcuggcccaagcgugcaccugcccuuacagugaaguuaaaaaaaaaucaagacaccuugaaagcuucccagguuucugauucagaagacggggugagccugacuuccaacaacuggugaaggcugcaggccacgccaugaguacccaagcuguggccacagcccugaagccuucggugggaacuguggccgacacuacuacccuuuuggaucauuuauuugccucucaaaggacaggcugagcuuuccaggguggcaaacgguauagcugccaguucucaguggucuuugaaguuggccuuccuuuucucuacaaaugcagucaucccuucucuccggucauccuggcaggaaaggaagagagagaugaaguuugaaucuucccauugaggcccucagcugacugccugcaucuccaaggugcucuugugucucccuccuugccuguucucugagcucaucaacaagacggugauucugcaguaggccuaccuguggcccaugaaauaugggauuccccagaaacagugcuaagcucgggacaggggauuguaaaccaugcaggacacaaucaggagugauaacaagaguaccagaaacucaugcuuauggaucugggagggucugaguugggaaucucucacagagcuguggggcagcaacagaacccugcuuuucacccgccccuuccuuagccaguggacacgcuaugugcaaacaucuucacuucuuccuuaaaggaccaagccacuuaaacuuuuuuuauuauuauuuuuuuuaagugugugugugcgcgcgcacagcacagagaucagaagugagguaucagaggaacuggaguugccggugauuguaagccaucuggugugggugcugggaagugaacucagguccucuggaauaguaguacaugcuaagucauuuaucuccuuaaauguuuuuuuuuuuuuuuuuuuuuuuuccaagacaggguuucucuggguagcccuggcuguccuggaacucacucuguagaccaggcuggccucgaacucagaaauccaccugccucugccucccaggugcugggauuaaaggcguaugccaccgccacucggcuuuaaauguuucuuuuauaaaacacugagcacugggccaguggugcaauagguaaugcaucuaucuggugaucagacgauucuuuaaaacaccuggacgugagcuucugauaagaggugaacuguagucaagcaaggcggcacacuccuuuaaccucagcauccaggagcagacagaucucugugacuucgaggccagccucgucuacauagugaguuccagaccagccagggcuacauaaugagacucucugucucaaaccaauacacaaauaaaauaaaauuuaagaauuagguggugguggcuauagaugauucagcaguggcuggagagauggcucagcaguuaagagcaucaacugcucuuccagagguucugaguucaaaucccagcaaccacaugguggcucacaaccaucuguaaugggauccgaugcccacuucuggugugucugaaggcagauauaguguacucacauacauaaaauaaaaucuuaaaagaaaaaaaaaagagauggcucagcagcuaaaagcacuugcuauuguugagugggaucugaguuugguuuccaacacguaaaugguggcuacaacagucuguaacuucaguuccaagguagccagggccuuuuucuggacucugcaggcaccagacaugcauacaguguauuuacgcacacagagguaaaacacuuauacauaugagauagauacuauuuagagaugguuucucugcguugcacaggcuggcuucaaacucuggggcucaagcaauuauccuuggccccaggcuccaaaguucggggacuacuguggccagcuacaaauccacuuuaaacgcaggagcugaugcuuaguggugugacucacggggccuuccugcagugagagauccccagcagcaucugcaauggaaacagacuagaauccuaagcagaaaauguuuuacucacgguggcaaagguggaauagaaaagccucuucuccagcuuauuuccuucuguuaacgucaucucaaaggcuggaaaggaaaccccggcgucaccaacugaagugccaaacguguagguacaugccaggcugacugugaccuacagaaagggcuacaggcuuggcauggacuccacacugacccagcucuccccguuucucaagugaauggccuguguugauguagccauaugaauacccugcucuccuaggccacccaaacaccuuaguagugguccagggaucucagaaaagcaccagaacugaacaaaguacaaauagcagaaucuggccagcuaagaggaccugagguggcugguaaaacugaacauagaaacacagaaaaggauaagaagcagaagaaggguggcuaugcagcagggacagcacccgcugggaucuucuuccaauggagaacauuguccuguagagcagugcucugaaggaucugagcuaugacuaugccugccaccgugaccuuaccagaagccuuaguugugcccugugugcuccacaaauagcuggcucuuuaaacaccaacuccccugauuguggccaacagcaacccugaaagacugguguacccucuggagguagcaacaacuuuucugagucacauuuuuuuuuuuuuuuuuuuuuuuuuuugcccccaagaugacucuacauguaagcagaaacacagugccauuccaaaugcugagauaaacuauuacauuaagacuccauuccugggacuggagagaugauucgguggcuaagaacacuugagcucuugcagagaaccuggguucucuccacagagaggcucaugacuguccaacguccuucaccgcaccauguacacaugugauguacauacacauaggcaaccaaacacacauaaaaauaaaaaauuuagaacaaccacaaaaacuccacucagaugguauuccacaaauccuucuaccucuagcccugagagaucugcugcccuccacacaugaaaaggcacacagacccacauacacacacacacgugcauauaaauucacauacauguuaauaaauaacagaacucuacuaagaaaagacuccaagcuggaugugguacaugugaaacaugccuauaauccuagcaacagaggcaggugaaugcagaguuugagggcagcuucaguuauauagagagaccuugucucaaaaucuaaacaacaggaugaguuagauggcucaguggauaacagcccgaguugccuggccuaacgacaacuggaauucaaucucuggaacccauauggugaaggagguaacugacuccucagaucauccucugaccuccacaugugcaccacaggaugcccccucaguaaguuaaaaugugaaauauauaacuacacgggucuauuuaaagagaagaagaaggaaaagguugagguagcucugaggaaagcaagugagaccagcgucaugaggugagaaaacugauggaaugcuucuuuugaacuaugcuacugcaggccccaggcuacagcccacuugcauaaccagaacaugggcacaggagggaaccauucaauucagauccccagagacagcugucccaggaagcacagaccacuaacuucagggcuguggcuacacucuuagucuucccucugugccugauacugcauugccauuauguuccuagccuggcccagccuuggguccugguauaaagagauacucagaauagcuuauuagaccuuugagugaccaaaccuggaacacuauggcaaaccgcaauucugagaacuuucccauugcugccugggacaagguaggguaguuuggaaccucacaacuucaccucugcaguccuguggccucuuccccgcagacuccuaccugcauucacagauucuuucgccauggcuacuacgauuuuagaauugcuggcaauuuuuucugcacauuggauggcuucuucaaccaguuuuucaacaggaaaaaucuugcuuacaagaccuaaaacaugaaaagucugaguauuaugcagaaauaucccuguccacuuccucuagaacccagugacaucgagaggccaguucccuggguccuuaacaagggauggcuguccccagcagugggugacucugggcucuccacugacgggcuccagucacaugcugucuacaggaucaaauggaacagaggacuugaggacuguggucacuggcaagggcaggaaaaaaggcuggccuuuaagagcuuuuaaaggcaguggaaagagauguuguuauuauuucuaaccugaacauauguugccacucucugguauaugauguauuucaagauauaaaagcuaaggacagaaccuuagggcuccaacaccagcuacccacggggacaccugaagcagccuaugccuuccccagcucccagcaucagauaccucaccugccugcuuugcauccugagcugagaugcggucaccagugaggaccaucuccauugcuagcgauuugccgacugcucgggugagucucugagugccuccagcaccuacagggagagagcugaggucucaccuggcccuuugucaggugacacugagaagaaacccagggcugggauguagcucagugacagaagaggcuuuagcgcgaggccaagggauccuucucggcauuaaaaaggaagaaagaaaaaucaaauuggcuccuuucccaccaugauggaagaagguuccaggucuaccuucuccaggucggccuugccuucuccaggucggccugcaccaauacacugcucucucugcucagaaucucagaacaagccuggucaagccuggucaagccuggagaguagcagagaccuccucugaauguggucucuucucugagggcucaaguccuuucucugaauguucaucuccuccugccaggucuaaguggcuccuggagggcaaugcuauugcuuccuccauaucuuagggcuuucccaggcaguggggagugaggaucccccaauccgcugugcugaacucagggaagcuuccugaccuguuacgccacuggcauaggaauggacagagccagacucacaugggacagaguuuucgguguaaacccaagucuacucaucuuugucccaagcucgugacauacaaagcucuuaaagguguguggaucaugggcaggaaagaaccauuguggcucaagccaguaaacucuguguuuaugauacuguuggauuuaggaucuguauauucaugagagaugggcauguccugaggcuuccagacugcgcuaagugucauaugcugucuuucaggugccgguuggcggagagaaaacugaacggacaagaaaggcuaagacucaggcuucuccugcuacagcucaccuauucuuucuuuuuuaaagauuuauuuauuuauauguaaguacacugucacugucuucagacaccccagaagagggcaucagaucucauuacagaugguugugagccaccaugugguugcucggauuugaacucaggaccuucagaagagcagucagugcucuuaaccacugagccaucucuccagcccccagcucacauauucuuaccugggaugguccccaggaggauuucuggcuguccgaacugggcuuucucgccagcauagaugauaucacacaucauggcaaguucacaacccccaccaagcugaaaaauaagaauguucagaagcagcuggauuugaccagaggagcccaggcagaaaaccacucuguuugcuuauagaacuuuucuggaaccaugaaacagagucagauaagagcaaauguuaacuuagcugaacaaaacuagauuuaagugguaggauaaacauaaggguaauguugcuccccuuagcugggugcauagacuuuuaugcaaagggccaggcaguaaauauuuguggcuuuguggugaauaacucagucuggcauaguggcuccaaaucagccacagaggguaaaagcaugaauuugaguggcugaccaacccuaccaggauggcuuuuauucaauaaucagcauguauaauaaucacauggcuuuuccaugggcuaagcuagugcugcauuucucaauagccuagugaaacaggaacccuugugggcguccagacagaguacucacagccuucacacaaguagcuuagccacugcagcaauuaaaaagaaacagaaaaguucacuaaggcaucugggaacucgccaacgggccuccaucaaacaaagcagauagcaaaagacacuauuggcuuuuaaaggcacaggaggccccuggggagcugucacuuacagcauaaccauugacagcugcgaugaccgguuucuugacccgggugauguggucccaguggcucaggaacuugcuggaguaacaguccugaaauguucgguucugcauuuccuugaugucagcuccagcuacggguagaagugcggguucaaugaccagacauuaaagaacuucucaguccucaaggcuugggggcacuucccuccacaguggggacagcugagacauggaccaacaacucaccaagccaucuguuuuaagaagguaauguugaggacugugucaggcaguggguggcagguacacuuagaggaggaccggcuuagaccaguguuuaccugacuaguaaggaacugagcauaccugaauguucaacacaugcccugcucuuccacacagcuuacuuuacagguuaguauaucuuaaggcaccccucucaucacagagaaacugguccauuuugcugcuucccacaggcccuagcauuccccucccauccacaaccauggcugcacaccugcaaaggccuuauccccaccagugagcacaauggcacccacagcaggaucuugcucaaaggucuccagugcuugguugagcuccucaaucaggccauugcaaagugcauugagugcuuuggggcgguucaacuggaucagccccacgcugcuauucuuuccuuucuuuucugugaugauguacugaaaguuagcaccuaggucaagaggacaaagggaagugucaucauaaagauauuaaagucaccgugguugguuaaucuuggucaucaaccugaccacaucgccaaucaacuaacacccaagccuuaccuguggaagacuuucuuucuuucuuucuuucuuuuuuuuuuuuuuuggggggggguuuucgagacaggguuucucuguauagcccugguugucauggaacucacuuuguagaccaggcuggccucaaacucagaaauccgccugccucugccuccugagugcugggauuaaaggagugugccaccacacccagcggaagauuuucuuaaauggcucuuuugaggugaaacgacccaacccuaagucugggucauacuuguugguagcccacauaaaagaacaugaaagggggcuggagagauggcucagcgguuaagagcacugacugcucuuccagagguccugaguucaaaucccagcaaccacaugguggcucacaaccaucuauaaugagaucugaugcccucuucuggugugucagaagacagcuacaguguacuuacauauaauaaauaaauaaauaaauaaauaaaucuaaaagaagaagaagaagaagaacaacaacaacauggaagaaagaaacuuuugaucuuugccugcuugcucucacucuugauggcaaguucaccuaauuuuuuguuuguuuguuuugguuguuuugagacaagguuucucuggcugucuuggauuucacuauguagaccagucuggccuggacucagagaucugccugccucugccucccaagugcugagauuaaaagugugugccaccaccagguaacuaaucuacucuuaaggcacuccuucucugguguuugaaccuaguucuucaagauuccaauauacacuuaagacccucagcucucuagcaguuuucuggacuccaaaaucagauugggccugcugagauauuuagucucuuggacugaauaacuacugaauccuuggccuuucuuucaggaaacauccauuguuggacuacucagaccacaaccuguaagccacucuaauacccccccucccaacgaauagauaauauauauauauauauauauucauucuaucaguucuguacugaaacagguauugacagggaauuguguacuaugcuuacugcuccagccuguagcucuggauaugaucuauccagacaugguggcggcggcacagaccuuuaacccuagcacgcaggaaacagaugcaggugcaucuuccugaguuccagguuaaccuggucuaguuccaggccagccagagcuacauagugagauagugucucaacaaacgaucaaaggaacgaaaaggaaaacucuagcacagaacauucacccucuccccauaugccugcacuuuccagagcagacagcaggcgggagccagccagagcccgggccugcuggagcaguaugccuggugggacagagacugauccaaugcaccauuuguucuaggagaucuggagggccaaccagcucagacuuggggagugcagcccacagacuuaaggugagggagguaaaccugagagugaaggucuguguucugggugauuuguuccguuguaacuuaagugugagguacguuacugaacaguaggcugucuaccauuccgggaagcaggacaugacagccaauccagguugggauucaggaggaacccuugccccagaacgugguuaagaauucacaguggacccagaaacuuaggauacccaagauauaagauacaauuugcuaaacgcaugaaacucaagaagaacgaagaccaaaguguggacacuuugccccuucuuagaauugggaacaaaacacccauggaaggaguuacagagacaaaguuuggagcugagacaaaaggauggaccaucuagagacugcuauauccggggauccaucccauaaucagcuuccaaacgcugaccccauugcauacacuagcaugauuuugcugaaaggacccagauauggcugucucuugugagacuaugccggggccuagcgaacacagaaguggaugcucacagucagcuauuggauggaucacagggcccccaauggaggagcuagagaaaauacccaaggagcuaaaggugcaacccuauagguagaacaacauuaugagcuaaccaguaccccggagcucuugacucuagccgcauauguaucaaaagauggccuagucggccaucaacagaaagaggcccauuggacuugcaaacuuuauaugccccaguacaggggaacgccagggccaaaaagugggaguggguggguaggggagugguggggaggguauggggaacuuuugggauagcauuggaaauguaaaugaggaaaauacuaaauaaaaaauauuaaaaaaaaauucacaguggaguacuagaagucuguagaggaguugagccaaggagugggaagggaggaacuauucagcuggcuaggaaggaaagugggugugucgguaugggcuacgcugauuggguggcuugaaggacacgaucaggagagacuguggaaacagcagagacuagacaggaggcacuauggacaaaccuuucccaauacccaggcugucuuacuuaaccuacuuucacauucucuuaaagcuaccuaaacacaugggauuucacaaccaacaugcauguucccagcugacacucauaaaaguucgagcguugagaagcuauuacacccagagcccucccacuagacauggcuucgaggugcuaggaucuggcugggcuuguaaggugagacuaaggucagacugaggagcggggaacgggguaaggaauugggaaggggucagucgagcgcuggaguuggaggcucagaaggaagaucaccaagcuagagucaguggucacuugcaggaaaucuggguuuaguguggggaugcguacucgaauccaggguccagguacuucagagucaaguguugggagugcaugcuuguggaaguagggggucagacaaaagaucuagaguuaggagagaagggccaggaucaagugaggaugcgugcaggccgggguuuagggaccacccagagguuauggguggagaaaccacccaacguggguggggugacgcaccccgccgguguccgcacucacccgaggcgaagcgccguaguucugggcagcggacugaggacaacagugagcuacaggcucugggcagcagagcacgcagggccgccauggcggagagacgauguguuccgcccacagaaucgccccgccugcagaaucgcuccgccccagaucccaggcgggaugaagacg

SEQ ID NO: 4171 - RNA, 2680 nt, Mus musculus
cuucucauagugcauccaguucucaaccuguuccacccauuccauguccugucucugcuccuucuaucccuaguccauggcuuuccucucuggguccuuugggccuuagggcccaugguugcccuuuguccuguuauuggaggcguucccaggguuccccacagcuguuguccaggacuauggcuaaugaaucuuccuuugaucauuaagggauuggugucaggugcccuagacugguaggcuaaaugguccuguagaacugagaagaccgugaggcaaggagaugacacagccuauccugaccuggcuuggggauuugggagaaggugaagaauaaaaaggcuuaaagacuauuggggguuagguuggccaaacacagggagggcguggugaaugagagaauauggaguaagggugcuggggagccaggugugugugguagaugugaggagugugcuagguaggucaggcucuuggauauuuuuguagucuggucucauugucgucacagcagcugcagaggacaggucuguugcuccugguuacagcggagacaggacauuuagacuauuaacuuccucauguuguagcugccacagggcuugcacaucuccucuggagaugguugaggcuggagagguugguguagcgagccuaucuagugagauauugucucaaaaggguggagcuccagagggagcucgaagaguuugcagagacgcuugucccagcuugucccauccuugcacagcaugguacugucacuagccccagguuuggcauggcugagggcaagcccuccugcuuguauuuguuauguuuacacuuuugaaacagcucuaggcuugcuucuguccaguccaguccagcucucugcuuggcuacucauccuucaggucuuuaaggcuugcccuagcccccaucccagcaguuugucaugaagcauguuauaucauaaggacacuuccugcuuuaaugucaccaggcugcccuugcaacaccauggaagaaagccaguacucuaacagguuuuuacuguagucuacagcuugaggacugagaaagcacagaucuuucaagggcaaaagucuuuguuguugacacucagggacacauuucaguuuucagaggagugacuuugcgggacgggggacaggcuugccaggaggaucugagcugcuagggauggguuggggcucuuccaugauggagacugccuugacagaccuaggacuuuaaacuuacaaucugggcacauccccucacuggacucccccauuuuccuuuugagacaacaucucacucugacccaggcuggcuuugaaauuucuauucugccucagucucacaagggcugggcuuauaguaugugccugucuggaggccugggggugauaguaguacuggguaucaaacccaaggcuuccugcauucaaggcaaccauuauaacauugaguuacaugucaaccccuuuuauuugagauagugucucucuuaggguaguuucuaaugccuggcuuccccuggccucuaucauccuuagcugguaucacaggccuguucuaccaggagcagcuggauuugcauuuagucuuacaacuaugaagcccacuucacucucauuguauuaaugggaauguagucgguauuuauaacaguuacauuaaaaugucacacuugaaaauggaggcauuacagguguguguguguguguguguguguguguguguguguaacacuugaaaguucuaaggcaggcccgggaacugauaggggacaacucaauuuccuuacauugauuuauaugaguauacgagggagaaagacgacuuuuuuuagacugccucaugaagcucaggcugacccugaguuccugacccucuugccucaaaucucucauaugcuaggauuacuggugugugcugucacaccugccugaguuuugguagcguaggcuacaaagugagauauugucucaaaaggaagaaaaaugugccuagauuuuaaguuuaaauuucuaggccaauuucccaccauggagaagccacaucuucauugccagcagcccaauuucuucuggcuucccuaugaaacccuagaaucuugggcaugcuaggccaggccagcuuguuauccuccaugcuauauauccucaaaccugaaagauuuggaauauagugaaaaaucuccagauugggacuggagagauggcuuggagguuaagaaugauugcugcuauugcacaggacugaaguucaauucucagcacccagucaaacaacucaaaagccccuguaauuccagguccagaggauccacuggcuucugggcguauccgcuaacacauggcauacacagacacuucaaauaaaaauauaaagggcccccaauggaggagcuagagaaagcacccaaggaacuaaagggaacugcaacccuauagguggaacaacaauaugaacuaacuaguaccccggagcucuugucucuagcugcauauguaucaaaagauggcccaguaggccaucacuggaaagagaggcccauuagacuugcaaacuuuauaugccccaguacaggggaacgccagggcaaaaaaaggggagugggaagguggguauggggaacuuuugggauagcauuggaaauguaaaugaggaaaauaccuauuaaaaauga

SEQ ID NO: 4172 - RNA, 13225 nt, Mus musculus
caugcgcagucgcgcacggaacccaggcgcgccggaacccugugagcagauccaggcccuggcggaggcgguccgacugcgaacucuuccgacaccagugacaugaggcuguggccgcaggcauggggugccguccggggcgcuuggcgcgagugcuucccucugcaaggucacgauguagcacgcugguuccccggccacauggccaagggugaggccagcaugggcugcaggcggcacgggcgccgguccuggcgguuccuugguucgccuuccuggcaucggguuggagagcuguuuugugcuugauacuuuugagacgcacugaguggucccuuuaagucacaugcaagcugaugucugaguuuauaggucacaacuuggccccaggcagcuguagacguagugcgguccuaggcugcuguuugcuguggucuuggcugccgcagccaugcgagauuauaguguguggcagaaaaggcgccgggagugugaguggacagguggcaguugcggugcggagccucaguguuucugugcagugaggguauuaaguccgcacaguaucaggaacuuccugauuaagaccaucuugugugaaauguaccuuccagaaccaucggggcaccguggaacguggcucagaaugcugccuccuuuaacccugugugcacugaugguucucagauguauuccccuaggagaacuuaaacuugcccccuuuggcuguuuccuuagugccccucuauuuucuaggacuaaagaagaugcagagcagucugaagucgguggauuguguuaucgagguucaugacgccaggauauccuuuuacgcuguagaggggagcaccucugcucgacuguaaaggcagcagcaggaugcuuuccugguuccucuccaucuccuucagacaguuuagucugcucugccucugguccaucauuaugucuacagcugcgacagcuucuuuuguaauuacugggacauaaagcaguguuuuccaauucucauuacacauuagaguucccgggaggcuuuuacaucaauagcuagggcccuuuuagaucagaaucucccucguggggucuaggcugguguuuuuauuuuuaggcucccaucugauaucucucccccccccccccccccagacaggguuucucuuuauagcccuggcuguccuggaacucacucuguagaccaggcugaccuugaacucagaaauccgccugccucugccucccaagugcugggauuaaaggcgugugccacuacgcccggcccaucugauaucuuauuugucucagccucuuguuuacuuugauauuuuuagggguaaauuaugaaaccggagaugaaaugauccuacuaaccuguccuuuccucuuguccuuaauugaagaauuggcaaguuacaaucaugucuacuggcaggugcuucucagacuguuuguugcauuuaagcuguguuugguuucuguuggcaugugaguuuuucauccugcuuacuuagccuuagaagagcguggggaugccagaccaccaggccccuggaacagcagcugguggugggcguggggaccugcugccacuggugguagucucuggaaauagucauggagaauaggaacuauuucagccuucagagaacuucaggaacuuuagcaauaauacaucugguguauuuguuuuaggcuauacaugucuacucaucuaauaucaccugcugccagaugugaccaccaccaccaccaccaccaccgccaaccaccacuauugacauagggucuaacacuguagucuugacuggccugaagcucacuauguagaccaggaugaccuggaacucacauagaucugugugcaaggaguaaaguuguguccaccauuccucccaauauuugauuauuuaaaaaguaaaacuuuguuauuuucagcauguaugaugagagaacuguccuccuucagucucuggaacacuuaacugaaucuaggauguggcaggaggucugugcuggguagcgguuucuguagcaucuuaggacaggagccuggagacuuggguuugugaauggauuggucagcugugaaagagggacuaucuagauggagguagcagcuuaacugggugccagaugggacaggcagaggccuuaggauccuuguaccagauccuacugggagggcugaaggggcagaagccccauucugccuaugucacaugguggagucccacaucagacugggauagcugaggauagcugugggcagcagcaucuccagugaggaugggugguguuugagguuaucugggugggauuucacaggagucaccauuucuuaaauguucgggccauuucacuuucaauuuaaauuccuugggauccaaacaauggcuucucuucgaacuuugguuuuauucuuuucaccaucugcuugagaaguuaggugacagucccuucccuaaaucacacccuucacaagcugcaacaugaggguuggccucccaagucugggggcaggaagauggguuguaugguugcacuugcucugagaugggcuucuuuguuuguaucuccugguggacuagccacugguaaacucuguagggauuaugccuuaacaucaucagcacaucccauuuucaggucgaaacccucuguuccaagagcugcuuggucugaaaccgcaucugcuuguccucaacaaaauggacuuggcagaucuuacagagcagcaggugagcuccuucucacagaugccagcagcaacgugacagagccacagacacagaggaguucugugaugcccccggggaggcuguaacuuaaaacaacuucuggcuuugauggaggcgucuggccuggcuuuuuagcaacagcugauucccucaguaugaaaguaucaccuaagugcucacgaugggcacaccuccugugggaaguggguuggugugcugugggaccucuggggaccacuacagccacuuuguacccucaaccuuucugauggaugcucuguccaccuugucccauguaggcacaugugaccacugaagcaaagggggcugauuacauuuuacuuagcucuaacuaauugggagauucgcaagguuaauguauguagcccuggucaccguugguguagcccggaguucauuugugguagcugcagugucccuagcugacuauguacccagccugaucucagguuuucugcugcuaguugcuuucugcacacuuguguuccagaaauuggaagggcuggguaugggacugggauaugaaaagcccaaaguacccaacagugucuagcgcagugguucucaacuucccaaugcugugacucuuuaauacaguuuuguugauauuuuauaacuguaauuuugcuacuguuaugaguugugaauaucuguguuuugugacugucuuaggcagcaccugggaaagggucguucauucgaaccucaaaggggucgagauucacagguugagaaccaaugcucuaaauucaggcagaauugggucacagggcaguguauuuucuacacagccugcaaguaaaaaaugacagccaggaauggauuugaagucuuggcuuuacuuuuuaucacugugcugucaaauucuuuggaaagggggaugacagggccuugaauucaagccagauuuuagaaaguugcuagcuuguuagugacacagaaauuuuuuccuuuacugaagagcugcagcucuuagggaaaggucaggaggcucuccaaggcgguugccagggcagcaccuuccuccaggcuuagaucgacagcgcugcuugucugucucgcgaguaucucggucuugcaucguuuguuuguuuguuuguuugcuuuuaucuuuaagugccuuccccugguuuuuauuaaucgagauucuagcuguuuaggaauugcuucagugcgucaaagcacgacuuuacagacugguguacgcugcccucuacugggcaggcaaaggugagccgaguaccaggcuuuugaaggcccuuagacuccacccccacggucuguacuagagggacguuugaguacauuuucuuggauaacagagaucagucucugucauggcuaguaccgauucuauuucccuccaagauuuaauuaauuaauuacuuuauuuauuuauuuaguguaugaguguuuuccauguuuauauguauguauguauguauguaugugcaauauacaugugugccgggugcucgcaggggccagaagaggguguuggauccccugaaacuggaaucgugauuuguaugagugcugggaaccaaacuugcaagagcaugaaagugcucuuaaccuuucagcccccgacucccccccccaaguaucuuaauuguaucauaugugacaaauaacucaaaauauauuaaacugacagcauuaaugaauuacuuuuugcuuauuuaagcauuuaauaugcuuugugguuagugaugaccaaacacaaucaugacuuucaacgcauauugauagaugugaauauaaacgauguauacugauuauacugacuauuaaacguaaugacuuugugccagcucuaauguucucuugucacuacuuauuuucuauaauaagaucgagcucaauaucaucucagucuacaguaaagucccacgcuggaugucaugguacacgcuuuuuuugcuaaaacgugggcagaggcaggcagaucucuaugagauccaggacagcuuggucuacauagugaauuccaggccagccaaggcuacauagugaaagccuguuucaguuuccccuccucuucccaagggagucuuauaugauacagcacgugaaagugacggauuccucagagaagccagcaccugugagcuuggugcugaagaggccgaagugaccugguucaguccgcuuuguccccagaagcacugaggucccugugagcaggccaugccccccugguguucacccuggcagagccugaggcacacauacagcacagcuaggucugcccgagggcucuucccccugcucucuccucagagcccuuuccuugugcuugcuggcacccacgucuuguugccgggcuccuagaguuagggcugaugcagagcagagagcaccugcaguguccuuucaagcuuagagccuuaccuaacuucuuaccuguuuuugagacagggucucacucuguaagacuugcuggccuggaacauguugugucgggacaggggugacgucaacucacagagauccacccgugucugccuucugagugcugggauuaaaggcaggugccaccuggccaaccagauuacuuuuuaaaaaccaugcuuuuuuuuuacauuuauuauucauuuacuugugugugugugugugugcgugugugugugcgugugugugugugcgugcgugcgugcgugugcgcgugcgugcgugugugcgugugugugugccauggcauacagguugaggucagaggacaacuuggaggugucaguucuuuccuucuacucucuaggccugggcauugaacucagguugucaggcuuagcaucaagcgccuuuaccagccaucucacuggccccaagcucagaaccuugaguuuuauauaucacaccauauguguguguguguauguguaaauaauguauauauauauacauacauguguauauauguguauauguuugaauguuuacuugcuguuguuuguuaaucuuuguuuuuauuuuuugguaaauggguguuuugccugcuucuauguuuaugcaccacacuuaugcagugccuguggaggccagaagaaggcauugaaugcccugggacuggaguuauagauuauuguuagcugccaggaggguaccgggaaucaaacugguccucuggaagaguagccggugcucuuaacugcugagccaucucuccugcccugaucuccugacccgcccccccccccccaacucucucucucucucucucucucucucucucucucucucucacacacacacacacacacacacacuuuaauuuuuaauuuauuuuagacagggucuuucuguguaguacugggauuaaaggcauauaccaccacgucugaaugucauaccauucauauuuaauuuaguauuuaaauuuaauuuaguauuuaaaauagaaauguaucuuucagaaaauuguccagcgcuuagaagaaaaaggccugagcaacguucucuucacgaacugugugaaagaugaaaacaucaagcagguugguaaggcucugugcacguuagcugcuaaacagucgggaugagauccuggaucuggcuucagcugcccagggaugcaggaucugcagggcaggaugcugccugucuccucugugugugcucacagucugagggaguguugagggagucugcugggguucuaaguaauuaaugagagccucuugcagaacccgguagcuuauuuuccuguuuguuuugauggauccccaugaguugauguguggaaugucuacuaggugguuauaguugcuguagaagagcccuccugagguagccacacuccuggguuguguguggguuggguugggaguggguggaugaauuccaauuagcugacuguuggacagguggauacccaugaucgggaugaguaaugaggugugugugaggucucuacccuccuaagcgaggggucaguaaggacaggcucucugacccuguuauuuguaaguggguugaugagggaugcaugaccaaaagauguggccuguuuguugcagauugucccaaaagucauggaacugaucaggugcagcuaccgcuaccaucgagccgagguugguugggugcagagcugggguggguauguggaguuacccagucccuuccuaccugccguucugagccuucuuuaauacagaagacugggcugugucccagccaggacccagccuuuguuuuuacuguucuuuagugggaaaugcuggucuuuguguugaugucccuuuccucugggcugugguuucauaaccuggguuggauaaaguugaaacucuucugcuuccacagaccccagaauacugcaucaugguggucgguguccccaauguaggcaaauccucccucaucaacucccugaggcggcagcaccucaggacagguaggcagucucugcugugcugacuuccauuccuagagggcacuguggaagagugaggucagcccuauguugcuuuguggcguuccuuccauagcucauggccugcucuguccgcuaaaaggacaguucauggucugauggugaacagcccuuggcuacacaguguguacuuaugugcuuucacaugcucuugguaguguauguauuuuagacuuugggauaaauuuauauugccuucauuuuuuuuguacuaauaguauagucuuuauuaauuauuuucuuuuuucuuuuguuuuacaaagccagauaugguagcacaugccuuuaacccagcucuugggaggcagagacagagaggcagaggcccugucugcaaaauacaauacaagacuacaacaacaaaauccauuuauaguguaaaggccaagagcuuuaaaucauguuguaucacuuuagaaaggagcuguugggguauuaauugcagagcugucacagucauuuaauuuuuaaguguuguuuccuuuaagugcgcaucuucucuguuuagaggcauuaaguuuguuuauaggguugugccggcauccccacuauccacacuuuaaaccaccugagaccgaagcuccaagcacagcauccuguucucugccccagugccuggcagcccuguucuaucucaguccaacugugucaauagagugcuggugcuggcuugucucaguagaauguucuagguuugguuauguugggauuuuaucagcaguuccuuccuccuuagguccaaguuauucugcugucuacucuguccuuauuccucuggucaucuaugauggacacuuuuauccuuuuauuucugugaugguuugacagugaauaguuagcuucccagggguacaugggcuagguccacgccaggcaaccacaguguuggaucagggauggugcuggccugccugcuguggguagugcuguagaguaggggaguccaggagaggcuuugagguggaggaguagcucuggcaugaccuuggcacuagggugggaagugagcugcacugggaagugagcucugggcauuugucagcccuuggccacugugccuagcucuugaaaacccuugccauguguucuuugagacugaguaaggaacaaauuauaauuugacaaacuuacgaggucuggguuuccaaucugcucgugggauauguuagugaaauaccuuucauuccuuguuucauugcuguaugcacagauuugauggacauuuugugucuuuucaggaaaagcugccagagugggaggugagccaggaaucacaagagcugugacauccagaauccagguggggucccugguagcugaggccagaguucuguccagagcuuugcaggcucugccgagucuggcuccagugagcacagcauuggcugugaucugaccgccauccuuucucucccuucauguucccaccagugcugcugcccuguggaaguccaucagaaaggcagccuucuucccagagccacacuuaugcauucccuuuuauuuucauguucccaccagugcugcugcccuguggaaauccaucagaaaggcagccuucuucccagagccacacuuaugcauucccuuuuauuuucauguucccaccagugcugcugcccuguggaaauccaucagaaaggcagccuucuucccagagccacacuuaugcauucccuuuuauuuucauguucccaccagugcuucugccccuguggaaauccaucagaaaggcagccuucuucccagagccacacuuaugcauucccuuuuauuuucauguucccaccagugcuucugccccuguggaaauccaucagaaaggcagccuucuucccagagccacacuuaugcauucccuuuuauuuucauggaccucagacuuguaguucuucaaauuaagcagaaauuauacccuauggggauucuauaccucagugcaaaagccaaccuaugugguggguuuauccagaggccugccucagagucucaggcaaugauuuggcuguugggcacaggcugccugacuugacccaccuucugcugcacagguaugugagcguccacugguauucuugcuggauacuccuggggugcuggcuccucggauugaaagcguggagacaggccugaagcuggcccugugugguaagccucugccccacugcugaccuugacuguucccucgguagaaggacuuguugcucccucuucccuuccugauaccagaugcucugcacaguuuugaaagggcgacuagcucccagcaugcaugugcuggcugccauucugcccugcaguagggguagacagagaguccgugcuggacaaccaagccacaugccauagaggaagaaggccaacacugugagcugaccugcugggaggcuccuuaagcuugaggccuucugccuucaacuaggaggcauucaggcuugguggggcauagaugccuacuguaccaugggcuuccauuagcugcgugucuugcaggaacuguguuggaccaccuuguuggggaagagaccauggccgauuaucuccuuuacacccucaacaggcaugggcucuuugggugaguggcagugucuauggggggcuguaguucccuucuugcucaugcugucuagguaugguuuuagaaauaugucauuaaguuauuauauaauuuacauauuauuacaagugugugauuugauaaguuuugauaugugaccacaucauauugucacccaaggcagcggacauucugcuggguguggugguccaugucccagauccuaguacgugugauacugagagagggggaucauaagucugggacuggcugggcugcauauguagcauggcccuuguucacuuugucgcuucccuaagccccugugggugaguggagaagaugagaauucugucagugacguuguacaggaugccuccccacccccaacuuccccuccugggcagcacaagcgucccgagccucccaggcucugcauuccuuuugauggcucagcucguugucuaucacccagacaucugcacuugguuuaucuguucacccuggcggacaugggguguguguaguccuuggcugcuauaaacaaagcuucuggagacguucauguggguuucuccuugucuuggguagaaugcaggagaaggucggagccacucgagaauggugagcuuuagcuuccuacaggaugcugagccguucuccagagcauuggccugugccgugcaccgccuagcagagaacagggcuccacacucucccgcauccucuuuacacuuguggcucgucuuuuauacuuuuggguuuaauuguuuuauuuaauguuuaugaaguuugcuugccugccugcaugucuuuacagcauaugcaugcagcaccuguagaggagagcaucacauguccuagaccuggcauuauagaccguugugagcagucacggggaugcugagagacuuacccagguccucugcgagagccuccaagccaugucucagcccuggccaguuuuaacuuuagccucacagucugcaggguuuggugcauauuccuacuagugugaugcagucuuaacuuuagccucacagucugcaggguuuggugcauauuccuacuagugugaugcugagcaucuuuuccuguaucuauggggccaucaauguaucuucucugagaaaaugucuguuaaauauuuuucuccuuuaaaaauuuuauuuuggggcuggagagaugacucagcaguuaagagcauggacugcucuuccagagguucugaguucaauucccagcaaccacaugguggcucacaaccaucuguaaugagaucugaugcccgcuucuggcaugucugcagagagugacacuguacucagauacacuaaauaaauaaaucuuuuuaaaaaagugaaauaaaaauuuuauuuuauguguauggguauuuuaccuggugcccauggaggccagaaaaggguguccaguccccugaaacugguauuauagccaucaugugggcacugggaauugaacccaauuucucuggaagcacaguaaguacucuuaaccauugagccaucucucuagaccaccaucccuuuuuguuuuugguuuuugagacagggucucuccacauggcccaggcuuuucacaaagaucugucugccucugccuccugcauuugagauuaaaggcaugcaccaccauauucggccuccucucugucucucugucucugccucugucucccgaugcuggggauugaaccugggacugaauauaguaaguauauguuccacugcugagcugccucccaacccauuuucuuaucuuuaaguugcaccgugagggauaaggucuauacaaaguuuuucaggagucuaggccuugccuuuucuucuguucacacuguauucuuaguuuuggauucugguuuaguaagaauauacuucauaauggugcugcuucauaccuagagcuaugccuagccugaggccauagagguuuguuuucuucuugaagaguggcagcuuaggcaucacauuuagguguaugacugccucugccauguaucaacauaugccuaguguauggcacaacuaugaaguucuuaguuuugcacauggaugacuggcuguccagaaaauuuuguugaagacuuuuccucacuaaauuguccuucugccuuugcugggaauccauuuugucucugucuguuuguggacacuucuguccuguacugucuuggugagggauuggucacuuuugacugggugucaggcauuugaauuuuacacugauaggugauuaaguccuuauguuucuguaagaaucugugagccuuguucuagagcacuaaauugccuggaagcaauuuggucuucccaggaacccaggcgcuggcucaucugaggugugggugagugugacuccuucucaggcucggagccucacaagucugaccugagcuaugggcuuccagguaugugcagcacuaugcccuggccagcgccugugaccaaauagagugggugcugaagaacguggcuaucaagcugaggaagacgcggaaagugaagguucucacaggcacaggugaguguggcugcacgguaugguaugaggcccuuacucugccuucuguuggggacaggagugagacacagaaggaaaccugugggcaggacacuguggaaguuucuaggguggaaggaccuuguaguuuaggcuuuggagggugguccuagcucuggacagugcuggguggcuaugaugcuuguguucuuucugaacaugcccuggucccuagauuucaggggguggcccuaguggucucucagggccgggcugucuuaggggccccuuucucaucagauccucuguccucagguaaugucaauguuauccagccugauuaugccauggcagcccgagacuuccuccggaccuuccgcagugggcuguugggccaggugaugcuggaccgugacauuauaccugcuugcugaugacguuaaccccuggacuggcuggcuggaguauggucuccugcauaguccaugugacugcagcuggaguguuuaaugcuuaggacuguuccuccaguucagaagcucucugugcugguaacugaggcucaggccccagcuccaaagggcgcuauguucucuugucuaucagagccuggucaguccugguuacuaccaugagaccccaggagugcuguguauguggcuuggucaggagguuuucuccaucucaaguaagagacaaaugcuaucucagaggagucuaaguuauaaucuguaauuuaaaauaaaauggguuaaaaggcccacuuuaaaaaaaaaucucucucuggcuucucuuauuuuacuuuauuuauuuuuuugucauuuucagacaaaguuucaucauguggcuugggcuggucucaaacacauuccuucugccuuagccucuugagugcuggaauuauacaggugugugccaugacaaccgauuaaaagaccuauuuucuga

SEQ ID NO: 4173 - RNA, 4728 nt, Mus musculus
ucagguaaugucaauguuauccagccugauuaugccauggcagcccgagacuuccuccggaccuuccgcagugggcuguugggccaggugaugcuggaccgugacauuauaccugcuugcugaugacguuaaccccuggacuggcuggcuggaguauggucuccugcauaguccaugugacugcagcuggaguguuuaaugcuuaggacuguuccuccaguucagaagcucucugugcugguaacugaggcucaggccccagcuccaaagggcgcuauguucucuugucuaucagagccuggucaguccugguuacuaccaugagaccccaggagugcuguguauguggcuuggucaggagguuuucuccaucucaaguaagagacaaaugcuaucucagaggagucuaaguuauaaucuguaauuuaaaauaaaauggguuaaaaggcccacuuuaaaaaaaaaucucucucuggcuucucuuauuuuacuuuauuuauuuuuuugucauuuucagacaaaguuucaucauguggcuugggcuggucucaaacacauuccuucugccuuagccucuugagugcuggaauuauacaggugugugccaugacaaccgauuaaaagaccuauuuucugauggcguuuucauugugcacuuaguauggugagcccauaaguuaaaucuccuucuaucaaugaaugcugaggagugguagauuagaggccugggguuccuaagucagauucucaagugucucaaaguccugcaaugagggaaaagccuguuaccagcagagggcuuuauuucacaaggaacucuucacugauaaagugcacagacacggacaggaggucugcagcagagaaguccaggaaugucaucuccccuugcacuucagggccuguaccucaggaggccugcugcuguagcucaacuuuguacaggccaagaggaucacuggaaggggcucacagucuagccauugaaaccaugguggcugcaggggcggugcagagggcauguaccagcaugguugaccuccaaauaccuguaggcaccuagaagauguugcugccagcagcuugcugucuaaaaagaaaaggcaagggguuggucgauacagauaggaagugcuguugggccagggggcuaucccugcucaggaguuuuagucucuucuguucgguauugaccugagcuuuccauaguugcuugaaccaguacuuggaugcucaauaggcucucugcuucuuguggauggcugauagcagggguagccucccacuguugccuuuugcuguggcugcaguauuauaagucucuucugagauucucccucagcaucuauaguuccugcuaguggagaagguauuuaaagauguguggcugugccagaugcuaaacacgcuggagaagucagauuggugaauguaaaauaaucaucgaaaggugauguguucauaaugccacaauacccagaacuaacacaugguacucugugguacacaaaggucugguccacauaguccauccucauggguguuggacaaguugaaggggcucuggugguucucccuauaccagacuugacgcaucagcaccugccuuugaggaccuuagugggcuuggcccuuagcuugcuggucuuggugguuuugagcuuggucuauuagagacauaggagcaucugggcugacugugccugugagcaccggcagugagaauagaaguugcagggaguuguauccugcaaccuguuggucaagaaaaugcuuggcuagggcccugccaauagcuuugaaaccuauacacuagccagagguaugcugagcuagcauauauugacugaaucccaagacccaacacuccauguggcaaagaugugcuagugggucccuggaacagcaagaagccagucugcuuaaagguagauucuugugaggauuauagaguaccucucuaaggccacucagcacaucagcucuguucucaggauguauauggauggucagagagagcuaguagcauuaacccacgcucacaaccugcugaggcugguucuucugucugcuagcuuuguucuggcacaguggggcuguagaucugcugccccuuccacuguucaguuugccagcugucagcugugccaugcucugucucaccuccccaccccaaccccguccaaccguuuccaagggaggggucucccaacauaaaaugcugcuaucuacuggaacuaugggaaucuugcaguuuggguuauauacaaagaaggccccagcaggauugguauuauauccaagugacccucacucaugacccuuaagcucaagcagaauggaauguuuuugaaaguguauucaaaaccucuacccucaguggauuuuaggaccaaguggcuucaaguggaaacccuucugacacaaggucucuuaggcagucugccaggaagaaacauacuacuuggcuuugguagcauguuguaggaggagcauggugggcguccugggaugguuauuuuacugcucuggauguuuucugagcuaugacaucauugggaccugcucugggcaggugguuagcaccugacauuucucacacugcagucuaagugaaugcucucuucaucaacuauaagucccucugguuccaugggaggcucaaggucuuugggggcuuuaguggcagaaucagacgggcccacccaaggauggccucuucuuggcggucagcauuguucauguccucgugucagggugggcaagcagacaggcaugccugcuugggcaguucuggagagucaagggcagccugccucucugguaguagggcuguuaguuccugccagaguggaagacugggaaacugggaugggcaagagaguaaacuacauccacaaauugcaagaggccuugugggcccagaauggccagacucuucucugggcuggggaaucauaguuagcaaaaugaaguuacccccugggcaggaggccauuagggugggcccuaggggccuuaagacaggcuaggagcuagaccugggauggaguuuagccuggucuaaggccgaagcaguucuagggcaccaagggugccgcccagaagcagacaaauacgugggcugugcacggacccugagccggaaguccaggcccaguagcuguagacuccucggucgguuccguugccucccauugccccauucucaucguccuccaggccuagcucuccaggcccugagguccuccuccagccagagccgguagcaaggcccgcagccacacccgcugcagccccugcugcugccccugcagccgccacgcgcagagaggagccguagcggggcgccggccuuacgcguacucuugaugccccgcgugcaccuccgcgcaccccccgggcacugccucgagcgccuccgcggccgcccuuggcggaacagcugucacagaggaaggcggcggccagcagcagagcccagcacguggcagcaguccaguucauccuacugggcagaaucugcgagaagaggguggaaggggcuucagcuucugugcagggguggagcgugguuuaggaccagggcaagaggguaucagggcuugggaauaggcucaucuggaccuggggacaccuacuucagccucugguuuugugguaauccgauagagggcucccagcaucuuggaggacagugggcucaggguuggggaagggguucuuuaaacuccagcaucaggacuuugguuuuggguuccugcuguauaaccagguggagauggggugguggggaaaggguuucacuacagggcggccguuuuacuauugugguaggguggagaugggucccagaaugggguuuguggagcuccuacaguggggcucaggccugggggggggggggcacaaaucccccgcucugcacacgagucucuggaaggggauggauuaguggauuaggauucuaguuuggaauggagagccuucaauacccccagauuaugguuagaauggacagccuugugacuuuugcucuggcaucuggaucuccugaugccuuaagagauagucuuucagccaguggcugcggcugaaugcacugggugagggugggggucagaauccagaucagcgauuccuugcaacgcaaacaacuagcgaugggugaaccgcccagcaggcccagacccuagguaauuacgucucuuccccgcuccagcuccacccuuuuuggguuugcccaggccaguagccuggacagguaaaccgaucaggauggguucuggcuggcuguggaccagccaucucgguggcggcagcuccauccuccucagguccucucuccccucccccucccucccagcaucacuggguucauccaccuccccuacuuacuggucacaagccuaggucggaugagcgauuuaggggccgugaccggccaagcggaaaggugcggcagcgaggacccuuuuccuuaggcagagcucacgacuggauuuugcugaagccuccgccugaagauuaggggcgggcagccgcggaggcucagccccgggagacgugaagggaggagauacugaaagcucagaaaagcacagccacagcccuucucguugcccggcccccauccucgcugcacugcacacagcacccucucaucccauccccccaucuucccauccccgccacagcccugcccaaucucucuuuccccuauggcca

SEQ ID NO: 4174 - RNA, 959 nt, Mus musculus
ccuaggaggaggcgccuagaaccugggcugcucgcugcuguaccuuauguagcgcuugcuugaccucuugguuccgaaggcaguagaugaugggguuaauuaggggugugagcacuguguagacaacagacacaagcuuguuguagucgaaggaguagagggcacggggccgggcauagaugaagagagaagcugaauagaagaugaccaccacggccaggugugaggcgcagguggagaaggccuucugccugccaccggcggagggcaugcguagcacggugcugagaauggccguguaggagaagacagucaacagcaguggccccaacaagaugagcagcgccaggaggaagucuacaagcucugcaacugacaugucagagcaggcaagguugaguaguggggacacaucacagaagaagugguucaugacguuggggccacaguagccuagacgagaaaugaagaagaccuuccccagggaaauggugaagccagacaaccaggagccuccagccaggaggcugcagagaccggggcucaugaugacuggguagcgaagcggguugcagaccgccacauagcggucauaggccaugacacccaagagcgcgcacucgguacaggccagugccaagaagaaguacaguugggccaugcagccugugaaggagaugugcuggaacuugggagagaccaggcugagcaacaucuugggcaccgugacagagauguaccagaucucuaggaaggacagguugcugaggaagagguacauaggcuugugcagugaggggcuggcgcgaaugacugugaugaugaccagguucucugugacagucagcauguaagccagcaagaacagcccuagaaggcuuagguggagccccagggagccugagaauccuacaaggaugaacucagucacaucugagcuguuccuccuggcaaacaug

SEQ ID NO: 4175 - RNA, 441 nt, Mus musculus
aaugguugcccaucaggaagugaacuggucuucaauagugaaaguucaccagaaaaggcccuuuggacuguuccuccccaggguacagggcucagacccacgcagcagcagcucuuccgugaagaaggaagcaaucggagagucagcaaugaauguggaacaugaaguuaaccuccugguggaggaaauuaaucgccuggguuccaaaaaugcugauggaaaauuaagugugaaguuugggguccucuuccagaaugacagaugugccaaucucuuugaagcauugguaggaacucugaaagcugcaaaacgaaggaagauuguuacauacacaggggaacuacuuuugcaagguguucaugaugauguugacauuguauugcugcaagauuaaugugguuugcauggcuugguguaucugauaaacuggaauaauuaagu

SEQ ID NO: 4176 - RNA, 1001 nt, Mus musculus
guccucagaaaaaggaacagagaccucuaccaaaccugugaucccccaguccagcagggcugaaggcaguggugcuggcacaggcucagcagcaggagaaaagucuccggagugcaacuuugacauccuuauuccucagaguguagaugagaggguucaaggugggugccacugagguguagaugauggacaccaccuuguccuuguucagugaguagcuggaugaagggcgaauguagguguagaugacaguggaguaguacauggugaccacgaugaggugugcagagcagguggagaaggcucguugcuugcccucagcugagcggaucuucaggaugcuggccacaauaaagccauaggagaggaugaucacagagaaguucccuacagccaggaacacaucugcagcgaaagccauggccucguucaauuguguuggagcacaagagagcuucaacagugggggaaucucacagaagaagugcucaaccacauuggagcugcagaaugguagacguagcaccaggcuugaguuuaugcugguguuagucaggcugauagcccagacaaugccagccagaaaugcacacacucuggggcccauccagguacuauaaugcagagggcagcagauggccacaaagcggucauaggccauagcugagaagaguagaagcuccacccccagugaccaugugaagaagaagagcugggccaugcagcccccguaagagaugguccuuccccccaccaugguguccaguagcuuggguaggaugguggaggugcaaaggauguccaccacagccagguugaccaggaagaaguacauagggguaugcaggguugggcuggcacugauugucaccauaaugagcagguuuccugagacugcagccauguauaggcauaggaagcugaggaaaaguaguauccgaaggugaggcauaucugagaaucccaggaugaggaacucagugaccagugucccauucauc

SEQ ID NO: 4177 - RNA, 935 nt, Mus musculus
cuuaauuugauaaagagggcaagagucuucucagggcaagcuugacauccuuguuccucaguguauagaugaggggguugaggguuggacugaggacugaguaaaaaaaugagguaaauuugcuucuuucugggcuguagcuggaagcaggacugauauaggcacagaacagagaugaguaguacacagaaaccacgaugaggugggaugagcagguagaaaaggccuuccucuugcccucagcagaacgcaugugcaggaugcuggcaaugaugcagccauaggauagcaagguaaguaaaaaauugaugccuccauaaaaggcaucugccacaagagucauaacgcuauuuacauauguaggacuacaggagagcaggaggagugggggaaucucacagaagaagugggugaugaccuuuggaccacagaaugacagcugugucaucaggccaguguguacagaugcauucacagcacagauggaccauacagccacggccagagcugcacacagcugugggcucauucuagagcuguaguggaggggacagcagauggccacauagcggucauaggccauaacugugagcagcagcacuucagaggauccagaccacagaagaaagaagagcugggccaugcauccuuugaaggagaugguauuuucuucauacaguagaccaaccagcgccuugggcagcacagaggagguacagauaauauccaugguugcuaaguugcauaggaaaaaguacaugggacuguggagcccagugcuggaggugaucaaagcaaugaucaccauguuacccauuaaagccacuguguacagggacaggaaacagcccaucaggaacagucuuagacucgggugcucugagaacccuugcagcacaaacucugucacuacugucugguugggacugaccauu

SEQ ID NO: 4178 - RNA, 6510 nt, Mus musculus
aggaacagcccagucaaggagaauauucuacacaucuccucuuaaugugagaaagaggccaacauccugcccaaggcaagcuugacauccuuguuccucaguguauagaugaggggguugaggguuggacugacgaccgaguauagcacugagguaaauuugcuucuuucugggcuguagcuggaagcaggacugauauaggcacagaacacagaugaguaguacacugagaccacgaugaggugggaugagcagguagaaaaggccuuccucuugcccucagcagaacgcaugcgcaggaugcuggcaaugaugaagccauaagauaacaggguuaacaugaaguugaugccucccagaaagacaucugccacaagugucauaacacuauuaauguauguggaacuacaggagagcaggaggaguggggguaucucacagaagaagugggugaugaccuuggguccacagaaugacagccgugucaucaggccagugugcacagaugcauucacagcacugauggaccauacacccacggccagugcuccacagagcugugggcucauccuagagcuguaguguaggggaaagcagauagccacauagcggucauaggccaugaccgugagcagcaacagcucugcggauguugcccaugcaaggaagaagagcugggccauacaucccuugaaggugaugauguuuuccucagauacuaggccaaucagggccuuaggaaucacagaggaggugcacacaauauccgugguagccagguugcacaggaaaaaguacaugggauuguggaguccagugcuggaggugaccaaagcaaugaucacaauguugcccauuagagccaucauguagagggucaagaagcagccugucaggaacagucuuagaccaggaugcucugagaacccuuccagcacaaacucugucacuccugucugguugagacucaacaacaucauggagagugugggguccacugcuuugucguucagguugaggaaauauuacaguuuuucacuucgaacucuggguucaaacugucuugcugucagaaagggaaggagugaguguauuuuucuuauuaaagccucuugucuuuucuuguauauaccauacuauuggaaagccacauauauuucauuuucuuuuauuucucauaugguaacuuucccccuguaguguuuuauaaaggggaaccuauguucuucucugaucuugaacauucggaaagagagaagcauucuuuacucaguaccuaccuaugcuuuucuucuccauugcuacuaagcccugugcucuggggacagugcuuggugacccagcuguaccccuuacuuucacaucucuuauucuccaccugaugagaauuuuagguaguuacacugaggugauuauuauaucuuuguuuuuacacuuggccuccuuagcugacaggcauuuugucucuucucauaucuggugugguuguccaacuacccauuucaaccagauauuggaacccccauggccaaguagccuuguauuuucugaauuaauuacuguuauuguggucuucucuacuuggaacucuucugacucuaacucacaucaaaucuaugaccauggagaacauuucucaaaacccagcccuaugaaccuagacuguuuauguggcuuuuuugucucaauauaccacagugaacauucaugucaacauacccacaccuaaagucauugccacugucuacagauguuucuuuguaguuucaauauauuuagucagaaauuuacccuuagcuacgcaguguagucuauucccuugagagauucccauuagagucuagcuccaugacccaagaauggucuucuuuacccucuuugccucucuaauccaccugauccucaaugagugcaacuauagcuucccuauccuuacaacucacauucucaaggucuucaguaguuuuauaauuucuggguucuuuucuuuuccaucauuuccaguuuccuuuucuaucacucaaggaauacaaaugguauacuuaugauaacuggccuucugccucagaccaaacucaccauguccugucacagucauccagcaaauaacacuacauaguuugaaguagaagacucauuuaacaucauuagcuuuuuccauauguuccugucugaguauauaugcaaaauacucugccuauguagaaaccuguuugggaaaucauuugcagugcuccucaucuggaaauaucauuuuucagcagucuuccagagaaaucuuucauucacuggaugcaguggaaugcuccacucuccacuuugcuauauaacccuucauuuucuuugcucacauuuuauuucacagaauuuucauaguauggcuuauaaucuauuuucucucuucuuuaguggugaaugcugaauuuuaaacuuuauaucuuccuacauuucaaauuagagauacauaaauauuguauuuaccuuuuggaaccauguggauagugauaugucugacccugucuucuccucccuauucuauugugcuggagaaugccaaugcaugcuuaguauuguucauuguucugcagaaacaaauuccuauaauguucaagggaguuucuugaucagacuaucuaauucaacuacacuugauauuguaaaauacucucuugauuguaccuauaaccaguaauauuugcuuccauuucugguuacacaugucucagaacugaaggaaaagauuuaaaaacaauugaaaccugugacaaacaugugcuauaugauagaaauuuccuaguauuaauaacacuucuauacaaaucuaacuauguggaaaacaaguaacuuuauuccaaaaugauacaccuuagaaaaaaugacagagaaguaaaaucacuggggugaucugaggacccagaaacaugucaacacaucuauggacacaugacuuuuugcaaacagacaaagaaagaaagaaagaaacaaaaaacacacuagaaaaauaauagcauauucaacaaauggugcugguaaaauuggacauuuacauguagaagaaugaaacuagucacuuucucuuacccuguacaaaacucagcugcaauuagaccaaggaccucagcauaagaacaaauauccuaaagaugacaaaggagaaauuauggaauaugcuugcacucauugucacaggaaaggacauucugaacaggaccaugguagcucgagcauuaagugcaauacacaugcuccacuauauucaaaacagccuuauuuauaauagccagaagcuggaaagaacccagauguccuucaacagaaggauggauacagaaaauguggugcauguacacaauggaauauuacucagcuauuaaaaacaacgacuucaugaaauucacaggcaaauggauggaacuagaaaauaccauccuaagugagauaacccagacacagaaacacacacaugguauguacucacugauauguggauauuagcucaaaagcucagaauauccacaaugcaccucacaaaccauauggagcuuaagaagaagggaagacaaaaauauagaugcugcaauucuacauagaaggggaaacaaaacaaucacaggaguuagaaggagggagggcccugggaguaagagaguagggggagggaaaaggggagcaggaucagguauuggaagugacaggagagaaguacagauggucaggaauugaauagaaacauuuagcacugggggauagggaacugggguuagccacuagaaaucccagacuccagggaacccagaaucucccaggacacauugguaaugacuuuagccaaaauaucccccaaaaggagagauauaaccuguagagaccaccuccaguagauagucaugacccuuaguugagagauggggccacccauccaucucaaaaauuuuaaccuagaaaucuuccuguccaaagaaaagacagggauaaaaaauggagcagagacugaaggaaaggccaaccagagaccacccuaccuagggauccaucucauuugcagacaccaaacacucacacuauugcugucaucaagacgcacuugcagaacaggagucuguuaugguuguucccugagagguucuaccagcaucugaccaauaaagaugaagauucucauagccaaccguggggcuaagccugagaaccccagugaaagagcuaggggaaggacugaaggagcugaagggaauugcaaccccauaagaagaacaguaucaacuaacuggaacacucagagcucccagggacuaaaccaccaaccaaagaguguacauggagggggcaauggcuccagcugcauauauagcagagaauggccuuaucuugcaucaaugggaggggaggccuuugguccuguggaggcuugaugccccaucauaggcaaaugcuaaaguagugaggcgggagugggugagugggugaagaagcacccucaaagaggcaaaggggaagggggagaaggaggauggaauggggauuuuguggaggagaaaccuggaaggggaauauugcuugaaauguaaaugauuagaacaccaucauuugcgugaauuggcagacugaagaaugguaucaagucuuuaacaacagcauacgugauagaaaguuaguaucuagaaucuaaaaacaaccaaaaacuuaaaacugccugaaaucaaacaacccagcuaaaaaauaggggaugaaauuuaacauagaauauucagaagaugaaacacaaauagcuaagaaacaguuuuuaauaaauguuaaacauucuaagccuucaaagaaauggaaauuaaaaauauuugagauuuuaucuucucucaguaagaauggugaagauaaaggacagcagcagaugcugucuaguuguagggcaaaugacaauuauuccaggcugguggaauucaaaccacuuccuuaacuguaccuugaaacuguaaagaaagacuaauuccacuuuuaaauucuacuuuaauccaagccuugacauggcaucgaccuucaaaaugcuuuuaaugugguagagcaaauggaauguauguucagaguaaugggagcacuugccuucagguggagaaaggagacaccaaagacaagggggcagagugugaccucuguggaguaggauuguuacuggagagauuagauggagucaugccuuuugaacaguggaguacaaugccuuugcuaugugcauauuccuguggcuacacuuugaugcuuauaauuccuauagguguagcaaacaauauuauguuagucagauguaauccagcuucacagaaggaaaaauaaaucaguauguuuuccaaguguuuaucuauauccaugguggugcagggagaugcacugugccuaccuaagcucucuuuccauaaacacauccuggucaucugugaguuuaaguuugcuugugucuaagugaacuuagaaggaggaaucuacuauccagguggggaguuauuggucagcaaagucaauaaaauauccucacuaugacagcaaggcugaccugaaaaccuucagaagcugagccucaaugaggagcaaagcugcugaggauccucaccacagucaggaaccaaagugucugcagauuguguggucugcugagaacagucggcagaggaaggaucuacaugugcagcccuguuaacccagcccuccccccuuuauuuggacauuuauauucauacagaauauuggacagcuguaauuuuuuuccuuaggugacuccaagucaugguauccuguucuuuaggagacagggcaaggcuaacaccaucagugcuaugcugguguuuuuaacuccauggaagcugcaggucauuuucuguuccugaacaguggacucuggacaacaggguaagaaaaaucucuucuguggcauuucucaccuuucuguguggauaccacagaccaucaagacagcauccaaguccuaucuacucauauaaauuuaucuuagauucaucuaaaucuguugguugccuuucacaauuagugugagcacugugggugaugaauggauagauccuguuaugaacauaagaaaaaaaacaacaggcacgacuaaacucucugauggugauuagaugcuagaaauucugcuauuuauacaauggaagaagauaacaaaucuuucuaucauauucuguuuucugaccucugacccagcacccuucaucaaacucaggacucauugagaagauaaguuguuguccuuuaauggugacaugcaaacacuaggacuaaugucacuuuuauagugagccuuuuguuuuggagcuccacuauuagccaaaagagacacauaaaggaacuuaggauuuaacccaccuuuuucugucacagugaauucaggugacagaugacuccaacaaagaugcacauugugcugggcacagacugucuuuucugcaagcagcaagucuuuagggucccccugaugcucugucuuccuuuuuauagagguca

SEQ ID NO: 4179 - RNA, 962 nt, Mus musculus
cuuaaugugagaaagaagccaauauucugcccaaggcaagcuugacauccuuguuccucaguguauagaugaggggguugaggguugggcugaggauugaguacagaacugagguaacuuugcuucuuucugggcuguagcuagaagcaggacugauauaggcacagaacauagaugaguaguacacagagaccacaaugaggugggaugagcagguagaaaaggccuuccucuugcccucagcagaacgcaugcgcaggaugcuggcaaugaugcagccauaagacaacaagguuagcaugaaguugaugccuacaaaaaaggcaucugccacaagagucagaaugcuauucacauauguaggacuacaggagagcaggaggagugggggaaucucacagaagaagugggugauaaccuugggaccacagaaugacaagcgugucauuagaccaguguggacacaugcauucacaagaccgaugaaccauacaaccauggcuagggccccacacagcugugggcucauccuagagcuguaguguaggggaaagcagauagccacauagcggucauaggccaugaccgugagcagcagcagcucagaggaugcugaccauguaaggaagaagagcugggacauacaucccuugaaggagaugguguuuuccucagacacuaggccaaccaaggccuuaggaaucacagaagagguacagauaauguccaugguggccagguugcacaggaaaaaguacaugggauugugaagcccugugcugaaggugaccaaagcgaugaucaaaauguugcccauuagagccaucauguagagggacaagaagcagccugucaggaacaaucuuagaccagggugcucugagaacccuuccagcacaaacucugucacuucugucugguugagauucagcaucaucauggagagcaccagguccaccauu

SEQ ID NO: 4180 - RNA, 14732 nt, Mus musculus
cgcuggagcuggccaucuuuggcaccuuugggagcuccugcuguucugcagcagaggcacugacguuguuaggugcuuugucauccugugaucuggucccagaggcacgcguaggggcccgggauacuauagaagcgaggagauggugagugucugccugacguccuggcgggauccagccuccacaggucucccuggaggcugccccaggguagcggggguuccaacucuccuccguuuuggggcggggcugugcagacaguggggacucugggucucgucugguccuuuugcaggguggugcuaggcggacagugggucccugguaaagcuguuaguugcccacccugcguagugugcucagauccugcugagcgagccaucucugggcggcuguguuccugccauacacuucagaugugcugaucaccgugaucucagggaaggauuccuauuggcuggcuugugugguuuccaucagcagcugggcaagaaagauccuggagccagaugcugcuuucugccauuuuguucuacauagcugaugaaaacuugguuaaugcgcagucggccaaauuuuccacuauauugauaacugcuuuuuucuuuaucuuguggaauuaacauuuuuauuguuauuuuagguauacgcaugcacacacgcaaaugugacgugcuuguggaugaggucauuggaucuguuggaucagggguggcaguugugagucaccugacaugggcaaugggagccaaacugguucucuguaagaacagcaagggauuuuuaaccacugauccaucucucaagcuuggggauuccuuaaguauccugcauaaaucauuauauuugauucagaagcuuuuaaaguucugugcuuguuuugcuuuugagaaugaaggcucacauuuauggaagguacuggcuguacucgugaagggccugaagcagaccuuugugggcagcuuuucauuguagcacauuuucuugucauagauauacacuccuuucuuuuauuuuucaggaaaaaaaaaucauauauucccaagugucuuaaaaauccaaaauauagcucaaaacaaauaguuaauaaacaauaggaaaaaaauugaaaaaaguguaagacucagauguugcucuuaauuugcguuguuaggugugugcauauuaauagugucugaaaagaaagcaaaccauaauuuucaaauagauuaguaaggguuuuuuuuuuuuuuugacaguguguuuccuuuuuucuuucuuccuuucucucuuucuuucuuuuuuuuuuuguuuuucgagacaggguuucucuguauagcccuggcuguccuggaacucacuuuguagaccaggcuggcuucgaacucagaaauccgccugccucugccucccuagugcugggauuaaaggcgugugccaccacgcccggcuguguauuucuuacuuauaucaaaauaaaaaugucuggucuuucuccucccaacuccgagacagugucucaggguguaguccuggcuagcuuaaaauucacagagauagauccaccugccucugccccuugaguguuaagauuaaaggcaugcaccaccauccuggcucaucuguuguuuuugauguguaguuauuuuauauggguacauaaaauaaaaguuuuauuauuuaugaauuuuguuuuguuuuucuuaucuuuaaaacguauaaccaaucauuuugcacuaauuguacagaugggcagguuuagagaggcacuuguuuacaugcaugucacacuuuggucacccucuggucgcuuucccacacccucucuucucucccuggcucccugcccugcgggucccagcagcuucagaccggucugagacagaugucugcuccucuguccccuguaguuucuacaugugagaggaaggaugacaucccugcccaaauauggcuuauuuugcauaaacauuuucuggucugauuuauucuccugaauauagcuugauccccuucuuuuuuaugguugaauaaaguuuuagagugauuauuauuuugaggggaaggauaugaggauaggaauuagcucucgggucaccuaguuauuauuuauuauuauuaauaauuuugagacaagggcucacuguguagcuuuagcugguuuggaagaccaagguauagaccaaggugaucuaagcgcacagagcucccuccacuugcuucugacuucugagugcugggauuaaaggcguccauccuaaauuauuuuuuuuacauaagccuauaguuuuaaaauuuuuaguuuuguuuuaguuuuuuguuuugagacaggguuucucugcauagcccuggcuguccuggaacuuauucuuuagaccaggcuggccuugaacucacagagauccaucuaccucugccuccccgggugcugggauuaaaggucuauaccaccacuaccaccuggcauaguuuuuuaagauuuaauuuaaaauguuuaauucuuugcguuuguggauuuguacaugugauuaacagugucuguagaagccagagagggacaccagaugcccgggagcuggaagugugcagguugugaacugccuacugugugugccaggaacugaacgcaagucaccuucaagaacagugcaugcucuuaagcacugagccacauauuuccccagucucaagcauauaguuuuaucauaugcuaaugaucuuauuuuaguauaaaaaucuuauuuuauuauauaacuuuuuuuauuaugccaaggcuuuuuaucauaaucuuucuuuucccaaaauauauuuuuacacuuaaaaacuuuuacuuuuuuuuucuuuuuuaaagcaggauuucacuguauaacuguggcugucuggaacucacuauguagaccagaccuaccucugccucccaagucugagaguaaaggcauugccaccaugcccaacccaaaccuuuuauuuauuuuuuucuauuauuuguugccuccuuuuuguguuguuuugacuugcuuuaauuuuuuuuuuuuugagugagcuucucacuauguagucuugucuagcuuggcauuuacuuuguagaucaggcuggccuugaacucauagagauccucuugccuuuaccucucaagaugagauuaaaagugagugcuacaaugcccagcuuacuuggaaaaaacaauuuacaaaaacuuuacauuagacaaauuuuuuuuucucaauaaaaaagaaccuuaauuaguagggcuuugugugcuggugcgugccuuugaucccaggcagaggcgggcagucucuguggacuggaggccagcuaagauauauagacccuauuuccaaaaaaccaccuaaccaaccaaccaaauuauuuuaaugaauaauuaaggccaucacaaucaguucuaacacucuucaucuuugaccaaauuaggaacucuugucgauguuaaugguuaauauauuauuucuguuucuuuuaggagccaaugacauuugaugauguggccauuauuuuuucuccagaggagugggaaugucuggacucugcucagcgggacuuauacagggauguaaugguggagaauugcagaaaccugcugucugugggugagaacagcuuuccucagagguguaccaccaacgcuaguuaacuuucuuuggggagcaucucccgcauaccuuuacacugcaugaguguauuccagauccuugccuuucgggaagaagugagguauuuuuugguauaaguaaaaauauucaugaugugcuuauaacccacucuauuucuugggguaguacacacccuuugugugagguaauaacccuuugugguuguuauuaggaacucacugguuuaaaauacuguggccuacauccaaaaauacacugucuucccuucgccuucgguuugguaguagcuggauuuggcaguagcuggauuugguaguagcuggauuugguaguagcuggaaguagauuccaggacuugcaaauugcaauucuucucuaaguauuagaccagaucugaagaaucaacguuuggagaaacagauuucuagaaucuuguuguaccuuuuagaaaacagauauuuauuuuauguguaugaacgugggucugagugaaugucugugugcccuuaugugcaggagcccauggaggucaggcaaggccuggaucuccuggaacuggcguuagaugugguuaugagcuugcauguggaugcugggaccugaacccaggucugcugcaagagcagugagcacucuuaacuguugagccaucucuuuagccccauuuaaucuuuuuuuuuuuuguauuaaucacauaacuggaauagagaugucauuacuugaaaaucucaagaaucguauucuguuuucccauaagcaagucuugcuaucuguaagccguacauggucuuugcagaaugaaggaaagagccuuggcguguuaaagauacaggagacaguagcuguaugcccaggugaccugaaccaguggguccuucuucagugacagguuccugagagagaaaggaccauggaaugagaggguagagaggauagaaagcuggggucaggaggucuugcauaagcugucuuaugcugggcaaguuuauuaagaaguacagcaucuuaaguacuuuuuguaggggagaaaugagccaaggucggcagagagcuaaaucagaugcuggcaaagagaacacaggauaccucagacacaguagccuuacaauugauaaccacagcccauucaggggaaaaagccagguuccuaggagcugaaaccuugacuccagccucagacaggaccuuaucaaguuuguucauggacaaagaggcagaacuaguggucucuuuguccucucaucagggccugugagaaaguccgagucagucugggucucaacacccagguggguagaauuaaugaaggaggugagaggcccaagguaaagaggaggcuggacuuucaaagcaguggagagacuuugcauggcaacagugcuucagaggucuugcuuuggcccucgugcuaucauuacagaagggcaucucuguaucaugcuuugaaaccccuuaagccuccuccuuucuauguagcgaucgcccuacguauucaucaaaccucaucucuguguuaauuacuaucuuguuuacuauagguuaauauguuuuauaauggugcugggaucauauuguaacagagcaggauggagcucccaugcugucgcugaguucuucagggaucuuugagaucacauauggguuuuacaauagccuuuucuaguuuuguauagaaaaaaaaagugaaauugggauuuugauagcuguugcauagacucucuagaucaguuuugauaguauauauauauuuuauuaaagcuuuccaguuuuugagcaagacccguuuuuauuuaauugccacaaauuuauugauuuuucugauuucucauucaugauugauuucuucucuuuaguuuuuauuuuuuccucugugguuagaaaagaauuucagcauguuaauaucuauccaggccauuuugugcauaacacuugguguagcugggaaacuuugauuggcuguauauuuugaagggccucuuguuuccuggcuuccgugcugucugacuuuauuucugcuacaagugagaaauugaauccaauuauuaacguguugcuuuucauuuuauuuucaguccaaucaguaucuguugucuauauguagaguauaugacauuacagauuguauaugugugcguguguauguguauauauauauacauauauguauauauauauauauauauacacauacacauauauauaauguguguguguguauaaacaauauccuagaaaauuaucccuuuuauuauuuauaguuuguuuuauuuaauuguaccuuaauuuaguuuaauuuuauuuaaauaugguauccuucuguagccugggcuuccuuggaacuugugacaacuguuuugcuucaacguccccaguacuagaaucacaggcaugagcuaccaugcuuagcuuuccccccuuauauaagaaucuucucuugucuuauuagagcucuagucuuguagcguauuucaucuuguguaagaaguuuaaaguguaauuuauacaauauaauuauagcuaccucugcuuucgugugauuacuucuuccuuuuuuauccauuugcuuuuggcuuuuuuuuuuuuuuggucuuaggucuaaagagauuacugguggcuccuacuuaaucuucauuguacuccauauagagcaaaggccaucaaaaagaaguuuacuguagacagcaugcgcuuagacauuauuauuuuuauuuuaugaguaggaguauuuuacuugcauguauguauuuuacuguaugucauuuguguguuuggugcucaugccaaaagaggguuuuagaucccuuggaacuagaguuccagaugguugugagccaccaugugggugcugggaauugaacucaggaccucuggaagaguagccagugugcucuuaacuccugagccaucucuccagccccaugauuaguuuuuuuuuuaaaguuuaauuccuuuaguuaauuuauguauuuugauuggggauuaaguauaaaacaauuuuuauuuaacaaacuugcugaaaaagaaauuauuauuauuuauuucuuauaauuguuuuuccuaccuuucuuacuguuuuuugucacugauuuuuuuuuauuaugcuuuuucuauuuccuuuaucuucuauaaguauuuugcaauuuauaaggggaauauaaaaaagcauuuuaaauguauaaaacuacuucaaauugguaauaaauugacuuuaaucccauauaaaauccuuagcuuuuacuuuaagagagcuacuuuauauuacauagcuauuuaucaguuuuuauggugguuauauuuuuucuuucauagucuauaaaggaauuaaaaauauuuuaugugccaucaugagagaacuagaggauucuauauuuauauaaguauuuguuuuucucagagagcuuuaagauuuccuaugauuuguguaaccuuccagcauuagauuauucuucaguggucaggacucccuggaauagucaaguguaggacauccccuucacuguugauggcccuuugcuggcuacaguguucuugguuguuuuuguucuuuuagcucuguauccccagcucuccuugacugcauuuucugccugaauaacaaagcagucaccagagcauccuugcagacggcauauuuauugcuuccagugccucucaggauuuuuugugacuuuugaaacucugguuagaaugugcuucauuuugaaucuuuuucugauaaucccaguuggagauguugagguuuuugaauuuugauagcauacugguucucauacuuccaauuucauagccauuguuauuuauagaaaucuuucuauuacacuuaugugugugcgugcguauauguauguguauauauauauaauauguauguguguauaaguauaugugagcaugcaugugugcuguguggauguagaagccagaggacaacuucucuccuucuguccugcugguuucuaguauuaaugcaggucuuuugaucucuacccagcauguccuuggcucagccauuaguuuuuauugaauucuuuagguauauaauuucuacuucaauucauaguuguuaccuuucuguucauguucucauuuucuuccuuuuuuugcuuucuuuauucuaauuuaggucauuuuacuucuuuaaagguugaguucuucagcuaauucauaaaucggaguuuucuugaaucuuauuuggcuuucaguugagcuaagucucccugucucuuuguauguuguuaauuuucacuauuuguccauuuuuaaaccagggaacaguagauuagugaaguugugggaaacaguauagaaguuacuacacacacacacacacacacacacacacacacacagaauuaccacauaaucuagcaauuucacuccugaauguuuagcuaaggaacgcuacaucaguauguauaauaaauagcuuuacugcuguguucaguguugcauaaaucaaucuaaguggcuuuccauggauaaaugaauaaggacauguuauauuacaggagaucacuguucauucagucauagcaacauggguaacacacaggguuuacaugaagagaaauaagccaaagagagaaucaguuccuguaugaucucauucauguggaauuugguaacgguaaccuuagugacuuugcucauugggagauuuagauuaaaggcuacaaaacauuaauaggucaaauagugucaggagugcugcugugcagcuuggugaauaacuaaauauuaaguaauuaaguguuuuuucucucucucuuuuugauuuucauuucaagacagcauguuucuguauagcccuggcuguccuggaacaccauuuguagaccugacuggccucaaauucagaggucugccugucucugccucccaagugcugggaucaguauuuugucuucuugauaaguguuaaucgaguggauagacaguucucuaaucauaaaaugauaguugugugaugaggaagagagguggagauugucuccccgacuucacaguguuguuuggggauuggaaagcuguaguuaccacaguaacagucccggcugcaugaccucucuaagugcugagcucaccugggguguucggcaagguuugcagguagauuugguuagcauguuguuagcugugguaauggaugccucgggcuugaaugggcuucucugucugcugugaucucguauauuguaugugcaaaguguuuucaccugcguccagucauuuguuuuuauuucuuacagaggcaucccgucaugguaccaaaggcuuuucaucaaagaaggacaugaagcguuucuuccaagaagaguuaaggagaagacucagcaaguguggcgcugacauuuuccauccgaggaaacagugggagagugagaggaagacggaaagucaaaaagugcugugcaguagaccgugugugacagcugacagugguacagagaaaagugucucugccaacagagaucaaggacaggaaauaucucagaaaaggucucccgucguggcagugacucaaaaagagccccaccuuucagucagcaaacauucccagccacauuugaaacuuaccuuuccucugaaaggaaagcggcaauguccgaaagggagccgacuucacgacacgaccaguaaggugaucgauuuaaaaaggagcacuggacugaacucuuccucaaacauuucuguagcuagauuagaauauaaacauauuucuaaaugugaucaguuagagagcucuuuuacaaaaaagccaucgcuuuguaguaaacaaacaacuugugucaaacuacacagugucaaugaacgugggcagaaacuuucucgucccucacucuuaaauaaaaaaaaaggcacaacgauuugggacgcgaagaggggagcagagagcgugugcaaggagacuucucagaccguucgccagagcgguauccugaauaacucccaggauuccucuacuggagagaaaacuuaugaauguacgaagacacacaaaaacuucagcggugguucagcucaugguaagcgggcuccuucucuagggaauguuuuuagagggaacaaauguggggaugucagucaucagagcuuaaaagaucuucagaguucccaccuucaagaugaggcuuacaagugugagggauguguccugacuuuucgucaaaaaucagaucuccuagaacaccagaaaacucaugggagagccaaauccuacaaauguggagagugugguaaagcuuuuagcaguuguucagaccuuaauguacaucagagaagucaugauggagagaauccccaugaguguaaagaguguggcagagccuuugcuagugguagggcuuuagcucgccaccaacacacucauacaggaaagaaaucuuauaucugugaagaguguggcaaaaacuuuaagaaggguucaaaccuuaaucaacaucuaaggauucacacuggagagaaaccuuucaaaugugaggacuguggccuagcuuuuaaucaaagcucccaucuugcuaagcaccagagaauuuacgcuggagaaugugguagauccuuugucaaguguuccaccagcagacguugccauagcauucguccuggagcgaagccccacaagugcaagcagugugggaaaaccuucguugauauuucaaagcuuacucaacaccaaaacguccacacuggcgagaaaccguucaaguguaacgagugcggcaaagccuuuaacaguggguuaagccugaaacaacaucaaguaguucacacuggagagaagcccuacaaguguaaagagugcgagaaagccuucacgcagauugcaaagcuuacagagcaccagcgaguucauacuggagagaagcccuaugagugcaaggaauguggcaaagccuuucgcaauuuuucagcguucaauuaccaccacagaacucauacaggagagaagcccuaugagugcaaggaauguggcaaagcuuuuaccaaaaguucagaucucaaaagacaucacagaauucacaguggagagaaaccuuacaaauguaacgaguguggcaaagccuuugccaugaauguaagucugagagagcaucagagggugcauucuagagagaaacccuacaaacgugauuagugcagcaaagccuucaaccacuguucacaccucacacugcaccagagaauucacaccggagagaagcccuacacgugugaagccugcggcaaagccuuuuccagguggucaggccucaaauaccauaacagaacucauacuggagagaaguguuccuaaugcaaagacuauggcaagcugugugugugugcacauguguggacacaugucacuauguguggaaggcugagguuaauauugaauuccuccauugcucuaccuucuuguuuuuuaaauuacauuaagugccaggcagugguggcauacgccuuucaucccaggacuugggaaacagaggcaggcggauuucugaguucgaguccagccuggucuacagagugaguuccaggacagccagggcgacacagagaaacccugucuggaaaaaaccaaaaaagaaaaaaaaauacauuaagcauguuguuuuguguguucauguguauguaugugcaugcaugugacauaguugggggguugguuacauccuuccauguggucuuggggaucuaacucaggaggucacacgaggucacaguuccuuuaucugcugagccaucuuacugaccucaccuuauuuuuugauacaaagucuaauuuuuuuuaaaaggauguauuuuuauguguauaauguaugaaugucugugcaucacaugcacugcccacagaagccagaagagggcaucagauuccccggcaguggaguuacaggcaguucuuagagccaguugguugccgggaagcaaacccaggucuucugcaagagcgaguguguucuuaaccacuaaaccaacucuccagucuugucuucaaacauuuuuaaauaaauaacuuacuuauauacuuacuuauuuguguaagcacagacgucugugcucagaguuagagggcggcuugcacgagucaguucuuucuaccugguuggucccagggauuggacuuaggucauuuggcaugguggcaggcaucucacaaguucugagauaagcuuucucaaugaaccuggaguucauugacugggaccagcaagccuucauaauauuaauugucuacaccuccggagcuagaguuauacaaauugugcugcuaugccuagcuuuuauuuauuuauuuauuuauuuauuuauuuauuuauuuauuuauuuauuugagacagguuuucuguaacucuggguguccuaggacucaccauguagaccagguuggccuugaaucacagagauccgccugccucugccucccuaguucuggaauugaaagcgugugccaccaugcguggccuaugcccaguuuuaggugugggagaaaggauuuggauuugggauuuauauuugaauagcaucugcugucuccauugagccaucuccucagccugcaugaugagguuuuuuuugcuuuuuuaauuaauuuuauuuuuuuguauggagguuuuguuuguacgcauaucuguacauugcaugugugccugaucgauacucugcggagaccagaagaggguaucaaaucuggacuggauugcacacagcuaucagcugcuauuugguugcuggcugccaacugauuagucauuucuccuguccuguggcaacaguuuuauucagauaucaaacauuguuuaauaaauaauucaugcugaauauauuauacauguaaugaaugugagagacccuugucuaaaauauacaccuuagaaaauaguaaaaauguucacauuggaguuuuuuuuuuuacaaauguaauuaccucucucuauaugugugcguguauguguguauguauguguguguguguauauguauguauguguguguguauguauguguguguguauguguguguguguauguguguguauguauguauguauguguguguauauauguauguguguguauguauguauguguguauguguguguauguuuguauguauguguguauguauguguguguguuuguaugcauguguguauauguguguauguauguguguguauguuuguauguauguauguauauguaugugugugcguauguguguguguguauguauguaugaaugagaggacaauuuggaggacucaguucuucauccacaugggucccagggaucaaacucaaguucucaaguugguggcagaugccuuugccagccagccagcucacuccaguucacuaauguaaaguaacaccuuuuucgaacuuuagaucuuggugaauguaaaagaauuauugaaaagauccaauauagagaggauguguggcagucuuuaacuuguuagaguuguauaucauuaguggcaaccagggggugcucacagguauaaauagugaagaugacuccugucuguuuuuuuguuuucuuuuuuuccaggguuucucuauguagcacugguugucuuggagcucacucuguagauuaggcuggccuugaacucacagagaucugccugcuuccaccacccaagugcugggauuaaacaugugcacugacaacaaccagcaaaagauggauuuuuuuuuuccuuuuguauucugucaagauacauuuuuuuuaaguucaaacuuccucuucauggaagcaaaaaccuauuacuugcacuuaaauuaauguaucuuguuugacuaauucuguagagcuuuuagccuuaguuuauuuccaagauuuuauaauacucugauuagagugugugugugugugugugugugagagagagagagagagagagagagagagggagagagagaaagagaaagagaagggggugggcauacagaggagaaggaaagagguauggaauugugcaugugugagugaauuguucuggcaugggcauuagacuacuggaggcuccagguagcauguugacagcguuguaccagguaagcagauaucucuaauaaucauuuucuuauuuucauuaaagcuuaaaauuauugcugaaacaguaauuaugggagagauaguauauagacuugauuucugagucuucagugguuguacaauuuuaaccucuauuuuuauauguuaugcuuugaguccuaugauguacacuaauuuuggguuuguguuacauugagauauauagcuauuauaauauaaugauuaaucuuaggacuaagcaacccauggaagagauaaacagcucgugcaugucuuugaggauggguuuggugcuuaccuaucuugauacgguaauuacugacacgaaagaaaaugcaaaugacuucccacuaugguuccuuccagccuccuguaauccgaggaaacaauggagaccucaucuuccugaagucugugugggauaacugcguguaacccagaggcuuaacccuagcuuuccaaaggucccgaauuccacaagaaagacagucuccucuccguucuucacagaugccauuuugauucugugaaguccucaucuuuagucccaaugggcagugaaauaauuuuucacuuguaacagccccaucucucuucuaaagggguuagaguucuaauaacuggugauucaucuaucuaauuuauuugcuaagaggauugaaugaacugcccuugguucucaguauacuuugccagugcucaguucugugagagaaguacagaaggcagggccuaugcguuccaucugucuccugacacuuaaagugagagagugugggggagugugggggaugugagggagggucagcagacaggcacuuuaagagagugggcacagauuugugggguacuggggccauggcccuuccagagaucaggcuagcaguccgaggacuuuuuacugauuggcaauuucuccuaauuuauuucugacauuucacauuucugccugggcuagagcacacuacagcucugggcugucgucuuugaguccauucuguauuuucuacugaguucugggugaacuugaaggaaaauaaagaguuggacaggggauuuca

SEQ ID NO: 4181 - RNA, 1225 nt, Mus musculus
augggcugcaguaggcuuuauugauuuaacaguucgagggugaauuuauucgugaagaagcagugaucgcggcacauccauggucgcuguagggcugguccugucgcucauggaagucaagccguguuucgggucugcuuauguguccucuugagcaucuagcacuugcaccugaaagagagauguguggggaccaggagaccugguaaccaacaaccggaucccccagucccagcggcagacagugcugugcacaccaguggaggagacagacuccugagcauggugacccaccucuccuagcacccuggggaggggcugugugcacauguacugccuaggugggauguaguucuuuuggggugggggaagcaguucuaagagacuuuggaaacuucucugcgaggucuccaucucugcuggcugauggagaucuggggaucggggaggacuggugauccagcaccaggagggucucggaagaacugcaaacauucggggaugggagucccagcccgauuaccagcagcuugaccaguugcuccuuaugcacaggcuguaguucaucgaugcaggacuugagcucgcucagcgcugacuuggccaugucauugacauuguacuugcccaggggcccuucguagaguucuuccgggguccccaccaggaguguuugcaggaauuccaugaaaaacucauugucauccucugcucuagucagcccuguguugcaaaggggauacaaugccgagggagggacuugaucuccuguccuugucuuucuagcacucccaggucaaccugcagaucccuuccccaucaccacuagugggagcugcugugguuuccccccugacuuccugaccucaccagggaagagaagggggaguucuuccccugggcuaacuggauccagagggucaggucaaaccggauugcuccagggugggcggcauuggccucggugguuaguuaguguuaggucaggguggguugggagagaacuggugucaacagauuuccugcacuuaggggguggggucugugacacugguaggcauugcccaccugaucccaggauuucagccucuuggggccccuuaccuaccgaaagugcuagaaacaaggcccagacuuaccacagacgcagagcaggcuuagggccaccagcagaagagcgcugcucccuuucauggugacagucacaagaacugcuugggggaua

SEQ ID NO: 4182 - RNA, 4196 nt, Mus musculus
ccucggcagccggaugccucucaccucccgguugaacgaccgcagagcuucugucaccgcaucuuccucuccggucuccaaggcauccgcaacugcccggggcuccauggccccuggcaccgggugcuggaaggcuugggcugggaagacgcaaucggccaaaccccggggcuccgcccagguccggaagcccggcguccacgcgugagggaugcugggagagcagccgaacccaaggguguguacaggcgccuccgacuuaagguggagcaacccggcuguggucgcugagcggcuagucuuggagcggcgaugcuagcuaaccagccaggcaguguccuccuuuugagcccuccucucuagcccgaguuccuggcaggcgggggguggggugggaugggaggguggggagugggguguggcuuggcccgcgcguggaccguccucuuuacgcucuuguccccguacugugauaaaaaagggagcgccggcuccuggccgcuuaaucaguuggggaagacgauucucgcgauccaggccuuggagcucaucuuccauagggaauagggaaagagaaguacaacgacuuggauggucaaaauaaugcacgugguuagccgggcauagugacgcacgccuucuuaaaucccagcacucgagaggcagaaacuagcagaccuaucuaaaaagaauagccaccaaaguaauacgguuauucucaagaaaauugcagagaaggaagugaagaacacccguggaaaagccacucccgcgagaggagcaacggaggggcggccagccgaggcgugucugagguuagaagcguaggagcgcuguguagcggggagccagguccgcacgccacuuagcugagucggugccccacagugacacauacaaacagugcuccaguggaugaugucacccgccgugcuaaccggcucugccccuacucaguggcaggccccggccgucuccuucaccagucucuuucgggucugccuguccuccccauccaguuggauuuagcagcgccagaggcauccgacugauuuacugagcugguuccuagccucugcuccaaauuugggucugaacaccugcuccgaguaacacccacagcgcaggacuaauauugcugaccaauccguggguccgaaugcugguggcccgcccuucccuuauuuacauucccgagaagcacuccaggucuguuucuuccgcuucagaaccuucucccggaaguuauuagcccggaggcggaaccggaagacccggguacuggugccacguccguugcugugcugcgaauucccugagugggacccuggagggcgcgauggcagauuggacucgaggugagagcacuugaaaggcaguagagguaggaggggaagucuaagucuggagcuggagacaucgcucguuucucgguggaaggaccugcgugggguggcgcuuacguaucccuggaaaaacagggccggauuucgccuggcgcugccuuggaacccaagccggcaugccaucaguuuugugugugguugaugccaagagcuggaagcagaggguccaagcaggguuuuacuaaugaggggccugagugccucgguucacacacauuccccgcccccgugccuguguucagugugacaguugugauacugaugcuucgcccacaacgaugacuaugcaguggucgguaggacacagccgucugucuuucagagucuggucgcacuuguuugcuggugcugcuggccuuccccuuaggugggucacaucgaggcugggugggugguuuuuaugcuucagaucggugcuagucacacuuaggggggugauucucaacuaccugucccuguccaucggaguuagguuuccacgagcacagugcucugggcauuccagagauucuguguggguugcagacauagggcgagguaguuucuacaguagaaggacuuucuuacacuuaccuuggaucugauuuccaaguccuccccacacagccuuccugucaccugcugugccaccggcuguucuguuuucccuauggucccuaucagaaaguacuguuucccuuugagaccggccccacacccucagaugacaauuucagcuaaggcaauauucacuucgguucaggaacaguauacagcagggucguguauguagauugauuggaucuucaggcuccccagcccguccuugccugggcaugcacacagguucucacacgacccaugcuacaugucugauguguagguggucagccuguuggagcauagggugggacgugcuaaguuagcagaaguauaugggggaaugcgcuuagaugucuccacuggagugaggaaucagggaccacaugucugagggaaugcuauccuuccgccucuuucucucacagcucagagcucuggugcuguggaggacauucuggacagagagaacaagcggauggcugacagccuggccuccaaggugaccaggcuuaaaucggucagugguggcccucuucccuuccgugagauacuuugguggguggggcugagaggggaggaaggaggccgugugcugucugugggcauugcugacuggagaagugcuucagguaauaacuuggccuuuuuuuuagcuuucucugguaauagguacuuuucagagucguggguaaaauguagcuggucugaagggaaggugggcacuacucucuguggcuuugcuugacggugccuucuguaucccaaccagcuggcuuuggacaucgacagggacacagaggaccagaaccguuacuuagacggcaugguaagugcccgcgguacggguacguacaaaucauagucagcuccgcccaccugccgucugcucugcugggucuucgcugcuagugugguuggguagucaagggucccaacucuaugugacccuguugggucucucccacaggacucagauuucacaagugugacuggccuacucacggggagugugaagcgcuucuccacgauggcacggucugggcgagacaaccggaagcuucugugugguauggcuguggucuuaaucguggccuucuucauccucuccuaccucuugucgaggacaaggacgugagccagugggagccaagggcagccaggcucuuguacaccuggcauccugguuuccuaaggaccugacuacaaaaaaaaaaaaaaaaaucccuuugaaauuaucaucaugggucauucaucuuccuaagucaggacgacugcagcugccucugucauaaugagcucaucuuggcuuguccuguguaugaaggaagaagaaaaaggcaaaagccaaugccacucccuggugcuaaagacacuggcagagccagagccauguugugugagaucaagccaggucuaugcaaagcaucugugagucccaaaugggcccacuguggccaucggccacacuccucagaagccaggaucuuaagggccuucuggauugcccuaaccuguuuaugccugguuuaaacccgugucuguguccuugaagagucugaaacugacaccagaagggaauauggccgugagcccucuccagaugauggucauuggcugaggcugcugaugaggaguggaccugggcaggcuguacccaccagucacuggcaagaggcaaagccguggauagaggaguggacugcaguccagaggcacuggacuaagauccuucugggccacaaggccagguguccaggagcacaggcacagauguguguguccuugggauugagaaucuuaucagugucaaagaugucuccauccccagacagacagacagagagcuguaccagguggcuuuucagagccaggccgugcuggggugcucucucugcuggggauccuuauggggccggaggccaccuaggaaagcauuuguguagugggagcuuuugaccuuguacugaaccuugcccuacccuguacagccagucucccucggugugagggagauugagccaccuccucguugcauaacucaacagacuugccugcucugccggcccucccugcugccuuggccagccccauuugcacauaaaucgaccuguggggcugacagggccagcagcuuaugaggaccuagcacuuugugucuucacauaaaauaucuuuaagacgagcuaugaaguuccgugcccgucucua

SEQ ID NO: 4183 - RNA, 7747 nt, Mus musculus
ggagaagguucugaagcggaagaaacagaccuggagugcuucucgggaauguaaauaagggaagggcgggccaccagcauucggacccacggauuggucagcaauauuaguccugcgcuguggguguuacucggagcagguguucagacccaaauuuggagcagaggcuaggaaccagcucaguaaaucagucggaugccucuggcgcugcuaaauccaacuggauggggaggacaggcagacccgaaagagacuggugaaggagacggccggggccugccacugaguaggggcagagccgguuagcacggcgggugacaucauccacuggagcacuguuuguaugugucacuguggggcaccgacucagcuaaguggcgugcggaccuggcuccccgcuacacagcgcuccuacgcuucuaaccucagacacgccucggcuggccgccccuccguugcuccucucgcgggaguggcuuuuccacggguguucuucacuuccuucucugcaauuuucuugagaauaaccguauuacuuugguggcuauucuuuuuagauaggucugcuaguuucugccucucgagugcugggauuuaagaaggcgugcgucacuaugcccggcuaaccacgugcauuauuuugaccauccaagucguuguacuucucuuucccuauucccuauggaagaugagcuccaaggccuggaucgcgagaaucgucuuccccaacugauuaagcggccaggagccggcgcucccuuuuuuaucacaguacggggacaagagcguaaagaggacgguccacgcgcgggccaagccacaccccacuccccacccucccaucccaccccaccccccgccugccaggaacucgggcuagagaggagggcucaaaaggaggacacugccuggcugguuagcuagcaucgccgcuccaagacuagccgcucagcgaccacagccggguugcuccaccuuaagucggaggcgccuguacacacccuuggguucggcugcucucccagcaucccucacgcguggacgccgggcuuccggaccugggcggagccccgggguuuggccgauugcgucuucccagcccaagccuuccagcacccggugccaggggccauggagccccgggcaguugcggaugccuuggagaccggagaggaagaugcggugacagaagcucugcggucguucaaccgggaggugagaggcauccggcugccgaggaaauuucaggaagagaggaagcaggggugugcgcgcaacucggcuggggugugcgugcgagugguggcagggagcacggcgguggguggugggcuggucccucggguggcucugugguggcgugugguggggcagguguaugggaggcuagggugggccuugccuuaagguucagagcgauggaugcugcuucagaggucugcucugacucgaggagcacggguccuaccugcauguggaucugagccuccugggucucccugcagcauucucagagcuucaccuucgaugaugcccagcaggaggacaggaagguaggugucagccccaagggcuccuagggcaggcacgggcugaccccaagaagagggccuaguggaaccacuuuuguucgaccccacagagacucgcaaagcuacuggucuccguccuggagcagggcuugucaccaaagcaccgugucaccuggcugcagacuauccgaauccuaucccgagaccgcagcugccuggacucauuugccagccgccagagcuuacaugcacuagccugcuaugcugacauuaccgucucagaggaacccaucccacaguccccagacauggauguccuccucgagucucucaaaugccuguguaaucuugugcucagcaguccaacagcacagaugcuagcagcagaggcucgccugguggugaggcuagcggagcgugugggacuguaccgcaagaggagcuauccccacgaaguccaguucuuugacuugaggcuccuuuuccugcuaacagcccuucgcacggaugugcgccagcaacuguuucaggagcugcacgguguacgccugcugacugaugcgcuggaacuaacacugggcguggcccccaaagaaaacccuccggugaugcuuccagcccaagagacggagagggccauggagauccucaaagugcucuuuaauaucaccuuugacucugucaagagggaaguugaugagguagguuggaagucuuggcugagacucaguucgggugggacaguuugcuucccuuuguaccucagcuugcaggguaucagauauggcgaggacuagaggaugguguaggcgggaacucagggaaggugccugagccgcacugugcaugggguugcagguggguauucuccacagugcuucagguggccaaaagcaccacaugugcugugcacagcgucuagggaucaacuccauguggccacaagaacagggguucgaucucacaggagccccuuucugucuuugguuaggaagaugcugcccuuuaccgguaccuggggacucuucugcggcacugcgugaugguugaagcugcuggggaccgcacagaggaguuccacgggugagggguagggcucacaauguuggggacggcaagaguuccuagguauggguacagaaguccuuaacccuaguugugaaucagaagcacuugggggcccaggccccaccuuugacuucaucaggggaauggggcaccaguguuguuuccagagagccuagguaacucagguauggcuaagagaagagcuaugaacuuagagacagggccuuaggcggaggcaguauggucucuugcuggugccucugcucaucucagguucgagagauuguuuggcaucucagcucagacauaauggcccagauagcgucugcagaaucuccccaccaaauuugaguugggguaccaccugcccuugccuauagucuauugcuuucagugcaacccuucgagcccauccauguguaccccaggagaagggccagggaguguaucugugcuaaauauaauuacugugucgaggccucugugugucuguccccagccacacggugaaucuccuggggaacuugccccucaaguguuuggaugugcuucuggcccuggagcuccacgaaggauccuuagaguucaugggaguuaacauggaugugaucagugcccuccucgccuuccuagagaaacgucugcaccagguaggacugggggccugcuacguggacacccaggggcucgggcaccuguugugacugcuguuucugaaccauugguacuggcgaguagaacucagcuugacgauauaucguggacaguugcucugacugcucuguggugcagcuagacgguggccgcucagucaggcccucgcagaagccugcagauacacugugugugugagcccuccugcugcugauuaccagaggagagcaagcuucucgggucccaaggugaaagguagcccuuaggucucuguggcucugcuaagugguucucagaagccuuuaguucccgcuuccaaccgucaggcuccucguguuucuauacaugggcagccagaggcgacauugucccucugcauuuuuuugguuuuguuuuguuuuguuuuguuuucaagacaggguuucucuguguaacucuggcuguccuggaacucacucuguagaccaggcuggccucagacucacagagaucugucugccucuguccccugagugcugggauuaaagauguguaccgauaccaccgucaccccacccccaccccccagcugucccucugcaucuuaaagaggcauaaccacaaguaaucugaccccuguggguuuccauggggcauccagagagcuggcgauccagccuuuccgugugaaacccccacagcugaaagccacagacugagauucauuagaucugaggagccauguugcuaggcagagggugcucaacgccuaugagcuuggugagaaauggcugccuggccccugagugcuguccgugaggaacuuugaaugggaaaucuguuauuugcuuuugcuguuuccugaggguaguguguaccucaggugugcagacagcgucagaugccuuuuguuucguucguagcccugggucguagguguaacuguugguuuuaaagaagcgaguuguuugacccaggugacaaaguuuuccagaagugggucugguuuucuucacuuucucuucuuaaaggucucauagacccgguacaggcaaggaugaacuugaacuucagaucugccugccucccaagugcuggaguugcaggcuuguaccaccaugacuggcuuuaaugugucuauaccuuuuuaagcuaauugacacccagcaccaucuuuggcucuuagcuaacuuccggcagcauggccucuuuauaggagguuguuaggaaccaucuggugaaguguacaguguagcuccaucuuaccuggggagcauaugucagugacagaagcccuucugcagacccacaggcugaaggaauguguggcaccugugcugaacguguugacagaaugugcccgcaugcaccguccugccaggaaguuccugaaggcccagguacuuggcaaaugagacagagcugggaaaucuggccuguauccuuuuuauuggcuccuggcugcuccaagccaacacuuagagacagcugccucccuagguccugcccccucugagggaugugaggacucggccugaggugggggaccugcuucgaaacaagcuuguccgccucaugacacaccuggauacagaugugaagagaguagcugccgaguuccucuuugucuuauguucugaaaguggugaguugggggagcccaagccccaggccuccccugccucagccauauucacacauugaccucugcccuggucuucagugccccgauucaucaaguacacaggcuacgggaaugcugccggccuccuggcugccaggggccucauggcugggggccgacccgagggccaguacucagaggacgaggacacggacacagaggaguacagggaagccaaggccagguaugugccccuaauguauacuuggguucccucauaacccccauucucccauccacucccucuccagcucgaaccaguaguacauaggacaggauaaggaauagauaagaccuggauucaggaacuuguguucugaugacuaguuauguccucgguguacuaaggcccagcaagugagcuaucuaucugggauccaggagguccugggcaagacuugucaggcugguguuugaggggcaucucccuccugaagucccaucagcaccaaaaccaaaaccaagaagguggguucuugcuaacccagcccuaagcaugaagauggagacuaccugccccaccgagugccacuuuuccuauagcaucacuaacccauuuccacgcacuguuccugggaaguagcaucaacccugugacuggaaggguggaggagaagccgccuaauccuauggaaggcaugacagaggagcagaaggaacaugaggccaugaagcuagugaacauguuugacaagcucuccagguauguguuaugaggaaggcuuguagcuagaagacaugcgaaugauuguuuugugagcccaaggagacuggcuuagaggugaggauccuggugaggcuguauuggacauuugagauaacuugccccagagguaagccucuggcaaagagaagaagguacagucagcauugagcccuguuucuagaugacaagaaggugaaggacugucuaacgucucaaagcuaguuagguggugguuaggauuggggccuaguuaauaguuaaccuaguccaaguagcagccuagaaaugagcaagagcccccugcccugcacacaaggucccuuccccaagcacugugcuuucccucaggcacagagucauccaacccauggggaugagucccaggggucaccucacuucucugcaagaugcgaugugugagacaauggagggacagcucuccucagacccugacucagauccugacugaagaugccagcggccuugcuccccuucagaacuggugcugcuuccagacauguccuggggugcugccucaagaagccacaccccucuccagcuggggagcccuucucucuccuccucacauuucugucaucugccuuugguccaguuuccuguguuuaggacugugguagucuuacccucugugaagacggggaacccaccuuucauuuccacaagugaaguuguuucuuggauguggcugcagccacgagcagaauugcccuggcacauaaaugaacaugcguguaugagggugguaauggagcaggguacacaugguguaagcaugacugggcuggaugccagcccagagcccguauguggggcauacgcuguguuucaaacauuuuagaaucuguugaaauuguuuaaguaugucagaaaacacaccaagcgucaugguuccugcuucuggccccacugagcacagggcuaguggccucuucuuaacuuuuugguccuggcgcugccacccacugcaguauccgcauacccaagccucacuaguugugacaacuaacucagucacaaccacuggcuuaguaauucugugaaggcgaaaguaagacaaagucaaaucugagauucugaggcacagaauacaggagaguuugggacaagacuguguaugugaaguagucaggugaaaggcuauuaaacagaaacugauuucauucuguuuaacauucaugauuuccuacaucaccacacaucugcugucaacgaagaacaaggauagaagacaagaccccaguuccuggaaucucguugggucggcuacauacugucagccgcagucaaaugggucguaacagcaauggggugcuucugccuggcaaacagccugaacuguuucugaguaggcgccgaggaggaggcagccugugcuuaguaaugacugcacacaggacaggaaaacaggaggcucaaugggguuucccggaguaaugccugccauugguuuuagcaucguuacuggaagaaaccuggguaguguggcgggaaguggcucagggagggcugggcagauggggauucugaaggacauggguauucuccagggacugcagaagaggagccugagugaacacgagaguaagucaagggacaaaugggcuccguccugucauccaggaggagaacacccacauaaccugaaguuugucaacacucacuaucccaaagagacaggaugccaaguuuuuauacuaaguuuauuucaugcaagaaaugauguuguaguuaaagaugccacuuuaccgaucaacaugcuagauugcccuagugcaucgccugccuggcgacgggcgugcugugcugcccucgugauaacuuaagggccgcugcagaaagcagcaccugcacuacaccuucagcagugaugagguggacagggcgcacacauggaggggccccaaggguagacaucccuggucagccuuuccaaaggcagccucggaggaccacuguccaggccacauguuguggucugguucauguuuguaaacguguuggagcugucuucaggcaugaagucuugcuggacauaggaugaucugcugugugacuuccccaggugaagaagccauagucuuaucuguccuguccauccagcua

SEQ ID NO: 4184 - RNA, 18688 nt, Mus musculus
agccucacggguugcggucgucaagguaaccgcguucuugacuuccgcuaaacuucucccggguuucuggcccugcccuugaggcauuaaagaguagaggugccuggggacagcuagccacugacuggucacguagccucaagccugcagacuuggguccucugaaaccggauggcguuuggcgaggacuaggugugaugcaaaucgcucagagagcauuaguuaucacccgccuacucaaggaggucgagagcggcguaaaacgaugaaaucucccgguuuggcuucccaaccaauaagucagagucccacagagggagaagcugccagcaccaggcauaaacacagccuuccacacuucggguuaucgugcgggggcugggcugggcucggccgagggaaggcgccggagggcggcacuuggccagagggggggcgggaguaagagugccgagagggcggggcuuggcucacgggggcggggauucggauggcgcuugacccucuaggcgccgucguccugcagagcaucauggcgcuaagcggucgacuggcauuggccgcgcucagacugugggguccgggaggugagccacggcaggggagacacgggaucucgcagauaggcuaucagcggcguuuuaggggcggguagcuggaagcaauugugggaguaaggacccggcaggcgcgcccuucuacaagguuuugcugaccggccaucacuaccuucuccuuaaagguguuuuucuauguaacuauugcagcacagucuuugaaauauuuuauagaaguucguuguauggaugucuuauaauuuauaucaccauuuccuuauugaauacuuucuaaucuugaauuauuacaaauaacgugauaaauaaacguguuugcaccccauuuggaccacaaauucucaguagacagccuuggguaagguuacgugguuuguauuauuuugagacuggucucuuguucaaacuggccuucagcuggcugugugaaggaggaugaccuugaacuccggauccaccuugcuuccaccucccuccaagcgucggagacuacagucacaugccaccacauccagcuguuacuuguguuuuaauugucccccauaaagguugugaaacuaaaaauuuuuaccaacagucauacugucugcaaaauaguaacaugucucauagaguccugagagugaucaauaauagggauauuuucaguuugaaauaagugaguauauuaaguuagagagaaaucaucacacugcauauucaaaaaaaaaaaaaaaagucagcagacgucuauuggcuaucuuuaagguagcucgguggaacucccaguaaagaguccuugccagaacagagugacccuuucagugagguuuuuaguaaagcaacagauggaaguaauaucaaauuggacacuugcuacaucuaacagaaacuggcagagaaaguugagauagucauuuggagcucccaggugggcugucccucugucugagcugcgggauuuccuuccuacuggagggcacauucuuuuucuugcagauacuuuccuauacugggauaaacuauagugacuuccacuggaaaccguuucccuucuguucucaagggcacaaguguuuucacucuugggcuguuuugcuguucucucucuguccuuuuacauaguuaggggagccagcccuccagacuuuggacuuugagacaaacaugggucuggcaugagggaagggguugucggccuuguuuccaaagccaucuucucagugagcucaaaugacgcaagacaauuuaucaauauaauguacaaauuuggacuuuuuuuuuuugucugugcugaguaacaaacucaggcuuugcaauugucugauaggcuaacauggcaccacugaacuacacacccagccuggaguccuuacaguuuuagggcccacagucguuagcaaagaaauguaauggaagaauauuuggguagacaaugguauagucacuugaugugggugacaacauuuuauucuuuucaauaaagaguuguucauuuaggcuacgguuacagagcauuuucucuaccauacucgugagugcugaggauaaagcagggaucagaaaagacacucuaacuuguggaagcauuucuaauaugagaucaucuguaagacaguguggcugucauaaacccuaacacaggagcccugggauguuugugaggaggaugccuuuacagaacauuccuucuucucuugauuuuagauuugggacucuuuugugacuucauccucuguaacuuuacaaugucuugggcagaacugaauacuaaccucugaguuucuucaucucaggggcuuuccauaccauguagauguacuuuaaguuauaucuuaaguuuguuguuagauauuugguaaaauuuuguccacauguaugucugucaguugcaaacuguuuguuuguuuguuuguuuugguacaagugacuaaaaaugucuuuuauguucccugaguggugccuagcgguuggcagacacucagcaauggucacaacuuuucuuuugucccuuuuguauucucauaugguuuguguuuaagaggaguucagaaaauauuagggcaaaaccucugagugcacugcccugggugcccugugcgccaggguauuugaugagugagagguguguuggagccagagcuugcuugcugcugcuucucauucuuguuuuuaucaggagaccucuaggaggguugcagugacuuagcgcguuggucccuaggacccggcaugggcuuugcggucaggcuaaguucuaagugccacuuccggaaguagcccccuugcuucucacugagcauuuccuccuacuguacuuuggguuuauggugugugcuugcaggaaaguaaggguacccagaaaacggggugauuuugucucuuguguguuuucccagcugggaauaagguuccuuccaagggaacaaaaucucuugucuuaggcuucucagugaagcuguugugcuuuugggggaguucucuuugauuccucuguccugauggacuagagagagcaagugccucuuaucuccaccaucuuuaugauuaggcccccacaggaguucuaaacuaaaagggccagguugcaaugaggaagagacagagacaaaaaggcaggcgugccgagagaaaaucgagacugcuggaaaacagauucuggugaacgcucuacuacagauguucuaacaguugcucugcaacagcaagaggccaccuaguacgugcucagauaagccaguggaccaucagcuaaacgaaagcagguccagacugggucccagggagcacucucauacucuauccaaggaggugacacagacaguuggacacaaaggccuguucuggcccuuggcacugcuccugaugacaccucggaugggacaggaucauccaugggcaucucacacugggugccuagaccaugggcacaaggcacagcucuugcuugcuucaaagugaauaaugcauagcuuacugugaacccaguaugaaugaucgugcccuggaaacacagacucggguuacacgaaauaaucucacuuauggaagggguuauacaaacuucuagucucagaacaaaagauagucagaaauucacucacuuacugaauaucagugggaacguuaggcagcaguaaaaucauccuauuggcuuccgauaugcucuaacgggagucuuugcuccugggcuaguggaagcuuguggucuuugaagucaagacauuccaaaggucuuauuucauagucaaaaggauguuagguauccuauccaggggacuaaagauagcucaagauaaguuuagcucuggaucugcaacauuccaacucuaaaguuccaucuggccagucagcugugguuuucucagagcccuucagcucacaccauugaugaugagaagcaucagggaaccugucugcaaaccugucuguaaaucagaauuuucuugcccccaaguaaaucucgauuccugaugcaagaugguucugugcuuuaguugguagucaugcguggugggaaagugguuguuuggcuggcacuggagaggccauguccaccuuugacggggggaagaguccagcugcccucacucuugcuagccuaagacugacuguugccugcugccucucuccugcgcucuugcugucaguguuacaggugggagaaggcccauaucccucugugugggagccucaggcggcuuuggagguggaggaagcagugagaagaaguuuucucugcaggauguagcugagcugcuucggaccagagccugcaguagggugguggucauggugggggccggcaucagcacacccaguggcaucccggacuucagguaugcugcgguucccuugggugucauuuccccacugucuucugcagggcucagccuuuuccuucucucugcagauccccagggagcggccucuacagcaaccuucagcaguaugacaucccguacccugaagccaucuuugaacuuggcuuuuucuuucacaaccccaagcccuuuuucauguuggccaaggagcuguacccugggcacuacaggcccaaugucacucacuacuuccugaggcuccuccacgacaaggagcugcuucugcggcucuauacacagaacaucgacgggcuugagagaggugagccuuuggccccuugcaugucugugcuuguuucucaggacugccuacggccuaguguuuaugucggcccuggacuguugcuaggcagcugguuaugccuuuaccacuucugcauuugaggccacauggaaaccucucuguaggccugucuccugcacaccuucugaguccugaguuuuagauggaacuaaaauucauacaauuuuaaaucuaguguggaucuccccucucucugccucucucucucuucuucucuuuccaucucuuucuccuucccuuuuucuucccuucccucuuccucccacuuucucuccaucucuggcucccaccuaaggaacccuuagguccuuucuuccauuuccaugugugacacauggccaggccuuguucucuguucccuccaccuccucuuucacccucagauuauuuucaggcagauaccucacaccauggugcuacuauagaaacaaugucuagauguuuauggauaugucuggaagauaaagccuuguugcagcauagcucugaugccauuauucugaagagccaccaacauuucaguguuguccaagucagucagugacaucuuggcucuacuucacacugagacagccaugguuagagccugcauacccugggggaggugcugcugcuuccucaaggugcaauaugcaggcccauggcagauccagccacucugccauucuguggagugcuguggucugaaguaagacaucacauugcgggauaggaguccugugagaaggaaucuacaacccagaaccagagacaguagugaccaccccaaguuucccccuaagcagaaggaaagguuuuaggggaagauaggaauuuccuggcuuuggguuuaagcaguacaguuaccaaagagcaguaaugaacuucaugagagcccgguuguuguuccgaggagguucugcuagagcccacacucaccucaaacguacuccguagcucagacugucuuggggcucucagcucuuuagccucagccuccccagugcuaggauugugugcuugugccaccacgugcagcugagaggucccuuucuguuugcuuaccugccauagaguuuuuuugaaaucaguuuugucaagcccagaaggugagcuugugugcuuacauagccaucccagaggcugcaacacugagauuugcuuugaauuucagcaucugggaucccugccucaaagcugguugaagcccacgggaccuuuguaacagcuacaugcacggucugucgaagguccuucccaggggaagacauaugggugagucaccucaggaaauagucucugccuucugcaauucuuggggguagaggaucuuauaauaguuuguuuugugcuuguuuauuuguuuguuucaaaacaggacgcucacagaggucugaaacucaccaaaauagcuaggcugguuggucaggcaaccuuaaagauccacccuaaggaucucugccuccccagugcugggauuacauuauacaucaccauacuuggcuuuguuuguuuagacaaggucucacuauuuagaccagguuggccuauaacacaaagagauccaucagcuucugugggauucaggaugugcuccaccaugccuggcucccaaacuuuugacuuagaaaaauaauacauacuuguaaaggaacauaaggcugggcugagaaugugacgcagcucaaugguggagugcuugccuagcauaaacggcccugggcucuauggccagugcucccuccaccccaaaaaugcaggucagaaauauauagggaaaaugaauuccccauggcaggcaugguugagcacaccuuuaaucccagaacuugggagcaagaggcaggcagaucucugaguucuaggccagccagaguuacauaguguuugucuaaaaaagcaaacaaaaagaaagaaagaaagaaagaaagaaagaaagaaagaagaaagaaaggaagaagaaauaaaaugaaucucucucuaaccaaucccuuuggccgacauuugugauugagggauaauguaauagucuguguuuuuaaagcaaaagauauauguacauauaaacaugcaugcaagguuucuauauagacauuaaaauauuaaaauuaguucauugauuccuauuaaauaucuuuuauaaauucucuacauuccuguucaguuuaauggacaucuuauguugacaucugagacauguuuauuccuuuuguuacuuaauaugaggcauuuuuaauguuuauaauuguugcuauuaaaacaacacaggaaaggguaaggagauggcucaguaggugaaccauagaagagcuaggcaggaauggcagcccgcuggacucucagauuccuagaacaagcugguauuuguacuagcucugcuaagcacaaagaccgguguucagauccuuuuugcccauccccuucuccugagggccacuggaucgccugagaccccuggcccuggacuccguacauuucacuucuccccagcaugcaacauccaccaucuuguaaaaguuggacacaguaguauacaugucuauaacccuggggcugagugguucgagacaggcauaccuguagagcucacuggcaaaccagccuagccuaacugaugagcugcagguggugagacacacuaaacucaaaaacuaagguggagucaagugugcgguuacaugccuuuacucucagcacuugaggcagaggcaggcagaucuuggugaguucaaggccagcuuggucuacauguugaacuccaggagggccaggacuacauagagacccugucuacauacacaugcacacguggagcgugacuagagaaggugcucagcaucuaccccuguccuccacacgcauguauucauaaguggguccauauucaugcauaccguucugcaagguccagagaacauggagccaaccacauuggcuccuugcagcugguagggaugguggauguugcaugcuggggagaggugaaauguauggaguccagggccagggcucucaggugguccaguggcucccaggagaaggggauuagcaaggguuggcauccuucaggcagcaucauuugaagccuggaagcuagaaaacauuaaucauaaacgagcaaggaccaaaaccacagggcaagauggaaacagugagacccaguggagcacaugacuuucagggcaguguguugaauucuggaggaaacgaagcucaguggccguuucagggggaaguguacauggcuuugucugcuaggcacaggauuucccugcgguuggucuuuguggucucucuugaagagaaagcauguguccuuggauugccuuauuugucuuaguagguuuuucuuauuucuuguuuugagugcuuucuggaaaauaggguuuaauuagggacaagugaaucuagugagugauuuccuggaauuuguccaugggcucaugccacccacguucauggugguucuucccacguaguuaacccucucuagaaacacccugcaggcacccccagagaugugcuuuagcaauuaguuaaguccuaacagccagcaagguugacagggaauaucacuggggcaccggcuagccaggugcaagcggucauuuuccuucuucauuauuggagucacuucugcuggagucugucaggucaggugcaucugcuuucagccgguuggugcuuggucugcauguaucugcucuccacuuccuuauucuuuuaaagauaagauuacuuuuguuguuguuggugguggugguggguuuuuuuuuguuuguuuugucaagacaggguuucucuguguagcccuggcuguccuggaacucacucuguagaccaggcuuagaaauccaccugccucugccucccaagugcugggaugaaaggcgugugccaccacugcccggcuugaagauuacuuuuauauuuugcauuuauauucuauuuacuuguguggguguaggggauacauguaccacagugcccgaguggaggccggugugauuguugaaauccuuggguuccgaucagccaucuuacuuuguguuuuucccacugcucaccauucuuucuuccgucccuuccucugucucuuccuuuccuucucuauuccaucccuuucuaguucaucagcuugggaguuauuauaguuugaaguaaaauguccccacagggcugcauguuugaacaccccauguguaguccugugcuguauuaggaaguuguagaaccuuugagaucugaggccucgcugacagaaguagaucaccuggguaggcuuuggaaggcugggcagcuucugguucugcccuugcuuucugcuuccugguuggccauagcacgaacagcagcggcacccguucccauguccaugacuggagccacccggcaccgugaugaacugagucaaaguucugcuucuucaucccuugcgcuguuucugcgaggcgugggucacugcgaggcgugggccacugcgaggcgugggucacuucgaggcgugggucacugagaggcgugggucaugcacagcacugccaagagagcccagaucagggcugcacaagcuccuuguguucuuuuaguaacaaccaacacacacaugcucuuuuguucacauuucaaauauguuuccuagcuauuaugguguauauuuguaauugcagcacuuaaggcguagaagaugaaggauuaugagcucagagcuaaccuagacuacacagugaaacucucucagaaaaacccucauaaaaaucuuuacgauguuucauugugguauguauaacacaaaagucaucauucaaauaacuuaaaaauauuuacuuuauauguguguguguuccugaguguauauauuuauguccacgugggugcaggaucccauagcagucagaaggcaucgggugcccugagacuggaguuacagauaguugugagcugccauaggugauggcaauugaacuaaagucuucugcaagagcaacaaguacucuuagcuguuaagcuaucucuccaguucccaguuuaauaauuuuuaaguuuaguugcaagguaucaauguucugcaaccaguacugccauuauuuccaaaauaaucuuuaucauaccgagcagaaacuccauagcuguuaaacaccagcuucccguaagccugugguauguuccuucuauuaucaccuaaguacuggaucauagagucacucaguccacauucuuuugugacuggcuuguuucagauguacugucuucagauuuacccaucuccuagucagacuccccuuccuuuuuaaaguugggcacguuuuaaaccuguaucuguuugccaaugaguacuuguguugcuccucccuuuuggucauggagaauguggacguggugugcagacaacccuuugagacccugcuuucaauucuucucguuauaguccuaggcaugaaauuguaagcguuuaugguaaaccuaacuucauuuucugagguuuccuugagcuuuccgaagaggcgauccacuuacauugucucccgcuccugcacugcuauuacucuaaugacuuuguccagugucacagagcgucggagcuuuaaugcugucggguuguuuuccuuugguuggcugggcuuuuggcaucuaucauagcuucucuuguguuuucuucucaggguuuaaauguuuuagcucuuacauuuaugaauuugauccauuuugaauuauguuuuuguguacaauacauacacaguuccaacuuccuaguugagaugaagucagucugguuuagaacaaagaauuacauuuauuuggagauuguccccacccccaaggcaggguuucaccguauagcccuggcuguccaggaacucauucuguagacuacgcuggccaugaacuucuuuggaucuuuuuaguauuauggucucaaagacgauucaggaaguagagaguauacugucugaugguggccguuuucauagcucaaucucagaggauuuauuuugggguugugacaggugugugaggggugaacugucucacgugaagccuuguuuggcauaguucauggggucugcauaugcuggugaguccacagcucauccuuuacaaagccacaugcuccauuuaaggccucacaaacagugcugcucaacggugacuuucucucuuaacagaauucaucuuuucaaugcaccuaucuacuguuuuuagcacuuuacaauuugauauuauuauuuauuuuuuguguauggguguuuagcuggaugcaugucuaugcccuguguguguguacagugcccaaggaggcuagaagaggguguccgauccccuggcauuggaauaugggcagguugugagcuaccaugugugugcuaggaaaugaacucaggucuuuuggaagagcagccaguacuuuuaacuuuucuguuucuccagcuucccccacggguuccccuaaugcacuaaugcacuuugugacagggucucacuauguagcccuggcuagcuuggaacuugcuauguagaccacgcugaccuugaacuuacagagauccauuugucccucuguccuaaauucugggauuaaagguauguaccuccaugcccagcuuccauagugaaugaaacuauacucuccccucccccaacaauaggcuugauauccuugaaaaaaaguauugauuauguauguagggauuuguuugugggcucucugcucuguucuguugaucucucugucuuuuuuuuguaccaguaucacacugcuugguuauuguagcuuguagcaaguuuuaaagucaggaaauaugaauuaaaagucuuuauuuuacacauauauacauauauguguguguauuauauacagaggucagaaggaggcacugguuccccugggacuguauuuacaaauagugugagccaccgugugggugcuggggaucaaauccagguccucugcaugagcagcaaugcucuuaaccacuaggauguuucucuagcccaugcaaugugaauuuuaacacauuuuagaauggcuacaucagcuuucuguuaccacaagaaauaccucagguaauaaacuuagaagacaaaagguuuaucuugacuccagugucagggauucuggcucauguuuugggccugugacaagguagcgcauuaugaugggagagcgugcuacaaaagugcucaucccaugauuaggagggaaagagaaaagaggagaaaaguuaucuuugguucuuuuuaaaaauaauccauaacauuuaaaauuuuucuuuuccuagauaucuuaaguuggccauuuuuuccccuuuucauuuaaacacaauauaguuuuaucuucuguagcuaauacuuucuggcaucuguuggcaguuguuucuacucauucuugcugaauuuauucuacuaaaaucuacuuagcuagcuauaaaacuuuauuuuacgagauguuucuguggccuugucagaaagaauacugccuccuuuucuguuuggcaugagacuuguucuagggucaguuauuaguaauugucaucuacuuucccuguaaggagcugccugugacagcuguggucacuccugacagugucaucagugaguuguagcugaccucuaggguagaagcagaacacuggucacuucagcuccaacuggggacaggccugugcugccuuucccacuguguucaagacgccuacaaagcacucuagggcugugguccaucccaggugcaaccacaggaaaauuuguggguaaaacuaggugaugucuaggacuugauuugaaauauuugcagcccccaaccccccccccccccgcuccccacaucuaagaaauaguugacagaaauuguuaaagccacauggggaccauuacagagugaagauuuuuggaccuguucgacaucuccuugaagagcuuuuguguuuuccucuuuuaaaagucaucuuccucccccaacccucuucugauuccccaggcugaugugauggcggacagggugccccgcugcccugucuguacuggcguugugaaacccgacauuguguucuuuggggagcagcugccugcaagguuccuacuccauauggcugacuucgcuuuggcagaucugcuacucauucuugggaccucccuggagguuuguugaaaggcauguggggauggguaggagggcgguguggagggcuagggccugguugacggugucaccuuuucaggugaggagagucacugguggugacacuuaggguuugaggacaauggcuguguaggagggcguaaggguguagugaaagguuagccauggggcagggcugaaaggacugaucucggcacagagcuguacuaugggaugaagagcacauggcggcccugaagugaccuuuggugggaggagguuggcugcagcaucagcaguuagcugguacggggcagucagaggaccaguaggguuggggucugcaugcagguaugucuguggcucuguauggagaugaccacugaucugcaucugagucagaaugccagcgaguuuccaaaagguguaaagaggcaagaccacgggcuggagcccaucuguguguagacauaggggcaaaagguccaaaaagcucuguucaggaggccagcugugcagaggcugaggucugugcacucagccugccacugucacugcgugaugugaacaggccggucuggugcuuuagaccacuaacgugagauucaaaacuaaggcaccauugugggugguguguacggaaggacgugucagaguaaaugaauauuguugcaugggcuguggaggggugacauugcaaugcagcuguuuagugugagccuugucagugggucucaauaaagugguaaggcuuucugcuuaagguucggugggguacccuacagugguagcagugaggccagggccauggagaucccacugggaggucugaugcucugacuuucugcugaaaaggcuccugugggcugugcuguggauuggucagacaggacucagcaaagucccuugcugcugggguuggaugguccugacagguggcuagauaaaucagcaggggccaugacuguggguguaaagucagaggguacuaugucacguaggacauggaagagagugagcuaccacagaacuagggugugugugcccuguuccuaucauguggguuugaggauaccagcucagccaaauaccuuacaaagguaucugguagccaagguauaauacccuaaaggauaagguagcaaaaugugggugugggaaguagagucaggagggaccugggugaaaggugagcaaguagaagauuccagagugcugucauagauacagguuuggaaggaaggacagacuuggguggggguagaggggcagucaggggccaaaggguugggcccucuggucugugguacucaguauaugggcccaguucuucugauuauggcagcuaucagauaaggacacugagacugucagucaccuuuauuuuugaaguaaaaugaaaauagccauuuuuccuuacuuauaaauguaccaucugauuuuguuuguuuugagacagggucuuucuacauagcccgucuauucuggaacucacuauguagaccaggauggccuugaacucacagagaucuccccacccccgccucugcauucagaguucugggauuaaagguguauaccaccacugccugccaaccauaugcuucuacucauuuaugccagguaguggugacugccaccagcacuuuagaggcagaggaaggacagccaggacuauacaaagaaaaccugucucaaaaaaucaaccaaccaaccaaccaaccaaccaaaugucucguuuacagcagcagagacaaaguggagaaucaacuuuauucugucaguuuuuauuaucuuagucuauguauguggguguuaugucugcauguauuuuuggugccaguggaguccagaagagggcaucugauucccaggaacuggacugagagguaguugugagcugccauguaggugcugggauucaaacccaguuucucugcaagagcagcguacccuaucucuccagagccuuuaaagaaucagcuuuaaagaacaguagcuacuaauauuuuggccuacauccucauuggugucuuuucuuggggacaaauggcagaggccacacacugugacaugggugaugugagcacccaccuggagcagccuugcuagugcccugcuagugcuguguccugugagugugagggcacagacaggccaggccucaauccacuaccagugugggguaacaaaucugcaguguccuggauccuauauuugcagaaaaaauaguaaccuguuagauuagauuguggagcacuuaaucauauaaucuucuucuucuccuucuucuccuccuccuucuucuccuucuucuuccucuucuucuucuucuccuuccuccuccucuuccuccuccuccuucuucuuccuucuucuucuuccuucuucuuucuucuccuccugcuccugcuccuccuccugcuccuccuccuccuccugcuccuccuccuccugcuccucuucuuccugcuccuccuccuccuucuucuuccuuccuccuuccuucuucuccuccuucuuccuccuccuccuccuucuucuuuucuuuucuuuuuuuuuuuuuuucuuuuuucgagacaggguuucucuguauagcccuggcuguccuggaacuuaaaucugaacuagccagaacucugcaacauuuccagucauagguucuaagucaagaauuguggaccuauaagacaauguauguaggccguugcuuauugguggacaguagacaaacaguaauuugugugcugucugccguggugacuguccauguguguauuuacaccuaugcagguccucuugcuggacaaaugcugauaucgguguaugaggguccaguugcuuacauugucaccaauaugaaaaugacccauuuaguuuucugucauucugaacaguuacagagaggcaugacagggcuggugauguggcuugguggguugcuugccuagcaagcacuaagccugggucagcucccgccacagacccuguggggccuuauauuccugcucauguuuauguaccguuuguuuccucugcagaguugaaucacucgcccguuucucucagggcuguaauuagcaacguaauuaauguguauaaagcaucgcaccauacuuucccacagcaguuuuauguagaugucaggguggcagugccgaagucaccucucuccucucacuucagguucacgucuagaacaccuuuuccuccucacacccacaagcccuaguuuuucuuuauuuuuaagaacuuuucuuuuacauuuguuuauaugucugugugggccagaggacagucugugagagucaguucucuccuuccauucugguuccuagggaucaaacuuggguugucagguuugguggcgccuuacccacugcgcuaucggcaccuucucuaauguuuaggagcuguuaagacucuuugacuuguuuugcuuuucauuuuaaaagauauauguaugagugauugccugcguauguguaugauguaugugaguguguacacccuguguaucugguaccuaugcacaggauauugaagacucuggaacuggaguugcaguugugaacugccaugugguugcugggagccaaacccagcagcaagcacuccuagcugcugagacauuuuuccagccccuuauuuugauuuugaggugagggucuuaugugcccuagaugaccuucaauuugcuguguagcugagaaugaccuugaacaucugacccucggucugucucugacugcugggauuagagcugugcuacuaucauccuggcuccacagcugcuuuguucacacuuaaaucuaaaaucccuuucaaaguuccacagugaaagguaagaacugacuuuucccuuugagauaggagccaggcuugaucucaccccuuaaugaacucauuuuccaccguuauucuuggugcagaaauaggacacugauggggacccaggaagugggacaguagcagggugauaaaggguacuugcuccucuuugucaggcaaguauaggggaggcucagagcagggccccggcuguagaguggacagagcagguagaaggacaaugcuugcgggcagaacaugcagacaggggaggaggauggaguguggggagaagucagagcuuguauuggcccacccagcagaagagaggggcuauggaugggaaagagaucacccgaccaggggguaaaagccuuuguaaacuaaguggcaggcucuuugugucagucuccugccccaaggugucagugacuaguguucaauguccugaugugcauggucacacugccucucacauuuggguuaucuuucagguggagccuuuugccagcuugucugaagcaguacagaaaucagugccccgacugcucaucaaucgagacuugguggggccguucguucugaguccucgaaggaaagaugugguccagcuaggggauguaguucaugguguggaaaggcugguggaccuccugggguggacacaagaacugcuggaucuuaugcagcgggaacguggcaagguacaguggcucuggccgguccgacagagugcauccucucuggucacugcccucagugcguggcuggcguuuaggagcguggugccccuacagaccauugcuuuugcuuccuacucuacagcucucugcugggacaugguucugggaccuaggggaggggaagggcugagaagcugacauucucugcucccugcaugggacagagcuaaccugaaaugguuuguuaaucagugccauuaucuaguauagccggugggaauaggaagccugggaacacugcucuagguuuuauaguaccugugaaucacaggaaauaaucuccugugagaaccagguuauaugugauuauuauaaaaaggugcugcacugcccaggucucaccagaauauaucacagcugauguuauguggcucugggucuguggucucacuuuaacugucaaaagcucccagccucuugugcuuagccugagcccuuaaugaaacuggaccaaagagaagccuggcauauuaaggagccguggcauuuacugcuuccacagaugagauguaaccaccaguauugcaucuuuuuguuccaaggcuugguucuuaaggcugaauguacgcaggugccauuuauuagaaaacagucuauguuuugugcuaggccuucuggguucccuuuucuuauucauuucaaagacaaaaguuuguuccauaaaauauuuuuuaccucaaugacugauccaugucuaggaucugcuagccucugugugugauguuaacugaccucugccuguucuagcuggauggugcuggcucugugugugauguuaacugaccucugccuguucuagcuggauggugcuggcucugugugugauguuaacugaccucuugucuguucuagcuggauggacaggacagauaagacuauggcuucuucaccuggggaagucacacagcagaucauccuauguccagcaagacuucaugccugaagacagcuccaacacguuuacaaacaugaaccagaccacaacauguggccuggacagugguccuccgaggcugccuuuggaaaggcugaccagggaugucuacccuuggggccccuccaugugugcgcccuguccaccucaucacugcugaagguguagugcaggugcugcuuucugcagcggcccuuaaguuaucacgagggcagcacagcacgcccgucgccaggcaggcgaugcacuagggcaaucuagcauguugaucgguaaaguggcaucuuuaacuacaacaucauuucuugcaugaaauaaacuuaguauaaaaacuuggcau

SEQ ID NO: 4185 - RNA, 6278 nt, Mus musculus
cucugacuucagccuuugccagcacugacuuuaauuagccaaguuggcuugguacaggagcacaggguuuaccaggaucgugguccuacgcuaugaaccuuguucuggagaaacacuaagaauggaagugaaggccacgcugcugcucagcacugauggccaggaccauggccuggaacccuguccaucugacuccauucccucuggucgccagucugacuucauuuacccuguccugugauaacacugccuuccuucucacgggcugagugguuaaggacagcucucaccuuagcccaguacgcuagauaccaucugacgucagaaaggaaucaaagacuaggaaguucaaagccgcaaaaccucugagcacuuggcuagcccuaccuggugucaacugccugccacaagaaacuccuguagcuaagccccugacugugacucacuucucagcggagucacuggccacuucccaccuagccugcugaccagaguuucccagagaacagacgugugaacaggaaguuaaggccuagagagacaggaagguggggagauaaggaggggagggugcugcggucagccccaaacaaaggaucugugaggccuagagagcccaggacuggcgagggugaggaaaggagggaggggacagaagggacagaagggacacccuguaaccuuacugcuucagggcuggauccagacuaagagguugugagguuggggaugcaguugagggcaaaagagugucccagaggaacugaaagggacuucuaaugccaaaacuccuaucaggaaccacggaagaauuucugggcagcuauggggaugaccuuuguauccggccagcugaguggggaaaggagaccuucuguccugcaagagagaggguuaauccuugaagacauggaccaagacaucugggucacacgcccaaaggcuuuucccuaccuggugucaggggaagaugagccagcgauggccacagcucagcuucuaguaggggugcccagggcucugcacgggcugugaccucaagugucaccgaguccuuggaaaaggcgaaguugaucuuguuccccagguaggagauaccagagacagauacucuggagaccaggucuggacacagggggucaaaggucacaccugccucagugauccuguagggagagcugugugaagaggguugggacaagugggaauccauggcuggucgccggucgccacacucaccugaauccugugcacccgaagagugcugccugcaggaagccccccaugccagucaagaaguucacugcaccagacccgucugcauucuccguccacaccugcaggcagcaaggguggcugucaccugaggcuauuacccuagggucaagcaggacccuuacccugcugagacuaccacagugggagaagaucgaggcaguggguggugggcaggagcgaggcugaccuugaagggcucagugacauuggcgaaacuccugcucagguggaccugagcccuugaggggucccucaguuccauccagcccacagcaaacaugcucugagaucagaauucagauaggaagugguuagacccaccaugugggaaggcaggugaggaccguggggcaagacgacccggcaggcuccucacccaggucauagcagggcccuggggggaugucacggccucauaagucuccaaguuuuuccuucggaugucaggugucaggggaaaggggacuggguaccccaggagcacaacaucugccugcuucaccucuucuccugauuugggggaagggguaguaggauagguuauugaucaaagagaugagagugugccagggugagugugggggguuugaccaagcaagggccuuuagaagagucaguaccacucaccacgcucauagccaucaaacucaggguggaaguucugcucagagucaaaugguaucuugauccuaucagccaccuccagccacuguuuucggauaggcaaacccaaguccuuggccaaagcagcagcgaagugcaggcuggugaggggacaaaccacaguugcauggcuucugacugggcccugucagccaugcuggaggcuauggguaagugaagggcaaguuauauuucugaccuguucuggaccaggacauugguguagacagaguuguugacuccugaaugguacucaucggggggcaugacuccuggucggucacacagggccacaugacaguuagugcaggggcucaggacauguuguuccaugguaagcccauggugagcugggcacuacgcucuuagguccucaccuuucaggugguacaucuuguccugggagcuccauucuacacggcuacaccaaaacucagccacagaacugaccacaucccagccaccauccucuuggaagagcuucgaguccuggagaaugagaacaggccaaaaggccaggcacaacccacggaagagggccacugugccuggcuuccaaagucccucuucacacagcuuccuaggguccugggguggaguguggccucgugaggugcgugggcacacaccugacagugccucaccugaguguaauaguaauacagcugaaaggccaaggccacagccccauugauauggaucuccugggucccauaaauguccucagggcagaccuccaggccagugcuugcacucucccaagcaaacuuggcucccugugaggagagaggauggcuuggucaggccuugaucuggggagggggcgguccaguccuaccagaggggcaauccuuuguggaggaaaggaaagaggagguauggggcucucaugggcacugaauggcacuggaaagaccuuggggcaguggcuuaugggaugguacccaggccccauucauuaccugguagcccagguucuggccauucuucagggcuccucccagcguacggacucgguauucuaggauggcccuggcggcuucuggguggaacaucaaaauauuugggaacauccagauguccuaagggacgaaccauuugaggguaaacaggaguccauaccuucucccucccuuacucuuauggacugcccacauucaacccugccaaggcuuccaacugacgacacacagccaagcaggcagcugggggcuuccuccaucccuacccucuggcucucccuuuuucucucccuggaucccucauuucaugcccacucacacccaccuggggccuccccagcuugcccacuccagcgcuaucuuuccagccuagacagcccagaggucugguccucagccggggcaguaucaggagaagcucacgggcacgagcacugguuugcaucacgccucuagggagagcuugcucuccggcugccugaccucagcuuucuuugacuucaucugucaaaugggccacugugcagacuucacaaggugucagacgugggaguggccucgagccuucccucucgcuauucccucacgcaguggccgcugaucuccauaggcuacaaccuacaguacugccuucuccagcccuugcuucccccgcacccagcugcuccugacagucccaaaucuucccagacuguaucucuccuuguaucauucuucuacagucucuaugguuuuuccaguccuuuuguaagcuccaggcuugcaccuggcucacucugaggcucugguguucuuagccagcuaugaggccccuucucugcuuucaaauguugcagacccucagccuuugcgccuucuguuugcucuaaccuggaccacucuuuucuaccacauuccuacacaccuuucuucugagaaaccaaccaucucuuccaggaagcccuccuaucuagagcucccauguuuggucuugaucucagguagugcaaaggcaaugcccggaaucuuugcaugcaacucccccuguguaaccagugcaggguaggauguaccugaucccagaagauauggccccaguagcauuccuccuuacucccauuggagaguccuccggggcuaagcccauggcugaugaauccuugagugccaggcuggggaagcucacugaacagguaguagagagagccacgaagggccuggcgcagggccaggggcccagccacauccaggccacagccugcccagagccggccccaggagucugcauggauuguauacagaacaccccuggucugcagcuguagggccucagcaaagcaguccugggcuucagccuggcugcuacccacaacagucagaaacucccagguccuguccuucuccucuuccccaagggucaaggcuggggggacaggcauccauagcauaugcacuuccugcuguggcucuccaggcugcucaggguuaaguacguggccaugcagguaccugcaagggcauagcugagucuuaagaaagggcucgcucugcucucugggcuaccuagauuuacccagugugauucuuaccggagucccuggaagucaggccccacacgcagguccaggucugggcuuucgggggagaagucugcccguaacggcacugugauggguuuguucccuguggucaagcgugcaauggacacacugaagaccaggacaugggguaacacacggugagcauagauccgcugggaagcccggaagcuggggccuuccaggguguggaggaaggaaccuagggaggguuggggaaaggcagacacacucucaguaccacagagcaccauuaccuuccugggcugggagugggguccuucagaccucaggcugccucuccccacuguguagugggcccacccagaugaaaagaaagcaagagcaaccacacaggccucauuuugggaggcggcuuuuucauguuuuuuuuuuucuucuucuucuuccuuaaauuaaaggcuauguguuuacauauuuuugugaugcaucuugauguguacuggaggcugagcuccaacucuccgucuucccgccucaaccuucccaguaccagugccaagguuacaggccugaggcacacauuggugguuguggccccuuucccagcuucauggacaagugaggagcaauagguuggcacggguuggugacagcuaaccuguguugguguccaggguaaaggucucugucagcuguucugucccugcaggggccuccagcuggacauugagggggcugggcagacuggcccggugaguguccccgacagcuccauuguacacaccguuuauauggauggugucaugauacacacguguaccuagguaugaguucguuacaguggcccagagccuggggucacugggcagacaacgggcacugaauauggucgggucaucuucagagccguccauggaaagcugccucagcccagacggccuggaggagacaguuaacagugacuagcuggacuuuccuccacacgcacacucacaguaaacccucaaacuuggccaauccccacaggcggugaggggagucgggggcuagcugcguagcuacccuaaguaaggguugcgggcgccaagaacauucuuaaauuaagaagacugccaggagcccaagugaaucuguaaacaaguucucucagcacccaccgccgaccucccucuugugagcuccugagccagcuuccuuaaguaagaacugcugagguaggaaucagggaguucuucgcgggcccuaaauccucagggagggugaggccggacgguggaggaagaggaacccggagauuuggagagggacagcaaggagaggcguugggauuggggaggagggaccggaugggguggaugacgacgauggggugggguggggccgcaacuggggaguagcgggacuugcccaggaaauggaaagaggaagcccguguagggguggggugcggagagggggaucgaucgcgaguugucgggaagagagacuagggaauaaagggacgaaaaagaguucagaguacucagugaaagagggugagggcgggcuggagaagagugugggcuguuuuuguaacucaccgcugcccucuccacucagugcggggauccggguguaagaaggcucugugggugcgagcugccccuggcgguaggaagaagaagcggcccugccgcguggcaggugggcgggucugaguuuaggcgggaccugggaaacugucaugguuuuggggaagagaccacgcaauaggacuagggguuaguugagcuuuggcucuaagauguaugcaaggcugggacagaccugagauaccacucuacagugacguuua

SEQ ID NO: 4186 - RNA, 7183 nt, Mus musculus
ucuggaaucugccacuuuuaaucgugaacagaggcucggccugguaaguggggaaagggacaaagccaagcacugaggacccucuagguuauaaguuaagucugagggaucugaguggggcagcaucaaauacacaucguggacaagagggccgccucugaggucacggcugggcagggaucgaggugcuauaguaggcuguaacucccaggagcugguguugggcacagcugaccugacaugguuguccucgguucagggacaggcucggaacucuuaguuauaguccuccucaucaaacuuggugcugaagaaagccgcagagucuuuggcuaacuuggacaggugcaaggcgccagucaccaccagucccaggagcagcaaugggggcaccaauguccacauugcagccaggauguuguagcacuuggcuuuggagccauacugccuugcagccuccaaguucccagccaucuucuggucucgggccugcagggcagcaccagaaacaagauguuaacauguucauggugucuaggggacccccccucccccggagcaacuguagagcacaggcuaaacucuaaaucuugacggaggacucuggcucaaggagacauaucccucggcuggaccuaguuccuucacaggcacaguuuggccucuggcaggguccuaaccauagucucagcauaaauaaaggcugcagguagagauucaguggccauucugggucagcagcacccucugagagccuccuaggggagaggaguccuaugagaaaccaagaacucagugcuauucgggaacuacagugggaauuccucuaugggcaaccuuuaaggacuuugcccuuugagggagacuauauagccagaccuuccuuuccugugaacagugcauacaccccuuaacgguccccaaacuuggugagguacuguggcuaugccaacagacacccucauauacuuuugaacacugcccccuccuucccggacuccacaucaccuccccccacaccacacucauucucccaucccagaagccuugaagccaaccuugacagaguggaccagcgccaggaauccaaggcagcacagauucagguacaucgugcugaagacagaccagagcaugugaucucgugguguagggccagguguucccauggagagggcugugugggcugcagcaucagccuugcgggaugauggagcccggggguccucacggggauaugaaguguccauggguuccagcgccgugucuuccuagcugagacuuguccucucugagcaccaagccugcuuauagccccuugcuacccucccuggcugaccagcuccacccgcuauauauaucacaaauuacagccucagccugccaaauagaguggcccgcccuugcaccccagcgucccccgccccucucaaaagaccccaucaaaggccccugcgccacaugggcaguggcuguagaccacccaccagagucccgcugcucucucuacuucacaaaaggcugucccaagaacacuggcugcaaacaguuccauggcagacacuagggcugagaaaacauggggcugcaucaguuucaggcaacaaccagagcucucagguguggcuguccagcagccaugggugaacugggugaccugagaggggggcuggagaugaaaaggaauggggugagagagaaggaugaagccaagacaaaguuucugaucaaggcuccaaguuuaauuuucaucacuguguuuacagagggaaagcccacagaccccaugcuuuguuucagcuggauuauguugcagagcuagcucagugggcaguccacuccuguaggaaauugcaaauggagcgaggccacggcuaggcuguaaaaccauugugggucgguuuagccuacucaaggcugggggaagggcacacucaggaucagagcugcauaucccugccagaacucagacuccaggcuuugaccaugaccccugcagacaugcauaaaugggaccucagauucguaccugcuagagauaaaggcuaagaagaagacagcaggcaaagaggaauaaugaaggagacugccuccuucccacugcacacuguaggaggcuccuccccacucccuguaaccagcacucuccugcuccugggcagguagauccucuucagucuccuuagcuguuaggccugcccuucccaguccuaaaaaugugaguggaaucauuuccuugagggcucagauacuugcaugugccaagaacucaaugcauguccggcaggaagucuaacuccaggcucgcaugccaagagccuccuccguaaaggggaccucagugucuucccagcucaaauccugagcaagagcuaaauccuucacaccaccacugcccagccucccucagcugcuccugcucacgcccacucggaucaauaaacaagcgagcagugcagggcccucgggaugguacgugaacauggagggaagaccccugaccugauguaaggaggcugcagugggcagggaggaugaaagggaccuagucagagcaucugacucccagaugacuuucuccaaggucccuugucauuugaucuccuccagucuggggacauauggguaauauuuggagccuaggccuauaccugccacgcuaagugcccauacaucagugccuuggucuucaucaucuguguaggugcuguuucugccccuucuguuaaucucagagaccucuuuuuaaaaauauuuuuauauauauguagggaggggcguguauguaccuaugagugcagaugcccacagagguaguguugaauuucuagagcagcaguuacaggggagccaccggaaguggauacuagaaaucagcccggguccucuuacagaguagcauaugcucauaacugcugagccaucugcucagcccuccuuacagaggacaggucugcccucuguccugcccuggcuuccucgugaggugagcuagagaaggcacaagaacaagagcaaucugccaugguggggcugacacaaacucagaccuggcuucucccaggacaugugacuacucagacgaaaacaugaccaucccagacuaagcagaugagcuccgccuagccuuugcuucauuauaaucauaucuucauagccucagaauuauaaaaucucucgcucccauuaugccugaggacaaaggagggaugggacuguacuggagaaaaaaaaaaaaaaaaacccugacaucucagggauuucccuccuauuaccccaccuuaacucaugacuaaucaauucauuccccccccccaauaaaagcuuagccauaggccaagaacgguggcgcacaccuuuaaucccaguacccagaggcagagcauguggaucucuguggguucguagccagugugguccacauaguucuagaccagaccccugccuuaaaagagagggagagggagagaggaaaugaggggggagggggagggagggaacgaggaggagagagaguaugaauuuucaaaaacccagcaguugaaacuauccagaagccuccucccagccuuugauuacaucccucuauccaaaguguaacuucuucccagugcuccucugguuccugacggugccaagaaccuagaacacugaggucucggccaugugucugagagcucccagucuucacucaccagcagcagaugcuccacagacgcaacacccccugacaccuagacccuuacugcaucacagauauuacacuuacacgccuguccagugagacuuuguaaaacacaucugguucuaaguguggcguaucaaccucuacuguuaccuccaccaccguccuguugcuaucugacugaggggagaaggacccauuuucuggccuccugcuuagggcagauggaaccacagugagaguccgggagcacugaggucuacuuuaagaauacacugugucuaaauuuucuaggcucuagagcaccccgucugucugacuuuuggggaaugagaacagggcuggcccugagagauggaugggccuuggcaccuucagaagcaguugaugacacccugguccuugucuauccuauggcccaccacuuccuguccccugagcauuccacucuucuauggggcugguuguauagacguccaguagcagguuggcagggcagcauccucagcucuagguccacugcagaagccaaauaucaagacccgugacguggugacagauaggacagaccccgaagucucagggcugaaucccugaacuugaguaucugcucccucgugguggaggaacugcccugggcccaagaaaguuccuaggccucugggcacccaggguaucagcaggcgaguucucuucccaagagguucccgcggcuucaggaaggucuugaggucaaguucuguuuaauuccuuccuguggacuguaacccuccgucgaaaugcacagccuguccuaagucucccugcugauccaccacccaguuccccuggucccuuccugccaugcgugcauccacgagaaugaaaagcaucccuccuccuggaaacucucaccaacucggagggagucaagaaucccaacauaauuaacauuuucugaaaccugccauuuucgagagaucucaccagagacucucugcaaagcccaagcaguuccugguuuucccucaucaguguggucuccauccaaagcccugcagucgcucuauagccucggcuauggaacgaggagagagaagaguuucuuagcacccuguuaagcaaugacauucuaaaaagcuuccccaaauccuacauagagucaccccuaaaacacuuagcagugaccccucacaagcccacacuccuacuccugggugugcuuuauauuuuaccaugggcacuguuucgaauaagcuccaacuucugccugcuauuuugggaaauucucuuuaugucaaaagcacguugagauuucuaaaagauuaaaggaacuccccaaacuggcaugacguagaaauaagcugacccccuucccggcagcugcucuuacuuccucuuaaaaaccauacuucuaauaaaaaaacaaacaaacaccacaggccuuccccuugcugaagucgcacagggccuucaccugcaccucuaugguagggaucacugugccacgcccaggauuuuagauaaauucaaaucaucauggugguuagggaagcaaggacccaaauccugcagacacuggaagcccaaucugacuuuuuggugccagccuuggguaagcagaaguauccuuuagaaggaacuccagggaugcaaggcauguuagcggggugccaaggcacacacagccuccccccuaggagagguggaaccuaggagcugugaggccagcagaacugucaugugguccuccuacaagaaaccuucuagaguccccacccacuccaggucccuacauaagccugaguguggggaaggaaacagugagggcagcaaacuucacagcacccaacuuuugugugcgggccagcucaggagcuugaagucauauccaagaggccaccacaaaaagaggacacaucuuggcuagggauuucuuuuccccuaaaguaaaggacuccgggugucuuucacuccuaggccggagccuccuuugcccaaaguucugcacccuuccugggacccccgggagcacggccucagcguuagaugauccucggauccccucugccuggaucaggcaaaaacccacaggucggcugcugcccauaucuggagaccagaagccugacaaguuaacgacacuugcucuccucagacaaaaaggaugcaaggugagcucgguacagaaccagagaacagugagucacagccagaguugccaccccgugcacuuuauugaauccacuguggacagauaggugaagguaacauuugcauacgcguaggguaaagggucgaggcuugagccugggggcggggcaggggcggggcagauguggaccguggagcacagggcagcuagaauccagaaugggguguucuuugugcaaaagacugaaagacuaccacagaggugguagagaaaauaaugaugcagauaaugaccauaaggaugcugaagaucagggagcugauauucaggcacuuggcaguggaggcguaggccugggcuccaaccacaucgcccaccaucuuccugucccuagacugaaggaaauuagauguaaggagcccuggagcuggccagcugagagccaggugcucuggcuccauuuccccaacugcucccugcccacugucucacucccuccagccgggaaacccuccccucuuuucacacacacacaaacacaaacuauacaguaagcuccagcauucgcugcauaccucacuuuccacacagauuagggccccagucuaaagggugaagggguggggaaagucuggccccagaauccccaggcaguuucauccugugacuaucagaaagucuccaacaccagagacagacagugcgcgcgcgcgcgcgcgcgcacgcacgcacgcacacacacacacacacacacaaauaggaagggugcacacacacuuucuuacagaaaggaccccacacucacaccucggugcuaucugaguagauggcgcuucaggcucacacacaccuucuuacaccauucccucccacccccucuagcacacucaccuucacagaguaggcauaggcaacgaagcccaggcagcaggcguugaagaagaguguauugaacagggaccagaccacauggucaggcaccgacaccucucugggcauguugaucacggugguccucacaacagcugaguugcuggguucccccagcucagucaccccguacuccucuuugauugucucauagcuuggaggaagcccggcauugguggacaagaaggcuugagaauuguggcucaugguacugacucuggaacaaucgccccgucuggaggauggcugcugcuauccugguucuguagacccgcccuuucucuagcaauuuccuuuuccuguugguggguuagucuccagagggccuuacuguggggaauuggcuggauacugaagugggcgguacuuaggccuugaguaucaaauuacuucaggacuaguugacuguugagguaccucuguauaaacuucca

SEQ ID NO: 4187 - RNA, 1228 nt, Mus musculus
aggauggugguuaucaagugcacuuuauugaauccacuguggauagauaaaugaguguuacaccugcguguagggaggggcaaggagggacgcagcugcggagggugaagcacuucaggaccggaagucggaauccucuauuaagugugaagguuuugagcguuaagaacaaugaugaugacacuaacaauggugauaacaaccaucaggaugcugaggaccaaggugcugauguucaggcacuuagcaguggaggcguaggccugggcuccagucacaucacccaccaucuuccgaucccuagacuggagcagaacagauagacacggucaguggcccuggagcugauaggcagaugcucugacaguuuuccugacguacucccuguggacugcaucuccccaucuuaggucaggaacauuuuacauccucugaucauccaggaggcccuagcacuuguuguucaccccacuguaggcuauuguuccccaugaaucuccugaacauuuuccacacaggcuagaaucccagucuguugagugaaggugcuauaggcaucucugcauuggaagagucugacuccagaauccccaggcagccucacccugugucugcccccagagagccuuuaagccuacacguguacacacacacacacacacacacacacacacacaccacagaagaaugaacacaaacuuauuuuaaacaaaggaccccacacucauaccucggugccaucuggguagauggagcuucagguucacacacaccuuuuuacaccaucacuccccccauucuagcacacucaccuucacggaguaggcauaggcuaugaagcccaggcagcagaaguucaugaagaguguauugaacagggaccagaccacauggucaggcaccgacaccucucugggcauguugaucacaguaguucugacagaagccgauccgugcggugcccccaucucagccaccucauauucuuccuugauucuuucguaguuugggggcuguccuccacuggcagcggugaugaaggcuugagaagugugguucauggugcggagcaaaggcagcacugaagggcaaaggauggagcgcgcugcgggucugcccuuucugcggcaguuucgguuucucagaaguuuccuuuuccugaauuuuggcuugaugaaacugcucuggguucagaggggcggggaucuaaaaagccugcggaucaaau

SEQ ID NO: 4188 - RNA, 11299 nt, Mus musculus
cgaccgcggccugagcagcccgggaguaguggccgaaucccguaguccccgcagcggacaaaggaccaugcggugcugcaggcgcuaagcgcagcagggugggccgggggauguggggcggggcaggcggggccggggggccgcagcgacgccccugauuguggcgccgcgaugccgugguucccggugaagaagguccgcaagcagaugaagcugcugcugcuguugcugcugcucaccugcgccgcguggcucacguaugugcaccggagccuggugcgcccgggccgcgcgcuacgccagcggcugggcuacgggcgagguacgcgauggcgcguagcgagagggcccggaccucccaaggccugggggucugacugcccagagccccugcuguccugcuccucccagcucagcuauauugggggaggggucgcgguucuguucggcgggacgcccagugacgucagcaguaacgccagggacccucggggcucaucccuaccuuuuccgacccuggaaucuggcuuagauccgguggugauggaguuaacggugggcccuugggggaaccggugcccucagcuaagaggcuugucaggccauugccuacuuagcagggccucgguuuccucaucuucuggaagguggggagguaagggugguguugagggauccagcugccuagaguggccagagcagcuggaaacccuggguacaccugugagugaacugagaugucugugugcuagggaccaaugcuaacuugaguaaaugcuugcuguaguuugcacguuuaagaguggucagaggauguacaaagcaacuuaggccuguggguaagaauccggggagaaccucuggaguugguggccauuggacccacaccuugggggaaaacucuccagagcagggugaacaucaaugacagcuagguagagaaagaccagggaaugagccuggagaagccuaaccaagccacguagagcucagccccaucuuugugagggaagcuggugagcugaggaggggagcaaguaucucuccucucaaagucucagagcagugacacuggcucacuauguucugguccaguccaccugauggauccagaacucccuuuucagcccugcaccugucuccugccugcagaggcccucugccucuucuuaugccuggacaacuguuuccagacaucuuccagcagauccugggccaaggaucugagacagaucccagcccucaagaaagucuaugggucaucccaaaccauguaccuuauuagcugugacgucuucaagauauccugccacagcucuaucccgaagagauaagucuggacucagagcugacccaguacccaauaaagccagcucccaccagcugcccuuguggguucagcugacuuccugagcaauuuguuucugucugagaccaaccaggaaggaaugaagacagggaaccccacuguugaagauugaucacgagggcagcuggcucugacuccuccuagguggguaggaucuauucuggauccuggaagaucaguccugcccaauggcacugcuagaagcagccugggcggcacagauggggccccagccacacacucucuucucugggcugaaggccaucuccugucuggccaccugggacccaccaggcaccacaaggcaugugagaaauuggguagcugcaagcgccugagacuuuccugacagugucgucagucuucagagcuggcaacguucagcggguguccagcagccugugcguauagauaccuccaagugaggguggggcagauaacugucccuuugugcugaggcuuagccugagcugagagcccacuacagaaaguucccaguauacucaaaaugccuggacuuagcuugaugggcuguggguauccaggccaggcuccaggacguugaccaggagucuugcuugcucacuuccuggcuucucaaggaaggaucuagaauguggagcaccgccaaaauuucaagggaagagaccacacaggcagccccucaccuagagacaguucaggcucaucugguaucagcuguaccuuuccaguagccuggcuucugagaucagcaaggagggacagaugugaaugcaaggugugacuuugaaaaaggagggauuccuggaucuagugucucauugggagcaccaagagggacaggauugggauagaaugaaaccuccugccuuuggagacucaagucccaaagaguggacacccaggagugcagugggcaugcuacuuagggagaagguccaagaagugggacaaaacaagguauaggaguagucuacuccaagcuggaggaacugugguggacaugucuucacauagaucuggagagagaggaggcaaacacccuagcacgugggaaggacaucaagggugcuaggccaucugcaauucuucccaaggcaaagccauucugagaggaucaccagaugggugugaguguguacaguuucacacuagccugaguauauauagcccugcuccucgcucucauuagggacuggagaaagcugguaaaagacucuugcuuuguauugcccacccaagguagggucuagaaggcacccaaaugauggaagcggaaguguucagcaguccuucuugccccaccccuccagcugacccccaacaacaaagauaauggccuuaaggagucugagcucuaacacgccucauaugcgucugcagauggggagaagcugaccggugugaccgauagccgcggaguccgagugccaucguccacacagaggucggaggacucgagugaaagucaugaagaggagcaggcgguaaggaguggccgagaaaaaccuagucacaaggagccacccucuaggauggguagauaugacccuggguuguaugugaguuucagcaucccagccuggauacaggguccggguagucacugagugguaugcaucuguugugcauccagucaguggcuacauaacugucugggcagaucugcugaggguaucugugugggagagugcuuagguggugagacuggaugugcaaaagggaaaccaugaaguucuacucugcugugugugcccagauggacugugcaguugugacacuuccugccuuuagaacucugauauggcucuuucuuuccugcagcccgaggggcggggcccaaacaugcuguuuccuggaggaccuaggaagccacccccacugaaccucacccaccagacacccccauggcgggaagagguaagcucuguugggcugggcuggccugggcugggaggaaggguggggcagacuguauaacagcuaaugucccuucugacccucaguucaaaggacaggugaaccugcacguguuugaggacugguguggaggugcugugggccaccugagacggaaucugcacuucccacucuuuccucacgugaguaccucaaggacguacggguugguaaggugggcaaggcaugcaaugagcugugaguuaguaguuauugcacaaccggcagacucguacuacggugacaaaguuagcuguguccccuaaguggaagaacuauggacuccggauuuuuggcuucauccacccagccagagauggugaguagguugcauauggcaggggcaggaugucuugaacaguucagcuuccugagccucuguccuuuggacuaggagacauccaguucucuguggcuucggaugacaacucugaguucuggcugaguuuggaugagagcccagcagccgcccagcuuguagccuuugugggcaagguaaguucugcccucuugccuagcuccucuauccacaccacaucugucuucucuggaucuccugcagccucuuggaaacacagacuguguccaaugcccacagggagaauguggucauuccuuugucccccuugugucaccccuagacuggcuccgaguggaccgcaccuggagaauucaccaaguucagcucccaggugucuaagccacgucggugaguaacuuaagcgugcaugcauucacacgugugugcacaucuauguuggcauaugagagggaggcuggguaucaugcuugcccauguuucacaagcacugucuuccugaggggucaucccggagggauaugagauuuuguccuaacccucuggguucuuauucuguuugaugagaagcaaccccaacuccuuaugucuacaggcucauggccucccggagauacuacuuugaacugcuccacaagcaagaugacaaggguucagaccauguggaagugggugugaguguggccugcccucugaagaagcuccaaagaccacagcuccccacccccacccacuuccucuaucaucggacagucacugcagggugguccccagcccaaagggauuaccagucuaggagauaaagcaguuauuugggaacaugggcgagggucaggaggguaugcuaugcuugcuggaugcucagaggggcugcacugaaaagugguccuucaccaggagacauggggaagacagaguguucaggccucucugaagucuguaccuggaggacuagcuccuauuaucuagcaucuucugagacuccaagaaguuggguagccugaucagucaggccugugaugcugggaugaacugcucagacugccgugggggagugagguagcugagauuuugcaugccaggcaucccucuggccugugugaaaccaugggaagcagagagaccaagccuugggaaguguacuaucuuuuuauuaccaugaucaucgcuguaacgaaauccuugacaagaagcgauuuaagggaggguuuaugucagcucacaguuugaggguucaguccaugguggaggggaagcccuggcagcaggagugugagguagcugguuacauugacucugcauccagaaacugagagacaugacugcuggugcuuggcucacugucuccuuuuuauucaguuuuggaccaccguccaugggaugguacuccccacauuuuaggguaggucuccccacucccacccccaguuaaccucaucuagguucucgcucacagacaugccuggaaguuugucugcagugauucuagagccuguuagauugacagugucagcaaccacagagaagaaagacagggagacaggagggaggguuuacuaacaggacagagccuggagggagagauacaugaccacaguagcauuggugcuucuuggcuucagcaccucaguacacaucaucccgucucaguagaguggagacucgguguuuggauggucugagggaagagagcagagguacugguaacgagggucccagaugagcucagucagcacccccaggagcaccagcugaguagaggugggaggaacacaucugcaaggagacucaggagcauccauggagcuggggcacggggagggccaucugguggcagauacuaggucaggggcugagggaagauccggcaguggccgcaggaaggcaacgugcaaagccagagagaaaauggagucagaaguuauagucagcaacuuuuggaggaaaggaaaagggagggagggaaggggaggagguagagaaguggggagggaagaguguuggguggagucuggaucugcccccugaacaucguaaccuucugggccuucugucagguuccucuuccuuaagccccuccugcccuccccaucaagcaucuugcauccuuuggggauuuucacuggguaguucccucacccaugaacuaaggaaagccaccuaccaggacccaaccucuuuccucuccccgcacccccaguggcgagcuuuccugccuggucugaaguucgagaucauugauucugcucacauuucccuguacacaggugcgggcuggguauuuccucaggggauggcuggguucggggguggggguggggcucagcauggggaugguggaggggaggaugaaguucccgauacccuccuacucccagaugagucaucucugaagauggaccauguggcccaugugccucagucuccagccagccacauaggaggauucccgccgcagggggaacccagcgccgacaugcugcacccagaccccagggauaccuucuuccucagugagaggaggcuccagaggauggggaggauggaguggggugaaggccgggccaggcucccaagugauggcccuuuuugcagcuccucggauggaaccuuugagccuggagaauguucuggagcccugugccuaugcccccaccuauauccucaaggauuuccccauagccagauaccaaggacuacaguuuguaagugcccggugugggaggcggcggcuuaaagcuacccuuugccccaggcccuaccccugagccaucggcccugcccgcagguguaccuguccuucaucuaccccaaugaccauacccgucucacucacauggagacagacaacaagugcuucuaccgugaguccccacuauaccuggaaagguaggugggggcguggccugucagaagcgagaaugaggagccucgaugaggaaggucucugaugcacuuucucccucagguuuggguucuauaaauacaugaaaauggacaaggaggagggagaggaagaugaggaggaagaaguucagcguagagccuuccucuuccucaacccagauggugagugucucgguccugcugcacucccagcccaaaugccagguacuugagcuuaccagacccucucugcagacuuccuggaugaggaggaugagcaggaucuguuagacagccuggagcccaccgaugcaucuguacagcagagccacaggacccccaccccagcagccuccacuggaacgacagccagcccgaccccaccuacaacuaguccucuggacgagcagacccucagacacucccgggcacugaauugggccccacgcccccugccccucuucuuggggcgagcuccaccuccccgaacuguggagaagucgccuucaaagguguacgugaccaggguccgaccuggacagcgggcuuccccgagggcauugcgagacucacccuggccacccuucccuggcgucuuccugcgccccaagccucugcccagaguacagcugcggguacccccacauccaccucggacccagggcuauaggaccaguggccccaaggucacagaacuaaagcccccagucagggcccagaccagccagggaggccgggagggccaguuacauggacagggacucauggugcccacaguggacuugaacuccucaguggaaacacagccugugacuuccuuccugagcuugucucagguauccaggccacagcugccaggagagggugaagaaggggaggaggauggggccccaggugaugaggccacaucagaagacagugaggaagaggaggagccggccgcugggcggccccugggucgcuggcgggaggaugccaucaacuggcagcgcacguucagcgugggcgccauggacuucgagcuccugcgcucugacuggaacgaccugcgcuguaacguauccgggaaccugcaacuuccugaggccgaagcgguggauguaguggcucaguacauggagcggcuaaaugcaaagcauggcggguacggggcagacggcugcuugaagagaaggcaugccggugucugcagggaucgcagaacuuccuuggcucucagcaacucucugagccccuucucccucucuguaacuacugucuuacuuauccagguugaagggcucucuggagccccccucaagacugacuucaucucuccucacugccaauucccacaucugccaccuuagaccuagacccagggaugaacccaaaccaucggggacaguagucaggaguagccagauugugggcagacaaccuuuucaggaaccagagacacuaaagugucaugaccucuaccuguggagcacugcagggucccaacuaggggacugugucuaguucaagggagccuuuggccuccuaggucucaggcuucaaacuuguuucuaccccauuuugagggaguucuuaugagacuguucuguucauugucagccuugaggaaggggaaaaccuucuuagggcuuugaugaacgcacagauaucaggacaagguaucuggcagccaguguugagagccaagcuccacacaaagguuugaacaggacagggguuggaggaaggggaaaaccuucuuagggcuuugaugaacgcacagauaucaggacaagguaucuggcagccaguguugagagccaagcuccacacaaagguuugaacaggacagggguuggaggaaggggaaaaccuucuuagggcuuugaugaacgcacagauaucaggacaagguaucuggcagccaguguugagagccaagcuccacacaaagguuugaacaggacagggguuguacacagaugugcuccagagggugugagccugacagcccucaaaaggggccaggagacccuucccaccacuggugauuauguuggacagaccuagguggcucagagggcaggucucucuuuuuuucccccagagcugaggacugaacccagggccuugugcuugcuaggccaaaugaucuaccacugagcuaaauucccaacccugagggcaguucucuugagagcagcuuauggggcagucucuuggucucuuuauaggacuguccaccuugaguggucauaggcacaucugggugcuaugguguggguagcuuaccccaaggaguaaccuaaaguguuugguuggggauagaaaguuccugauuuggguauggcugacucccaucucaggucaugccaaugguaucccauagggggauugcuagcugucaccagagggugggaagcagaauaaauagccuaaggccugagacaaaaugaggggccugcuccggguaugagggguacacgugggagaacuaacagcuuccuggugguucuugugggaugcuaaccauaggagaagacugagacaucaccucaggacaaagaaaaucaugcagaggaagacaucugggagaacuugacaauccugggcucacagcgaccccuaguguagccuuuccuauuuccugcugggcuggggaauugagacgugggaaggucaaccuguguuuaggagcgauagaacggguugcagguauugcggucuggggaguacagucgcgugguucucgggguaaagggggaggcaguugagcagagcuacaacccucgguuaaucacaccugccucgcaggcgcuucucgcuucuacgcaucgugaacguggagaagcgccgcgacucugcacgcgggagccgcuuccuccuggaacuggaauugcaagagcgcggagggagccgccagcgccuauccgaauacgucuuccugcgguugcccggagcccgcguuggggacgaagauggagaaagucccgagccgccuccagccgccucgauccacccagacagucgcccagagcucugccggccuuugcaucuggccuggcgucaggaugucaugguucauuucauuguaccagguaugugcgccacuaugaggcguucggggguggggugggaggugggaaccauucgguccagucaugcugcuucagugacauccccucuuccagugaagaaucaggcgcgcuggguagugcaguuccuggcagauaugaccgcgcugcaugugcauacgggggacucguacuucaacaucaucuugguggacuuugagagcgaggacauggauguggagcgggcccugcgugcggcucagcuaccucgguaacgauguuuaccaccauuucgggaaaaccaaggaucuuuccucuuacaggagaugaguuauucugacgccgccguccaccuuccuuuccucuugcagguaccaguacuugaaacgaacuggaaacuucgagcgcucugcaggccugcaaacuggaguggaugccguggaggucugugggccagucaagggcuuaggggaaagaaaggagggugcugagcucaccuuggggaggugagcagggcucagaccucccaaccuacaggaccccagcagcaucguuuuccucugugaccugcacauccacuucccaccuaauauccuggacagcauccgcaagcauugcguggagggcaagcuggccuucgccccuguggucaugcgucugggcuguggaagcucaccgugggacccacaugguaaggaccuggguguucccuggggagccccagguucucacaaccaccagggcaaacuccaaaccugaccuccuggguaagaauaggacccuauucauacacauaagacccguucgucuauaaaccuaggagcucucuaguuauuagcaaauaccaggcacucccucccacccagggucuccaaaaucaggcuucuuagaauuccucccaggguccucuagggagaaaauguuagggaccacacccuaaugguuauuuauccuccucaccucaagguuacugggaagugaauggauuuggccucuuugggaucuacaaaucagacuuugacagaguaggaggcaugaacacugaggaguuccgugaccaguggggaggcgaggacugggaacuucuugacagguaacugcccuccccucccucacacugagacaccucaucauccucccuugaggggauggaaugacagaacuccaccugccaggaucuuagagacccacaaaaucccuuccacccacccugcauugaacccuucccacccccaccccccacccccggccuccugcagccgccagggcagccccaagccacagcaccugagccaggguucugacguuccacccgcuccucccaggguccugcaggcagggcuggagguggagaggcuucgacugcgacacuucuaccaccacuaucacucgaagcgaggcaugugggccacacgcagccgcaaaggugcccgcgcacagcgauccugaagaccuagcugcccucugggccaccgggucuuggugcagcagguagaagcugcguccugagcuugauucaggcucugccaccaccugugcuggucccuaaaagccuccucugggacugcagauagguggcgcucguggcagggcaggcaccuugguccccacacccccugaugauuucugugaaauuuuccguagcgacgacauuguuuucagaauuuacaagaguucugucuguucuguuuuuuauucagaaugaaaugaaauauuuuuuuuaguucugac

SEQ ID NO: 4189 - RNA, 16597 nt, Mus musculus
aacaaccgggagcccgcaggcacucucacaccugccagugccagccagcauccagagccccacauugaccgagggaccagccaccagcaugcaggugagccucgguucugaggguacaugccugcagccucuacagcugucauccuucccugaaggcuugguggcgggcaguucccaacaaccugccaucucagggagcacgcuggcuagaguuggauccuugacuauggggcaggcuaaggaagaggcacgauugaugaaauagcuuucuaguccuauucuggaauucugaagaucccaggaacugggauccuauagguaugugauguaggguuuuucugccagacuuaccuauguaaggugagaacagagaugcuguggugggacacucagaccugugacuuccacugacggggagggacuaugggcaccagguuagacuggccuguguagcugugugccacacuuucuggauccugcuccaggcagacuggaccuggagccuagguguaguccagaagguaagauguguguguucuugggguaccuuuuagaaagcacuauguccccuuuugucaaccaaaauggucaccuggggcagaggccagcacuuaaucuccagggaggaggcaagggcgagguagagagugaaacuaacuucccacggaggcaccaggccuccaggugugggcuguguggguggcugcucccucugcuuuuaugcaguccucucacuaggccuuccagacccagcucugggaacugaguguucagguuagcacauagacacccuuaaccuggcuccaauauccauccccuugccagccucuuucucaagcuagugguauaaggagagagagcaugagccuuuaggaccuaaaguuuagguacacagaggguuugguggucccagguccuaguggaucugagccugcccucuacuguuuaaauuucuuccaugacucuccagagcuuuugucgaaguccaagaaaccuuccuugaccuggcuacuguaaacgucuagccucgccugguggcuuucuccuugcccuuuauacuccugcaaaguugaagugcugaggacaaagucaccggguguagugacuacccaguucccaggggugcugaggacugaguccuguggggacuugcaugcgcagggucagaagacaagccucuagagucaguucucuccuuugaccacgugguccuagggaucaaacugaggcuugguggcaggugccuuuaucugccgagcuaucucccugguccgggcauaaguucuucagauccauagcuugugagucuucugaggugguaaggagugagucccugaagggguugagagcugaauaaacuugccaagugcagccugccucucaggacugacacacaugcaugucucucucccagaaaugcugccccaaucuuuucccuaguuuguucaucuuuugccuuaggagguaaagauugggaccaccucucccacaagguaaacaugacuccggucccuauauguguccacccaugcaccacccuccagggcucagcacugagaacacagaguuuccaguuuagugucuggggauggauauggggagguauuacuaggcagggugccaaggacauaagggugcccuggccgcuucucuuguuggaagaguguuacaggccucagagcacuagcaagggagguaaacaugaucuugggacaaggugggccaaaggacaaguggggugggaagccagguccacgccuucaugcaugugugccgugaccugugggucagccucgguuuggagauggaugcucuguaugcacgcgucucuucugucugcacugaccgggaaggcagcucggaggugagcaccagggagcagggcugcccugcgcugguucccugcaucccugacccucaggagggaggauuccuuaggagauuugauggcccacaaacugaagagguggccuguguccauaaugaagagcuaggggcccuaccugaguccugaaccuugagcccuaggccauuguguauggccuguaggacuggagaugccaagggcuggggaaaauggcaggaacguuaguggccaggcuggugauuuucuucacucuuuuccugcccgugucaggcugauucuuuguugcggaagugauauccuuggauucuauuagaaagaaauugaaucucugaggggccaaucacaucagagccagggugucugccugugcuugaacccuagucuggcuguauacgguaaggugaaagucuagguccaaggcccagcugaguguguggggacagccuugucccuauccuggguauccuggaguuucaggagcccacacaaccuggagguggaaugcaguggauuaggacccaggaguuuugagcacuucaggaacacugagcaagcuguuuggcuggagguaaagauaguuucaugagcuggucccaucaugaacgccccaagggcaauacugagauagaugcuuacaggcauugcuuugccauggauagauauauagugguccugcccagaguggcuucagcuuacacuggcugaagugaugucuccagccccuggaggcuucagguaacuguuccaaagcugcacacaucucuaaggggauuucugauauaauuuugggacuggcuagagacagccucuuagcccagccuucaaagguauacuuuguggauggccucuucuucccagggugcccccuaguuuggauuccaaaguccuacagguuccugguucugaccuaggucuugccugugcucuaauauguucuacacacuaacauuuugggcccacacugaugacuguggcuuaugggagagauuguggcuuaugggagaggggagacaucagaggacaucugcccaggucgaucgaaagucaagcucaucucacucaccaauucaucccacaugacacuugcugggcccuugcgguggguggauuacuaggcagggugccagggauauaagggucccuuggccgcuucucuuguugguuggggugucaccuucuucucaaguugagacacaggugcagcucuaaguguggguuucucuccuagagaaguuucaaucccugcccacgauaucuggguugcacgcgucugugggcagugaaugggaaaccaagagagcccaggagucuggggaauguugucagaggcgggagggcgggagcagacagaaauguccagguagagaggcaaguauagcgcacagggugcacacaagacagggagaaggucugaggccugugcuccuucugucagcuggauggggaugcagggaggggcagcaccugcccauucuugaaccagaagcuccucccgcaugugugcgaaugugagucugcacucacagggcuucaggagggcauggauucagcggcaaggcaaauaaacaaacaagcagaaccaaaccaaaccaagcaaaaccaccuuaggucaaauuggaucucaguauacccaggcaauauugcaauauacuuauacuuaaaaauaagcaagcaagcaagcaaucaaacaacacccccccccccaaaaaaaaggguccuuaauuuuguuugguuuugcuuuacuuugugauaaggucuuguuauacagagcaggcuggccuggaacuugcaauguacaucaggcuggccacaaauucaccccaacccuccgaaucauuggcaugugcuaccaugcccaucccaaagccuguuuaucuaucugaaauuccuacaugauuggguggccuguauuuugccuggcagcucgucggcuggccuguuggagcaguauggugagagucucuggaggagguaggaggaauauguuugagaaggggagggauaacagguucguggggcgggggaagcaagagucagacuuggcauugcgguaacuucaggaaugauaauaugcaguguggggauagaggcaggggcuacugaggaugugcacuggaguugguaaugggcuaaggaagacacgcaccccucggaccauggaguaugagaacagcuucccaaccagcuggacagcuagaaaaacagcuuuauuuggcucaagugucuagaaggacauagucccugcuucugggaccauggagccacgggguccuugccacuguggagucccucuaucaacuccugcauuguuuguaggggcauggaugggacuauaucacucaugugugcagaugcugucuccuuagccagugcaucggcccacucaacuccucccuuggccuuuacuccaucugguuuggaaaagcacaacuugcuccaaccugccuggcagccccgacuuucccaguucuuccucccugcuuccuacaguccacacccucaggaaagaagcccugacugccaccgacuucaguccucaggcaccuuguuuauucagaguacaugaaauccuaagaacccagcacccagcaccaaggaaacagaacagagcccacagcauccauugcccugccucugcucccucccuuggugguguauauagcuuaauuaguguauguaguguauuuuaguguauguagcuuaauuagcagguagcuuucuuagcacacacgaaacccugaguucaguuacugguaucauaaccaggcaugguagugucugccaguaauaacagaauuuuguaaaauuuuguaaaagcaaauuuuauuuuuaaaaauuaaaacaauuacagagaccuggguucgauucccagcacccacacaguggcuuacaacugccugugacuccugcucuagagaguccaaugaccuccacagggacauaaaggcaaaauguacaauaaaaagaaacaaaaaguaaaaugggaaccagacagugguggcacacgccuuuaaucuuagcacucuggaggcagagacaggaaguuuucucugaguucaaggccagccuggucuacagagaucauucaaggacagccagggcuacaugaagaaauucugucucaaaaaccccaacccaacccaaacaaacaaacaaacaaacaaacaaacuggggacaggugugauggcggcacacaccuuuaaucccagaacucuggagagcagaggcauguggcucucucuggucuacauagcgaguucuaccuagccaggcuagaacccugucaaaaaaagaaaaaagaaagaaagaaauggguuagagagauggcucaguggccaagaguacuggcugcucuuccaaagguccugaguucaaaucccagcacccaccuggcagcucacaacugucuguaauuccagauccagcuaaucugacacccucacacagagauauauauaggcaaaacaccaauguauauaaaauaaaaaauagauuuuaaaauguuucuuuaaaaaauuuuaaaagcagagcuuuacuuguuaauugcuuuuuauuuuguuaaaaaaaaagaguauaucuugcuggggacuggagagaguucagucacgaugaggagcagcagaugcucuccccgaggaccuugguuuaauucccagcauccacgugguggcucacaaacaucuggaacuccucuggucuugcugugucaccuacccaguuccaucuaucagaucugaugcucccuuuuggucuccaugggcaacugaaaaaucucaaguccuucagauuccacuuguggcucucggcgauggggacuaugccccugcccugucccgaguuucuugucuguguccucaaggauggccaggccacaaggucuaguacugcccagugcaaaugucccccaaguuugugugaacuaguaccaguaguacacacgcguaucccugaugucccucccugauguccccagacuuugguauugucagacuuuucuuuuuuuuuuuaauguuuuauuuauuuauuuauuuuucgagacaggguuucucuguauagcccuggcuguccuggaacucacuuuguagaccaggcuggccucaaacucagaaauccaccugucuuugccucccaagugcugggauuaaaggugugcgccaccacgcccggcuuucuuuuuuuuuaaaggaauaauuuauuuguuuuauguuuaugauuaugcugccacugucuucagacauuagaagagggcauccacugagccaucuuuccagcccccucuucggacucuuuuuuuuuuuuccuuguuuuuuuuuuuuuuuuuuuuuccgagucaggcuuucucuguguagcccuggcuguccuggaacucagucuguaaaccaagcuggccuaaaacucaaaaauccaccugccucugccuccgaagugcugggguuaaaggcgugugcccccacugcccggccacccucuucgaacucuuggguagcuggugucuucuaggucuccagcuaucagaaguacugaccugcaucaccuugauuguccugaggucgccauuuccugcccauccaguguucacugagucuccccagcucggagcaggauagggagucucacucccuugagugcccauguaccugcucagagacuguaggaagaggcuugugaggggcuuacauacuugucuccccaucuuuuucugucuuccaggaugaugagaguucccagaucuuuauggggccagaaggggaccaguugccauugguggaaaugggcaguuguaagguaggucugcucagaccucccaagcuggauuccaccugcucucucuguguggucccaccugcucuguguggucccaccugcucucucuguguggucccaccugcucucucuguguggucccaccugcucuguguggucccaccugcucuguguggucccaccugcucuguguggucccaccugcucuguguggucccaccugcucuguguggucccaccugcucugugugguuccaccugcucuguguggucccacaccuccuuccauaucccaugcucuaugcuggguuccugucccacaccuucuccccuccugugucuugugcuggguuccagauuuacauuuccuccuaucuguguucagaguucugugucuaucccauaccuuaucccuccagccugaggccucugaucaaugggacuguguccugguggcugaccuccagacccugaaaauccagaagcaugcucagaagcaacugcaguuccuagaaaaccucgagagcaauggcuuccacuucaaggugggcugguuugcuucaggggccaagucaugggccagagagucaugaggaauggcgugacaggggacagaggacaagaugguaacugugguugaguucuuuucuugugacucucaagauguuaaaggaccagaagaagguguucuuugggauccgagcugacagugacgucauugacaaguaccggacucuccucaugaauccugaagauucuggcuccagagacgagcagagcuucaacauagcuaccacaagguuaggauguguccagagccaggccaggagaacccuugcccugugucuaggcaggacaagggccacaucccaucugugguaggacaacaguuccauacagucuuaguauggaugucacaggagaucagaccugguucugaacaaggcucugugccucaguucccauuuuguaauaguaauauugacacucacuuauugacauccugugagaacucuuuaucacaguuucccuggagauccagaaucaaagucauuagucaccacuucuggacucuggggucuuaucucccauagacccucaucagccucauagauccucaucagcccaaaugcuccucucuggacaccugguccuugauaucugacagggagagccuucuguguccccaguuaccugcuccuccacaaauacucauacagccccaucugguccuucugugucacuuacccaggucuaagaauagcuuucuggggcccuggcuaguugacucuggcaaaggacagacaggggacuggguagcaggcaacagaguccugugaacacagaauuuuuugggaggaaugaggggaaaucagaagaguagaaauaaugucuucauuacaguuuuacugcugugaacagacaccaugaccaaggcaacucuuauaaggacauuuaauuggggcuggcuuacagguucagaaguuccauccauuaucaucaagguaggagcauggcagcauccaggcagaggagcucagaguuccaccucuuguucugaagguugauagaagacuggcuuccaggcagcuaggacaagggucuuaaagcccacauccacagugacacaccuacuccaacaaggccacaccuccuacuagugccauucccugggccaagcauauaccaucacagacaccuugaugggggcaaaacaagacagacuuguggggggaugucccugugaucacaagaugacuaucucagacacuuaaacuauaucugacucuggcugcacgaaugccugcguggccucagucaaguuacccuaaccucugagcaucaguucccaacuaagcaggauaacucauagccauguaaacaaguuugugcacauuaacacucagcaugcacaggggaguguggucagagguggggggagggggacucuaaccccugcaucugggagagauguggaagccugaguugguccccauucuggaggcgaggcacauuugaccugaguagguuuucagggagauuuauggacucuggauucuggucgguuguggugggaugccucuucuagaacagagagggccuggauguauggagaacagggccuuuaggagcagaguucccuaggcuaucauggggccauccugauccuuagauucuuggguuucagaauccgaauugugagcuuugucgugaacaacaagcuaaaaccugguggugagcucagaugggcagguggccgaggagggagcugccgugggcuggauucccccguccuccauugcucucugacugaggcucccuguaacccuagacaccuuugaggaccuggugaaggaugggguuuuugagaccauguuucuucugcacaaggugaggggcagaccagcucagaaugggccuaagggugggaauccaagguaggaagccaagcucucguucucgucgucuguuuccggggcccagggagaacaaaaccugaagaauauaugggcucgguggagaaacauguuugaaccacagccaauugaugaaaucagguaauaccauaccaagcagcucaccugugggucagacacaucuguguucaaaacagauaaccuguggcccagccaauccaguccugacugacagacacaguaguccccacuuacacugaggcuagcaguaccuccucuccccccgcccccgcccuucuccucaaaugcccauacccuaccagguacugaggccaauggggaggguggccuugauggggaagcuuucccacagggaauacuuuggcgagaagguggcucuguacuucaccuggcuuggcugguacaccuacaugcuggugccugcggcuguggugggccucaucgucuuucugaguggcuuugcccuguuugauuccagccagaucagguggguuggggccugaggccugcagucucauugugggccagguauggagguggggaccugaauggguucuggaucucugaaucgccagucuugucuucacacucacagcaaagagaucuguagugccaaugauaucuucaugugcccucuuggcgaccacagucacagauaccugcgacucucagagaugugcacuuucgcaaagguuagaugcuacuggagucuuuccugggcucaugcaaggguuggcacaguaucucagucuagaaguacggaagauacccacuggacccaaggcagcuggaugcccccaagagccagguucugccuuccccaccaggggacacgguagguaggaaacuuagcaugaagcccuucuguuccucuccccagcucacucaucucuuugacaacgagggcaccgugcuauuugccaucuucauggcacuguggggugaguugcuuccggacaucccuggaggguuccaggaguccagccaaccugagcucuucagccacccugacucggcccagguauccugugacauuucucugcgcucacugcagcuacggucuuccuggagaucuggaagcgaaagcgugcccaugaaguccagagcuggaaacuguaugaaugggaugaggaagagguaaggcagggacagcagcaucaagucugcuugcucucaaugccccauguggcccauaacugaauccuugugucugaggcaugucuggugaccucccuaggaagagauggcccuugagcucauuaacucuccgcacuauaagcugaaagaccaccgucacuccuaccugagcagcaccaucauccugauccugucccuguucaugguacuuccgggagcugugguaugggcuagagacccaguuaucccuacucuucacgcccaaccccaacccuuugcagaucuguuuaaugauuggcauggcucaugugcugguugucuaccgugugcuggcuggagcccucuucagcagccucgugaagcagcaggugaccaccgcugugguggugacuggggcagugguacauuauauaaucauugucaucaugacuaagguaaggaucaggcaggggaggcccuggggggcuccacugaaguccuagguaagucccacuugguuccuucuucccucaggucaacaaauauguagcccugaagcuuuguaaauuuggugagaagaggcuagccucucucugggaacugggaggacucagggcugagaguuacagggcugugaucaaacauggggugggggcuuccugcucuucuggggucccucacuugagagucuaggucaugcugucccacuggucuaaggacagacaagauggccaugucucauuccagaggaauccgggaccuucucagagcaagagaggaaguucacugucaaguuuuucauccugcaguucuucgcccacuucuccucucucaucuacauugccuucauucugggcagguauguuccccagccccaagccugcucucuacccaggcccccagggucuucaggcucaucccuccugucuuguguuucuugccuuuaaaagugcccagacuuggggcuggagagauggcugcucuuccaaagguccugaguucaauucucagcacccacaugaugccugaugaccauuuagaaagggauccgaugcccucuucuggugugcagguguacacacagcagagcacucguacaaaaaaugaaugaaugaaugcagcagagcacucauauauuacauuuaaaauaaauaaacaaacaaauaaacaaauaaaauaaacuuuuuaaaaaguggccagaucuuagucaggcaugguggcacaaaccuuuaauccuaacacugagcuggcagaaagcagguagaucucuguaaauuugaggccagccuggucuacauguugagcuccaggagagccaagacuaaauagagagacucugucucaaaaaaccuaaauaaguaaguaaauauaaguacauacauacauauauacauauauacauacauacauacauacauacauaaaaguggccagaccuugaugcuggugauguagcucaguugaagagagugcaugaagcccuguguuugccucuuguaugugguggcauucucuuguaauuucagaacucaaucauuggagugagccuuuggucagccuaagacccugcauuaaaaagaaaaaguucccccuucagcagcccguguacuaaaauuggaacaauacacacaagauaagcaugggccuucuguaagcaugacaugccuagaguacuuagaaacucaauauagaacacccuuggugacccucagccuuagaagggacaugagccagcguggugggucuuguuguuuguucauguuuaccaacugcuuagguagcuuugcuaugucagcaaucagacugauguuucuguguuguuuuuuuuuaaagauuuauuuauuuauauuuauuuauguauaugaguacacuguagcugucuucagacacaccagaagagggcaucagaucccauuacggaugguugugagccaccaugugggugcugggauuugaacucaggaccucuggaagagcagucagugcucuuaaccacugagccaucucuccagccccaggcugaccuuuuccauggaaacauccuaguggcucugcccaguguaccauccucuccucaccuuuuauggggugcugcguuucaugaagaaucuacaugaauauccucuugccuucccuauuuaaaugaaccguuuuuggugcagucaauguacacaagaaaauaauugcugcuuuauuuacgugcuuaaaugucauaaggcauucaaacauuaccaguuagucgcaaacuuccuaccaaccuugcguccccaccacaccucccagcaaguucagagauaccagacucccuaaacuguccuuggaagucauuccuggcaauuuguccaagcuccuaggaagacuaggauggcccauuaagcuggacccacagcauucaaccacuuaucuuguccaaagucccaaagucuuucacauuucuccaaaaacaacauagucaggucuuuuuucagcaguaaguaguccacugccugguaccuccuucugcuuuaguuacucuucuauugauaaaacagcguaaccaugacaacguauaaacggaagugcuuaauuugacccaugguuucagaggauuagaguccaugaugguggagugaaggaacaguugagagcucacauuuuggucuacaaccaaugaggcagagagaggggggugugaagaggagccuaaccccagugacuuaucucuuccaacaaagccauaccuucuaauccuucccaaaccauucccccaacuaaggacacaguauucuaauauaugagccuacugggaguggguaggcauucucauucaaaccaucacacugcuacucuaccuucccauggucgcaagaucagggugcuguccaucuuccucacaggccuugauuuucucccuaggaucaauggucacccugggaaauccacgcgccuggcuggccuguggaagcuggaggaggucagucuguccugagaccucauugcccaguucuugaauuccccuccucccucaagccccauccaugaccuucauguuggccccacagugccaucucaguggcugcaugauggaccuguuuauccagauggccaucaucaugggccugaagcaaacccugagcaacugcguugaguaccugugcccgugaggaccucuuuccaucccacuucagccucccgcagugcccauccccagugcccugcagucuuucuguauguuccccauauucuucgugcccacagguuguuggcccauaaauggcgcuuaaugugggcuuccaaacauggucacauguccaaagacccagaacugaaggaguggcagcguaacuacuacaugaaucccaucaacaccuucagccuguuugaugaguucauggagaugaguguguggcgcucugugggaugggcagauggggugggugugcaggguaaagaguggguggcuggacuggacacacagugagauuuuucacccugcagugauccaguacggcuuuaccaccaucuuuguggcugcuuucccacucgcaccccuguuggcgcucuucagcaaccuuguggaaauccgucuggaugccaucaagauggucagacuacagcggcgccugguuccucgcaaggcuaaggacauaggucagagcacacacauauuguacaguggaggagagcagccagggcgcugggaagagcaacuuccaauccugggcuuuucaccagcccaggccaggccacguugaagcaauguaauaacugcagccccucccauuacucuagagacaucccuuagguugucagauaugguaacuaagccucaugggcucaaccccuagaaaagggcaggcuagaacacacaccugacaaggcucucccaugagccucugacaugugucuggagagcuugcagccuccaaggggaccuuauggaagagcaggacuuugaucacauggaagaauggcggaucagagagcccaagaccucagucauccugacuuuccauagugagaaugacagacgucagggaaacagauggcuuaguugcuagacauggggagaagcagcagggagagccucaguccugaggugggguucaggaauucucacuugggugggguccaggagauaaacaaccaguagaaaaguuccaggaagaagguggggauggggaagccugaguccuuuaccaauccagucugggagaagagggugcaaccauacuaugucugccuuagcuggggauuucccagcagauaacuuagcuccucccauggcugcgcuggggucacaaacagagauaacacgaggcuccuggaccaguuaggcuccaagcuuuuagggcagaagacuaccaaugaucaggacuggcugcuucauuccacuucugucauucagggaccuggcugcaggugcuagagaccauuggagugcuggcagucauugccaauggaaugguuaucgccuucaccucugaguucauccccaggguagucuacaaguaccacuauggcccgugccgaacgaaucggaccuucacagaugaguaaggcguugaacuaacccuuccaguuaaguccuuggagcccagaccuggggcucuccuggguauaagugggugcugccagaccuacugggggcuguacugaggcugggacuugacuccuuguacugucuacguggccugcauaccuuggcuggauucugggaauaacugauggacccuuguuggaagggaaguugguauugagcaggcaguaccuaaaugccucgcuugcuaaguuuuacgucccuguccuguuucugguacgggaaggcaaagcagaaaugucuagcucccacugcaccugcagacugggcucuuuaggucaacccuagaaguauucuuccagucugcuagggcagacuguugauagcauccccaaaaccccacagccucccuucacucucccagggguagccuugugcuuagauagugggacuuuucugaugaaggagaauggaggaggccuuccaugguggcuugcccccaaagacccucuaggugcagaagacuucucaguaagggccucaggccaagcaaacaccacacuuuucuuucuuuagcugccucacgaacuaugucaaccauagcuugucugucuucuacaccaaacacuucaaugaccacagcaggauggaaggccaagaaaacgugaccgugugcagguuuggaaccuuucaucccccauaaacggccucuaaacuccugauuccugaccuggguauuucccuacuccagguaccgggacuaccgaaaugagcaugacuacaacuugucugagcaguucugguucauuuuggccauccgacugaccuuuguuauccucuuugagguggguaaauugugagugagccugaggagagggcuuauuccucuuauuccucuuuccuagcccccaaauccuaaagauucuuccuagccacugaccuugcugggccacgcucccuauugccugcagcauuuugcccugugcaucaaacucauugcugcgugguuugugccugaugugccccagaaagugaagaaugagguucugcaggagaaguaugacagaauucgccauagaaugcgguagggauguagaggcucaccuggcuggagcaggucucugccuggggacaggccuggccuccgacccauaccaacccuauccuuccugcagcuucaguuccaggagcacggauguauagacgaccuggggcagguggagaaaugccacuuuccaggagccuggacuaggaauaaguccccaccucuacagcuugccccuauccauaacaauguguauguauguguugagggaggcuguaaaauggcccauguauauguaggauccuggauggucuacauauauguuaauacaugaagaucaaaggagggccuagacuauauguagguguauaugggcauccuacgaagcccauguguauauguuaaccacgggagacuuguauauguagggaucauugaaauccauguauauuuaggguauuuaugaacggcacagaugugccugugggguuugcuucaacuuuccuacgguucagauugguacagaccugacuugagacucuugaaugacccuaguaccuauagaacugcagguugcucauaaaacccccaugcaguaaaauuagccuaaaugccauggaccuccuggcuucugggccucagauccugcucuguggccuccugcuuugugggaagccauggaccuccuggcuucugggccucagauccugcucuguggccuccugcuuugugggaagccuagagaguaacuucuggauccccucccucccaguuaaccuggauccguacagcggcaaaacuuuuuacaagcaaaauaaaccuguguguauugauuucugagccucau

SEQ ID NO: 4190 - RNA, 27360 nt, Mus musculus
ggauugcaggcugguggcaccacaagccaacacaucugagaaaacugaagaaggacccacacucucagacaagaagcccauucccuaccucuggcaaaauguaaguacucucagcaacuaaccauaccaguuucaacuauccaacuugacugguccugcuaauuuagucauuaauuuuuauuuacguuaaaguuugagacagagucuagccuuggcugaucuagagcucacaguguguagacuuggauggcuucaaacacauauagaucuuccugccucugauaccugagugcuaggauuaaaggacuaugccaucaugucuggcaauaauuuaucuaauuuaucuaucuaucuacaucuauuuauuaguguauaaguguuuugguugaguguaugcaucuauacaccaacuguauacagugcccuagauacuagaagagggcauuggagccacugcugcuaugugagaguggaaacugaacuccauccucuagaaggucaggcagugaucuuaacugcuaagccauuucucuaucacuauuucaucuuauuuauuuauucauucauucauucauuuucgagacgguuucgcuguguaguucuggcuguccuugaacucacucuguagaccaggcuggccuugaacucagagacccgccugccucugccucccaagugcugggauuaaaggcaugggccaccagugcccggcgccuccuuuuuuuuuuaauucaagguuugaauaacucaggcuguccuuggauucguucaauccuccugccucagcuuccggaguuuaguuugcuuggcagggcugucuaccacaacaguuuagguugagucucuuuugcgucccuauccccagagauuauaugucuucggaacuuuaucaacaccagccagugccagccggcuuguacagucucugucaggcggagcacgcggccggucuccuagcaaccggaccgcgucccucccaccgggcaguuuagggcuuuccagcgcccagcaugcccugcggcccggcgcgcacuacgcgucccacaaugccucacggccccgccccacucccgcggagaccccgccgggcagcacugcgaccccagcccaccgccugcagccuacugggcugcgcaggccgggcgccaugcggaggggcgagcgcagagucgccggaggcucgggaucugagucuccgcugcucaagggccgccgcagcaccgagucugaagucuacgacgauggcacuaacaccuucuuuuggugagggucuccccgcgucggggcaggaguuugggacagacaguuuagauuggaaucgggaaccgucagggccuggaucagccaggggagcgccucacucccuccggcccucguggaaccccccguggucgucuccguaugagaugucgaguguuuuuucggaucggaggagccccgggaugagcucuggaaggccuggccacuacauauuagugacuuuucagguuucccuuucugggggauagcuguuguuccccugcucuucacccguaacguugcccugaacuggccuggugggcauggcauaucuguaugguagauuuuccucacagcuacccuuuucagugacccuugcuugcacaacucaaccucugacaaguuuuggggucagguugccccgucugccuuucguggaguugagugcguaggaauugcagguguuuugcuucuuugaaggaccaugccaccgcccuggcugaccagguguaaucccaugaccuugggcuaacccuucaccuuuccuuguuugugagaaggagcacgcuucaugagaggaauggcuuugcuuuuauuucaggcagccaaguuucuacccaccuaugcgacacuggagucccagggugggcccuacaggcaagugacacccaagugcacagaaacaaauguguucccacuggaggggauguuaaguggaaguugcucugagagaacagagcuguggcaguguccagaacacauuugaucagagagaauccuggucuggaaguguuaagauaauucaggagaaggugccaucacacagauaggguccuccaagggacucuuguguaugucagcuuguaucucuggcuugcaagugggagugguaacugaggcacuggugagauacaguugaaauagcaggaaaguggguugggugugggagauagcuuugcaucuggaccuuauacuauuagcaccuucccuggguuauggacagcuucugcagugagagccaaccagagcugcuuuucaauaugauuccgucuaaugacugugaaaacauuagagggaaaagaagcaaucccagcacuuggaaggcagaggcaggugggucucugugaguuugaagcgagccugguuuacauagugaguuuccaguacagccagacccuggagggagcgagagagggagagagagagagagcgcgcuuggaagcgagcauggggcaguugaaguuguggguauggugccagagcuagugccgauggccuucuuugaccuuugagguccuuuggacauuaaaauggccuauaagucgggcuguugcaaccccauaaacuaaucugaagacugaucccauaccccauucuucuugacuggacauaauggccucuaaccccauaacugaccccacaccaucucagucauauccuggaugacaggacaaagaggaaugaugcuuacaaaaucccugacccacaccugguuuuuuguuuucauaaaccgugcacugccuuacuucagggccaagagaucuuuguggcaggagccuguuccugguugccuacuuaaauaaaggacuccaauuggccuuacauucauagcaguccgugaauuacucaaguggguuuuuaaacaucaauucucuaucagguagccuccaccauggcucuuggacaggagagaggcgggacuguccuucagugcaggugacggccacuggacugagaauucuggaguguguugcuggcuugccuuucuugcuuuauagucauuuauucauucagccauucuucaguguguauuuuggggacuuuugcugagugucauuacuaucuuaggggauaauaucaggaaacuaaacaagagcucugauucuggcacagaccuggaacuuuauuuauauaaaguuuuauuuuguguguauugauguucugccugcauguguguguauaaaaccuguaugcaaugccccuagaagccagaagagaguguugggucccuuggaaccauaguuccagacgggagcugcugagucgauguuagggaccccaucuggguccucuggaagaguagccuguguuguuaaccucugagucagggcuccaacccaacccccuaccacgggaucucacuuucuuuucuuuucuuuucuuuucuuuucuuuucuuuucuuuucuuuuccuuuccuuuccuuuccuuuccuuuccuuuccuuuccuuucuuucuuucuuuuuuuuuuuuuuuccccagaugggguuucucuguauagcccuggcuguaauggaacucacuuuguagaccaggcuggacucgaacucagaaauccaccugccucugccucugccucccgggugcugggauuaaaggcgugugucaccacgcccggcuuggaucucacuuucuaacccacucccaccagcauggaaucugugacaguuugagaauugguagucuauucuugggucuuagagcauggugcuucuagugagccaucuaggagaguuggggcagaaaucaccaguacauccguagcaauaauuucugcagcuucagauauaagugaucuaucacugugggcuagggcuuaccuagacuugcccacauuuaguaagcaugauuugauaauucauacucuuuugacuaucagaucaacaagccaagaaagccaguguaacaggcuagaagccucuugaagaccugaccugggaccggcccugucccuuucuuggcaacgccuucaugguucccugguugguucuggcaggguugccuuccuacccacucagcgugaggagcguggucaucuccagggaagaacaggaacuggguauuuuccacucagagcaaggaaccaguuuguccucaugccugccccugggcaguaacugaagucccaaaauuuacauaggucaacucucauauugggccuagucaugggacucagaccauccccgugucuguguaugguagggaggaguaggaggcagcgcugcacaaaccugacguucuggaaggaaaaagaugaccugucuuggcaaccuguugugccucccucccuccaucccaccccccaccucaccccccacauacgugcguguguguguguguguguguguguguguguguguguauguaaguguguaagagagagagagaguuagacgaggagcaacaaggcagagcucacucuugagcgagcauugauugaacacucugaggucuuuagcugugagucuguuuggcugaugcccucccucccauuucaccguuuccagaucaggggaggccgggggaggccagguuuuggugacugugugaguaauagggugaacauugaccucaagggaaaggucuauuuauucagauauuccuggucuacugagaagaaauagaaaauaguacuccuuucaagaucguagacagccaaggaugcccucaacuugcuggcuacuucaaaaacugugaagaucagagcaguacagaaaccauggagcuaaaguaauuucuaaggucuucggaaaugagcuggggauuagagcuuaguggcagaauacuugucuagcauauguaagaccagaggcccaguucucauuaccagaggggaaguugggggaagccuuccacauuuacuguuaaaugugaccauaucuaccuguguuggaagguaguaccccucugguacccacgggaauggucagucagcuugggagugcaggugagccccgcuccugugcugggugacuagguaucacgugagugcuuggugaucucugcucugacacuaccuguguguuuuuggauucaggcgugcccacacuuuaacugugcuguucauccucaccugugcgcugggcuacgugacucuccuagaagaaaccccucaggauacagccuacaacaccaagagguaacugcuucuguucagagggugugauguccuguggagcucuggccagccggggcucugcauuuuccuugugugucugauugacuggcuuucacaccuuccccugaagcugugugguauuccuugcccaggacugugggaacucgucaccuuugagugguagggauauuuugcuuuagccuucagggugacucccucuagcuggggugcagaagccuugugagaucgaccacaucaucacaccagcagcuccccucagacguaaggauucucagauugucugggaucuagagccaccagcagugaacccugugauggcacuuacauccuuguugcauucagguuccgaagcuagucccuagcauguagggacaaguuacuccagaguacugacagacuuuucuguugcuccucugguucucugggcugcaugucugcccugggaaggcaggucaguuacuguuaguuacugguucugugcagguccugcuugcucugggagggcuagaggggaggcccgagagaccuagugagguuuccaggcugcuuugguugcuuuccccugaccuguggaauccccguggucuuaacacuuccaggcuagaauuuuguuuuugaaaacugggagucuuaguacuuugcucuaagaauugaauggggugaauuugucuggacccuagggcucccuucugccuuucuugugcaguacagguaaccucccuagcuguuucccagcuguuccuggccuauucuuuacugcucagugacuuccagcucagagucagccucucaggaguguucucucucuccccucucuccccccucccuuucucuuuuucucgcuccccuucucccucucccucucucccuuucucucccgagcuugggauagcuuguucccaggcccuguagcccuucuggcgaugucugcccuggccuaugcuggugcuuccugcucauucucaucugcaggcuggccugcuccucccuccuuuuuucggaaggcuucuuucuaccagacucucagucucaagucucaggcaaggucuauaagcucagcaugcucuuaaggagaugaguuaacacugagagagggacuugugcuuccugggccaccgggucaggucuacuuuguccuuccuguccugcugccgacagaggggucaucugcagauauuggcccuugggguauggaggcaguacuccucuuugugccuuuaucugcucagagggaauuuucaaguagaacugggucuuuagcaaaguaugguugcucacacauguagaccuagcacuugggaaacugaggcaggaggaucagaaguuugaggccaaucuuggcuacauggugaguucaaaagaccagccuguguuacaugagacucuguuucagaaaaacaaaggggacaugguggcacacaccuuucuagcacugagacgcagaaaggcagaucucugaguuugaagccagccuggccuccauagcauuccaggccauuuuuugagacccugucucgaaaaaagaaaagaaaaaaagaaaagaacgagcaacaaaacuaugucugcuggcgucuguguguaccugggaauagagggucugcuggcaucugcaaggcacagcaaggaaguccagagagcugagacgugguuauaccucgggagguacucuccagggccuggauacaucacucaggagccuaggguuuaauccuuagcaccagacccugcacuccaaaaaaguuucucuauaugagaaguuuagcuaaagaugcccaggucugaugucacucacuggacaggaguugucucaggaagaguacaguccucucucugaagaguaggaacauacaaagguacccuggaguggucaccagucaccugccagagcuguuacagagcugucguccacccagucuguuggugguguugucaauacuaggugacccagaaccuagagaguccaagagcucagacucccaaguguaaggaggguagcacuguggaccguguggacacagccuuucuucauccaggggacacugcacaucuguuccucaucuuugucccccuauuuccucuuuaagagcaugaaggaacuaccuuucuggccuguaauucuucugguagagccuggaaucugcuauuugcuccucccuggaacggugggagucuucuuaugugcuuaaaaguaggcuuggugacaagcauguaaccuacugagccaucucaccagcucuauagaaaauauuuuauaauuuuuauguuguugcagauggaacucagacccuuauauaucccaagcaaacacuguuccauagagagacaacugcaagacuuacuuaguuuucauuuaaaaaauuauuuuuacuuauguguauguauguauugggauagguaagugaguauccucagaggccaaaagagggugucgagucccuuggagcuacagacaguugcgagucacagaauaggugcuagaaucugauucugggccuucuguacaaucagcaaacgcuccuaaccacugagcaaucuccggcucaccaagacuuaguuuguaacguauuucuuuaaaaaaaaagauuuauuuauuuuauguaugugaguacacuguagcugucuuuagacaugccagaagaggacuucagaucccauuacagaugguugugagccacccugugguugcugggaauugaauucagaaccucuggaagagcagucagugcucuuaucugcugagccaucucuccagcccaacauauuucuuaagauuuacuuaacuuuuguguccauacaugugugccugugugaguuacaugcacuauguacauauagguacccaugggugucagggcauuugauccccuggauuuggaguuauagucaguuaugagccuucugauucgggugcugggaacugcacucagguccucuacaccagcagcuaaugcucuaaccagugugccaucuuuucugccuccuuuguaaaguguuuccuuucuacuugugcgucauugcucuuuuucuuugagaugucgguuguguuucaugauauugccagucuuguccugaaauucacuaugugggccaggcuggucuggaacucacagacccacuuaccucugccucccaaguguugugaucaaaggcauucucuaccauacccagcugccaguuuguucuugaacuccagggcucaagugauucuuuugucucagccaggacucuagacacagaccacuguacagcuuuguuuucuucucagauuaaccuauuggucuauaauuugaugcauuucuaauuaaguuccagcuuggugaguuugagaugcacauaccuaugugccuguugcugaccgaggcagcccugagucucacaccauguguucugguuucccaggagugguguugcuauguuacuuucugugccuggcuucuuccccacaccagggauauaugucuuuguagacugucaguacuguugguaagcugucccacacagauggcucaugauuuaucaucugguguggugggugaccuggggcacuucuggcucucuuaucuucucaguuagugagcuguccauuccauuuaccauuuaaaacauuuuacaaauuuaaaaaauaagcaugauaagguuacacaccuguaaucucagugcugaguuguuugaagcaggagacuccuacauuguaggcaaaucugggcuguguagcaagauccugccuuucucaaacagaacaaaaaucuacccacauuuuuuuuucaaaaggcaaacacaauuaacaagaagcaacacaauaaaaucugauggaacacauguacucccagauacucaggaggcugaggcaggaggauugcuuggucuggacagcauagugagacccauucucaagaaagugaauaaagacuguaaaagugagcaagauggcucagcugcgaagagcacucucuguucuugcaggggaaccaaguucagaucucagcaguaauggcugcuggccauaauggucuauaacuccagcuccaagggaucugacaccuuguuggcacuuacguuuaauguguacauuaaaaguaauagaaauaagucuugggaaaaaacccugaagagguacucuaccaagaaagagaaagaggagagaaacagccugugaaaugugcgcugcugacaucccggggcagggcuccucagacugagaacugccagauuccaccacacagcuucugcaggacugaaauguaaagacgauaagaguuugaaacagcagcagcucauucauuacuaauagggauguggcugcauuggaaagcaacuuagggaauuaaaaucaaucucucaaucucucucucucucucaucuguauuugugugucuggugcucaugacagaaccccuggagguagagaugauagugagcugucuugugggugcugaaaaucagaccugggugcucuaugugaguauccagugcucuuaacuacugggccaucucuccagccccacuaaacucacaugugguccagcaucaugcuuuuaaaggugagggcaaugguagaauauuugcuuugugcugucuaggcccuggcuuucuuuccaaacuaucuuagauaauguaauggcugggacccuaagaaugaaggcauacugacaagagaaucaauuuauagacgcacugagccuccugaagugccaggagaugggcucuuuaagaacagaggcagaggcugcaagagcccauggauuggcugacagcugagcccgugggcaccucugcaguugcugcugcuguauccuugauuaugugacaggugccagaaaucaguagaguuuuuagguuaccagaggacagaggucagaagugccccccccccccccccccaacuggggaacaucagaaacaagcucagauuaaguucacuacagauacagucaguuacaaacggaaaugugugucaucuauaacacuucagccuccuggauccacgagcuucaucuccgaggaggagucaaccaguuuuugaacccuuuugaaagggguccagagagauggcucuguguaagagcaugagcugcucuuccaucggggaaaacgggcugaucaguccugcacacagccaccugggucaccacaaacagccucugucaccgccugaggagacucaggagaugugaagacucaccgucauggcuccuacacggagaucuggggcagaggaggacuuuagagggaccugagcaaauaggauaaagugaggacuuuacuugcuuaaagauuuauuuaaaaaaaauuuuuuuuaauuuuauuaauuuauuuauuauauguaaguacacuguagcuguuuucagacacuccagaagagggcaucagaucuuguuacagaugguugugagcaucauuacagauguaaugggcaucagaccccauuacaaguuguaagccacccugugguugcugggauuugaacuccggaccuuuggaagagcagucgggugcucuuacccacugagccaucucaccagccccaaaauuuuuaacaauuuauuuuauguauacgaguauacaccauugcugucuucagacacaacagaagagggcaucagaucacaaccauuacagaugguugugagccauuguguggcugcugggauuugaacucaggaccucuggaaggcagucagugcucuuaacugcugagccaucucuccagcccgguuuacuuuaaauuggcaacauuugguuucuuuuuccauuaccucggcucagcugauacauuucagguccguagguacuucuuacagcccauccuuguaaaucgucauucacaccagccuuguguguauggcccaggucccaugccacccagccuacguggcuguguugcuuuguaccacaggggacuguguaguuuagauacugauggucccagguaggugugacccgggcuucucucaggugagcaguacaguggcgucucuuugucuugacuuucauuucuauucuuuugggaaugguaacuguccuucaccuaauaggauugccauuguucugaacaggaagccugccuuuugcccugccugguaucuguggagugcugguuucaggguccuccaaagauaaugaaaugugugaacacuuagaucuuuuacauacagugcuaucuguauacccacauauaucucccguuuccuuuuuuuuuuuuuuuuuuuuuuuuuuugagacaggguuucucuguauggcccugguuguccuggaacucacuuuguagaccaggcuggccucgaacucagaaauccacuugucuaugccucccaagugcugggauuaaaggcguacgccaccaccgcccggccuaucucccauuuccuaaaaacaucucucaauugcauaugcuaccuauguggacuguggcugcuauauagagagcuggguuagcagagccaccauucacgagauuguucugaacaggaagccugccuuuugcccauuuacugauuuaaucaacuuaucucacuguggacaugagauuuguuguucagcauugccuuaggccauuacugggacaugaccugagaacgcuaaugggcuuuucugaguuucagacacaacaggaaccucuaggcccauuuuuuuuuccuuccuuuuugcuucaguccuguccuuaagaacgacucuaaggagucugggucucucacugaagaacaccugaagccaagacugguuguuggguaugccuguugccacuauggugaggcuggcuuuagacugcuaauaggauagcagucuacaggggaaggcaacuaauucaggcugugccuugugugagguauugcuucagggagccccuuccagguuccuuucccaccuccugucuugcuagugcugugaaagagcuaugaucccuccucggagcugagcagcaagugcucuguuccuccuggcagcagugguaucgagccaggcuggauaaaucacacgugccuuggagagcugcagaugcuccgcuaagauuagggguggcucucgucuugacugcucggggcaggcagguaauacuuaauuuucuuggcuuguucuggccacagccaugagguaggauguccagauauuaagggcaucagcaugggcagggcagagugagaccgggauuccugugaacacuggccugaggguguccuuagcagggacuguagccucacggccucggcccuggcuuugugugguccacgcuucugugcccugugcccuguuuucaauguggucuacauacauguaggugucauacuuuccauccugcaccuccaagagcacauugguguaggagguggugacccaacaggacgacaauucuggcaaggcccaauaggccugcgcuaugagguagcuauuagauccugauguuucucagaggcuuuaugaggucuaaucaagugaaccuguggugacacucuaaaugacaggagaaaccucacguggacaucugagagugugcugcuugugggcuguugagguggagugagccauguggaccagccucccgccaaguagcugccagacggaguugugggcuguuuccagcauggcuggucuaucauggguguccacugggguccccgcugccucccaccgcugccugaaagaagccugcacacacugaggggcucuuuguucuuuauuugcagagguauuguggccaguauuuugguuuucuuauguuuuggagucacacaagcuaaagacgggccauuuuccagaccucauccagguaacucaccauuucuuuuccaugugugccacgucucuucugucuugagcagcugcuguaucuguacugcugggugugacuguccuguccuccgccagcgcccccuguggcugcugacuguacuuccucccccugucucucccugucuguggcuuucucaccuuccugcagaccagagggccugccugggcuccuaggaggggcuggagaccuaggagugucauugaguacugccuccaccacccccacccaaguucugacaaaucuauggcaucaaauugcccccgugaaccucagcuggaggacacaagccaccuacuugccugcucaguuggccagagcucagaugaggaggcccuuaaggcuacaaguugguugguguuacuucuuaagggccuuggcauagauguuucuuuugugccucaaugugaguauaaacugugaaaauacagaaacuauuuuuaggcauuuuaaaaaauaaacacuuaaauuuggaugucuuguguauauuuauuuacuuauuuuugagggucucacuguugcucagguuauccucaaauucuuagaagcaaggaauucucuugccucuuccuguguacugggaccacaagugagucccccaguauugcuguuuuuccuggguuuuguuucuuuuuuuuguuuuuggauugcuuuguaaaguaggcagucuugagauuuuucuuucuguagcuguguacuuacuugauuguuuaaccaaguacuguuggagcaagagaugagggauuagccuuccagaacggggaaugucugccaagggugaguucguucugaagcugugaacagauucccccaugguccugaagcucugagcaggcugugugguuuguuauugcugcuagauuccugaguggccuucacccucugcacccauccagccuugacacacuaggaguugaaccagagccacagggaagggaaauaauuuaaaaagugccuacuucaucuuagcagcaaguguucuuuuuuguuuuuuugagacaagggucuucuguguagccuuggcuguccuagaacuagcucuguagaccagacuggccuugaacucagagauccuccuguguauccccucagugcugggauuaaaggcgugugucaccacugcccagcuuauuugugauuuuauuucuuuagauuuauuuauuuuauguauaugaguacacuguagcugucuucagacacaccagaagagggcaucagaccccauuacaaguuguaagccacccugugguugcugggaauugaacucaggaccucuggaagagcagucagugcucuuaaccgcugagccaucucuccagccccuauguguguuuuaagaugucauuuuugaaguaaguuucccugccaauaaugauuuguccuacaacacagugggaaaagucagccgaaucuguacaguuauauuuggaguuggcguuuucuguucguaauuuaauuacacacacauauguauauuugguaugcuagaaaggaaggaugcauaauuuuggguguuaaaguuguagaguuugcuuugucacaauaaaacuacauguguacagggacaggugcuggcugacggguaagggcuuguccugcauuuggaggaagagagcuauaagcccauaugguaaggcaacuuccucucaagagccacaucucaaggagcaugacagaugggaccacacuggccaacuggcaguaacuugcuucugcaacuuggcuccgggacucuugaaagugucuuccagacuugcagguucuuaaguccaggggcacaaggccgauaucauggcaaacagaaaucacugugcauggaagguuuuagacuuugggagguucccacagggcucugaucuaagugacugcaguucuagcucccagaccuagaauguuguuccucucccuccucuuuuuuuuuuuuuuuuuuuccccuaguaaggucucacuguguagcucuggcugccuagaacugugcugaccaggcuggucucugucuccugaaugcuggcauuaaaggcguguguuaccaagcccaggaacccucucuaacaugcaugcucaucuguggguuacuuugagaacucugcucugccuuuccuucuagaguaguugcugugcauaagcuccaagcuucuucaccauucugucuuauucauguaggaaaucuguccucagccaccucccaccccacuguuuguugauauacugagcauggaacccagggccuccagugaaaggguguguguuguagcuaagcaggaggucagugcacugugagagggacagcuccgugggugucccccagggaggagcucucccugccuuaccuacugcucugcucuuaggaagaccuagucaggcugccucaaccagggccauuaucugccuggccucauuagagcagcaaacugaggcuucagcugaccugccuggggaguugcuuuauuuggaaacuguaauuggcugugguuccaagugaacaccuugaaacaagucccaguucuucugaaacugcuucucuccauucaguuuuuugcuuuuguuuuugucuauuugcagugcuaggagcugaacccugggccucauuuguccuauacaaaugugccccacugagcuacaacucuagccccuuuccaaaagcuaggguucagcgccauccccagcacugcugagcugccuuugauccuuucucacauuuuauuuugggguagacaaggggcacuggcaucaaaacaaccaacagaagaagucaggguuuggggugcuguagaagcagcuggauacacaggauaagcaggagaagcagcuggauacgcaggauaagcaggauaagcagcuggauacgcaggaugggccuaaaggaggcaaggaugagaggcuucugcuuggaaagacuguggggaagacaggagagagcaauagcugaagaggugcugugggcaucagaccugaugacgucaggguuucuguuggagguggggccugacauaucuguucuucucacauacacacacugcaggaguggaggccagcuugcuccccucagcuggugaagauuuucacacaggcucuuccuucccccacuucaggcaugaagaacauucauaaacaccaucuguaucugggaguggcaugagcaaaugccagcgagggcuuccuacgucacauucccugucugucacugucaggguuggguauucucaaccaaguagaucaggucacauggucccuuuuuuuuuuuuuuuuuuuuuugagauaggguuuguagaccaggcuggccucgaacucagaaauccgccugccucugccucccaagugcugggauuaaaggcgugcgccaccaccgccuggcuggucacacguucuuaacgcacggaaccucccuggcucuugaguaccauagugcauucagggauggagcggcguuaggagaaaucugcaggcauaaauaugguuuguguuaaaacacuuuuccuaaauaaaugcagaagacuaaaaguucauacuaauucaugauaagaaauugaacauauuagaauucugagauuuucaccccuggaagagcuguccagcagagcaggucagcagcaucaguacaucucggaggaggaggaggaggcccucacucccagcaccguggcccuucugugccucugcagcaaggcaaacggaguaaaggccucgggacucaagaagaggaaagcaucucacauuucauagaggaguucuguguaacuucacuuaguccuugcuuacaaagauucuaugaaggacaccugagcauucccuuaaaaagacugucugaucaggagccuccugaggcuggguggggccuagcgccccagagcagagccccugacauugcuauuaucuuguuguagcuuacuggcgguuuuggcuguguguuaguguggucuacgaauuguuucucaucuucauccuuuuccagguaagcagcuuuucuugguugauaaaacaaguauagauaauagaggaggcuugaauccucaggccccagggugcuggcaagaagccaggcuggaccagcacggguagacacaaacugucuuacccuccaggcuggcccauauggaggagugucuuaguguggguacaggcacaggcugcugccaucuuuguaugcaagccgggacagacacaggggagacagcuccucugaugacagacaggucaagugcaguagcugccgcuuuaggaacuugggccugccugggacccgggggagcuggugggauuugcagcucaccaggggggugggaggggaauggaguauugcauuauguguucacuaaugguccacucugcuucagucacugaauucugaguuccaugagugagugagucacuaggguuuuuauugugcuaaauccaccacaccgucuggggcaguuaugcagggcugagucccugugcauguacaaacauccuaguagacccagaacaguuccguaucuagaaaacucacucagaucucuuugauagucucucuguucuacucuccaguuaccugccaucugucaagacuugucuuggaacaccccgaggguguucuugauaacccauaucaugucuuugagguccacccagcuguaucguugguacaguguuucuucuuuccugagggacauuucaggacccaagaggcauuugguuucccauuaggagcugcugugaaucaagcugcucucaacaauccuguuagggcuugugggauacaaaguugcauuucucuccuagacaggcccauuguggucucacuggucucaucacacaggccuuuaauguuugaggagcugccagauugcauuccagcauggcugugccaucuugcaucccaccagcgcugaccuagaauucugcugcuuuaugccaucuuucaguucuguugucugaguucuguugucagagcuggauuugcuggcggugaauggaauuauauccuaauggguauaaggugacaucucuuguuuugucuuuuuccugccagagauucacuugaaaacaccauagcacaccuaagugucucaucuccagggcuccucuggacuguauaggucacagacuaagcuacuaacgggcugucagcucugcaaaggcuggugggugucugguaggccagguggccauggcaaucuuccacacuuuguucuucucuuucuuuucuuuuuuaaagauuuauuuuuguuuuguuuuguuuuuuuccaagacaggguuucucuguguagcccuggcuguccuguaacucacuuuguagaccaggcuggccucgaacucagaaauccgccugccucugccucugccucccaagugcugggauccaaggcaugcgacacuacacccggugauuuaucuguuuuauacaaguacacuguugcugucuucacacaccagaagagggcaucggauuccacaacagaugguugugagccaccaugugguugcugggaguugaacucaggaucucuagaagagcagucagugcucuuaaccacugagccacuuuuccagccccuguucuucucucucaugauugccccgugucagcugaucuccugcauuuccaagugaaugcuagacucucuuucuggcuauguaagagagcuggugagguuucguuuucuuuguuugcaaugcuggugguggaauucaguccuccugcaugcuaggcaaacgcucuacuacugagccccaccccaacccuagcaggugagauguuaacagaggucgaauugaucaguuuagaacacugccaccacaguguuagaucuugugguucauggacuugagguaucuuucuauccccuuauagccccuuaaugacuuccuauuauacuuuauaguuuucauaauguacauuuuguacuugcauuguuaaauuauucccaaguauuuaauuugcuaauaggguguagaaauaguuuuuguguugauguguguccuguggccuugcuaaccuuaccagcucuagugcuugugcaggcuuuguuguugucuagccccugccaucugcaccaggaugcugccacacuuccuuacagucugcuguuucccacucuugccugacuccccuagcugggccuuccggaggcugaucacaagcauggaccuccuuaccugguucuggaccuuaucggaguauccagccuuucugcgaggugcaaucugagcucugacuuuucucagaagccuucaccgagcgggagcuguuuugguucuggugcagcuggcuucugguuuucauuauuccguguuagacuuuuugauuuugugagaugcguuuucuacauuaaguaagaugauugugugaguuuuuccuuuauugaugaugguauuugcaccaaauaauuuuuaaaaugugguuuauuugggauguugguuuggucugguuuuuuuuuuuuuuuuuuuuaaagauuuauuuauuuauuauauguaaguacacuguagcuaucuucagacacuccagaagagggagucagaucucguuacagauggcugugagccaccaugugguugcugggauuugaacucuggaccuuaccagucgggugcucuuacccacugagccaucucaccagccuccugguuuugaaacagggucuuguuguauagcccaggcuggcccugagcuugcuguacauauacuuaaguccuccugcuucugccuccccgaguguugcugucagaggugugcauugcaaugccuggcaugauuuucuucuuggaagcuaugggcauuccugagaggaggugguggugucuaacccugucuggagucuggauccagccuccuaggauucugcccaggaucuuugcauccuuauucaugagauacuuucuuagauugccuuccuugaacuguuuuuuuuuuccucugucuucggcauuggaguucauuaggauuugucugcuguauuucuuaggauuuggccggauuuaagauauaagcagucugucaguggggcuucucccugguaagacuaacccugaccguggagaggcugcuaggcuucccucauacaggccuuuaacugccugugucugucugcucucuugaaggaaguuucuaugugcuauccauguccggguaggagccaggacuugggguucacuaucucaggguuguguaucuauguauuauggaguuccucuugaggaaaaccugucucuauccaaccauguguuaagugucuaauaauuuguucuuaucagcaugacucaaaguuauuuguucagguuguauacucaaauacugcuuuuauguuuuugcugaaguucuuuagacccuagcacucuccuuuaguuucugucuuguuugacacauccccuucuuuaaggguucuugguuuuuuauguguuugacucagacuauagauguuccaguuguguguaccuccugcuuugagcccuggagucagccuuuucccuagggcccuguucaguuccugaaggacagaugcucgucuuaagagacugcagucugggaacuggauuugccagucagguguccagguacucagcuacagaguguacaacccguuaccgugaucauaucgguucuagcaucugucuugaaagucccccugcaguguagcgacuucccuucugcccuccaucgagugccacggcaucauggggcucugcauggcgaucagaagcaccauguguuuugcagauaguuuaaaacuaagaacagguggguaccuuugagccuaaacuugugucaaaccuagaccucaucuucucugacgucugaggccuuuggggccuaagccggaagguggcuucaggaacauucgugcuucagcauguccucaagucuugcugguuuguguccaggacacagggcauuaacaagauggccaccuguggaaucugcaccagggacaggugaacccugacuuucagaccaagggcuagacucccagcuggccagccugauucaucucugguccuguccugcuuguuucugccccucugcuagacauccauuucccauggucucuaggccuuugaggcuucucuuuguccuggcuugagauuugcuccaaggguccccuccucuuuuguguccagaaauguuuaauccaccaaggggacagagcuuuaccaacugcugcauauccagaaagauggacuugugcuugaccgaguggacauggcccugcagcauggggggaaggcagcaguauagggcugccucuucuggaucgggaucuaguccaauauccacuggagagaggaugguaggggcuggcauuugugcccugauggcuuacuggggcucaaggcaugcucagcucuccagcccuagcuggaguggaagagcugcugucccuguaacauacugaccaagcuagaggucacacuacagaccacucuauccaggcugccuugcuaagccucaccacacuaauggcucugcuuugcagacaguccaggauggccgacaguuucugaaguauguggaucccaggcugggagucccauugccagagagggacuacgggggcaacugccucaucuaugaugcugacaacaagacugacccuuuccacaacaucuggguauggguguucucaacugcagggcuucagcagcccaggaccucccuugguuuuaugggaucaggcagggugcccuguaagacuguccaugccuccugcuuuucuucagacuccuacagggcagaguaggccugugaccuuguucaugucagaugaggguccaucagaggggcauccuggucucuguugccaguguggucaucugaagcagcacacuugccaggcccuggcuuggcaucagccuggaggguugugaggggaggggaaugacccugggccucugcacagcaggagguuauauggucccugaagacuugcccaagauaccacaggggaggagacugccugaugguaggggugccugagguggggccugggccucagggucgcauccuuguuaccuacaggacaagcuggauggcuuuguuccugcacacuucauuggcugguaucugaagguaggguaacacccugguucugucuaguuccccuuuugccauguucccagccauuuggguccacaaaugguccgcaggugggugggcccuggugcagaagcacugagccacccuggagaauauguaagauaccagagacuugcaguuucucaggaggccuuacguguagugcugauccugcucuucagaucuacgcccuguuccuagcacuguggccgguuaggaaaagggagugagggaaauggcaaggcaggaagcccaggacagccuggccccagaugcacccccacaauggugcugccuguccgucccaacccauggcuugaaccagaccuccuguuagagcucaaugccaagucuuggggccccuucauguugucuguaaaccuucaaguuagaacgguagcuguucaucugcuacguuuacggggggaccugcugaggcugggggcggaagucagggauuguguuugaggggugcugucuguagggaaggaguggcaaagccugacgggcgcugucuggcccucagacgcucaugauccgugacugguggaugugcaugaucaucagugugauguucgaguuccuggaguacagccuggagcaccagcugcccaacuucagcgagugcuggugggaccauguaggugcagcgggcaaggcacagccugggugggccccgccgucaucucaggccccgugguuaauuccucuccuuuccugacccaguggaucauggacguccucgucugcaacgggcugggcaucuacuguggcaugaagacccucgaguggcugucccugaagacauauaaguggcagggccucuggaacauuccaaccuacaaguacaucuugggaguuauagaagggaaccacagagcauugggcccgcaaggacaaggccuugcuacuugggaggguggcaagcaaaacauuagagugguagagagugacugcuaguccuccaucuggcucccuggcuugcuucucucaagaggcugugggccugaucuauccaccucuccuacagccuagguuguccuuagacuugcucuguacucuagaaugacucucgcccccaacucccgggagucauaauguguaccccuaugccaaguuucucugcuaccuauaagauuuaagaaagaaaaauuguaccugaaauggugguauaugucuuuagaggccacugcuugguaagcugaggcaggagaauuccuugaguacagaaguucaaguuuagucuaggcaauccagggagacuucucuccccccaccccccaaaaaaaaaaaaacacgcacacacacaggaaaagugggagcugaggauauagcucaguugguagagugcuuaccuaccacacucaaagcccuggguucaauacccaaaaccacgugauccaaauguucuggaaucccacauuugcugcuguuguaaaagcagaccagaaguucagucauucucaaguauauaguaagcuugaggccagcuagccuuagcuuacaugagaucguauuucaacaaaugaaaguaaaaauuagcaaggcauagugacacacauaccuuuaaucccagauaggcagguaaaucuguaugaauuggaggccagccuggucuacauaguaagaccuugucccaaacaaucaaaagcaggcuguauccugagacuugggagacagaggcggguagguagauuucuugaguucaaggacagccuggucuacauagcaaauuccaggacaaccaaagcuacacaacagagagaccauguaucagaaaacaaaaaacagacaaacaaacaaaacagaaaaggacagaggagcaaugcuagauagucccagcacuaggcaggaagagggcgagaggauggagaugcagguccuuagcaccacaggaaacaagccuccgcuccugucugggagccucagcaauguguauggcccccucugaaguggcugugugggauuuugaacagggcagagccuuguaucugcugggcaaagcaacaggcacuggcuccuggguucuggcucuagcucugugaccugaauaaagcugguugacuggccauguccucaaggcugcuggcucucugguucccaggggcaagaugaagaggauugccuuucaguucacgccuuacagcuggguacgcuuugaguggaagccagccuccagccugcaccgcuggcuggccguguguggcaucauccuggugguaagucccagcagccuggugacuggguauccaugcaacaccagugguugguucugggacugaugaacugaccuucuuccguccccuaguuccugcuggcagagcugaacaccuucuaccugaaguuugugcuauggaugcccccugaacacuaccugguccuucugaggcuggucuucuucgugaacgugggugguguggccaugcgugagaucuacgacuucauggaugaauugugagggcugccguagggccuagggggugggaugccagagccugggagccccaagggccccaaaugcccuugugcugaacaagccaggcagcugccgccucucugcaggaagccccacaggaagcugggccagcaggccuggcugguggcagccaucacagucacagagcuucucaucguggugaaguaugacccgcacacacucacccugucacugcccuucuacaucucccagugcuggacucuuggcuccauccuggugcuuacauggacugucuggcgcuucuuccugcggugagugggagugggaccccagaccaucgguucacugugaguggugucugucccccucuuugguugaauacugacaaggcucuauccauucccuacccuugccuugccugauggcucuaucugcccuggcccguguacucucugugagucucugguucugccuggcagaugcaggugcuugaggugaccuguccugccuauagcugacccucuacuugcuauugcuagaauuauagcacauguagccucuuguagaacgaagguagccaggugucuguggggccuaugcuggggcugcugcaggaacagguggugagguagcucugcugccccacagggacaucaccaugagguacaaggagacccggcgacagaagcagcagagucaccaggccagagccgucaacaaccgggaugggcacccugggccagaugaugaccugcuagggacuggaacugcagaagaagaggggaccaccaaugacggugugacugcugaggaggggaccucagccgcgucaugagccucacccucgucacuggccuugugccaaggggcugucccauuucucccuuccucgugcucccugcuucagaggcagggguggggggggcauccacacuccaggaggggcaccugagaauacauguuugugugcagguagguguaugcacauauuggcuccugacacuacuuuggggccaugagcugaacagugagccuggaacuugcucuagagcaagaguccuuucuaccuggucaacaaaggcccugguccauggucucccuugugcucaaucucagcaccggcuaggggagguaucuugguaucucgguacucuuucuccacucuuuaugggguaggcagaagccccaugagacccuguggucccacccacuuacagcagcauaagugaaggauaucauaauaccaacaugucugcaaaguggugggucuagagucagcacugagccauuuccuuuggagccuuccuuuaaccacgcaggacuauaaacugaaugguguauacaugacagucacagauuggccuuuugcggccagagagcccaacuuggagaccuguaccccaggugccagggugcugucaccauggcucccuugagcaaauggaacaaauaaagugaugaugaaggugcauagccucuggcugcccuuugccccgugcucuaugccuugcagaggaggggagugugugugucugucugucugucuccugggcagcuacccgucuacuacauuguuucucacuggguguggggcuggugaucgcugaagaauaaccacgagaaaugacugugagccuugcuuuacggucacagccauugggaaugcaguagcaaaccauuugucugccaacaaguucaauuuucccacgaaugcaaaugugcaagucaugcccuuagcuuacuaaggcaacgggucgugucuuuggauuuuugagccaggguuuugcugcauaguucagacuggcacaggccucgguguccaacccaagcuugcuucaaguucuuagcagcccagcuucagcuucccacauucugguuugugccacuauguuuaacuaaaaguucuuuuuaaauuuuuaaauuuuuuucuuaauuaugucuguacaugagugcagauggcaauagaggaggccaaucagacccccuggggcugaaguuagagguguccuuagccccuguccacccccauguaccuccguuguuuuccuccaacucucuggcugcugugaccacugcuguagugaugcaggcaguacagguaucugacacugacugauucagcuuggguuuuguguguaugguagugcaauugcugggccaucccauaguuccauuuuuuacaucuuugaggaaucccauacuccuuuccauacuguacuaacugcacauuucuaccagcuguaaguuugcucaucucucugcguccucacacuuugcagcggucucccugccucuacuucccgagugguggaauuagaagacugagcaaccaauuuuaacucugaccaguauuuguuaucuuuuugguuuuguuucuucgagucaggguuucuuuguguaacggcccuggccgucauggaacucacuccagaccagacuggccucaaacucagagauugccuccaagccgugccccaccaccaccugauucuuuuuucuuucuuuucuuuucuuuucuucccuuuucuuuucuaaacuacuuaaaauguuuuaaagauuuuccuuuaugagaaguguuugccuggaugugugcaugugcaccacaugagugccuguggccagaugucuuugggucuccuggaaguggaguaaagaagauaguccagagcugugcugggaacagagccucuauaggagcagcaagugcucuucucacagagacaucuccacagccccaugcccguggugucucucuuuccugacagccauucucaugagguaaggugacaccuuacuggguuugauuugcaguucccaggugaccaauggcaacaggcauuuuccuaccuggcuuugucuuaaagcuguaucuguuuagauguauugcucauuuuuaaucagguuacuuauaaauccugguuaaaacaac

SEQ ID NO: 4191 - RNA, 12540 nt, Mus musculus
ccugcacaacaagccccgccccccacagcgaggacacgaaggccucgcuacgcuucuuccacuucaguccggaggucgcugucgcacuccgggucuccaggcuucguucuuccugaggucaguuucacgugcuauguuagcucguggucacugagauguccguacccagcucagccggugaagaacuggaggcgagacggaugaucucgggcagggcaguacugggggagggacgaacgccgcggcgucugcgcacuuggaugacgccgccgucucccuguguaccuccggcuggggggaaggguggugggccuggugugugggucuacgcaugcguaaucucuccuagcccccgaagcagaguuucuuuccccugaaauaauuggcccuuggccuuccucuccgaaagcaccuccucgggauuugaggaguagguggagggccuggauagagcgagauuuuuaguggagggucgcucgaucguccaggucuucggagaauuauguacgcauagccugaaagggcagccagacuaacuaacccuaggccucccagacucuaggggaaauagaagaggcucccaugguaggcacguaacugguaccgcaccucgcgacaaucgcuuugcauuguugacagucgcuuugcauuguuggauaucguagacagauuucugcagcaauuuaugucauuuuggcaauguguagggaggaccuuagagcgagcugauccucguugcaggauagugggaaaucugaaaguagcccaccauagagaugguugauucagucacauaauugugcacaaaagaaaguuacauuguauauaaauauauuuuugcaacaauggcucuguaaacuggccuuuguauaugugaugauuguuuuuuuucuuuuuucuuucuuucuuucuuucuuucuuucuuuuuuuuuuuuuuccgagacaggguuuuucuguaaaguccuggcuguccuggaacucacuuuguagaccaggcuggccucaaacucagaaauccgccugccucugccuccggagugcugggauuaaaggcgugugccaccacgccuggcuuguuuuuucuuuuuaaagacacaauuucgccgggcagugguggugcauacuuuuaaucccagcacuugguagggaggcuagccuggucuacagagugaguuccaggacagcgagggcuauacagagaaacccugucucgaaccacacuccccaaaaaagacacaauuucacauuguagcccagccuagccugaaacugauuauguagcacuaacugguuuugaacucacccuuauccuucuugauggaagugcuagugagguaaagguugggccacugugguuguacacagcuaaaguagguugugcgugguagcaguggcuuagugcggaggaggaugagaccagccuugauuuuguacuggguucaaggugaaccuggacuacauagcaaggccauaucuuuuuguuuguuuuuguucucacuauguaacccaugcucacuauguaacccuugaacucacaaagauccacuugccugggccucuggaguagagugcuaggauuaaaggcagcccauggccugcugcaagaccacagcuuaaaaaaaaacugugacagagccauggauagauaguggugcaugccuuuaguccuagcacucaggaggcagaggcagguugaucucuuuaaguuugaggccagucauugugaguuccaggacaaccagagcuacacagugagacccugucuugaaagaaagaaagaaagaaagaaagaaagaaagaaagaaagaaagaaagaaagaaagaaagaaaggaagaaaggaaggaagaaagaaagaacccaaaauaaaacaaaaaaggaacaaaaagcacccccccccuauuguaacaguugugaaaaaaauuugccaguuucauaucugcugucucuucacaauucaggagagaaauuaaaagucaagugucugcaggaggaaacuuuuggagccuccaaaagauaaaccuuucuuugcccuuucacccaguaucuccgccgcuuccuaagaggauccucaggacuauacuggggcccaccuacccacccacccacaugaguucucccauacagcuuccaggaaaguuugugcaaacucagcacccaggggcccuugcccccuucacuucucacccuuccucacuggguguggucuuuguagaaagcucacuuucaugcugguagaaggaaggcaggugcuugucuuuaguuuguucugagguccugguauggugcuagaaacucauuguaccugccagccacauggcuugccugaacccaggcuccuaaguugguagccccugccauuugucuguggguacucaguauccaugaaaacaacuacagcucucaccuuaaaaggaauaagagauaguuuauucuggagucauuguuagugaccauggccugagaacacagauuuagguuacuccagauucuguguucccauggagguaguuucaugacguuuuguaguuuuacagaagaaaauaguaguaaacaaggcaaguuuaaguacauugaaggguacaucagagagauugguacaacaagaggaaggaagcuuuucuguaaguccaagaugccaacugaugacauucuuggcuuuugguuaguggaagcuacuggucugcuaaaggauuccaaaaggaugcuggguguggugacacuugccuuuccuaccagcagucagggggaagaggaagccacaucucugugaguuguaggccagccugaucacaagauauuaguugcaacacagguaggcaaggaagagcuguucuagagggguagaacuagcccaggauaaggcagccucuggaacugcaccagcccaauuucuccacagcacugaaacucuaaucagccagucucuguagauacagcuucuuuucaggaauucuccuucauggcagcaacaaauaaaggcuggcuggccaaaguuuuccuucuaauugggcaggcuuuaaucuuuccccaaagaacugauccccaacuucacaggucaguuguugguauugguuccaugaggauggcucugcagcgaugaagauuaagcucugucuguaguggccacugcacaggguuuaugaagcugaguuccagccucuuuucuugccugucucuuugccuccuucucucccuucagggcucccugucccaggucuuuuagggaacacaauuccugauuuccuaugcuggccugcuagacucuccuuuacuuguauuauuaaaguucccggagggacucagaacagcaucuggcaaaugacaaguguuuaacaaacacuuagguggauggaugccaguuccuuggcaaggguguguguggccauuugugcaagagagcagggcuccugagugacaaacucucaaugcugacuuuuuccacagugcuagaaucccagcacucaggaagcaaaucugcauguucaaggcccuccugggcuacacaucaagaccuuauuucaaaaauacagaaaccaaaagcaaauccuauaacuugggaguauguuacaaaguuuaaacaugggcuggagggauggcuuaggacacugcucuuccagagcacccagguguaguucccaacaccugaaugguggccauuccccaagaaucugauacccucuucuggccuuccugggcacgaugcacagauauauaugcagaugaagcauucauauauaaacgauauuuaagacaaauaucagaaaugcuuagugacgaaaugcuugagagccccaugcaucagaggcucucgacaucccaagcccuauccccagggagaaaggcuguucauaaugaacacuguucuagccaugaaaaccuggucggccuguaggagagauggguguguucauaccagaagcucucaucacagucacacccauuucguggcagcuguggaucauuuuacguauuuuuagucaggcucaaagaagugacucagguuugucaaguucuguucccaaagugcagccugcaugugggagggacagaccuagugggcggucuccaguaggcaaagugaaaggcuaguuggggccagagaaagagaagcggcgaaagucucuacgccccgcccugggcggaagaaaacggaucgucugggaccucuugcagcggcaccaggugagcaagggccauguuccggggcgcccggcugccuuugagaguuuuuuucgggucccuuccuggcccucuuaauacguggcagagcggcuggaccagaagguuugagggaucaaaaaauugggcgggggcgggaucacgggcccggcgagucucugaggccuguuccucccuuagggugacacauuugugccucagaggagccuugcuuggugcuugaaggcugaccucauagcuccgucgccagcgaccuguucgcucgcucacuuuaaggcccaaagagggugucuucagauccuaggauuaacccaacagcuaggagcagcuaguuagcaauauccaaucacaucaaagcagaggccugaaucaugcuucuaagccaggcuggugggaccuccugccuggucccaaggccaaacagggggaggagugugggagaagaaccagcugccuggguucuuucacaucccuugccccugaccucagaugaucgucaggacuggcuggcacccugccucccauaaaguccaguccugugcuuuccucaaagguagauacucuaggacccuguagucuguagugcauaagagagcagguguggguugcaccugugacuagaaguacuguagcuaccccaccccaguggcagugcccuagugaugacuggcuuuggaugacacaucugauccaggcagugcugguuuuacucccuggcgaguuguggguggggcuaacugguuucuccaugcccuggcuauauguccacagugaguuaucucugccguugccucaguuuucccugucacuagcccuugugucaauauguguaaagugcuccugguuagcauuaaggggguauccuccuagcccugggaaggaaggggaagaccccguuaguaaagccauguugugccaggcacuguaacuucacacagagcuguuugccaguuucgguaacuguuauagagagcagcugaagugacuucuguuucucuuaaacagaaccuaguaccgcucucccuucagugcuaggagcacagcacugaucucuucuuucaagccuuccaggauacccacaugcuguccaggcuagcuugcuugacagauaguugcuuaggaauguggagacauggguauuugucucuaggccucagauacauccuuccacagccagugccugucaugcuuauucagguugucagagccuguaaccuguuugucccagcuuuccuagugugauacacugccuggauccuuugcaggcugggccugagcuggcugaggauugugagaaguugguccuggccugagucccuagacucagaaggaagucacagaagcaaaagcuauagugacugccucugaauacucuccuuuucccccagaguccugugccuuccugcccuuaaggugguugcuuguguccaggcuucaugcucccuggccuuugacuuuguauagggcuuggcaacaguagaguauggugcuggaccaacuuguucucagaguaagaaguaggcugaaucagcaguaagccccacuacuggaguuuccagaccguagccaggcucccacaaauaagcagguuuccaggccagaguugguauccuggugcugggugacuggguuccuucagaggcuagggggugacugugucgcauaguccuaggcucucagguucugcuccucuuaaugguaccauguaguuagcuucucccugauaacuuauuuccgggauacucaauguguggacagacuugcuggggagaggcugggccccuacuggaaaaaaauacucucuuaacuuuuggacucaucuuuuuacaaauucuagccugucgagauaagaaauuuucucaagagcucucuuccuucuucuuuugcccagacugcacugugcacccaccaugagucuugacauccagugugagcagcugagugaugcccgguggacagagcuccuuccucugauccagcaauacgaaguggucagguaggagcaaccuuggggaccaguugggucuggcugggagggcaguacucuguuguggaggugggugguucuuguagcuuggggccaccugaugggcuugguguguuccaauaguacuuucucuauucgugggcaugaagauguuuugcauaaucuuuauuuauuuauuuuuuuagaauuaacacaggaagccuuuauuaaagauuauggaaaauuacucauaggcaacaauauacagguuaacacaccucaauugcuaacacgugacugguuacuagcaaagaacuuguccuaacugaaguccagauacauucuaaugaucuagcaugaaaucuuugcaucuuuaaaacggccagcaugucauagccaugcagaucugauucuagggcagugggacacgcagaagggguggggcaggauccuaguacauugauuaaaaacuuuaggaaacuaucuucaggguaaucaguuacaaggccauucaaggaaacucacauggcccucacucuuuauuuguaaacuggacuucaccuauuucagcuucgauacuaauccucaaguggaauacaggcaagccuggucgcuacaugcaagaguacuucaccuuggagccauucagucacgaguuucuuguaguuuucaaccuacgcuugugucagaggcagcagcacggcugggcaguggggaccggcucggguggaucggccaccaaggccgggaccgaaagcuguuuugcauaaucuucaugagauuuucaugaguuauucuugaguuuuucaacauuuuuguacauuuguuuuuagacaaggucucacucuauagcucuuacugacauggaauugggcaauugauuuccaacacaguauaaaccgagcaugguggcacaagccuauaucucagcauugggaagguggaugcaggagaaucagaagccuaagaucauuuucugaccuugguacauaguuugaaguuagucugagacauacaaguuuaaaaauaacuacagguuguguagcucauguagguaaggcaguagaacuugcccagcacgcauguaucauguaugagaagcauaugugaaccacuacagacucagguagggcgggcgggcauggugugucgggugauguugcagcugcagguggcagacaccuugcauucagcauuuccaacccuuauugcucagcuuuuccuucuggcugagaaaaggaguugcaacccuccuuacucguccguuacagugcuuggggacuuagguuuacaggcugcacauagaugccugcuucuucuucaucuuuccugagacaguuuuagguucguagcagagucagaggguuauuuaggcacccucagcccuccaucagcuuccuauaaccaucucccauuuugccaugcugccuggcauucuaggcagacauagauucccagauuugcccugugacuuucccccauucugaucgcugaggaucccacaugacuuuacugaucaucucauuagacccuucugcagaguuccacuuccucuuguaaccugaguuuugagucuagauacccuggcuagucagugauuuucacgguggucaugugcuuuucggagaguauggacacacucuagguguggucagucacaugguguucuggguguacgguggccccauguggucgugacugagucauccucugcuaugauucauuauguacucaugcugcugcagcucugaccaggucugaguuccucugcauacugucaacauccacuccuacccuggccaccccaccucgaagugcuggagcuuuguacaagcuaggcaggcaauuccagcucuugcuuuugagacagcuuucuuccacauguagcccaggcugacuuggagccuguuucaaguuuaagcauuguaguuauaacccauauuugaauuccucggcucuggaugggucuuccagcuguuuugugagacugacgguugggucugaggccagcgccgugcugacacaguacuguuugcaggcuggaugacuguggccucacugaagugcggugcaaagacaucagcucagcaguccaagccaacccugcccugacagagcucagccuucgcaccaaugaacugggugauggcggugugggucuggugcuccagggccugcagaaucccacuuguaagauccagaagcugagguaagcccaggggcucagcccagccuauccagggcagaacuuggggcagacaggcagcugugaugucaaaagccacugagagguuggggagguguggacagcuuguagugauaggcaccgcagcuuuagccaggacaucagugaauuguguagugcugggacaggcuauauuauggcauuguucccggucccagucccuaguaaaagucuggcugagccauacuggccuccuuuggucuggaggcccaucuagagaagcaguaccuaacccugcgagaugugauaggaaccuguucacgaccgcugcuggcggcaugugcuucagccuucagaacugcggcuugacggaggcuggcugugggauccugccuggcaugcugcgcucuuugucuacccugcgugagcuacaucucaaugauaacccuaugggggacgcaggccugaagcugcucugugaaggacuucaggacccccagugccgucuugagaagcuucagugaguguauaccuuguccgggucugagcucuuugcaacccaugacccagagcccagccaggaagcuucacaucagcacaguagaugagaaccuuggaggggauuccuaagaccuaagggccuccccuuugcuaagggcugguagcugcccuagccugagaugaggagcugaugcugguggggucggcuagauucuguccagugugaucccagaugagcugaagacacuucuccaaugggaauuuguuuaucugcugggucugggagaaccucgcucauguugguagggcucuuuucagugacaguuuucccugagcaaugcuaguguccauaugagccuggcagcucuagguauucacugugccugaauaaccagauaaggucuaaggaagcaacugggaaauaagauuccagcaccccuacgucucccugauacugcacuucuagaccuauccuuaauccuuuugaugugccugcccccagguuggaauacuguaaccucacagcuaccagcugcgagccccuggcuucagugcucagggugaaagcugacuuuaaggagcuaguauugagcaacaacgaccuccaugaaccugguguccguauucugugccagggccugaaggacucugccugucaacuggagucacucaaguauguacuaggccacagaggcuaaggggucgggccaggcaccaguucuccuuuuaccguauccuaugucuccaggcuggagaacugugguaucacagcagccaacugcaaggaucugugcgauguuguggccuccaaagcuucgcuacaggaacuggacuugagcagcaacaagcuagguaaugcaggcauugcagcacugugcccaggacugcugcuucccagcuguaagcucaggacucuguggugaguugguucccagucucuuuucauagggauggaagacaugguggaaugagggacauucgugaauaauguuguuaucccacaggcucugggaaugugauaucacugcagagggcugcaaggaccugugccguguccucagagccaagcagagccugaaggaacucagccuugcuuccaaugagcugaaggaugagggugcccggcugcugugugagagccuauuagagccuggcugucagcuggagucacuguggugagggccugaguggggcuaagguauaucuaggacagaaaagacagaaagccuagaguagagugagguuuggaagaugcugguguacccuggaagacgggaucaggaagaggacagcauuagauugagguagauaaacagaugcugcggggaagggaaggggaagggagugggugucagccaccugggucccuuuaauggaccuucaagggaagggcuccuuggaagaacugguuccagccuuucuguucccacaggauaaagaccuguagccucacagcugccuccugucccuacuucugcuccguguugaccaaaagccguucucuguuggagcugcaaaugagcagcaacccacugggagacgagggaguccaggagcuuugcaaggcccugagccagccagauacagugcugcgugagcuuugguaaguaggcugcagagguaagcagagcuccauugaaauggggucuguguagcccuaguacucacugugaacaggcuggccuccaacucauuuccuuagucacguucuagcuucagagcaugcguucuguauuagaugaguuuccaguacucuuguguauccuggucagugagcuagauguagaaccuaggguacuauuucucccauuucuuucugguucagggagauguuuugguuuuccaagauaggguuucuugguauaacugagcccuggcuguccuggacuagcuuuuguagaccagguuggccuugagcucacagagaucugccugcaucugccucccaagugcugggauucaaaggccugcaccaccacaccuggcucuuuggcagacuuuaaaauuauuuuacauuuuuguccacguguauauuuacccccacauguguauacaccauguggaagucagaagauaauuugcaauuguuuuucuaccgugggguuccaggcaugggauucagguuguuggauuuggcggcaaguaagcccagcccucuugagcagcccugagauuuucuacccauugugcucuggguuauugauuugucuuuaugugggucuuggccugggcaauuaaugugauuuuuuuuucuucuucuucuuuuuuuuuuuuuuugguuuuucgagacagaguuucucuguauagcccuggcuguccuggaacucacuuuguagaccaggcuggccucgaacucagaaauccaccugccucugccucccgagcgcugggauuaaaggugugcuccaccacauccagcgcuuuuuuuauuaaugugcuuucuuguccuuucucucuacaaaguccaggagucaguccuuggguuuuaaguccaggagucaguccuuggguuuuaagggaggacaauccaaucccuccucucauuuuuuuaaguuuuuagagcaucaugucacucuuaaugucuuguccuuuaccauuuacccuucuguggcagcacauccugacuuugucauucuggaugggacaccacagggcuaacagccuggagucucuccuguccaggaaauagcaucuugguugugggaugcucugcaagucuugaugaaaggaguguggguucucuccuaugaggcuuggggccugcuauauucaccuacaggugggguucugcaaauuccagcuauaccucagggagccaaucaauccauagcagcuucuugucuccgggccuacauguaccuuguacucucuaguaccucggggaaguucccucugauugguauggguacuagaccugcucacuuacuccuuuggccuguaccccaaucucccucagucuggaaaccugucuaccgugucacuuucuaugugcauccugauguaguuuggccuuggugcacaggcuuuuggccuagccaggcuccuggugcuaagagacauggauaugcccucugaggcugugcaccguucccucucaggggaagcuagaguucuauuuuauccaccugagggaagcaugaaguauggaggggcugccuuccugcuaaaucgcggauguggggaacagcucugcccuuuccauccagguugggagacugugaugugacaaauagugguugcagcagccuugccaauguccugcuggccaaccgcagccugagggaacuggaccucaguaacaacugcauggggggcccagguguccugcaacugcuggagagccucaaacagcccagcugcacccuucagcagcucguguaaguacuggggcugccggggcucagaggguugucaggaaggugggcaccucaacucacuuuucucugcuugccuguguacagccuguaugacauuuacuggacaaaugagguggaagaacagcuucgggcccuggaggaggaaaggccuucccugaggaucauuuccugauguuccucuggacacaucaauccagccccaggggcagccagcaggaucucuggcucuggguguccuuguguugaccggcaauaagcacuguggucuuacuucaguagaaaacuuuaagacacuuuauaacuauuaaaacacuuugauggcaagaaaggu

SEQ ID NO: 4192 - RNA, 735 nt, Mus musculus
aaaguuaaaguuaaaucuuuuuuuuuuuuuuuuaguaucaauucuuuuuuauuuuucagcuggaaaacuagacaauccuccaguucagccaaguauuaauuaauccucuuccucaucaucaccagcuccagccccgcccuggccuuucuuggcauucuuccucuucauucgcccuagacggccgccaccauaaggagaacggagggagaaguugaugugcuucugagaguccaggcgaacaaugaaggaugggauguucaccaccugcuugcggacccuaaugugacguuggcggaugagcacacgggcauggugaauagauuuggccaggcccagcuuaaagaccugggucugcagccgccucuccaagaaauccucaaucuucaggcccaggauguaauccagcuucaucuugcccucguccagcaccccaaugcgaacaagccgccgcaggagagcauugccuucaaacagaggcauccuucucguccagcgucaacagcucccgggccgccuuauggaucuuggccaggguaaacuugacccuccaaaccucacguuuguuccagaguccauacucuccaaucaacuuuagcuccuggucgagacgcgauuucucgaagggucuccguggggucacauagguuuugcaacaaacccagcuucuggcgaccggcauguugaccucgcuaggcuggcugcgccuacgaacucaggcccgagacaaagagcaaa

SEQ ID NO: 4193 - RNA, 4246 nt, Mus musculus
accucagcagcucugugaagugugguuacagauguguguguagggugggcauacaaguccccuuaacaagaucaagggcacuacuugagauggucaggacaaggaagcuugguugaguugaucuuugugacaagucgagagagcacucagaaaucauguguucuuccuccagaucugccacagcaagaguggugaaaucaacccuguaaagguggccaaccuggugaaggccuauguggacaaauacaggcauaugcgcagacacaagaagacugaagguggagaggagccacccacucagggugcugagaccugaggcuagccacucucuggggaggcauccccagcgggaaagaaauggggccgccagcacuccugccucugagggucucaugguaccugucugcaccugucuugcuuauaauugaaaacuggacuuuuuuauauguauauuauagauacacuguuuccauuguguucuaauuuaucaaaaauggcuuauguuuagaaacuuuucuauggacugaugcuuagaaggugaagcgguuuuugguuucggaaagccugacggcucaguggaagcgucuguaucugccacaaagccagcugucagcagucgcucaggaccgucccugcuuagcaguucucuuccucuagcugcuuugugcuccugucaggagacaggacauagugcugugggucucagagguuuaggcacacacaggccccaccuucccaaguacaccuggcaucgggguguucccgauuccugucuuagaguguuuguguccaguaagagcugugcuagccuagccaguucuugauuaugaaagugagugcugcaaaggaggccugguguguagggacugggggucaccuucuuucaagggacucuacaagguccacuagagacacuauacagcaaggagcagaccugacccagggcuccacugauuuugaacuauuuauugggaguugggauucugagucaaggccacugacccagguccaugaggaaguguucgaugucuucguagagacuguuggugcuagacaagcacaagccgagacugcugcuguccagggaggacacacccucacgcugcacgcccuccagguaugccuugcauacccauggcuccagcuguggaaaggacauguguuaagacucuuucuuaccuagcagcccacaccuucccuuggcccacccaggcucuaccuucaccaggaucagggucuucuccuugggccucccugcugacaagucuugcccaaaacccagguagaugguguaguguggugacccuugccgccuccgagcccgaaacuccuccaguucuguuaaggagauagcucuggugagcagguuaagaaaggcuccaggccccagaggacagcaccccagccagacaccuuacugaccucggaagaaagugcugaagucgaagauggggguguggcgguugcgcuccagcagcuggggugggguggaggggccgguagugcccauagggcugccuaccucccaguacaccuugcacuugcccauacgcagggcccacagugacgguccucgaagcuccagcugaaggccgggagacacaugcuggagaagcgucucuguguagugcagcugcuucugaucugggagcucagcaggacugggaaagaucaccggcuggggcucugaaguucuuacugcuggggccauggggcuguacaggaacacgcaucuggggugccccaccacugccuguagcacugugcggcccuuguacaugauggucacauccaggaacccaaggcugcgcucuguguauagaccaugcugugagugguagguuuggguggagcauuuugucccaugcccccugccaaggacccauucaccuccuacugagaugcaggugugaaggagcaguagggcagaauucugcccgggaggcuaggaaaagcugugcuagcgccuccgcucuagauccucaccggugagagcuggcuguugaggccugggacuggggacagcuuccaccugccaugcugcauaggguuccucguaaacacggucuugcuccuggccugagggcaaauuggagcugccuguccaucuuagcccagcuucccaccccugucauuuuaacauccuuaucuuuccuccucccagcaaggacucuguuguccucccucucauacagccuugggcagauggguguucucuagcuuagccccagcucuguaacaguaacugccucucaccaggagccuguggugggacggggucugccccagacucggauuccaguauguggcuguacugcagaaccugaagcaagagguccccggcaucacuagaaagcagagggcuugggguuuggagcccagcauuuucucuugccagaaaugauccuggggacacacccuguaauagacagcauagugguaggcaccugccgaucccccacaccuaggaaggauggaccagauguaccugugugggcagagcauugcugaggcucacuucuucccuauuuuccguggcugggcccacugagggagaggaguggggaggggagauuugguuacgaugcccaagcaguuccaaaaguucucuauuucucauacccucuguucccaaaccaccagguaccucacucagcccaaggcucugacuuagcaggaagugugcacucccccuccaccccgacacacacacacuuuggaaggagaggaacugaaucuacaacuaguuucaaaaaccacaaaucaaaccauugaaaccaccaaaaugacagaggccauguaccucccuggcccaucccuguuuguggcacugcucaccaguagauccaagcucccggcuaaguucguacaccuuaugcggaucaacuggauccccugaauugucuuggcgcaagauaaaacgcccugugcuguggagugcacagcggaaguuggucuuccagccucuucgcucucuucgcucagcagccucagccucuggggguggcagguuaacuccacuagguggccaccucccucgggccacagcccaggccugaaggagaggagagagcauggguugaggcuggauucccccaggaguucuggcagauuauaaagagggcaggacuggguaccaccuugaagaucugugcaucuucuucauccagaucccuacgaccgaaaugcuuccaggguacgcggaagacugugcgagccucguucagccacugcagccccucguacuggccgcugcugaccucccccaauagccagucuccaaacagcacucgcuggaccccccugcaggcagagcagccacgcugggguuagggcuaauguaagggacacaggacccaauacaaccaggguagacauguucucaccucacuucagccauugcuccgucuacacaggcagucugggagaaucaaaguagaugcuacuacucugugaugccuuguagucacuggagcagucagcuauugcaaauaaggccccuugggugccucuaugguuuuagguuguagccacagauagugugaccaaguuucacaaauguguuuuaaacguuacaaguguugguaacagguaggaauuucaguuucacaagugugacccagguauuaggguguugagggucacagaugagguuugagaacuuguggucaccuagguucagaacucaguguagauuccucugccaagguggcuguagaugugacuacagauguagcgggagcgcacacgugaugucacagguguuaauccagcguccgagccuggaugggcugucacaggcuggacccugcgaagacacaaaaggggcgggcccagacgaguaaaacgaaacugcaucucaggaaaaugaaaccuaaacagucuaaacagcgcccgguagcugcuggcuucccgcugucuccacugucuccaugccuaccagugcaguccucaaacuacacccgacccuuacucagaucccaaucccugcagacccaauugcaaauccugccgggacgucugcccuccuguuucccccgagcuucucuucacugcccuucacugaucacucacuacucuguagaggggacaagaauuuccccuguggcacuagcucaccucccuccccgaguggcccaagagucccacauaccugguaccggagccgccgggacggguuuuaucucagugaaaaggagggugccagugcuuuuauaguacuucgggcagaggcggggcagagccc

SEQ ID NO: 4194 - RNA, 4246 nt, Mus musculus
gggcucugccccgccucugcccgaaguacuauaaaagcacuggcacccuccuuuucacugagauaaaacccgucccggcggcuccgguaccagguaugugggacucuugggccacucggggagggaggugagcuagugccacaggggaaauucuuguccccucuacagaguagugagugaucagugaagggcagugaagagaagcucgggggaaacaggagggcagacgucccggcaggauuugcaauugggucugcagggauugggaucugaguaagggucggguguaguuugaggacugcacugguaggcauggagacaguggagacagcgggaagccagcagcuaccgggcgcuguuuagacuguuuagguuucauuuuccugagaugcaguuucguuuuacucgucugggcccgccccuuuugugucuucgcaggguccagccugugacagcccauccaggcucggacgcuggauuaacaccugugacaucacgugugcgcucccgcuacaucuguagucacaucuacagccaccuuggcagaggaaucuacacugaguucugaaccuaggugaccacaaguucucaaaccucaucugugacccucaacacccuaauaccugggucacacuugugaaacugaaauuccuaccuguuaccaacacuuguaacguuuaaaacacauuugugaaacuuggucacacuaucuguggcuacaaccuaaaaccauagaggcacccaaggggccuuauuugcaauagcugacugcuccagugacuacaaggcaucacagaguaguagcaucuacuuugauucucccagacugccuguguagacggagcaauggcugaagugaggugagaacaugucuacccugguuguauuggguccugugucccuuacauuagcccuaaccccagcguggcugcucugccugcagggggguccagcgagugcuguuuggagacuggcuauugggggaggucagcagcggccaguacgaggggcugcaguggcugaacgaggcucgcacagucuuccgcguacccuggaagcauuucggucguagggaucuggaugaagaagaugcacagaucuucaaggugguacccaguccugcccucuuuauaaucugccagaacuccugggggaauccagccucaacccaugcucucuccucuccuucaggccugggcuguggcccgagggagguggccaccuaguggaguuaaccugccacccccagaggcugaggcugcugagcgaagagagcgaagaggcuggaagaccaacuuccgcugugcacuccacagcacagggcguuuuaucuugcgccaagacaauucaggggauccaguugauccgcauaagguguacgaacuuagccgggagcuuggaucuacuggugagcagugccacaaacagggaugggccagggagguacauggccucugucauuuuggugguuucaaugguuugauuugugguuuuugaaacuaguuguagauucaguuccucuccuuccaaagugugugugugucgggguggagggggagugcacacuuccugcuaagucagagccuugggcugagugagguaccuggugguuugggaacagaggguaugagaaauagagaacuuuuggaacugcuugggcaucguaaccaaaucuccccuccccacuccucucccucagugggcccagccacggaaaauagggaagaagugagccucagcaaugcucugcccacacagguacaucugguccauccuuccuaggugugggggaucggcaggugccuaccacuaugcugucuauuacaggguguguccccaggaucauuucuggcaagagaaaaugcugggcuccaaaccccaagcccucugcuuucuagugaugccggggaccucuugcuucagguucugcaguacagccacauacuggaauccgagucuggggcagaccccgucccaccacaggcuccuggugagaggcaguuacuguuacagagcuggggcuaagcuagagaacacccaucugcccaaggcuguaugagagggaggacaacagaguccuugcugggaggaggaaagauaaggauguuaaaaugacaggggugggaagcugggcuaagauggacaggcagcuccaauuugcccucaggccaggagcaagaccguguuuacgaggaacccuaugcagcauggcagguggaagcuguccccagucccaggccucaacagccagcucucaccggugaggaucuagagcggaggcgcuagcacagcuuuuccuagccucccgggcagaauucugcccuacugcuccuucacaccugcaucucaguaggaggugaauggguccuuggcagggggcaugggacaaaaugcuccacccaaaccuaccacucacagcauggucuauacacagagcgcagccuuggguuccuggaugugaccaucauguacaagggccgcacagugcuacaggcagugguggggcaccccagaugcguguuccuguacagccccauggccccagcaguaagaacuucagagccccagccggugaucuuucccaguccugcugagcucccagaucagaagcagcugcacuacacagagacgcuucuccagcaugugucucccggccuucagcuggagcuucgaggaccgucacugugggcccugcguaugggcaagugcaagguguacugggagguaggcagcccuaugggcacuaccggccccuccaccccaccccagcugcuggagcgcaaccgccacacccccaucuucgacuucagcacuuucuuccgaggucaguaaggugucuggcuggggugcuguccucuggggccuggagccuuucuuaaccugcucaccagagcuaucuccuuaacagaacuggaggaguuucgggcucggaggcggcaagggucaccacacuacaccaucuaccuggguuuugggcaagacuugucagcagggaggcccaaggagaagacccugauccuggugaagguagagccugggugggccaagggaaggugugggcugcuagguaagaaagagucuuaacacauguccuuuccacagcuggagccauggguaugcaaggcauaccuggagggcgugcagcgugaggguguguccucccuggacagcagcagucucggcuugugcuugucuagcaccaacagucucuacgaagacaucgaacacuuccucauggaccugggucaguggccuugacucagaaucccaacucccaauaaauaguucaaaaucaguggagcccugggucaggucugcuccuugcuguauagugucucuaguggaccuuguagagucccuugaaagaaggugacccccagucccuacacaccaggccuccuuugcagcacucacuuucauaaucaagaacuggcuaggcuagcacagcucuuacuggacacaaacacucuaagacaggaaucgggaacaccccgaugccagguguacuugggaagguggggccugugugugccuaaaccucugagacccacagcacuauguccugucuccugacaggagcacaaagcagcuagaggaagagaacugcuaagcagggacgguccugagcgacugcugacagcuggcuuuguggcagauacagacgcuuccacugagccgucaggcuuuccgaaaccaaaaaccgcuucaccuucuaagcaucaguccauagaaaaguuucuaaacauaagccauuuuugauaaauuagaacacaauggaaacaguguaucuauaauauacauauaaaaaaguccaguuuucaauuauaagcaagacaggugcagacagguaccaugagacccucagaggcaggagugcuggcggccccauuucuuucccgcuggggaugccuccccagagaguggcuagccucaggucucagcacccugaguggguggcuccucuccaccuucagucuucuugugucugcgcauaugccuguauuuguccacauaggccuucaccagguuggccaccuuuacaggguugauuucaccacucuugcuguggcagaucuggaggaagaacacaugauuucugagugcucucucgacuugucacaaagaucaacucaaccaagcuuccuuguccugaccaucucaaguagugcccuugaucuuguuaaggggacuuguaugcccacccuacacacacaucuguaaccacacuucacagagcugcugaggu

SEQ ID NO: 4195 - RNA, 6334 nt, Mus musculus
cucugcaggcgagccccgccccgccccaucccucgcacaaauauccgccugggcuguagccauggcguccgagcggcugccaagcaggccugcgugucuccugguggccagcggcgcuuccgaaggugaggcgcgcagggcagcuguguagcucacuggccugcaguccugacucugggcaaacguuuguguuuguggaguugagauucugggacccugcaucuguuucucuggcgcaggccuacuauguugucugcgcuggcagacagggacggucagcggcugcagagaugacccugcccccgagugagccgcaggggcuugguacucucucugcccguguuuucugccucucuguuacccccuaucuuggguuuaucuucgugcaccuccaggaagcgauccugaaagagguugcucgaaagagcugcauaaaagggacccucacgcagaaggggucuguuggcuucauguuccaacugcccggugugugucaggggcgcugggcagaugauuacuucacggguccuuagggaaccgacuggcccgagauagucucuguggggagguggagcccagggcugcggcccgggguuucccucuggauuccuauagaccucugcaagugggugugagcgcgaggguacgucgggaucuuggacugaugaauuucuggguuccacacugaagcgucccaggugagggugggaggggccugagggugcugcuccucccuggaauagagguaaaagagaaucuacagcagcuccuagguaggccuuccuugagagucggaaagugagggauugagaagcuaaaaauuaucuuuaaucccagcacucaggaggcagaggcagauggaucuccaggaguuugagcccgucuggaacuuauauagcaaguuccaggcuagcaggaguacacagugaggucugacucaaaauauuaaccaaaacaaaauccacaagccaaaagccuagugucagaguuggaggcaggaggauagagagggcaauggcuacaugagaugcugucuuuaaaaaaaugcuagggggcuggugagaaggcucagcggauaagaacacugacugcucuuccgaagguccugaguucaaaucccaacaaccucacaaccauccuuaacaagaucugacucccucuucuggagugucuuaagacccacagggugucuuaagaccaggaugggagagagcaaccauuuggucugaagacagcuacaauguacuuauuuauaauaacaaauaaaccuuuggacuggagugagcagagguccuaaauucaauucucaacaaccagaugaaggcucacaaccaucuguacagcuucaguguguacucauauacauaaaguaaauaaauaaaucuuuuaaaaagugcuaggaucaaaggugugcauaaaggugugcauuaccacaccugggggcuagagucuuuugaauuaggcaagcuucguuccuuuuugaaggacuuuuuuguuguuguugguuuuuuugagacaggguuucucuguguagcccuggcuguccuggaacucacucuguagaccaggcuggccuugaacucagaaaucugccugccucugccucugagugcugggauuaaaggugugugccacuuuugaugggcagaagagggcugagaauaccaugguggggcagaaucuuacccauguccugggugugggagugccccagacaccacucuccucuccugcugcguuuaccucugugacauguucacugcugcucuucccagguuauggggaccuuggauccugguggaucucuaaggggaugcaccagacauuuaccuguuuggaaguaccuauagugggaaaggguaggaugcagccaaggguguaaugguguugguggacaguuaaggugaccugggggccugaagguagaguuauuaggucaaguggagagccuguccagggagguuucagaaccacuggagcaccugcaggucuuucaggguccagugaccaaagcuggguaaaauaauagacuugcuguggaccucugagcaggucuucucaguuauguauuccugaaccugaagggcugcuguccugcccccagggaguaggcccugggguggguaaaauggacugccccuaaggcagguucugggaccaggauggccccaggagcacuggagcagucuaugaauagggaugagacagcuggcccuaucaugcccucacuuuucuggaccccucuuuugcaggugugucagcccaguccuucguccacuguuucacacuggccagugcugccuucaaccuacagguggccaccccaggggugaguagucacccuucucuagggugagcuguucuccuuucugaguugaggcuaggagaguguagagagcccucuguagcugauagggccaggagggagcuaccuucagguaaggggaucuacagccagucuuggaggcauccuuaagccaccaucccaguucccugacucugacuacccaucuucagggaaaaaaaauuuuuuuccauuguggcuugcacuuuugcaggccaucuuuaagugaaagauaaggcuugacccuaguguguggguccuacacacuuggcuccuaauaggagagauuauugauucuugcauguauccuggggacauacgguauaaaugggucacggcaaguguguauuguguauuugugacuuugaguguuuugaagucaugagcuggguggacaguuguugcuacuuuauaaguaggagacuggagaccaagggagagcaggguauagaaagaccucaguauugaguagcacugggcuccacacacuggggguuuggcucucugggccuuuuuuguacuugaucuuucucucuccauagccacuggaggcuuccugcuugggccagccaguaaaagugcuauuuaagaggguguuugugcccugggcuguuuuuaagucuguuagccuuucugaguuuucugccauccaaaugugggggagauaccaguguuaacccugcuucuguagggaaaggccauugacuuuguggaugugacugagagcaaugcccgauggguacaagacuuccgccucaaggcauacgccaguccugcuaagcuugaguccauagaugguagguuggaaaugaggucugugguggcuucuggacagcggaucccuguggaggacuguguccuggcggugcccuuauuugaccuguguuuucccccuaggugcccgguaccaugcccuccugauucccagcuguccuggcgcccugacagaucuugccagcagugggucccuggcucgaauacugcagcacuuccgcucugagagcagugggugacaagaaacugcaggauaggcugacaggcagacacugggugggaaggaggagggaacaaccacaacaguggaugacagggaacuagacuauauaggcuuggaagggggagauggaguggauauuggguacaggguuucguguucaggacugggcaugccuggugauucaucagcccaucagaugggaguggggagcugcagcggcucugacuacacacagauaaguuugcucugagaucaugugcacaacagagggaucccacuaaauauacuguguguacugucagucagugugcugugggccuuuucaggcugagagggcuggugaccauggccucuuagcuuucuccaugguaggcuagucaggaugcugucuggauuccugauuggagugggcaacaucuguugugauaagcacaccuguaggcugggacaggaugcucauaagagaguagcaugcagauaggcuccacaugguguccuuuguuggugagagcuggauuucuaggcugagacaggcagcauuuguucccagucaccucggcaaugggaacgcacuggccauuaacuugccauugggggaaagccaggguagccucauugcagagcaggaugucccccugggaggacagcccccaauagcuucucugcaguuggaagcaguggcugguacauagacugggaguucugcaugcuugcacaugucucaaagcucaggcaguaugggcucuagguuagucuugagacaucaaccuugggugaggggacacuugggaggggacccuacccaggauagcauccaaggccuuagacuauuuugcugcuuuuagaacccaucugcgccauuggccaugguguugcugcccugugcugugcuaccaaugaagauagguccuggguguuccagggcuacagucugacaggggugaguaccucgugcacaagccagcauccuuccuuaccccuaccugacccaggaggagcuuccugccugcacugugaccugucauucccuaugcugcuacaacaguucucuccuugccugggugaugugugcuaaguguaagaaggcaaacacauccuggaaccucagccccuuaccuggacaucaugggacccuccaagggaauccuuccagaggauacgaggauaccugcccaucucauuuuggucacauauaccuugaugccguaguggcuuagucccuaaaagaugucagcuuugccuuuaccccaucucccccugcggauuugaucugccuggucccugggguugguccuuugggcaguagggcauuggacuggguaaagccacuagcuggucugacacaggcccugcccuugcagccuucaguguacgagcucaucagagcaccuggcuuugcccgccuaccauugaucguugaggacuuugugaaggacucuggugcuggcuucaguggugaguucaaguuggugccccuucacuuagaugggcgaggcuacuugcuguguguucacagaucccuaaugggugggagugggucugggccuggucuuugugugccuaaggcuugugccuuuugccuuagccagugagcccgacgcugugcacguggugcuggaccgccaucuggucacuggccagaacgcuaacuccacaguuccugcuguccagaaccugcucuuccucugcggcagccggugaggcucccgggcaaggguuugggcggguucccgcuuugugacuggcucccucugcuggacaguuuugucugugacacucugucugcuggugcugagccuggaccauguauucauccuauaggaaguaagcuuggaugcaguccugguggccuagagacaaggacugaacucaccauggucuccuguacugacacucgaugggacacucaagccuccaucaggaccuuguggaaugcuggaagccuccagggauuaauacuuguggacugucaguccuaauguagacuaggcacccuuuccuccaucccagcacagugucuuggcuggccaggcagucccugagaacuccagauugacgauuccaagaagaauugcccacgggauguagucagcuguggggucucaggauggggcguuacucuucugugggcuuucggcuauuucugucccuuccacuguucaugggaaucguguggauggaccacaggcuggagcuugcuaugaacuuccuuucucgucuuuccuuuuuuuuuuuuuuuuuuaaaaaacuuguuuauuuuuauauuuccuaugcaaugguguuuuguuugagcauaugucuuuaugaggguguuggauacccuggaacuagagguacagacaguugugagcugccgcuugggugcucaaaauugaacccaggucuucuggaagagcagucagugcucuuaaccauugagccaucucuccagccuccccuauccccucccccuuuuuugagacaggguuucucuguggccuugccuguccuaaaacucacucuguagaccaggcuggccuggaccucagagauccaccggccucugccucugccucccguaggcugugauuaaaggcaugugccaucaccuggcugugaacucauuuuuguuguuguuuguuuuuuuuuuuuaaagaagacuuacuuauuuuauguaugugaguucuugcgugcgccugacucgaccaucaagaacuacgcugcaacaggauccuucugcacacauuuauugggagagcuugauugcagaggcgaagagacccugagcccagaacuggugcugcuuauauaggccuaggaaaggcgugucucacacccggauugguuaugcacuaugccucauuugcauguuccucaucugauuggcuacucaguaccuuacagaaccucauuaacauaccucauuugcaugucucacaucugauugguuauauucucaguaccucauuaacaugcucgggccaggcagugacuuggcaaaaagcuuuacugca

SEQ ID NO: 4196 - RNA, 8156 nt, Mus musculus
ugggcggugucuaaggagcaucucuccuaaagcuccgggaccaaaccuuccccagaccgucccauccccaugcuucccuccuaccuauucucagucuuucagggcuuugagauaggaacaaggagggccuagggauacgccagaaagcccacucccucaaggguggccugaggcugugguaguggccacgccggccgggagggggagccgaaggcagcaaaaacuuagggcggagcgggcgcgccuccgagagacgcgccuccccgccuaggugcaggccccgcgcgcggcacagcggggaagcgaucccggcggcugcaguguggugagugcuagccggucauuucccguggcgcccacucaaaucuggcuggguugcagggaggaaaaaggguggcauugguggcugggagaggugacaucugcucagacacugcggcuuuggcggagccugaaccuaauggguacaucgaccggcugucuccggguguggaaggccgugcucggucccggcucugccgggcgcgcuccccgcgcacacgugucccagcaguguggacgcuccagagccgaggcuggaguuauuucugccagggguggggggugcugcacacgugagagcccacuggacuugcgugggcacguauauggucagaguccgcguugucugucuggagauaacgaggccagcugagcccggaccuugggguaaagggcaugaucuggccuggaacagaggaugugccccauacugcuuuuccuuuguaggacagcuggaguaccuuucugugggaaaccucuuugugguccuccuagcuagcaagacaaagcuaaccucccuaagaggaaggggcaagggagacuggauugggggaagggcacucaaguggugaggcucaaccccaguccagucucucucucucccuucucuuccccccccccccuucuuucuuccagacagggucucucuauguggagcuaguuguucuggaauucucuauagaccaaguugucuuugaacucacagacagccaccugccucugccucagagggcugggauuaaaggagggagccuccagugucaccagcauuucuuuuagguaggaaacaggcagcuuuauucaugaaaauugaggaagaaacuguauggagcuguuagccucuguaugcuaacggggcuuuucucaguuggccuguggccugacaggggaagaaggcagaaagcucuggauccucaguggccugacuggacaaucagguuucuaugguaacauagacagcaucgagggagcccugacaugugucucaaacugaugagaauuaaagaacacacacacaacacacacaagccaggaguggugguggcacaugccuuuaaucccagcacucaagaggcagaggcaggcagaucucugacuuugaggucuacauguucuacacagugaguucaaccagagcaaucuugucucaaaaaauccuauaucaaaaccaaacucuuugggugggggaggcgggaaacagaccagacgguucccuuuguguggugcuccaggcagcagaaccccuuugcucucagcucagcaacuguucucucuggugucccgccuguuuuguuuaguucaggguacagggcugacuaagcccuggggaucucagugccuaccuggcucuuccccauggacuucagacugucugucugacuuccaggauacacacaauacccaaguccccaggucgcagauauguaggagauagcaucucagggacagcagacugaagguagaggcauaaggaaggauggggcuucuccuaaagauggaguagcggagagcugcuguaucuaguuuacacuuggagcauggcguggagagcaagaagucagacuacaguucaaaggucaggccugcgccacacacaagggcuaggagggacaggcacucuuccauugagaccccucguaugcagaggucagagggcaccuggaguaccgccuccaugcucucuggucccaaaaggugagcagggccugcugugcuugguggugguggccuuugagggucaagcaucccuuccuuguccuuuccagaggacaggucuacuuucuugugcccuaaccugaaguucccugauagguacacucagaucucacagcacagugguugguuguugacccauuucucaaaagcacugauggguccauacaggguaucccauucccuggggcuccagggcuguagacagaucugugcuuauuccagauagaaaccuacugaguggcccggagcuggagucccuauggguaggcaaccugguugguucucagggcuagucuguuccuucuuuagcauccaggcuggguccagccccagaaccccagaaguugucuuauccuucucuccuuuucccauagcugcagagauuaccauuuagcccaaaaugaaagagaaaguccuccccccaaggcccgccccgccccgccccuccgccaauccccguaggcuuuugucuccucccccuggccagccucuuuaucuccucggugagcguaguuguuggagcggcggagguggaggagcaguuguccgcacucuggggugcacucagggugagcggaaccccguggacugugggggaagaggcggguaguagauccagagucacaacucgucugggggcuuuuuagcgugaggcagccaugugauccccauguggcagcacugaggauacauagccugugugugacagcugaccucugagggcucgggaagagacacagggaaggaccaggacugguuuuuaugauugugucccucaugccuccccccucucccaaggcaggcucuuguugccccuucucccucucuaaaguuaugggguauaccagccacagaugcuucaggaggccagcaucccucuuacaccauuuauucuugucuucucuuccccaaguccucauuccuaggcuccugugucuuuugggagugaaacacaucccugggaagcugacaggaagaugggcaaccagcucggugugggugggaaucuugcuucucuaagggaaggggcuccgugacccagugagcuguuagggaacugggccugcuccgcccaggagcuccacaaaggagaaaccacuaccacccaucccacugaaaaaacggcagaugcuagcuagcugccuuugaucaagggugggaacuggugaucacagcucaaguccaggguccaaguaccacugcauuaaaaggcaucuggcccuuuaaaaacuggagcuugccuucugugcgugagcaucugcgugugagcgugaguuccuggcugccugggaggacgccacggggagggcauugaagugaauccagguggccccagggauggguggccucccuuucuucccccacccaccccccuguguauccucuggguaucuugaaggcugcagccugacgcauggggucuagggagugagggacuucacgcccuugugagauggugggcggggagaggggcuucuuuuucugauaggccccuuuuaccacucauucuguccuucuuucuuucagguggcacaagacuugaaauugcuuugaaggugaggacauccccucccccaccgccagccaccaccaccagccaccuacaucguccucaucagccccuccccaucagugccuccaccaacaucacccggccugacuccugcuucacuugguguaaauggcugauaagcagaucaggucagagggaccccaaucccugggcuuuuggucuuggcuuuuggucacccccccucuccagcaugaccucccuaucccccuguccugugggugaggauguuaauccugacacuugacccugcacacacagccugccggccaagcucaucaaugguggcaucgcugggcuaaucggggucaccugcguguuccccaucgaccuggcuaagacacggcugcagaaccagcagaauggccagcgcauguaugccagcaugugagugagagcugccuaggaggggugagggugcagcugccaccuuuuaucucugcuccugcaccccugaauuugaugaagggggaacaacacagggcagaccugagaaagauucccccacccuacccugacccugacagagucuuuggcuucucugucagccuuggaugagcauaguggguagagacaacacuggcugcccuugccugacucggggccaggguccagcuggccaccacuuauugcuguccccuugacuacaggucugauugccucaucaagaccauccgcuccgagggcuacuucggcauguauaggggugaggccugggaaugggugacagaugggucuggcugggagcagggacaagggaugcaugucugggcuuggucuguaaguauagacgugugauacugguagcaccugagcacagugggggcaccugccauccccucaugcuggggggacuggaugucuggggggauaguucuucugcaggguggcaggucucaaaccucaccugaaacacccugcugucuucuacugguacagcaggacagagguuguuucuuuuucucuauuguaguggcuuaggucuccuccacuacuuucugugacaggcaggaccacaucugugccuagagaccaggggcauuaaacaaagcagcuuaggaaacaaucccugaggguggauuugcccagaugcuguguagcccugagcccucagcucugaucagccauccacagccuucucugagcccugacccauacuguaguccugccagugggagcaccuguccccaggagggaggacccccccacauagucuuuggaggcuugcuccucauugccucucaggagagaccuguucugccaaagccagagacagauggagguggaaugcuggggagggaggacacagcgccaccccaucccgccugguucccccgccugccuggcacaaaacaagcccauaugugggugagagggcaggaggcugcagccaaggagugccaggcagggcuuugccaguguggagcaaagugcucucccaaagcuucccuaacccaagcuacccagcgagucuguccccacccgaccuaccugugucccccaagccuuagcugacccucagaugccccacaggagcagcaguaaaccugacccuggucaccccggagaaggccaucaaguuggcagcuaaugacuucuucagacaccagcucucuaaggaugggugagaggcucggccacgcuggcugcuggggcccagguccuaaggaaggguguguugcuaaccccacccaucacgccccagaaguccccuagacugaaaacagaccccagaggcucuucuaccucggucccuuugcgcaccaucucugaccuugugggggcgggugcuugccugcugcccacgugaggaggugcaaggcagcugcugagucagcagcuguuggccccuagccaccaucugcugccagaauuugggggcaugaagcaguuaccccaugacuggacuguggggcugcaagguuggccccuucucuuccccauuucucuuuaugagcccuuacgugugagaccaucuguccuuugggcuggacgccuguugcuggagagucuggagcccgagguugugccccugugggaccuccacaguucccaucccccuuuacaccagugaaucagacugucccugccccauguagggaguuguuucucaucaccucaaucauaguccugcccccgcucuauagacagaagcugaccuugccuaaggagaugcuggcaggcugcggggccggcaccugccaggugauugugaccacccccauggagaugcugaagauccaguugcaagaugcaggccgcauugguaaggugcagggaggggacagagccuggguggggacaacagcuagacccuguccccugccccuuccccaagccaggaggaagagaccagagauccuuucucaccagcugcucagaggaagauucuggcugcccaggcucagcucucagcccagggaggugcccagcccucgguagaggcuccagccccuccucggcccacggccacccagcugacccgugaccugcugcggaaucauggcauugcuggccucuacaagggacugggggccacgcuacucagguggagagacgggcguauggggggaggaggucugccugcugguuccuccccucccaccagcaucacucuucccuccccacagggauguucccuucuccauugucuacuucccccuguuugccaaccugaaucagcugggccgcccauccucugaggagaagucgccuuucuauguguccuuccuagcaggcugcguggcugggagugcagccgcuguggccgucaacccuugugauggucaguacuugggugugggccccaccgguggauggugggauaggagcccccacggugacucauaugucccuuguaguggugaagacucggcuccagucccuugagagagguguuaaugaggacacuuacucuggguuucuggacugugcaaggugggccaggucccaugagcugggacagggcugggacggggcugggauggggcuggucgggcaccauuucugaccuuuuccucccuuucaggaagaucuggagacaugaaggucccucagccuuccugaaaggcgcauacugccgugcgcuggucauugccccgcuguuuggcaucgcccagguggucuacuuucugggcauugccgagucccugcuggggcugcugcaagaaccccaggccugagcccauggcugcuucucuccagccuaugggcaggggccagaacagggugaccagcacaagccugaggaggaguggucucuccccgguccuccucauuaagaugggaaggcaaggggagggugcaggguccacaugggugaugcacacauaagccccugugugguccugaagggacaacaaauugggaucaaggucuuauuuauguagaaaaugcagaaaucuguacauuccucaagccaguucugucccauccuuguaccucaacccagucccaccuggccugaacaccccaugagacagagcuggucucugggcuggggcccccaggccugguuugggcaggcagacccuacccuguaguccacuggcucuggucucugaggcucuccuggucuacauaggggacccacacacacccagaauuauuuauugaauuuuccgugcccauguggcucuccuguccuccguccaucagucuuugccccugcugcucuucccaccucauccaggaccccacucugccuccccagccagccuuacaggaggccuggagggucuuagccucaugucaagcuaggauuccuaggcuggguauguugccguaaucaggugucaucccaggcaccccacacauccacuucccgcugagccuuuggacccccaccaugugggacccagguugcuugaggucuuugugugccugcggugggcaguugcucccccacccccagcagucagcuggccaggcugcuuagggauggggacccauaaggguacagcugccuuuucccguggagucagccacccugugcuugugugcuguuugugccucaggacucuucugcugaccccguccaauaauuuaguucuccagcuuggugacucuucugauagagcccuacuccuggacagagauugcuuuugggagguggagugggggcuugaaggucaggcaugaaggccaguuuagcgucugggccucccagcucucugggccucuguccauguuuggaaagccccaccccuacagcccuggauccucuguucagaaucaaagcagcccuucccugccccggccaugugauuguguuuggugauugacugaagugcuggugcugugucccucaagcccaacccccuccauggaggccccuucccagugacacuaccuggggcuccagucugggcugccccuaguucaccguugcuccugggagccaccccuccucuuacgucuguaccuugaaagcugcugcugcugcuuacagaauuauauuuuuuucuuuugaagaguuuuaagaaguuguaacuuuuugugucuugucauguaaaaaauaaauaaauauucuaaauagaugcuugcuuua

SEQ ID NO: 4197 - RNA, 5556 nt, Mus musculus
cugccucccggcacagcgucuccgccuccgccggcggagaccccaagguaucgagacugcgggacccacugcccgcaggacaucgagucacgauguucccgagggagaccaaguggaacaucucauucgcuggcugcggcuuccucggggucuaccacauuggcguggccuccugccuccgugagcacgcgcccuuccugguggccaacgccacucacaucuacggagccucggcaggggcgcucaccgccacagcgcuggucacuggggccugccugggugagccgagcugcgcggaaguugggcaggaugggguggggaccgcgcaggccgguggaugcucuagcgucccacgccuagccggcguagggaagcuguuccaguaacuaguuagugcaguagaagcgguagagagggacaucucugccuguauuccggaacuaugaccgaaaguccaguucugagcuccgguccggggcggguucugguuuguuuuuguucugguuuguuuuuguucuaagagugucuagggacugggguggggccuggcgcgcucuuggcucauggcauucucuuggugcccauguagcccgccuuaaggggcacaaagguuggagaccagcaggugccacucgacuguuauuggaaagagaaaguaaaucgugggcggagcuaugagcgagggagagaggaggggcauuggucuccccgaacuggcugccagcggucacuguguccugaggcucugccgcuacaaacugcugugacucuggggccuaguacaaggauuccucaaaugggcaucuggacacugugucaugguuccuaaaggggaccucugaacgcagcuggagccagggcugggcauaauugcuugcucgguccauggugauugacagcuguagccagcugacccacuucaccggguggccacacuucugugcuuugaaggguuucgggaguacagagaugggaaggggggcugggucucacacuuccggcuaccacguggguuguuguuuacagcacacaaaguucuuccuccuuaggaguccugggaagugcugcccauccccccgucccauaggucaggcaaggugacaagggcaucggcaggagauugucuaggguuuucugcggucucuuucccaucaccuuugcccugaggagggaagaggagaaggaauacaguucuaguucuuggucccugaaguucacccugugaucuugcccgcuggcucucaugggggcuuucagaggaguggguauaguggguagguggucucaggacagacaugaggaccauaccugaauugagaaugaguuagggaugccacucccacagaaccacuuacuaccaauacuuugcacaggugaucuugagcagcuagaacaaugacagguugccuacugucugcuguaaaccccuggucuuuaugucccaugccugccaaggugagcaucuuggaggagggcauggguccucaggggggaaaacaaacaaacccuagauucuccucucucuggccaccguacuauuguucugggucaucaucaagggccuccuaagugucagagugcuugcauuuggcagaagugagaccaugucuucccaggaagugggcccuccgcuguaagcuacuguucuugagggugcaccucuugggcugagcugggcuucgugggucugcccacccacuuagaucuggccaaguaggugaugguugaaguaggucagaguugacccuccgucuucccaugcuaggccacgugccauaccauguuaggcacagugacucauggggacaggcaguugggaaauaccaggcacagggcagguuuuaaucgcagcuggccagcuccugcuguacgccaucuccagggugguggucugccuucuucuuuaaguggcaaagucccaauugugagccagcccccagugugggcauaggugucuucacagucaauggaaugucauccaucugaguauauccuggguguggaguccuggaggacagaugguuacuaagcugggaaugcugggaaugcugucccugaucccggcccugcucucccaggugaagcaggugccaacauuauugagguguccaaggaggcccggaagcgguuccuggguccucugcaucccuccuucaaccuggugaagaccauccguggcugucuacuaaagacccugccugcugauugccaugagcgcgccaauggacgccugggcaucucccugacucguguuucagacggagagaacgucaucauaucccacuuuagcuccaaggaugagcucauccagguaggcacugcagacaccguguuggcggcggcagggaguuaacucaaggcagagccuugucuacuacccugugucuuguucuucaggccaaugucugcagcacauuuaucccgguguacuguggccucauuccuccuacccuccaaggggugguaaguaucucugcuuggcccugcccuggaacgagaagcaucauguacugucucugggcugcaggaaaaggggguggaggagaaaggccacuggggugccucucuccaucuucagucccucacugccuguugcuugacuucucaugacucaagauucaggggagucuuggggaggcucagauuuccucuggcuggugcccaucucaacuccaucugucuggccauuugcugaggaguccccaguggccaauacguagugggccaaaggcucaaguggaaccgaguagggcugccaggacacccugcagccccucagugugugacuaugaauguguguucuugcaaagcgcuauguggauggcggcauuucagacaacuugccacuuuaugagcugaagaauaccaucacaguguccccauucucaggcgagagugacaucugcccucaggacagcuccaccaacauccacgagcuucgcgucaccaacaccagcauccaguucaaccuucgcaaucucuaccgccucucgaaggcucucuucccgccagagcccauggugagcccgcacacacccaguccugacuaagccagcaccaggggagagaacccuggggaccucugagcccugggaugacaguggggcuuuuggaugcuuuccaagguuggcaggacuucaagccagggcagguuguugguggaaguggcaguuacagggacucuacagcaguaauucaaccgcaccauucacacugauuuauaccuccgccacagguccuccgagagaugugcaaacagggcuacagagauggacuucgauuccuuaggaggaauggugugugggcagcccugggguggaagaagcuggaccugcagugcccccugcuggccauaaccucugauggcaucucucugaccccccccccccccccacaggccuacugaaccaacccaacccuuugcuggcacugcccccaguugucccccaggaagaggaugcagaggaagcugcugugguggaggagagggcuggagaggaggaucaauugcagccuuauagaaaagaucgaauucuagagcaccugccugccagacucaaugagggugcgccgccacggggagggaagcucaguuaggaggccuaggaggcccccacuucccugauugacugccaccuuccucucugcagcccugcuggaggccuguguggaaccaaaggaccugaugaccacccuuuccaacaugcuaccagugcgccuggcaacggccaugauggugcccuauacucugccgcuggagagugcaguguccuucaccauccggugaggguggggaacggagucugggggaggacacaucaaccgguacaucagggacagaggucccggaucauccaugagcaaugggcuccuugggagauuuggggaggauaggucuucagaaccuggcaagggagcaccagaucccagccugguguuucugagcucaugcucucggugcucccuucucagcuuguuggaguggcugccugaugucccugaagauauccgguggaugaaagagcagacggguagcaucugccaguaucuggugaugagggccaagaggaaauugggugaccaucugccuuccaggugagcugcucugaccgccuggcccccuggguccugagucuuggaauggcagaucuccacuaagccuuccuuuccuccaugucuccuccccaccugcagacugucugagcagguggaacugcgacgugcccagucucugcccucugugccacugucuugcgccaccuacagugaggcccuacccaacuggguacgaaacaaccucucacugggggacgcgcuggccaagugggaagaaugccagcgucagcuacugcugggucucuucugcaccaauguggccuucccgccggaugccuugcgcaugcgcgcaccugccagccccacugccgcagauccugccaccccacaggauccaccuggccucccgccuugcugagaaucaccauucccacaucgcccggcuaccagccaagcuccaaguuguccugccccacuaagaggagccccgggguggaacaagauccugucugccccggcucucccccuuacaugcuguggaaugaggacauaggacccugcacagcugcaagugggcuuucgaugugaaaccuuucaccagccacucacuaugcuacuccugguggggagggauggggagucgcccucccccggagcccacagagcccucccccgucacgucaccugugccuuacuccugcccaccaccuuuucagugcagggucagucuuaagaacuccacaucugcugcugcucccugguguccaaguuuccuugcagagugugugaagaauuauuuauuuuugccaaagcagaucuaauaaaagccacagcucagcuucugccuuccucacuucugcauguuacccuugccuccgacuguggucagcagacagagcuuucucccagugaacuggugucucaguagcuaacaguugggcuucacgggguucucugaguccuggcagcuggggaccgucuccuaaggucaguccucuggcaaggacacauguaagcugcucuguucucucugaggcuugcugccugucucuugggccagcagauauguuugggaguuugagccccuuaguaucgauaaaaaaacuaaagugguggguuagaguugcucagccguugaacagcugucuaauaugcaccagguccggauuccaucucaagcacuagggggaaaauguuuacaaaaggugucacccacacauccgcuccucaugugacacagcgagugagggcguggaucccugugaagggcgaagcuucuggaacugcggucuggggacccgggaagauugguuccugacccauacuggggcaucuugcccagaacuuugugcuuggcuccucuuucuugguugucacaugcuccacugccaggugcauaugcccuuuccuguacuguaaccauaccugcuucccgccagaaccuugggagagaucagaaguacugaggcaaaguagaguucaccaugguuuccugaagua

SEQ ID NO: 4198 - RNA, 10412 nt, Mus musculus
gguccugucccauacagcaagccuguugugguucugcuugagacgcacagggcccccagcgccucugcagccugugauagccaggccagcuuuucaggucaguuugggggcuugguugggggcauacucuuggaaauagauggguuuccucuuaaguaggacuuuggcagcaucuucagaaguuccucuaggcccagagaagcccccgauuaggacugugccccaugaggagugcugagggcagacugagguggucucgcccggucccauacucacuucccccacacaggagagcugcuaacuuauaugucauucucuaguauuaaaacuuagaagacucuaaauugggaaaguaaagaaaagaaagucuaguguccacagcccuggauacagccacugaaaguauuugguuuauuuccugcuccgcauuuuccuacacaacacuucuuggcacccuaagucuggauacuccgggcgggguggggguuggcaucugcaccuccccagccuugauuuuguucuaaaagggucuuggggggagcuggggagauggugggagugagggauacaacuuugcugcccccuguggcucuccggggagagcuagccacucugggucgggucaccaggauaagagaggcgggacaaaacuacagcagcgcucugguggaggauccacccggacgugcuaucccggggucuccgggccuguaaggccgcaaggucgcucuggguacgcgccccucgcgggcuaucgggguccaggcaggggcggggcgcgccgcgcgcguuuccgggaggagcggcccgccugcggcaggugcggcggcgcggcucgcagguaggcauuuauuugcucgcaggucccgcgacuggggucccagcgccgcgcccucugggcuuccccacccccaaccccgggccccuagcuccaguggucgcaccuuccgagcgcuguguagagcagccaucgcacgcaucucugucuggaacggcuguguuccucgggugaaggcagcuagcccagacgugcguggaugagauuugccugugggcccacccgcugccuuucgucuggacucccuggagccuggcggcagcgcggcuuccggccaggauggaccuccggucccgaggaacacuggagcgguuggugggguggugaccgugccugguugaagugaggguagccaucaggggugccaaugauuacuccagguugcccuaccaugcucuuccucacguuugcuuguuguuccuccucccaccccccgaauauggguagggggaagaugaccucaaagacugaaaagugagauaggaaucggucagugucaccgaguuguagcuuugggaaaugugggguuaauacacugugggacugacagguggcucuaauuagaggugggauguccauuccaggaggugagaggggaggccccaggggaggagaaagcugcagagacuguguuaaaccaagauguggggguguuucuuaaaagcuguccagugcccaagccugggaccuugcaccugcacccuuaaggccugccugaguggcaggugggagggacugauggaguuuacucgcagcuugcuugccagcugucagaaguccaggguaucacaggcucaggccugaggcuaaggacuuggucuuggucagaagugguuuagcucucaaccuuaggcaguccuagcuugggaucucccaaguccaggauguggcagacucuacucucuguucacuacagaaucucugcuggcugccaagagcuuuuacuguuggaguaaggucacacuuuuuuuuuuuuuuuuuuuuuggagacagggucucacuauauggcccugacuguccuggaacccacuuuguagaccugacuggccuuaaaacucacagagacccaccugccucugucuccugaguguugggacuaaaggcaugcaccacuaacgccuggucacacuuucuuuuuuuguuuugagguagaaucucucuauguagcuccggaugucuuggaacuugcuauguagaccggccuggccccaaacucacagacagagaucugccuaccucugccucccgagugcugggauuaaauauuaaauauuaaauaugugugccaccauacccagcucacuucccuuucuugcacuggcuucuuccugggauucagccuuucccagaaucucuacuuccugagaagcagcucugguacugggucugcuucaugccaucgcagugacccuggagcgucccugucucagcugagcuuuccuuugcuucacagcaccuccaagagccaaggcucgcuccuauggccagcccugggcugccuggaucuggggagggccaggagggagaggagacaacaggggucucggcaaggcauggaguagaggugcugcagcaggcccaggaacucuuccuacuaugcgacaaggaugccaagggcuucaucacucgucaggaucugcaggugagccccagauccaagagguugcuagacccaaggccgaccuuugcugcucaccgugguccuucuugccuggucagggucugcagagugaucuuccacuuacgccugaacagcuggaggcuguauuugaaagucuggaccaggcccacacuggcuuccucacagcccgggaguucugucuaggccugggugagcaggucccagucaccuggagacccucuucagggugcccugagaccuuaugaaagccugugccuuucauucacaacuuccuagccauucugguaucuacaaacaggcgcauucugagcuguaccucccacagcuacucuacaguggaugggcugcccucccccaaucccuucucugccaaccaagguggggcgggggagcuggcugucauuucccauucccaggccaauagaaccagaacaaggaagaaaaacaggaaacugggcccugagagugggcaggauauguuguauguggcuggagggaguuggguagguccagggugcuaacccacaacccugauauucucuccucccaugucugcagggaaguuuguggggguggagucggccccaggugggucccccuugaggacuucugaggaaaccuuugagucgggcacagggggcucucuggaggaggaggaggaggauguugagacauucuacacuuccuuggagaagcuaggaguggcccggguccugggcgagugaguugaaccccacucucuuuuugagaauguuuccucuucuuuucacagucuguccaccuugcccaccugucuguuguuacagaaccccuagguccugucaguccaucccuugucuguugugguugucugggagaguggccuggcgugauuuuccucggaauuugcauuucaggaagccuuagcucugcggggcggggugccaccagacaccuuaggcacgcacuggcccagcacuugguauacagggcaccuuacacuugcagaggccaaggaagcauaagagcaccaagcgagggguguaguucugggcugcuggguucuccauggguuuguuucacuguccgcaauggggagauaaacccucacccaccagcucccgucucugaucgcauccuccaggcaaugggcugugagaacccucugggucgggcugcagcgcgagcgaccugagcuguugggcucucuagaggaaguucugaugcgcgcaucggccugccuggaggcggcggcccgggaacgcgaaggucuugagcaagcgcugcgacggugagggcuggccuagccuggggucuggggacucacggagggggcagagacuuggcucggaaaugaucaugucuaugauaucccgguuccucgaaggcgggagagugaacacgagagggaggugcgcggacuguaugaagaacuggagcagcagcucggggagcagcgacaccgcaggcagagccaggugggcccgcgcacgccucgcccagccuugcugcucgccucucuggcuccgccuuccccgaauugguuccuccccagaggacucaccucugggaguccaagcugccccaaguccagggaacucugcucugccucagcaagugccccuucccgcacucuccaccccuucgcuacccacccuugccugccuccuuugagcccggaacgaaggcucuagcgcggcuguacaucccagaaccuaccccgggaggaacagaggggccaccuggagcuggagcugcagacccgugagcaggaguuggagcgcgcaggccugaggcagcgggagguaagccguauugaguucaaguugguguccucgcaugggggggggggggggcgggcggguuuaucugugccuugggguccucaaccaggagccacaggggugaggggucagcuugggaccagagggguguggcaugccaaccagcauuccaccauuccccagcuggaacagcagcugcaggcccgggcugcagaacagcuagaggcacaggcccagcacauccagcugcagagggccuaugaggccauacgggcacagcuggaccaggcccaagagcagcucagucgacuggagggcgaagcacagggucggcaggagcaaacccaaagguguggugaagugccuguggugaggguagaagggucuguccccccaacccacaucuggaucacagccuuccuguccacagagaugugguugcugucuccaggaauaugcagaaagagaaacucagccuccuaaggcagcuggagcugcugaggugggucaggccugccugggcuaaugggaagugguuucaaguuuccagauaguauuggcuccuacccauguugcuggaaguccuuaugucugcccuauagccuucaugcggcuggcucuguaguccucuugacucagggaaggcaucucccccaugcacuuuuuccucuagaucuuagccuccucggucuccuaccucucuuuucuagggagcugaaucugaggcuucgagaugagagagaugccugugagaccaagcugcugggcaguagccacaggaaggcucuagcuauugcccacaagcccggacccaucuacugcugcugcugcuguggcugggcucggccccccagacgaggcucuggccaucuuccuagugcccgaugaccagccccgagugacucacuucccuauccagaggacugccccuaggagggacuggucuugguggcggauacuugcuaaguguguggcucuacccagaaggcaucccaugccugaaggagcuaaccucagaguagucaaggccuucaguccuucagucuuuauccugucuuccuuuuuuuuggggggggggguuucgagacaggguuucucuguguagcccuggcuguccuggaacucauucuguagaccaggcuguccucgaacucagaaauccgccugccucugccucccgagugcugggauuaaaggcgcgugugccaccacgcccggcuauccugucuuccuuaaucuuugucugaaggaccaauaaaggccauuguauacuguguacuccuuggcucuuguguguuugggagccacggugcauuugugguucaugcuugguauccauggcacaaggugacauggagggguuuacaggugcacauuaaccccuucguuccugcagcuggggguuccugugugcuuguguguguucugugauucuggauauucaccaagcccucacccauuccucccagcugaagcucccaggacucagguuucaacagguguccgcucccacgcuaguccacacguggaaggucccgcuccucaccuccguggucagcuagcuuucugguccagguccuuuauccaucauccuuuggcacaguuccuagccagaccauaugccacccacacugggcaccucucgcagggcccucaugucucuauggaaucuucuggcacccuccacacuguaucuggaguuuccccucuagcauuucuucagccgcuagaaccugcagcuuuagagugguucucccggcuuagacuagagaaacuggucuugaccucaguucuggaccucuggugggcuaggugccaccuuccccaccucuucgcuccccaccuggguucuaccucuggucuagcuccucugucucugggcgaguuggggcuuuugaugacaaacggggcaccuuuaaacuaacuuuacagacccacaggucucucuggcgcgcgccuuagcaccaaaccaguuaggacuugccugcccaggccggccgugggcggggcugcgcccggggcggggucgcgcgcagggcguguccucgcaggccccgggccgagcguucucuguacuccgagugaucgcuccuaccguggcugccggggcugguauuucaaagcgugguuggugagugcuccgugaagcauagccggaggguguggggagcaguguccugaguuccucgcucacugguguuccuagucuccaagcuggccucagggacgcccaggaggcagagccugagguaggacaggguugcagacuccuuuccggaagaucgacgccggggccgggcaguuagaaggccggagggggaggggugagggagagagcuucugugguucuugagcaggccugacggucucuuucgugcagaaacccagaaauuuaaaagucugaccacccuauucauugucccuggacaccgguucccuccccugagaccgcagguccgcccacuggcacggggcgggggagggcggcaggggcgguggugacuucaucucugugacgcggggauuccucgcccagcccacuucaguguuuaaucgggucgguggggcgggugccgaaggcccaggacagguccaggagcuaaguguagggcgguuguguccaggccgcaggagcuauuucuggcugguccaggcucucacaccggcacuuucacagagaauuuacauccagucugcugauugucucuuggcuuagguugauggaugugucuaaaagcccauagauucugggcuuuuagagccuggccccggggguuugcauuguggccaggcuucuuuaugucauugcccgcuuucagugaggcagcaugcauuuuugggucccaucuccaaauagagcucugaaaucucucccacuuuccaaaauggacagucgaugcauccuccuucaguuugcggucgcugcuguuuggugggggagggacugugauggaugggacuggaagguggggcacuuggagaaggcauuuggucccucccuagaucaggcaggucagccauguucuuuggccugccgccguccaguagaaaacagcaggccugccuguuaugcuuccuugcagaucugguggcucugagaaccauuuugaccacugcuuaagcuucuguaguuggaguggcaagaucccaccugcuaggugaagggcagagagugacuuuugaccuguaccugcugguccugacuugagaggugagagcuggugccugggcagagccucaaggccccuggcuaacaguucugcuuaggugugugucugggaaucugaccugcgucagccgaggucuguacacuguccucagucagacaauagugugucuagggcagggugugacuaggggacuccuggaggaguggcacauucacauauguggaacugggaccucccccuacagucgggaggagagcugguuguacaggcuccaccuaccggcaucuuauugucucugcccuggcugguaguagagucagcucagaguccucacaaacugucccuuaggguggccugagcucucugccauaucugggaacggguaugagugguaaguaccuagcagccugauugugggacucagggaaugcuugggggugccgaucaacaggaauguacccugaaggucugcuggugcuucccccccuguugccagcaggagugagucagcagauguugggggguccuccaugauaacccaccaugugucuggcugugaggagguuaguucaggaagugacucauaagguuccugggaaugcuccucugagggcagauagcuggcugagcuccaaacugcaaucauccggggacugcuggaucuccuccugucuccguugguagauagcuuucuuccuacuuggaggccuggugcuucaggccaucugaccuccuccccguuccucuaggcccaggaugggugaauucaaugagaagaaggcaacauguggcacagucugccucaaguaccugcucuuuaccuacaacugcugcuucugggugagaagagcuaauuucucccugcaucccuaguccccauguuggaggccuggccuggggggcucagucccagcuuccagacccaggccagauguggugaccaguauauacuuucugcagcuggccggccuggcugucauggcagugggcaucuggacacuggcccucaagagugacuacauuagucugcuggccucaagcacuuaccuagccacggccuacaucuuagugguggcugguguuguugucauggugacuggaguccugggcugcugugccacuuucaaggagcgacggaaccuguuacgcuuggucaguggggcaugguggcacacgguggggcuaggggugccuugcauggauuucucagggggccucugguacugguucuggggacuuaacugguugaguguauuacugcaggcugucccuguuggggcagacacgagcuucagaacuaugaaggagcuaggcagccccagaguguagcuccuaacugaauuccucuugcuuggccuccuggguugggggcuuggcuuugugguacucuggcacuagcaaccccccacuuacugggucccugcucccuaguacuucauccugcuccucaucaucuuccuccuggagaucauugcuggcauccuggccuaugucuauuaucagcagguaagggccuggacaggccauggggugugccuagaacauggcccugucagucccauuggagguccuggcuccagcuuugccuuugcccagaguuugauccuacccacagcugaacacagagcucaaggagaaucugaaggacaccauggucaagagauaccaccagucaggccacgagggugugagcagcgcugucgacaagcugcagcaagaggugggugccccuagaacugcccgcccucucggcauggugccgugugccggcaagcgcugaggcucagccaugugccccuuguaguuccacuguuguggcagcaacaacucucaagacuggcaagacagcgaguggauccgcucuggugaggcagacagccgcgugguuccugacagcugcuguaagacuaugguagcuggcugugguaagcgggaccaugccuccaacaucuauaaaguggagguagguggguucucagcaaggggcggggcuaggccggacuggucuucaggcagccuggcccaccacccuucucucccacuaggguggcuguaucacuaagcuggagaccuucauucaggagcaccugcgggucauuggggcggugggcauuggcaucgccugugugcaggucuucggcaugaucuucaccugcugcuuguaccgaagccucaagcuggaacacuacugaccacgaugaugucaggccgggcggccagccuugcacuacugaccacgaugaugccaggcugggcggccagccuugcacuaugucccagccccacuacugaacacuacugacuuagacugcugacugccagagguagcuacccucaugccaucgccaugacccccccuggcaugccaccucaggggcaugcaccuucaagugccuuucacugcacaccaaagucccaaagcucgaagcagcguacuugccccagcauuaagaaggggggggggggugggggguucaaaugccaguguugggcuaggccuggcuaguagaauaggguuuagauuauuugacagaagugccucuuaugcagacugcuucccuuuggguagcugugaucugcaguaagucuggggagaaccugaguacaccacuacacguuggguaaaagcagguggggccuuucugguuggauuaggcacccuucaugccugcuaccaggaacucucagaucugcuugccccaaacaaaugguguaagcugagggaaacuccaaccccacacuugaugcucuguccucuccacacaggccucuugcuccuaacagcucagcccuggccuuuucucacuacugauagcaucauguaaaugcuccauguuccuguacacugucuccuuuuggagcaucucugaauggagcauggcuguuuucaucucacugcuguauuccagaugcugcccacaaaugcuccugcuauguaacaggugcucaauaaauguaaauguauaagcacucgaaucagcuugcugacaggaccuuau

SEQ ID NO: 4199 - RNA, 46978 nt, Mus musculus
uguggaggccagugggcgggacuuccgguugauuaaaucgucuuccggccgugcuugaugggucuggccggucuccugacaugaaggugagcccggcuguggcggcaaugggacugcuucaucuuccgcgucacaaugcgggaacgucgggcagcgaggcucuccccggacagaacgggcagagugugagcgggaaggagagggcacggaugagagcaauaugggagcuaugaaugugagggcgaggaagugagugaggaugagaggguuugagggggagagcgaucgugucagugugagaagaaacagaugugagggugagugggagcucgugcggaauaagcagaugugagggugagcugguggaagaaacagaugugagggugaguaggugucagaaagcaggugugucagccugagaguaagggcguaugugagagagcgagcgggugugagggcccgaaugggugaggggagaugugagaacauggacuuuauuaggggugagaaagcgaguggggaugaguaugagcaagggugagagaguguuagggugagagcagguaugggagagagugugacauuguucuuuaguagaagugugagcgccaagugugugacugugaggaagcuuucgagccaacaguaaucugagaauaugagcgagcacaggccguugcauaaaaucaagagagcccguagcgauggcuuuaauccuagcacccgggaggcaaaggcuggcagauggaucucugugaguccgaggccacccuggucuauagagugaguuucaggucagccagggccacauagcaagacccugucuccaaaaaagaguuuggggguggggcaaaagaagccgcaggaagcacgugugaacagcacaguagugaauguguuaaguuuauguaugugccaguguagcuggauaugaagaaacaugggugagugguguauaaaggaguauaaacaugaaccaggauguaagauaacgaagucagagauuucagauaugugaguuagugugcauagcuuguggagccacaaaugaacgaacgaugacaugagugugcaaacgaguuagcaaggccagaguggcugucgggcauagagaaugagcucuauguggagggcccagccucagguaggaggguauacagcaaguuguauggguuccuucaaguuugcuagguacaugaggccuuacccucagcgcagccucaaaucuugaacacucugugauggaaaauuuccaaagaacuuuccacagaucucuagacuggagcccagggaggcccagagacagugugcuggugacagaacuauaacuugagccaucuuaucacaguccuguuugcauugcauuguauaguugggaugggaugguagccacgugccccauggcuuggugggcugcccccuguguugguuuccuuaucuguaaaugggaauaacauuuaugccugccugaguccuggucuguggagagaacuuguggauaauucaccagguuuggcaugcaacauauggucaauaaaugucaccugggguugugaucauccugcuucuuacgucaccuucauuuccaaccauacacucacccaccuccucauaugaacaguucacuccaaaauguguucucaaaaaugaaaauguaggcugaccaucauacuugcuguaagagcagugaaucuauuagaacugaaggcugaaaguauggcccaguauuuucuuaguauauggaaagccaugaguucuaauucccugcuccuacaaaaccgauauuaggcagcaauaguaaaaggugcucaggauacaucaaucggcaucccacaaauccugcaauaccaaagcaggagcuuagugugagagccaaagaccaucucuguuguuauuguuguuuugagauagggucuccuguagcccagcauggccuugaacucaacuacaucgcuagaaauguacaacuacauaacugagaaaugaccuugaacucuuaauuuaccuacuucuaccuuccaagugcugggaucacaaaugugauccacuaugccccauuuaaaacuuguucuuuuaauuuuuaaaaaauuguuuuuuauuuuauguucacugguguuuugcucaaaaguaugucuaugugaaggugucaucuccuggaacuggaguuguagacaguauguuacacacauaaaugaccuugaacuccaguccucuggaagaauaaucacucuuaaucacugagcgaucucuccagagucccucguccccauuuaauguuuucaccaacuuauuuuuauauguaugugguuuuugccugaauguauuuaugugcucacagaagccagaagaggguggugagcugccauguaagugcuaggaguuaaacccagauccucuggaaaaguagccagugcucuuaaccgaugaccaucccuuuggcccccacaguuaauucuuguuuuuuuuuuuuuguuguuguuguuguuuuuguuuuuuguuuuuuguuuuuuguuuucuucgaggcagaguuucucuguauagcccuggcuguccuggaacucacuuuguagaccaggcuggccucgaacucagaaauccgccugucucugccucccaagugcuaggauuaaaggcaugggccacuaccgcccggcaguuaguucuugagagagagcugaaguggacagugcaccacaaaauuaacaccaauucgauucuuuaacucugcacaugcacagcagauuguacacauaauuuauacacauuaaugcauuucuuuguaaaaagcaccugacaugucuugcuuugagucugcuugagaaacauuugaaagcuucuccuaugacuugucagccucacuaagacaguccuuccaguggggaaugauuuguaaccccagaguuacgagaaguauagcauguucuccguuguuagcuugguauaagcagaagccaagacucaaguaggccgaauuuauaacauuccacccuguguacagggugugcugcccaaaggacagccauuaaugcuggaagacaaaacacauuuugauguaagaaugcuaugagacccuaggagucugcuaugugaagaacaugacagagaaugugcccuaauggucguuugggcagugggagccauggaaggugcaguagcuuggacacccuuuauaucauuauacaugccucacccuuguauacccuuaguagucuagaaaguugggucaccccaccccuucuuuuuaacaggguuucuuuguguagccuuggcugucuuggaacuugaucuguagacccagccuuggagauccacauuuaugagcgucuaggaacauggugguagcauugauuuuuguucugcuccacuucagacacaacccaacgaaccuaucuuccucuauguguccagagagacccccaccuuuuugguauuuugggguuuuguuucuggguuuuuuugagauaggguuucucuguguaauugcccuggcuguccuggaacucacucuguagaccaggcuggccucaaacucagaaauuugccugccucugccuuccaagagcugggauuaaaggugugugccaccacacccagcuaaaaggauuuauuuuuuuaaagcacgcguauauguuugugucucuguaugagcaucuaaguguagguauuuauagaaauaagaauggagcauuggauccccuggaacugggguuauaggugauugugaguaccuaacgugugcuggcaaccuaucucugguccucuacaagagucguauguacucuuauuugcugagccaucuccucagcacaucccaccucucuuuggucaguggguauuugggguagugcccagggccucaugcguucuagaaaaguggauuacugaaagaaauucccagcccuucccccccaccccuuuuauuuugagaaagggucuugauaaguagcccaggcuggcuuagaacucuguaguacagacagaccuuaaacuucaaguuccacgugggauuauaggccugggcuaccaggcuaggccuuccuucacccuuucugccuguagguauaaagucacaggucagggaauaaggaaguguuuggcagagggacuuuagacuaugugaacagugagcagcugcaagucuaggcaacagauagaucaguagagacucaagaucacaggcaccuggacauacucucaguccuggacaacuuacaucaaguuucuuacuucuuuccuucugugacccaguuuuucacccaagggacagaagccuugcuuauguaggagcuaaggcuaacaacaucccugugagcuaggauaaucauagucccacuggccaggcaagguguggguggguuuuucuggguuacugaucucaaccucauacugugguuaggauuucccauucccuggggguaugggccacauaaucuaagcgucacaauugugagggccaagugguaagcuuggguaaagugagauacagggaguuauuuucucuuauuucucauuuuguuguaggagagaagcugguggggugggagacuagggugagagaguccuggaucuuacuccucuaaccagccagcuuuuauaacaaucacugccuuugcuggaggcaucaaccauccagcauuauuuuauauauaguuuuuuuaaguucucagagccucaagucuaggcuuucuuguggucugcccaucuucuaguagaaucuuccuggcuugccuuacucaaagaccacuuguuagucauagcuucauacauguguguugguguucuggagugucaaaacuuggaggcuuauugccacaaucccagcuuuccucaggucgcaccaggagcagcgucagggaagugacagcaaaaggaaacaggaggccaugggaacaggcaguggggcaucaggguggaccugccucuaugcugcagcuaauggcucauacccugccuggcugggcuuucuggaggcuuucagcguaggcucuggcaucccuaggugcucuugaccacaggggaaagcuuuauugcucaucuguugggcaguggucugggucagccuccacagaauguuccugggcuuuugcagcucccucacuugaucuaguagacuauguguuacgagggacacgaaacuagguggauacacuucugcacaccuuaucuugaagucccauugagggaaugacagcccaccugggcagugucuauccagaauuuccuaagaucuaaaagugaauuaugcaacuaaaaagaaaugaccaauaguucccuaucugcuucugguuuugcuccuuagauacuuuccugugugaacauaugggcauaaaaacaaggcuguuaggcuuaggaggcugcagcaggaggaucuugaguuggaggccagcugagauguuccuagcacgauccugucucaaacaaacgaaaaccgacucuucugcggaaaugcaguugugugguguuuuuuaccuugguugcagacaccuccaugcuugucuguguuccaguaucagaagugcccagucccuaagcucaguuccugugugugggacauccuugaaguggaacuuguaauaggaaggaaguguaugguggacacuguguuuauggccacauugucauucaaaaaaaaaaaaaaaaaaaacccuuucccagcuggaauucccacuuagcccaagaguuaguuuucccaguuaacccuucacacacugauuggagacaccaucgucuguguuugcuucuuucauuucuggggcucuaaguaucucaguauuugaaaccuguucuuguuuuuauaguggggucuuguuuccugggaugucuuuguuuauuuguuugcuuauuuauuuuugagacggaguuucacguggcaggcuggcuuccauauccacauguggccuugggacuccugauccucuugccucuaacuacaucaaguucugggucacagacaugugccaccacaccuggcuuuuuuuauuuguacuguuucuuugaacauuguggauaggaauuugucaaaugugucccaaguuaaguuuuucugacuaacuugucuuuaaauuugccuuuuaucuccuaaauaaacauuuuacuuuaaauauuuuuaaaauuugaaacagagucuugcuauguugccucagcucuaagcuccuugggaucaagugagcuuuuuguuccagucucuccagcagcuaagguuauaagcacuuaacacaguacccaacuuugaaaguuacacauuuuaaaauuuuuauuucuuuuuauuucaugugcauugguguuuugacugcagguaugucugugugagggugucagaucucuuggaacugguuuaacagcuaugagcugccguguggguucuaggaauugaaccugggaccucuggaagagaaggcaauccucuuaaccucugggcuaacuuuccagccucaaaaaguuaaacauguuuaaauauuaaacuuugauaauacucucuuuuuuauucucuccuuauugauauacuugaaaaagacuuuucuacccugggauuacauaaauaguugcccaucguauguuugaguaccuucuguggcuucauuauuuuacacuucagccccauuguugcugagguuucuuuuguuuugaggggaaugugggagccaauuuuccuagauggauggcugcuuauggucggaaggauaucuuuggacugccuuugguugucugaggggaccuggugauccaggcagagaagccuagaagugauagagauuugacuucaguaaccagggcuggccuaagggcccuaaggacucaagcccuauuagcauaaauauacuugucugguucaugccacacgucugugcuaaucaucugccuucguguaugucuuucuuucugcagccccccuaggcccagagguugguuccugcugugacaugccugccauguggccacuucuucauguccucuggcuugcucuggucuguggcucuguucacaccacccugucaaagucagaugccaaaaaagcugccucaaagaugcugcuggaaaagguagggaacucaaggugaccacagaggccacaacuuaaccuguccuuucuggcuaggaucuuugugagucagaacauaggaggggcuuggcuccuuacacaguuuucuuuuuacuuacuuauuaauuaauuaauugaauguauguacacuguagcugucuucagacacaccaggaagagggcaucagaucccauuacagaugguuaugagcuaccaugugguugcugggaauuaaacucaggaccucuggaagaguagucagugcucuuaaccacugagccaucucaccagcccucuuauacagcuuucugagaagcuagcggugucucagcaggcagccuguguggcucuggagauggaucuugcuaaaacuguggguuuacagccauuaccuucccugcucagacucuguguccugugacaauuuccaucuaucugccuuuccuaucccaugguuguugaauucucucaucuuuacagcccaacuuguguuuucaucagagcccuuguucuguucuuuugggauauucccagggauugcaaacccaagguuagguccccauccagcuuacuccuuaggcccaacaguccccauacugcugggcaggcugcugacuuagaaccauaccuauaacucagaucuggacuuagagaugcucuguuccuuggggcagagaacccauacagugggcaucucuguaugugcuaggugguuuuaugucaauuugacacaagcuaaagucaucugacaggagggaaucaauuaagaaaaugccuccacaccaggaugguggcgguacacaccuuuaaugccagcacuugggaaaaagagguagaaggaucuuuaugaguuugagaucggccuagacuacagagugaguuccagaggcuacacagagaaaccuugucuuuaaaagaaaaaaaaaaaaaaaaaaaagccucuauaaaauggguuguaagcaagcuuguagggcauuuucuuucuuucuuucuuucuuucuuucuuucucucucucucucucucucucucucucucuuucucucuuucucucucucucucucucucucucucucucucuuucugcacaaagucaauucacuguguuuacagcuuuugggaagcuccuugcuccaaaaccuugagcaccugacccugucaaagggccuuuggucacucugcuuggcuauacggcuccuucagugguggccaggcuugcaggcugccuuuguuagaguacacccuuaaguucuucucugggaagagccugcugcugccuaaguaauugccuauuuccgcauuuucuuauuuauuguggauggugccauuccuggguucuauaagaaagcaggcuaaacgcuggagaagguuaagagcacugacugcucuuccagagguucugaguucaauucccagcacccacaugguggcucacagccaucuguaaugggaucugaugccuucuucugaugugucugaaaacaguuauaguguauucauauaccuaaaauuaauuaauuaacuaacuaauuacuuuuaaaaaaagaagcaagaaagcaggcugagcaagccuugaugagcaagccaguaaacagcaccccuccauggcuucugcaucagcuccagccuccagguuccugcccuguuugaguuucugcccugucuuccuucaguggugaacagugauguggaauuguaagccaaauaaacuccuuccuccccaaguugcuuuugguucugauguuucaucacugcaguuagaaacccuaagacagugucucuugagaaaugaccagggaaccaaaugcuaguagggaagucugagccaagcccccaaagaguggacagaacuggugaggugaccugcuggaggucaucuagagcaggucagggagaagcagacauaccagcuuccuggucaggggacucaggguguggcuaguaguauagcauguacuugacauguccucaguguaggaccugggguaccuugacgaguauccaguggugugaguacuaaauaucaaacuucagauguagaaggaaccacuucugucauaucuccagcccaaauuaagggccgaauagccccuggaaaaugcuacugucuuacugggugcuagaacccuucugaaauaaaucaccuacugggcuggagagauggcucagugguuaagagcacugacugcucuuccaaagguccugaguccaaaucccagcaacuacaugguggcucacaaccauccguagugagaucugacgcccucuucugguggauuugaagacagcuacaguguauuuagauauaaugauaaauaaaucuuuaaaaaauaaaauaaaucagcuacuauggccuuaauccucuaccuacaaggguagaucagcagugccauguuaaucuagagacacaguccaucgguggcugaaugaaacagacuugcugcugucacuguugccucgaaugccacauuccgcacugagaagagaggucagauggccuguuucucucccuuugucucagacucaguuuucagauaaaccuguccaagaucggggucugguggugacggacaucaaagcugaggaugugguucuugaacaucguagcuacugcucaucaagggcucgggagagaaacuuugcuggagagguccuaggcuacgucacuccaguaagucaagaguuuuguggugcagaacagggcuguccuuguggcucuuguucugcucuccguggcugcugcuaauaugaaacuguaggagagauacugacaugaagaugucagagggaaggguaccaggguuuucuuggggcuugcuccuuaaugauuucaggcgacccucaucaaugcuuccugauguagaggagagcucuagugcugucuaguucauggugggggcuuguagaacccuggagaagggacaucagccccgaucccaggcaguggacugcagaguggaagagggaagcccaggcaggggacugguggcagcucaaguccagcacugugauacugacgacuguccugggcauguccagagcaucaggugacagcaucacagcagugcaggugacauguauuuacuuguucucugucugcccucuccuuccucugccaguggaacagccauggcuacgauguugccaaggucuuugggagcaaguucacacagaucucaccagucugguugcaacugaagagacguggucgugagauguuugaaauuacaggccuccaugauguggaccaagguuuuuccacuuccuuuuuaucuauacgcccccugagggcugaauaugguagugugagugugucuuugugucugugugugugugugugucugucugucugccuucucccaagugcugacauuaaaggugugagccaccacagcuagccagguuguguauuaugacuaaugaguagcagugugaauguauauaaauauaucaauugugacucuguuaauaggccuguaaucucugcugcucaggaggcuguagcaguagaauuaauuacaagaucaaggucugucugugugugacucuggauaugauuguaggggugugauggugagagauaucacgugugacuagguuuguaacugagugugaauaugauagacauguaguuugcugucucacaccacaccgcugggcucagaguggaucuagguguacagagugugaagaauggccugccagguaaagacagucccuggggcagucaccaccgugaagucugcaaggcuggucagcuacaggggguaagauacuguccuagggaugacagauugaagggcacuggggauuggugccgucuccuuucuuuucugucucuagugccaggagcuguucaacguuccuucucuuuaaugucagggcugcgugugaguggaaggcaggcaggcuccgagagacuugugcaucugggcagugacuggucggcucucccuuuucucucuucccuggugcucugcauuugguguccaaagaagaaaauaggcugggucagggcacgucacugaugacacacacugggacuagauaagcuacagggcugaaccauauuuggccucugacagaauuaacaggguugacuggguuuagaguucugagaccaggaguguucuuucccgaugcugugaagaucugggaaagcugaugggagaagggaccaggacaggaagagggaguggaauauagaguggaagggggauaggaaugacugcaaggucgcccugggccaggagaggagugaggaauggucuggacauaugcccucuacugacugucccuuucaucucugacaggguggaugcgagcugucaagaagcaugccaaaggugugcgcauaggugaguucagcgggccuggggauggucagaagagcagccguagccauaccguguagauguacaacuuugcuguggguagacagguacccuagguccuugcauguuccuuccaaucucagaugugcuacuugaggguauaucucuccccugaaugcucugagcagucaguugaacuuggucaccaacaccucccuccguggcuggugguuuuccugcauacugcucccuuuuccuucuuucuuccugucuugcaagcguuaccgaguuuccuggugccagaccccccuaggcuggaccugagggugauguugccccuacccugccugugccucugaggcucauagcugguaugggaaggaaaaauuucccaagggacagcaggaaccugagggcaacagaggagccuauggagcucaggggaagcuacuggaggcucaaaagcaacgacaagagaggaccuaucauuccacccuugugguacaggaguggaagccaucaggucagauugagauagacaagguaguagcagcaaagauccagaugaacugggggucuagcccagccauuuucccaaaaucugggcccuagggauauuugacaaguuagugucuccuuauuccuuccuuccuucugcuaggcuguguggguauagaaugucugcacugaauagauccaugacugccucgguggccucccugcuggucccugcucaugcagacaagccaugaucuuucuguguguucucuccugccaucagugccucgacuucuguuugaagacuggacuuaugaugauuuccgaaacgucuuagacagugaggaugagauagaagagcucagcaagacuguggcacagguggcaaaggugagaccugugugcuccugaggaccucaaggcucagacagagcuuggagcaccagccaccagacccccucuccucagacaggcuguacagucuacucccaacuuuccuccuugucuugcuuugcuuucuucucugacucaggcucccaaagguccccaccugcagccuucauuuguuucuuuuucaagacaaguuuucucuguguagccuuggcuguccuagaacucgcucuguagaccaggacggcuucaaacucauugagauccaccugccuuugcccucagagugcugggacuaaaagugugugccaccacugccuggcuucuccucuuuuuucuuuaacauuauuuuugugugcauguguguagaggaggaaaugauguaacauguguguagagggcagaggacagcuugcuggaguuauccuuuccuaccaugggaauuccaggaaucaaacucagguuuucaaacuuggcagaaagcccccuuaccuacuaagcuaucucgguggcuuuuuuuauuuaaauuuuuuuugagacacaaucucacaauacccagauugaugucugaauuuauuauguagcugaggcuagacuugaacuucugacccaccagccucuaccucccaagugcugagauuacagguacuaugaccuggcuccucuugcuugacuuuuuucuuggguaucuucuuauucaaaccaugucuuccaggguggauagcauaaaccccacucaggcuguaccaccucuugcugguagcuuugggaguuccagaggugggaaaguuuuuaucucuggggccagaaaacuuccuuuggcuaaaacucuauaacuuccagaggugagaccaucccugcuggccaucaggaugccugggcuacugcagggguggagaagugugggcaacugagcaccucugcccucuggcugcuauggcauacccccucccccugcugccuacuucagaagaacuagugcagacuggagucuugccucauaagugacugggcuacuuugccaugugccgagccagugccgccucuucugucuugcccaauccuccuagauucccauuucuccucaccugcccauuucuuucagaaccagcauuuugacgguuuugugguggaggucuggagccaguugcugagccagaaacaugugugaguggggaugugggcagcugcuuaguucucuuucuggccccuauguuuggagaagccagaggaagaaccaagggagagagaaucugccuggaaaggccuuccuuccccagccucugggcucuggguuggagaugggacccuauaaaagguggaggccuacccagagaagccaugaauagccacagggcagacagcuuguccugaccacaucacugugcuagucuggaggucccucuaggauggcuaaaggaaaugggggauccucacccaggaggacugaaugagagaaggguggcugggucuacgcuauagaugaucagcuuaaacccaaguagauuuccucacugagcacaaaggagacuuccugggacauuaaaaagaggcugauugaguguggccaacaccuggggugugauggucacaauguuucccggggaaggaauguccaagugcauaugagcagucugcugggaggaggccgcagaaggccucaugucuccuugcugccaccgucccagccagcagccaacgcaucugagacucacaggagugagaccaggaaggagggacuugugcaaagugccagcagcucacacagccuaaggcuggcugcugaggaaugagccuuccugaucuuuagcucaggguccugaagcagggaccucugccacauugggaguucuacccuagagaaggugacacaaaaacauuuuucccugcauaggacugacgcugucuggguacacccucaguagagguuuacacaguucauagcagauguuucggauaguagaggcucuggaaucagcuccaucuccuuuucuugcauaaaggaguuuguuuguucuuuuuuagccacagcucagaauuggcuccgccaauucuccugucauuuacugucucagagguuccuccuuccccuuuguuacccuuagagacuuugcuauuugcagagacuguaggccucaacucuguccacuuggaggcagcauccccacacgaaucucuuguagccugugaaggagguucuggugcacucacuguaggggugggaaugaggaagucauuugaugaagggauguucauucugggagccagaggguguaccuagugccaggugugccugggccuugcccuugaugaaagaccccaaucagaggccacaacaggggagaagugugcccgugaguuaguagggaaucuucugccugcaauaccccugaaaggaccacagcucuggucugugaguuaggccagagacugccccagacucuuagccauguuauaucuccagacccagcuuuguguccuugcugggcagagggcccaccaaagcugacugugcugccagacauccuuucuuuuaauucuggagacuacagaucuauuaaucagagauuugcuauaauuuauuuguguuucagcacauuaaguaggcagcgagacacagcugcauugugucuaggcucccaacggaucauuaauaucagauggggaggucuaggggugggaggcucaagagccugcaguaggagacguggcaguaggagcagccuccaugaaccuuugugcucagggaacagugcagagcucuuugcagagcaggaaugggacugaggcauagguaguggccaggcuccugagccccaaaguccaucuaguuuaugauuccuuuggacacugccccaggaggagccugguugcuguaagacacaauagaaauauagaaggagagcacugcucugguugccguucccugccucucaauauuguaaguaucuguguggauuugaagagcuaagucacauguuugacacauacauguuuacccuuagucuaaggugaugguagggcccaugacucuugguuucaggagacagccuuuucuccagcuuucccagaguguaguggaugugucgagggacugugacucaucucucgggacuuuucuucagauugccaugucgaaauauuugcccuuaggcagaagcugcuagucaugguaggagaugcuaugcaggcagccuuuagggccuccuggucuuaggguccuaugagagcaggucccgccaaauauccuggucugcuugggcuccccaucaaaggcucuucuucagggcuuuagccagccuuauucaggauaaauuccauuuacugggcucaucccagcaaacaccacaggucuuguaguaguaaccucucuaaaauguggauggcagcaguggcagggaagugauggcugcuggaaacaguagauuuuuuuggguaaccuuguguaaccuugucccuggaagauacuggucccucaguggaagagagacugcuaaucaagagccuauauucucugcccccauugcugucucaucccaguggcuucuggucacaugcauuggcuacuuggcacaggcuuggagauaugcugccugcaggaucuguuggcuaagucuuuuaugggcuaagucuacugccagucccacuaaaacucugucugggguacucguauagaaucccuaugucuagaguggcuguagugugggcccuugagaggaaugagguaggcgcguacuugucuucugaaagccccuggaaugaucuuagacaucucugaguccuuaggucucauaugcccuggggaaaagaucauccugcugcuguccugcagcccagcagaagggucuuccuuuggugggcuuggcuuuccacauuacuucagcacaugggcagcauucuucugguucaccugcacaagagauguauugccugcaaccugcaaaguguauaccagaccaaagaaggacagacaacugggacuuacugcccuuuagccccucauugcuagaguuguuacacuggaaucccugauacucagguugaaaaguuauagcucaauuugggucacaucaggagagugaagccaaugcuguccagagcuggccacugagaggacucuagacuguccccagagauguacuaggggcaagucuugcagccaguaggguacucagcuuuggcugagcaaauguaggacuugucaaccugucugcagauggagcuguuccugaagguccagguguauagggagggaagacuuucuuuacagcaguagcagagccuccuugagugagcauaacauaacagaccugaccucacagccguugcauugggccaacuccuuaggacggccaccugcagggaaacagcugguguagaacaugcuacgggcaguccacuagagggggaaggggagggcgggcucccaggccauguggggagagaagcugacauuuguccuugagguauaccaccagcugucuucucugccuugucugauuuccccaucucuugccccccugcucucucuuaguaucuucuccaaguauucugccccaucuuccuucccuaucugguauguugcucaaaguguuuugugguauuccaaagcuugaaggugacuaggauucucugggucagugcuuggcccuucaguucccugaaaacaccacuuuccuggguauccccaaguaugaggaaaggcaggcucaacugggguacagagucuccuuucccucagcuucccucauggauucacacgaagagcaguacagaaaacccugugaagggcuuguaguucugcaacagggccuaaggcuggggcuccaucugguauguucuugaugcagugggugccacagugcucugggcuaaccuugcuucuugcgucuuacagaggccucauucacaugcuuacucacuuggcugaggcgcugcaccaggccaggcugcuggucauucuggucaucccaccugcugucacgccgggguaagugcacucuuaggguggaaaacaguuagucaagggcccagacccucucuuaucaacaugggcuccucauucaaaaaaaaaaaaaaaagguuguaggggaggggaaagcugaccuacaguucugaccuaucuugucccucaguauagacaucuacugaggaauucaucaucaugagaauccacaaguuuagacucauuaucuaaugucccuggggcucugagguaccuaguucaguucuuaggcuaucaauacuuaauugccuauagcauauugcacuauagcugggcaagcugcugccaacuggagccaccgaagggaucugggccuuuguuccagacucuggcucuuucccauucccagccaugugaggcagcucuuuuggaaccuuugggacaagauguaaugaccuagguacaacuggagccaaggcauuuggacucccaugucuacccugccuagagccucucuuagaaaucaccaguguuugacuuagaaauaacaauacugugaaguaggagacucagagucacccagggauagaccuggaguacagcaggcaggaacagguauggaaggcagguagaacuauuggguaguaguccuaggaaucuuccugguguuuaagcuuccaagggcagcccuaucuauuuggccuucaaacucucugauggaugcuaagcucccuggucuacacaguagaagaaaguguccuucucucuggucaucucugagccuucagcucuuugaaaugauaguagcuggauauaguuggcuaugccuccagggcuugaggugcauuggcaacucgauggauccuuaugaaagaaauuacuuuucugugaauuuagacuagccugaucuacauagcaacuucugggccagucagggcuacauggugagaccauugucucauauaaaggugaaaagccgagugggguguauauaucuuuaauuccagcaaucauggggcugaggaagguggaucucugugaguuugaagccagccugaucaauaugaugaguuucaggccagccagaguuacgcugagauguugucucaaaaaaacccaaaacaaacaaagaaaagaaaaacccgaguuagccgggcgugguggcgcacacguuuaaucccagcacucaggaggcagaggcaggcggauuucuaaguucgaggccagccuggucuacaaagugagcuccaggacagccagggcuauacagagaaacccuaucucgaaaaaccaaaaaaagaaaaacccgaguuaauauagcaccugcaaggugcuugggcagcugacagggacgcuaguugcugaagaccuacucugugucacuuagugucaccugucacuacaggugcuacuauagaggcaguucaaagcuuaagacccaccagcucaagguaguuuucccaucccaaccuugagugugccaaggccccuguguaugguguggaugucugccugcugucugagcuuucucaguaaacuuccucggcucucagcccauuaguagggacugcugagcacaacagcaggcccugcacauugauuucaggccuagccugcugcagagaguaugccguggggucuggugccucuagguaggaaccuggaaaguagaaagcaugagaguugugugccacucugcucagggggagcucuagaagugcuaggugacacaggguaggucucagcagcuagugucugugacagcuggcugcucaaguaccuuacaggugcuaaauuagcucaagucacuuuuguuguuguuuuguuuuguuuuauuugacaacaucucacaguaucccugauuggccuggaauucacuguguagacuagguuacguuuuaauguguggggccuguguguguagugaggcuccguucuauacuuuuucuuccucagcugaccaaacagucuugcagaccuagguggaagagacagcaagggggucacauacuuccagaagggccuccagaauugugguaucagcugccucugccgggugcucauuucuggaucucuugguauacaguguuggcuggggugcuauagcuaggcggaaacuuggaguggacaguucagaaaccuguggcagguuuugguucuguagaagcugcucucagauucuggucaggcuuggggugucauauuuugcagaggaccucucuguccaagcaucuccucccaaacucccagcccuuugccugaaguggaucuuagaagcaagccaaggccaagucugucacucacuuugcagugacugaggcacauaguucaccuuaugcagccaugaggagagggauucuggaggguacccagaguggggguaggggacgcaucugcaguggcuggaagaaggaccaagaguggcaagagucugaggggaagcagggcccuuagcugguugaggccuugugggauuggggaugacccuucugccuugaguguaguggggcucuguugacacugcuccagggcauggggugcuuacuguccuccuuguuuguccuccccaacccuuaguagagagccaccucugcaagggagccaaaacagcaacugugcccugcaucuucagcaggacauagucauguugucauuugccucauaaaggcugcucuaggaagacagcugugguguguggggguggggaguagggguggcuucuagucaucaaaugaaaauucacuuauguccuuugucaccaaaggcagguuaagucagagcugcuacagaaagggcugccacagcacugcagacccucgggguccugcccuagaacugggcagcuauucagccaugcugaccuugaacacuucuuccaagguuacuugcauacacucagcaauauaaaaaccagggcagaguggcagccuugaagauguaguuuaauuagauccccauaccuacuggggcuagcaacauaucaucuuagggacauaggagauaucagguuugcuucuagccaaccucuuggguuucucaaaagccaguaacauacaauccagaauggcagugagggaugugacaaguuaaagucaggucaaucucuaaccugccuuucacauuuccuuggccucacuagcucuuagggaccucuuagguuggugacagagaucacaggaacaacaaggccaggcaagaugggcaacagagacuuaacuguaggguaaacuggcaacccauucuguuguccuggaagaaguaggggccuggcuucacccaggggcacggagagaggagucagaggaagcgagagucauagggacaaaggcauaaagcuucagaggaaagcugugggacagugccaggaaggguugucuuuaagucuggguaccuucuaucuggcuguaacuccaauacuauggugccgucagcuauagcugguguuaauuguggacuggaggagggaggcacacacccugugggcugaggacagggaguuaaaguuuguguguuggcauccccaggguaggaaagaaugcugcauugcugagauaagguagcccuaggguaugcacgguuaagaguugacagcuucauugaccucccugagguugcagguggugaggcugcugggcccauaacucuccccacguucaucaguauuuucugcaggcuauagcugcacagugugcccuggcaccaucugggcauuuuuccuagcuauagggugucuggauaaaggaccacauggcuggagggccccagcccagugucauuacaguucugcucucuggaaaagagggucucaucauuggaaaggauggguagccugggcuaugagcauugccccauuuuagcccucagugggcacuuaaaagugucucccugccugggcuagguacuuucuucuuugccaugggaaggccccagcugcauggggccuguccaagacccaggcacugaguaauguguuuuguuauauuguuuuccucccucagaaauuaauucagaacaugagguuuucagcaugaacaguaauuucuguuuauuggaagucaugccauguguggccuauuggcaagcuguuuuuaugucucucgcgcauggacucauuuuauccuggugcugugggacaaagagaaacagcucaguggccgggcuccccagagguuuggggcaggagcagggcaggcugggaggguuggcuuuagcaacagcuucugcauagccuuucuuccucaaagacagaaggacaaaggacauauucccagagaaaccccaaggacauagccgggaggauggaaguagggaggauaguaagaggcccaguagugucccgucuuuccuguugauggcuaccacccuagaagguugcuccauuucaggaaaguguuggcuguguuccuguuugucuucauuuugucuuaggcugaccacuuaagaauaaggccauucugacaugugggcuguucuuaauggcucagccuguggaacuggguugcaucagugagaagcugaauaugggaaccucugggaauaauguaugcuucaggaaaauaggccccacaggguccauggucuucccaaaguucccacccacgccugucccuguauucugucucucccaccuugcacccucuccuauggugucagaaucucugaccugcccuguuuuucaggugcucgagccucugcccacagcccucauuaucuccccguucaugccugcccugcucgguguuccaguaacacagugagggcaagugcuauggcagccugccuggaggagcuaaaggugaccauggggaucugugccuagagacagggaacccaaaggucagaugauagcaaacaacacuguguacuggggccagcugugccugggcagaauuguguggugaucagaucuuuguaaccuaccuugaacucacagcaugcccucuggccugcccgcuccucugggugaggucuagcugauaggugagcugguccaagaaucacaacuaguagggaauaccguuugaggucucaggacuccaggcagugggcagugcuguuaccuagagaugguagauacugucugcuuugacuaguccugucuacaguucccucugagcuucuggccuggggucagagggugcuuacagccuggccagugggguuuagcagaagaaguuuuucugggagccuucagauaggaucugugcccgcucccugugcaaggucugugcagauuuaucuugccguugggagaugugugcuuuuucuucacuguaucugggcauugagugacacugacguaagucuucagggagaaguguucuuccccagccuggagugaggccacagggugggacuuugccagguguagcuacucugcuuggaacuuucuaggccccaggagcuucuucuugcccaaaggcuucagccacaccuuucugaaccuuucugagccuucuuccugcacuugugcugaauccauaacacaaggugggacuaagaaaggcugcuccucugccagccucuagcuauagcucaugccuuucuugaugagcaaucagaucuagaaacagcagggccugacauacuaggagucuauaaacauuggcagguuuagaugaggguccaccuaggagcaggcaagcuuuugccauagaagcccaucuuagucuugguuucuauugcacuucuguaaagagauaguaugaccugggggcuggagagauggcucagcaguuaaagagcauugacuacucuuccagaggcccugaguucaguucccaauaaccacguggugacucacaaccauccguaaugggcuugcuucuaguuuuagguuaggcugugauaauaguugugagaagcaaacagucauggagcuagaauaguaguagcugggaucuuuauauccuuacccauaggcagagggggaucagggacuggaccugguauuggcuuuugaaaccucaaagccugggagcuggugagauggcuuagcggguaagaacacugacugcucuuccgaaaguccugaguucaaaucccagcaaccacaugguggcuuacaaccacccauaaugagaucugaugccuucuuccggcgcaucugaagacagcuacaguguacuuauguauaauaauaaaucuuugggccgaaacuaguggaguugaccugagcaagcagaggcccuaaaaauucaauucuuaacaaccacaugaaggcucacaaccaucuguacagcuacaguguauuuauauacauaaaauaaauaaaucuuuaaaaaaagacuuucaaauccuacuccuaaugacaaaccuccuccaagaccacaccuucuaauucuucugaaacaauucaacuaacuguugacuuacuauucaaaugaaugagccuauauaugagugaacccuucucacucuaaggacaccacagagccacaguucuagauugaaugauugggcuccauuugggagcaggaguaggaagaacuguucuauuauggggccaagauaauauguuucggaggccggggcccuggggacacagggaaaugguucagccaugucugggcaacugggaccucuaugagucuguccucuucuauguucccacuguggaaugguucuggaacagggcggagugcuagguaagcuguacagcucuuaccccucuuucucucaggaccuuccagggggaaggaaagagggacaucuuuguuugacuuuggcccucauccuagcacccaaaguauguaugaccccagccaaauagcacacuacugagggaaaguagccugggguccuccuagagcaacaguucucacccauggggggugucaaacaaccaaccuuuccaugggugucaccugagaccaucagaaaacacagguauuuauauuacaauucauaacaguagcaaaacuauaguuaugaaguaacaaccuaaauaauuuuauuguuggaggucaccacaacauagagaacuguauuaaagggccauagcauuaggaagguugagaaccacugucuuagaggaaggagaagggguacaggcugggaacccagacagcaugcuuguucugacucuuagugaggaaggccagccauccauacauaguagcucaaaguagguaugcuugccuugucacaggacugaccagcugggcauguuuacacacaaggaguuugagcaacuggcccccauacuagauggcuucagccucaugacauaugacuauuccacgucacaacagugaguaugggcugguagggcacuguauguacaguggguccucaggaagauauagaccugcaccuuggucucuuaagcugacaucugccuaugggcucuauggcucaacaccaaugggcagucacuuucuucacaccagaugcugccagauggaagcuaaugguguuccugccccuuucucaggagagcugauucuuugagaagacccugccuagguggaacuuugucaccagugacauaggcacagucugccacuucuguuucccuugggcauuggucccagcugcaugucugcugacccuuccuugcucaguauuuuagaccuguuccuaauucucuagggauggggagguuacaaguaaguacuugccccaugcaaggcaccuguggguccccucaaaaggugcuaagaccacuuugucuacaguacuuaaaugagguuucugguugugccccuuuuaaaacaauuuugugauguguucagugucucauuuuucuaagauuuaucuuauaauuuuuaauuauacauguaugggucucauguggggguauaugcauguguaugggcucucaaggaagccagagguguuggauucccccgaggcuggaguuacagcuaggugugagcuucuguguguagaugcugagaacugaacucagguuuucugcaaucuuuccagcccuuuuuuuauuuuuauuuuuuauuuauuuuuuuuuaaguauaagcccucacucuguaacccagacuggucuggaacucacuuuauagucaaggcugggcuuauacuuguagcagaugugugucacaaugcucaacuucuucccaacucuauuuuuuuuuaagauuuauuuauuuauuuauuauauguaaguacacuguagcugucuucagacacaccagaagagggcaucagaucucauuacgggugguugugagccaccaugugguugcuggaauuugaacucgggaccuuuggaagagcagucggcacucuuaaccacugagccaucucccagccacccccccccccuuuuaacuuuuguuuuaucuucauugguguuugacuauauguauaucugugugaggguguuagauccccuggaacagggacaguugugaguggucaugugggugcuaggaacugaacccaaguccucugcaagagcaguuagugcucuuaacugcuggacuaucucuccagcccucagcucccaucccuuuuuuuguuuguuuguaugagacaggguuucucuauguauucuuggcuauccuggagcucacuauauguagaccagacagacuggccuugagcucaaagaucuccugcaucugccucccaggugcugaguuuaaagaugugugccauuaaccugguuucccaauucuugagagguauuugccauaacacugaaggaaaugggcccaaguagaugaccuagaggaccaaacuagagucagacgcaggacuuccugccuucacagaguggcuccauuucccauugaacuugcaggccuggcccuaaugcucccuugucauggauucgagccuguguccagguccuagaccccaagucacaguggcgaagcaagauccuccugggcuugaacuucuauggcauggauuaugcagccuccaaggaugcccgugagccugucauuggagccaggugagcccagggcccuccuggucacauuccagguguggccagucagagauguggguuucagucccugggaaagggagggaaaguuggggcugagaagguugggguagcuccuuuugggcuuuucgaacuguggagucugugauauggguuggguagaaagcuccaguccucuguuggacaccccccaggcccuugaggguuagcaccucacccacaguguuguugccuuagccaagaucugcauccauggugcaguuguccuguacuggggagagguuuggacauggcuggcuggauuugacaugcuuacauauuuccucugggcagcuccugugucuaguggacuugucuaggacugcucuucuuuucuggcccuaucauuuccuccacugagggucuccuccagugucuuggcucugguuuuaauagugugaacccaagcaccucuguggguuuuuuuguuuuguuuuauguuuuguuuuuuaauuuuucgagacaggguuucucuguguauguagcccuggcuguccuggaacucacucuguagaccaggcuggccucgaacucgaaauccgccugccucugccucccaagugcugggauuaaaggcgugugccaccacgccuggccacaccugucuuuuaaagcauuguuucuacuuccucucucugcuuuuccuguuuauaaaucuccugacugccuccaagcuucagugcuagcuguugggucucagcaguuugaugacuucagucaccugugcucaguguucauccagcucuccgugggcugugugcucacuuuuuacuaugauugggagacauucggaaguuuccucagcucucauccucagcuguguggugugugccggccugaugaggagcccugggcuccugagaugugauuuucuuuugauuuuaguuauuuucuguugcugucuccaggagacugguuucuuucccauuccuucuccucuguuaaccccacccagguucuuuucuucucacaucuacaaguuuucuaauucgugauuuaccuuuccguggauucaguuguggugcugcucaaagucugccucugcagguucugacaucugggucaguucucuggccuccacaugagggagugggggcuguuguggagccccaucugaggauguuagauguagugaaguucacuuuguuuuaagauguauuuauuuauaugagggcauuguagcugucuucagacacaccagaagagggcacuggaucccauuacagaugguuguugugguuucugggaacuaaacucaggaccucuggaagagcagucagugcucuuaacugcugagucaucucuccagcccaugaaguucacuauuaagugcuagauauuuuaacauucauacaaaucuggggucuuuauuccggguuaguugcuuagaagccuaacuaggcaugaugguagauacuuuuaguuacaguacuuggaaggcugaggcagguagauuucugugaguuucaagacagccuggucuguauaucaaguuccaggccagccaggaauacauacugagacccuguuucaaaauaaauaaauaaauaagcauuuaagcugcccauuuuccuaguggcuuuccauggagaauggcauccagaaacagagauuuggguguuguugcccacugagugcggccguuucuuucugacccguaggcaggugcagucuauggaaggugccaugcaugcaucacccagggcaagugagccgaggccaggccgcccagccuguacuaaaugcugauguucaguucuaucgacgcuucaagauucucuccgucugggcccagacaaagccagagcugacuuacuugccccuuaacggagcuuguauuugagugggaagguugggacccgucucuguggcccugguuguuuguagucugugaagguacacucaucagagcugagaccaccucucauucaagucuuccauugguccuuccaugguggggcauuagggugggccaugcuucaaagccauggaugugaauucugucuucccuacacaucugcacucuucaggauccacacagcuuguuccagcgucugggguucaucacagacuugaguuaauagcuguuguagcccacagugcugcugccuugcuuugucaugagccuuuggucuaacaucagacaagggagggcaggcuuacugaccgagaaggacccaacauggggcagacagggugggacgcuauuaaggcuuugggaucuggccaccugcuguuuuccaggagacuguuaaggguccugucagucucuuacagcuguccugugccugaagauguauguggcaggaacuagacaugggggugccacacaggugaagguacuucugcuccacucgggagcacacauauccacacaggcuguucuuagucuccuggccuuucugaauuuucccagcuagggaaggaaggcugugccucucaauccucauuucgcuaaugauuccuauggggcgagaugagggcaugcaugcuccagccuggacaugggcccacccaagggagacaauuagauggagaaagucgcuuuccuggggcgaggccuggcaagcugaucgauuuugccagcccguccaugcucaccuugucagggcugcagaauagaugcccacucagcagggacacuuccuuccccaggacuggaacagaucagcagccaggcuucucauggcuguagagccagccagcauuaacccugcuucaaggguaggcaucaaggagcaugcacuccucaccuugguccuggccuggggcugcccugcaaggagagagacuuaggaggacacagcaggagcccacaggcacugcugccugccugccggccaucugaugcuuggugacugcuagagucuuuucuuggcaggucucuggcucaggaaugcugacguuucccugagugagcacagcgccugcucacaguuguugcuaggccuucagauccacagagugcuuucccagacccuaccucaacuccagugacgucugaccucucccugcagacaagcuuccugugcucuuuccuuacuucaccauuagaccuuuccccuuacacccccaugggcaagccucagcugugugguguccacucuugacuuagaauucagcuuucuaagagcacaagguaagauaggccuccuauuuggggguguccuguagggucuucgccuccagugccugaacccggggcuaaucguccugauuucuggaagcacuuaugcuuucagcucagagccuuuccucagucuccaccuacgccuucuguuguuggcaccaaauuucuguuucucacugauaccucugucaacugcaguuggaccuaugccuuggguaaagcaaauugcuacucccagcucacccuucacacuguguaugcugcugggugacauuguuuaucggguccccucucaggccaugucuuuccaaagugaagagcucucauccuuucauccuguuugucuucucagacaaaugggauguguguaaagcagguggcaagacaggacagauccaguacugugguucuucuuugucccugcugccaaaauucacagaaacuaccuguuuucuuccuuaucucauucuuacuacuuuuguuuucuuuuguuuggagacagucauacucuguaguucaggcuggccuagaauuuauugcccuggaacuuacucuguagcccaggguggccucugucucauaauaauccucuuaucucagugagcuagcuccagcuuccagaucuuaugccuucuauuuaguuucuaaguauuaucugacaagcagugauguggaugaaggauucccuuccccucaagguccccaaguuguuauuuugggcacccuggcauuaaguggcuuucacugaccaaguauagacuucaggcaugagccccucugccagaacaggucugauagcucaggcuugucagcaguuuuugucuccauugaauggaaugggauagcacuccauggggacccccauaccagaggcaugagaaacccccagaggacgcugugccucugcugagaagccaguagagauccaccuugagcugagaaagaccuuuaaaccuaugaagccuugguugucugaccuaagguuuuguuguucccaggggagguuuggagguggcucugccaucagccaucuccuccaguaguucugagcauuggaaagaggagggucuugcuagugcccuaccccagcaggucugggucuggauucagagcucuggacagagcuaggaggcgccaaagaagagccucuuauauacaauuugagcccaaaaacuagcacuggguagggguaacuaaguauaacauaaguauaaauauaacaguacaaggugucuucauaccuauaucccagugagugugcucagcccacaggccugaacaugcccuguuuucaaugaugggucucaugaggaagcaccaguucuagcugcagugcauccucauaugccagggccacauuugauuagcuuuggccauagguagacauagguaguaggaggucaggcaagucuaucaucugcaccugcuggcuuuacucaguguuaaucccugcacuaugaaagcaguaccccacugagcaucucagcuuugcuccugaggaugccaaaccucaccuugccuuguaaucacccagugacagcaaccauuugacauugccaacaaaauucuuccuuccuucuagggcucaacccugccugcugcucacaaagugaguucccauagaucuccauauggaaucaaagggccucucacagacagggccucucaaacacagggccucucauauauaaccccuccauagacagggccuuucacagacagggccucucacagacaggaccuccauaaaaagagccucucacagacagggacucucacagacagggccucucacagacaggaccuccauaaaaagagccucucacagacagggacucucacagauaggcccauucacagacagguacucagacacagccucucacagacagggccucucacaaaaaaggccucucaaacacagggccucucacagacagggccuccauagacagggucucuacagacagggccucucacagagagggccauucagacagagccuuucagagacagggccucucacaaaaagggccucucacagacagggccucucacagaaagggccuucacagacagggccucucucagacagggucacucucagacauggugucucacagacaaggccucucacauacagggccucuuauaggcaaggccuccauagacagggccucuuauaggcaaggccuccauagacagggccucucacagauauggccucucauaaacaaggccuccacagacagggccucucacagacagugccucaauagacauggccucucacagacagggccucucacagaaagggccucucacagacagggacucucacagauagggccccucacagaaagggccucaaacagacaggcccauucacagacagggccucucacaaacagggccucucacagaaaaggccucucacagacagggccucucacagacaggaccucucacagacaggaccucucacagacagggccucucacagaaaaguccugucacagacagggcccacauagaaagggcuucucacaggcagggccuccauagacagggcauuucacagacagggccuccauagaaagugacucucacagagagggacucucacagaugggcuucucacggacagggucuccauagaaagggucucucauagacagggccucucacagacagggccuccauagaaaggaagggccuuucacagacagggccucucacagaguggcccuccauagaaagggccucuuacagacagggccauucagacagggccuuucacagacaggagcucucucacagaaagggccucucacagacagggccucccauagaaagggccauucacagacagggccucucacagacaggcccauucacagacaggaccuuugucacagaaagggccucucagccaggcguggugacgcaugccuuuaaucccagcacucgggaggcagaggcagguggauuucugaguucgaggccagccuggucuacaaagugagcuccaggacagccagagcuauaaaaaaaagaaagggccucucacagacagggccucaauagacagggcuucucacagacagagccucucacagaaagggccuuucauagacagggccauucacagacagggccucucacagacagggccucuaacagaaagggccucucacagacagggccucccacagacagggccucucacagacagggccucccacagacagggccucccacagacaggcccauucacagacagggccucucacagacaaggccuccauagacagggccuuucacagacagggccucucacagagugggccuccauagaaagggccucuuacagacagggccauucagacagggccuuucacagacaggagcucucucacagacagggccucucacagacagugccauucacagucaggaccugucacagacagggccucucacagacagggccucccacagaaagggccauucacagacagggccucucacagacaggcccauucacagacagggccucucacagacaaggccuccauagacagggccuuucacagacagggccucuaacagaaagggccucucacagacagugccauucacagucaggaccugucacagacagggccucucacagacagggccucucacagacagguccauucacagacagggccucucacagacaaggccucccacagaaagggccauucacagacagugccucuaacagaaagcgccucucacagacagugccucuaacagaaagcgccucucacagacagugccucucacacacagugccauucauagucaagggccucucacagacagggccucccacagacagggccauucacagacagggcuucucauagucagggcuucucauagacagggccucucacagacagggccucacacagacagggccuccauagaaagggccucucacagacagggccucucacagacaggguuucucacagacugugccucacacagacagggccuccauagaaagcgccucucacagacagugccauucacagucaagggccucucacagacagggccucucucagcagggccucucucagacagcaccucucuuagacagggccucucacagacggggccucucacagacaaggccuccauagacagggccuuucacagacagggccucucacagagugggccuccauagaaagggccucuuacagacagggccuuucacagacaggagcucucucacagaaagguccucucacagacaggaccucuaacagaaagggccucucacagacagugccauucacagacagugccucuagcagaaagugccucucacagacagugccauucacagucaagggccucucacagacagggccucccacagacagggccauucacagacagggccucuaauagaaagggccucucacagacagggccucucacagacagggcuucucauagacagggccucucuuagacagggccucucacagagagggccuccauagacagggcuucucauagaaagguuuuuaugacuuuuuuccccuuaaagcagaauuucuucuggguuggugucacagagccaugggucacagucucuuccauguuguaguccaaccccucuggugggauugaauccaauuaagagagguagcugugagagaagcagaccugccccucuucuggccaguccaaaugaaaucccucuuucccccagaccaggcacagcauguaggggaaaguuuuaggggacuuacugacuagguuuuaagugcuccucaagaacauagauuggcaggauacaaccccuucauaucaguuaccacaugucuuaguuaggguuuuacugcugugaacagacaccaugaccaacauuaagucuuauaaaacaacauuuaauuggggcuggcuuacagguucagagguucauucaguccauuaucaucacggugggagcauggcaguauccaggcaggcauggcacaggaggagcugagaguucuaugucuucauccaaaggcugcuaguggaagacuaaacuuccaggcaacuagggugaggaucuuaugcccacacccacagugacacacccauuccaaccaggucacaccuauuccaacaaggccacaccuccagauggugccacucccugguccaaggauauacaaaccaucacauuccacucccugguccccauagacuugcucaaaaacaugagucuaugggggccauagguaaacauagcauaaugcaaaaugcauuuaguccaacuuucaaaguccucauagucuagggcagucgcaacaauguuaaaagcccaaaguucaaggucucuucugagauucauucaacuuaauuaacuguaauccccaaagcaaggcaggaaaccagcugggcaaacuccaaacucugcaucuccauggcugaugucaaagcggucuucagaucuccacuccuuuuucaucuuuguugacugcaacaaacugcuuucuccugggcugguuccacucccuguuagcagcuuuccucagcauguaucccauggcucuggcaucuuuaacaucuuugagucuccaaggcaauuucaauguuacagcuucuuguuucagugucugggauuccacuugaacuuuuggacuccuccuaaggccuggcaucacuuuuccagcucugcccucuguagcacucuaagcucaaguugauccacuccacuacggcugcaguucuuggugaucacuccaugguacugacaucuccaauacacugggguauuccacuccaacuagacuucaccaauagccucucaugggcucucuucaggaugccaagccucaaauccuuugcaugaccccuucaguccuaggccaucaacuacagcugaggcuucaccuuccccaauggccuucccuggccucucacagugcuaagccucagcuucucuccaugaucccuucauuccuucacaagcaguaccaccugagugacucuuacacauuaccaaguccagcugcagcaagagguacaaccuuggguaucucuggaacacagcuucuuugugcucccagaaaacacuuuccagaagauuucaccucagugaugcuggucucuucuugaucacugcuaauuccuuagcuccagcuaacaagcaucaauuuucccaguaguuccuuccauucuuaacucuagagccagagccacauggcugaagcugcugaguucugugcuugcaggaacuagaacaugacccccuuguacuauuacaucgucacuggcuuucuguuuuccaacuccuucacugccuaagcuuggcucuccuggaucuuucucuguagauuggccuugaacguggagaucagcaugccugucuccugggauuaaagauguguaccaccaugccuagaucuaauuaagcuggguagaaucuugccccaaggucccauucccuuaaucuuuuaucuccuagaacacaagauuuugcuccauuucacuuccugguaccccuuuaauacucgaaucauauauuuuauauuuuuccuuucuaagcuugcuaugcuuguucaaacuucucuucauaagacuuaaccagagaacaaagucucugcugagcuuuuuugaaacuuuugucaaugcaauuaauucaagucucuucaccuuagccucaggcaaacuuuucagacaagggcaaaaaguagccacauucuucacuaaaauaccacaaaaccagucuuuaugccacauucugaaauucuucuccuuugaaaucucuugggccaagucaacacaguucaaaucacucccagcagcuaagucuuccauauuccuacuaggaugacccauuaagccccauuuaaagcauuccacugccuuccaaauccaaaguccccaaauccacauucuuucaaagaaaagcauggucaggccuaucacagcaauaccccacuucugguaccaacuucugucccacuucugguaucaacuucuguuuacugcuaugaacagacaccaugaccaacguugagucuuauaaaacaacauuuaauuggggcuggcuuacagguucagagguucaguccauuaucaucacggugggagcauggcaguauccaggcaggcaugguacaggaggagcugagaguucuaugucuucauccaaaggcugcuaguggaagacuaaacuuccaggcaacuagggugaggaucuuaugcccacacccacagugacacacccauuccaaccaggucacaccuauuccaacaaggccacaccuccagauggugccacucccugguccaaggauauacaaaccaucacaccacagguaccucuguuaauggccccacggggcagauaaugaccuggugugagaugcaggugagcuucuuaagcuccuuuggauucagugcucccccuuuaaagauuuacuuauuuuuacaugcacugaugucuuaccugcauauaugcuugugcaaggguaccagaucuucugaaacuagaguuacagacaauugugaacugacacgugggugcugguacuugaacucaaguccucuggaagagcagccagagcucguaaccacugauccaucucuccagacuuagaguugccauguuuauggaaaucuaagcauggucucaggaugaucugccaccccaucuuagccucuagaacagaguccuaguccuuuccaagacagacaugguucagccacuuaaccaucuguucagcuguauauggagccaagacccugugauaggagcgauuggccggcccacucaagccagugaccguggucuguuugccucuaccagccgugcagaccaucugugccuuuccuaugguaggaucugcagaguagugccccuucuugguauggccccagacgacuucuagugaaacucugagauggccugcucauugccugucuugagaguuaugguaccucacaguagcagaaaaagguucaggaugccuguccugggcccucgcuuggcugacucagcauaauuaagcugauuaagcaugauagcuaaguaacugcacauacgugggcucucauacacuuucugacagcuaccuccucccuucugccccaugaaagcugaacucacuugggcugugucuucugacuccacccugcugccaggccauagacucaaccucgugaugagccacaguuuccuuggugaugugaagaucaaggccagcuggccagcaagugugugggauccuuccagcaugggcuauugaugcucccagcauggagaugccauaguuaucuugugauccauuuggaagcuauuaugguccaagcagucugucaagugaaaagccagccuuggugcaaaugagcauuucuacccuguuccucuuuacccugcaaugccaaggcaagauccauuaucaguauaucugauaacugugcccuguggugagaagcuucuauccauggcaaggauagaagccagaugaagacgaggccagcggcauggcccucacuccuacccauccuguguauacucucgcagccuagacagcccaagagagacccugggccacguccucugaguuccuccuuacuugccccagcuggcucuguguaugucagcauguccagaacauucugaucaagccugcuuauacagcccugcuuuuuguuuuauuuaacuuucauuaauuuauuuuuggggugggaaagcacacacaggccacggcacuguuguggaggucagggaccaacaugcagaaguugguucucuccuuucacugucuggguucuggagaucaaacucaggucaucaggauuguagcaagcuccuuuacccacugagccgucucaccagcccuguuuuguugcuuaaauuaauuguuaauuuguuuuuauuuuugacuguauguauuggugggcaguauaugaacacaagugucagagauaccggguccuccuggaaguggaguuauagcagguaggugugacucaccuguguagauguugggcacugaaucuggguccuuugcaagagcaguacacucugcauccuuaucugcugagccgcaguuccagcccugguuuuugcuuuguuuuguuuuguguuugguugggguuuuuugaaacaugguuucucuguaucgccuuggcugucugggaacucacuguagaucaggcuggucuuaaacucaaagguucaccugcuucugccucaugagugcugggacuaaaggcauuggccacuacugcuggcuuccaggcucuauguuuuucaaguaaauuuuuaaaaauuuuaauguauauauuguauauugaucauuuccccuucuuguucucacccuccuuuuccucaccccuucugccuguuuuuagucucucuguccccuagacaguuugacuuccacuuucaugucauucacacacacacacacauauauauguguguguauauauauuuauauauauauguguguguauauauacguuacguacacacauauauauguauauauaugaaaauaaauauauauauaaaauaaauaaauuuaggaucacaaauaagagaaaacauauaauacuugucugagauugacuuaauucacuaguaugauuauccgauuguacccauuuuucugcaaaugauaugauucauccuuguguuugacugcccugguguuuaggagaccucuugagcagauccaagaaaaaggcuuucucucacuugccagcucugcauggucagccuacgacacuggccucacucaaggccuuuccucggcucagaugucaugugagagauaaccaagggagaugaagaugauggggcucccucuugacugagcuuucaggauuggaucuugggcaggucagaguaguggaaaugccagaccuucuaaguuggggugacuccaacuuagccuuaaaagauuuacuuauuuauauauuuuuuacauuauuuuauguguggggguguuuugcuacaugugugucuagguaccacaugcacaccuggugcccacagaggucagaagagagcacuagaucuccuagaauugggguuacagacaguugugaauugcuacguguguguaugcugagaauuaaacccagguccuuguucauaacugcuaagccaucuuaaccagcccccuauuuguuuauccuuauguguauaaguguucugucugcaugucucgugcccauagagguaagaaaagagauccaaagcuccuggaacuagaacuauggacaauugugagcuacuaggagccagucuugggguccucugcaggagcaguaaaugcucuuaaccgcugagcugucucucuagccugucccaacauaccuuuuguugguacuuaucuggcagugugucuggcugcagucaguuccucauggaauucuggguuuagugggaugucagagauaaaggaccagggccacgaugucagcuaugcgggguugucaccuuguucugaguuguuacucuaggccccaucauggaggcugagagucccacugcagcugagagugggaguuccuuuccagucucucagcguuuuguccucugacccugccuauaaaucacgguggacucauuaggcucugggccaagaaggccugagaaccuucuuaucacuggaaacagguaggacacccucuguugcuggugcaauaagcuccucuggaaagugucuagguggguucacacacggcucugucggcauuccugacuccuucauccgaggccuugugccauggacauuacucaccccgcacuucagagcguguaagcagugagugcacaguuacagaacccuuucauuaccccaaagaagccuuuacccucacaagucacgccuccgucuccccgcuccuguugacauggacccugggucaugucccuuagggucaugugccugcuguguuacaugaaaauggaaucguucguucacugugugguuaaggcuuuucuuucuuucuuccuuucuuuuguuuguuuguuuguuuguuuuucaagacaggguuucucuguguauuccuggcuguccuggaacucacucuguagaccagguuggccucgaacucagaaauccgccugccucugccucccgaguucugggaucaaaggcuugcgccaccaccgcccagcugguuaaggcucuucuuagcuuagggaaaugccuaguccuuaauccuuccuugcaguggguguugugucuccgagcuggcccaaaccccuagacucagaagaucuuccagacuacagacauuccaaucucuucugucuguccuacggauuuccuguaccuuccugugguucaagugaagcccaugaccaaugccccacgccauccucugggcuuguuuaccgucucucuaucugccccuccucuccuaaggccccauaccccaucacugcauguugcgccucaucucagaaagguguggugacccuuguugugcauggcagccuggcccuuggguggagcucgcccuucacaugauguuccacaggagucacauaagcccuagcgggcuccaaagccagaccuugauuucugcuaugcucaggaguugaaguguccagcaaccaacucaggcaucucugcccauccuccagucaucuucagacugacuuccauaacaaggucagggggccuuguuaacgagggggccuagagcagaggcaugcacaggaaacccuuggcuguugcagcuacaccugguucccaaggcaaccccacuugacucuuccccacaccuuccccugacucucaauccuuugucuucagagccugcuuagaggagcaguuccuagcguucauguuaaagggaagcauaggguccuccuuuucuggucacacucgcucccaaaggguugagcaugcacaugcacucgcauacacacacacaagcugaaaaggaugacccaguucuuuagaguauauugacugagaggcagcuggucuuguaggugaggccacaaaagccaacaugaauaaugguguauguggccacaggcccaaagggccccagcccuauggccucugucucaugcccuacacaucucagguucuuucaaagagcaucucagcugacauuguguggaaagccagaaaccguuaguaccuucaguggcauuugaaucagguggcccaguaguauuugaugauccucuucagggaguaauguugccuggguaguccugaauucucaccuggcuggauauguuucagauaggaccaguaaggaccaaaaagacauagcacugcauagaggacaagcuaagcaaauguguccauaaagccaugugucguaacacaggccugugaucuuagcacucagaggaggacugugagccugagucuagccugggcuacguaaugagauugucuccaaaaauaagcauccacagaaccauagugcacuguguagggaagacugcagcacucgggguagauaaugucaugugcguaaaggugccucagugucuugcagcagcucugacggcugggugccccugccacaccuuuccaguucuccugccuucauuugcuguggucugcauguggccgcuccucaguguggggguauugcuuaggagaagggacagcggugcucuccuaagcauggaaggauggaacugugaccacaggcuugcaaagagaguucaguuugagcugagagguggcucugagccagacugucuauuuauaacuauuuguucccuacuuacccugccuuguuccuuuuccugacuuauuugguauauugcaggcccuaauaccugcauaguagcucccacuccauguuccaugaggccagggccacucuccggagcacugcuaaacaagaugacagcuguucaagucuccaagauaccuugggggcugcuggggcucagcacuguacccuccuuuugucaggagccuacgaccaaugcaauucauaucuagaaggcagcuccucugcuggagggucccaugccuuauccaccaggaugcuggagccucugcugcccacugugccuucucucagggccccgacuaguagccaugaagaccauccacuugaggguccugccgcugccuguacccacccucccacagcaggucuugauugugcugcuggaucaggggacccugcaccugcagacuccuagcagcaaacagaggacagucucucagaccgucuauuaacauacucguggccauuauagccuuuaucugggagggauacuguucuggucucagauguagagcaugugauuggcugugugucauggguucuccuugcauuguuggaaacugcagucuucgcccaagcaguugagaacaagccuucuucaggaagggcagcauuacugcagcucuggaaaugaggcagcaguggccagcugaggaaaggaaaaccugggacacuuaaccuaucaaagccaauguuucugccacucuccaggcaagagcccuguccuuuuauccuuggcccacagcuugguggagcaguugaaguuuagacacugaauagcuuauuaucugggcucuggguagagcaaggucagagagcaucagguggucuguccauuggcuucaagaaggcucacaaaaggugcuguuuccuagugcaggacuuguguacagugggacuuggagguuugaccacccaagcuuacuggcugaacauaacacaaagcacugcuggcucacuguaggccuuuacgaacaauguauugcucacucuuuuugugguauccauagccacauagaagcuggggcuuaggggugaucugggguauguggcuagcucucacacccauaaccugaucucucuagguacguacagacgcugaaggaccacaggccccgagugguaugggacagccaggcugcggagcacuucuuugaguacaagaagugagugacuuguagcucaccaaauuguaggcaggaagccuuguggggaggacacuuaagugggagcagcaggggauggggaacaaugaggggccaggacuggaccuuaaccccggugggagaagaguguaguccuugaccuagccagggccagaaggcagggcucauggucccauuucuccugcaggaaucgcggcgggaggcauguugucuucuacccaacucugaagguaugugccaugugcuuugacugucaacuauaaugcuguggugggagugaguuuuggccagaugacaucagugguaucaauacuugccaucugcauuugaggucuguucugugggcuugauuccaggucacacauugcccccaugucuaggguaauuugggauauauuguggggguaguaaggaaauggguggagcaggugccuacaccucugucugcccccagucucugcaggugcggcuggagcuagccagggagcuuggcgucggggucuccaucugggagcugggccaaggccuggauuacuucuaugaccugcuguaggcuggaaagcaacccccaagugacuggacuuuucuaagccauggagugacuggugaaauauaggccuuuucucuguuuaccaugagacagcugcuauggguccacacgcaugggugucuccuaguccaggauuugaaucggaauccuuucuacucacuacucacugcugccugcugugggccaggugaaaacgcaacccccauccccuaggacagccuggcucuggacucaggccucgagugcuuuucaaggccugugugggauguggguuuggaagaugugaacaaucacagacucuucuaaacagcccuucucagcaucacccuuaagccugacaggcccugccuucauacuaugaucaccugccuaccacaaacacggguauauucaagguaccugauaccuggagcagguucuacaccuacccccacugggcuugaugugaccagguugugcgaucauguuggaaacuggcccagagaagcuggacuuacuucugugaaacaccaugggccauagcccugacuguccaccagauaacaggauaggaucagcccauggggcagcagaaggaccugugggcugagugggacagguaucaugagaucagaagggaucugucuaucuuaguaaacagcaacaggcugauccagugcuggggagauguccaagacuucuaaggcaccaacaggugaagaauggcugaccuacuuauuucuucacuccuucauuccaagugcccucauccccugcuggauaugaucucaagguagugaucucuggugcugcgggccauuggguggagcuuucuaauccacuagccaagccugagccauagagaucauaaacccuaacuaggcuuuuacccugugaguuucugagauuuguggcucaagauccuuaguguuaggaacggggaggaugcuaaaacagcgggccuaggccugacucaaaaggcugaaccucucccacucuggaguggguaguccuaccuacgucaguugaaccaccuauugaccuuaaccuacuggaauagagguaucccugaacauucacugagcucagugugaccaaggcugagaaccugggaugcuaggucagggguuccugagauggauagacucugccaacuaucugauaccuguaaaggccuugggggcuacacugaccccgcugacuuugagaagacacaacucuacagaccccaguuaaggauagucaggacaagaaggccagugugagggacagaggcaucuugacccccccauacuauaagaaguggucaucagugcgcucaugugcuaugugugguaugagguaguagacguuggaacacuggcugguacgguggggccaugagccugcucccacacuggcugcucagccagagcugaguccuagccuugaguccaaggguuuaguggaugggaguagucuccgaauauaagaagugagugacauggaguucuccuaguugugggcagagcacuggugaagcaggcuggggaacagccuucugcaagcagauggagugauuaagguggcaugggggacaagcagaauaggucagagugccacagucaaggguccugcuggagagucaaaugauagaaguagaugggaacuuggcugaguucucuggggccacagaaaagugagcagccagcucagccucuuggcuuucuuucccucauugaugcuggagauugaccccaagcaccaugcagggacauccgcacugagcaguaaccuucagguucuggguuugagucagcaaaguugagguaugcagagaugcuguccaagagcuaacagacugguagauagaaauucagucagagaguggcaagguagucaguggcuauggugagcuggugaccaugagccauggauggcagcugcuuagcuuggggaggagaggggagaaagggcauccugggacuugaggagggucagcaccccacuguacuuugaguacaacuucucaguuuggccaucuguaaguaacagguuuuuuugcuaauuagcagccugccuggagcagcugacuccacaguuaacucaggguccuauggcuucuaacuagaaagacgacagugggccacaaggacucagcccagagccagagauaucugggucacacucaggugugugagucacaaugacuccuaaugaggacugugcucagaguaggcuccucacacagcaggguguggagacugagagucagauggcucacagcuccugaggguccugggagcucaucuuagccugaacccccagaguaccaucccuauagucaaaggcccucaccuauagcucuucuuuauccccuaguuaagaagacacugccuuugaugucuugaugguggcuugauguucuauaugacucuaacucuggccaguggcaaaggcucugugucuccuaguguugcaauuugcagucucuccagacuaauccaggggcagagguacuaggacagagauacaagaguaacugagguagcccaggagaaacaggagagaacggaggccaccccuucccccaacuaagagguuagcaguguuccccugagcuccgagcucugcugacccuuggaaaaugaaagaacuuccucaguugaaggcuguacaaccuuuguguguuggcaagacccacagucugcucacacacuuuauuaagaugcaucuggaaccacgacacugucauggaauguggaucaugggaccuggcccugccuggagcaccaagaucaucgugggccuugagcagacugggccugcccccaaccuagcaaccaugcaaggcugggaaccccauccugugugaacacuggaagguauauauggauauaaaaagugucaaaguucccugggcccuuagcccugggugccauuuggcaccaacucuauagucuggugucugcugccacccaagcagagugcccucaggugcagggauggaugcugggugcucuggccuccagcucuucccccugcauucagcagaacaccaguccugcagggggagcggguuuggacaucuuccuucccgugggcggguccuuuggcagagaagcagaggcugugagaccuaugcacaguagguguccgccuuuaccaccuggcaguacauggucauagcgaaggugaggcccagaaucugu

SEQ ID NO: 4200 - RNA, 3684 nt, Mus musculus
agcugcacaaagucuuuguuuauuaggguuaaaggguuauuaggagguguuucagagagaggucguuaguaaaguguuggcauggcagacuccaguaccugagcucagucuaaaauacagcagcaugcauaguggugcauucucuagcacagagaagcagacauggaggagcuaaugugagcuacuacaagucucaugucccagucagagaugcuaucucaaaaauguggguguggguggcuccugaggaauggcacccgaggcugaccuuuguccccucacacgugcacacacaagcuacuugaguaucacauacaaaguucacugggagccuugguucuguucuguccuccuccuucuccucuuuuaaaauuaauuuauuaauuaauuuauuuauuacaauaguuucuuacuguacagccuagacuguccuggaauucccuauaauccuccugucuuaaccucccaaguauugggauagcaggcucuuaccacuguaacugguuuuuguuuuaauagcuuuuaccuuuacuuugucugugugccugugugugccuugugggugccgugccauagcaugcauguggaggcccgagggcaaccugugggaguugguucuuuccuuccacguguaguuucugaggauugaacucaggucauuaugcuugauggcaaaugccuuuauccacugagcggucucacuggcccuuauguuuuuaaugaaacagggucuuauguaacucagucuggccuugaacuuacucucuuugaacuccuaauccuccugccucugcccucuaagugcuuucauacagguguguaccacaugacuggcuucaauuuuuuugcucauugucuuuuccuucugcuuugaaccaaauuagaaaucuucuuucucuuuauguugcuuuauauuuuguuucugggguugauaaccgagagcaaagcucccuugucucugaagcuccguagagguuuugcccauaauccuuggacuuuaugauuaacacauucugucuaagugccauccaaauuagaagcagguguagguaccacagcugcuccaucccugccucauguuuaugacacugcagcagggagcugucccaugacaauuuacaaaugcuccccuucuuaucugcagcugggaauaauugucagaggcacccauaggacaggcagugucucgggagccucuugcccggguguggggcugggcuggugggaugagggccugggagcccagccgacaguuguguccugcccagaagacccugcggugcguggccgccugacugagugcuuggagaccauccugaacaaggcccaggagccacccaaguccaagaagguccagcauucaaaugccaagaacgcugugcuguuugaggccaucagccugaucauccaccaugacaggugagcccugcuagcagcgcaucccucucgagagacagcagguggaggcuggcaguuggcaucugucugugcagauguugaccggugucucuauucuagccuuggucucugcuccucuugcuucuugagcugugagcucacuucaugugagcucucuggccccgggacguugccauagauacuuuuauagcuguggaaucgucccuagagcuccuuuuugcuucugaguauuacaggaagcuucuuugaaaggaagggacacccgugugacuuucgcugcucagagaggcaaugcuccaguauucuggggucuccuggggcagugguagugaugacucccagcuucuguacagggucaugguugggucacaggcagugguugucauauacagugcaggcaucuugcuucugcucuuuuaugcucaguccugguugugugcccuuauguaugcccguggcacugcucucugggucucugccagaggcuguagcagacagaacucuagccuguuugggaccagcuguuuuugcuccaucauuuagauaaauguugcagugacaaaagcagucugccaaacuggagcaggguugaaaaugaacuguaaaaaacaaaacuuagggugugagggagagcauccuaagaaacguauguaagagggaauguugaccguuuagcccacguuccacauucacagcccucguuacucacugucugccuuagccugguccaguuuccugcauggccgcuguccaacucacuuuccuggacacaacaaaagaaagugaagccuuggccuaccagagcuuuccagagucugcucuggaguagaggagcuccugcagauucauuagaaagucacccccucuucacugcaccuccuccucccugaccccucauuacagcaccguccuaucacuucacaccgcacuucucauuccucaccucgcguccucuuuaccgaggcuuuuccucccuggacugccaucuguccuaugcaccaccucuuccagcgccucccgcugggccuccucucaccacugcgcugccuucucaccgcaccucuccacugcaucuguccucaccuguagcucacagcccucccugacuauuuuccccuccucaucauguccccuguuccuugcagugagccaaacuugcucguccgcgccugcaaccagcugggccaguuccugcagcaccgggagacgaaccuacgcuaccuggcucuggagagcaugugcacgcuggccagcucugaguucucccacgaggccgucaagacccacauugagacggucaucaaugccuugaaggugugcuccuuguuggucaugugucacugccuccauguggaggucagacuaggaggugccucguguggcaccuaagaugaauccauucaagcugucuggaucucagaguguuugccuggcgcucgucacuugcugucguuuggggugaacgcagcaguuggacgaggaagcuguccaucuuccugcagugcagccgggccugcuaucuucaaagacguggcagcuggggacagcgcuccagccgagggccuuuagcugagugucuccguugugggagcagcgccagcugagcacauucccgucuccuggaaugauuucaugugaccugcuuggaggccacauaguguaguuaguaaacagaaaguuuucuuugauagaaagaugaaauauuuuguuuuuaucuccaggaccguguaccucuuacacaacaaaauuccuugucaaggauucuagauucuuucaaggauuagaauuccagaauuuaaagcaccuagcugagguuaccuggucucuuaccuccuucugaaugugagagugacccugguaguguguuccucuggcauggcacacacugucuacauugccugcauguuagcuuccauguuacauguuaguugauuagugagccauacauguaagacccuucaucucggugagucuuaagcuguaguaagcagggcuggcccuuaucuguauuuuuguauaaaucaacagacauuuuggugucugacuugaacacaaggcugcauucuuccuaguccuggcugggugucugcuccagucguucucuuccaucacaaauacaagucucagucucaccuucguuaggugcccucugcccugcacugaggcauccugcacuguucaccacggcagggagcuacagauggcugcucucagacaccgcgcugcccaagcacuguguguagugggucucuccuguaccaccug

SEQ ID NO: 4201 - RNA, 10102 nt, Mus musculus
  misc_feature (10102)..(10102): n is a, c, g, or u
acuuaaaucacaacaccagaguggcuaugccugaguuuauuaucggaaagcaaagaauggaacagaaacuccgaaaauaaauaugugcagagaagaagccaagccaggaguggagaaggucagagagucagcagaauaguuuaagaugcgaaggaaugugcacgguacaacccauucacuuccuuccuagaaaacgggggcuagaacgccuggugcggacuugcugggccugugggagcccacagacaguguccuggcacagacagcucucgauguguguguagguauggcucagcucacugccaucugggcauuccaggguaacacuucggacacuggucuucuccuccuugcagcaagagcaccugugauccagacccuggaccugggcagaguaccuggggacaagaagggcaaaaugagugccagccucccugugaacagcaucagaguccucccuccuugaggccuguccuugagcuccuccaccugccccccaccaucucauacuuguagccuggcacucacauggcaaaagucccacaggacccaaaacaguaguucauggagauguucuuggugcagccauuguaggaaaucuccuucaugacggagacagcagagcaagggacucuggucugguuuugagggaugccugugggggaaaaaugacucuagcuagcuagcuccccuugccccuucccucucucuccccacuuccccucccucuccuucucuggugccauuucuucuuccuucuccgagcaugucucuagcccuuaacugagucccacuuuccuuugaggaacugagucccaacaugcagcugggcuccacccagccucucccuggaaggagacucagauuccuauacaucugcaugaguguaggagacacaguccugaagcauccuguccugcaucuuccccucaaggcucugaguaaaacucacccaucacccaacauuuccccagccguacucacaugucuuacagcagccauuaggcauguaugugauggagcccugaagagaaaggagaguaagaaaggaguccagagcacccccagcaagugagugccccuucuugucaugggaugcauaagggcuguccuacaggaggguguggaacaagcccccuggaaaccagguagcuggugcauuaagguucccugcuccuggcaacgcauacauggacagggccauagggucccacucacugaaacacaaucacuuggguugaagucgggacaggugauguuggagaccgaggagaugagcugguuguugauuuucaugcagcugaagaaggugcacuuguugcugggguuuuugugaaucuccccaggcuguggacgcaacagaaugaggaugagcagguguacgccagaggccagcccaggaagaccugggaggcaaagcgccacagaaaggagguccagagucacugggcaaguggcauccguuacagucuuggagauagcuacugugguuacauaacacagaaaucucuaaccuaggucugacuugugaacuagaaagugacucugaguggggaaaugaucuuugaaaagcucaagaaaauaaucuggauaugaggucacccuacaugaaggagguccuagcuccaggaaugaguauccuuauaagagacagaagaggaggcacaggcucagauagaaggacacuacuacaucagaggugauucaaacacaaaccaaaauuggcuggagcccaaagaagaggcaggaaggacuccucacagcaucugccagccuugaucuuacacuucagagcuccagaaguggagcaaccauauauguugcuuuuagccacccaaauaugcuaugugggauuuaggaugacucaagcccgaagucauccuagccuugcccucaguggcugccuagcuuguggguggagccagaagcgcacacaccuucagaauaauguacugcugcuugggccccucgaugaugcaaugggucugcuggcacuucuugcaacauuccccagggacguccacaagcucaaagcccugugaacacaggagaagaugaagcugagaucaaagacuugucccugcacccaaccagaccguggaaucgguagaaugccucacccagggggaggcuguguaugaacaagugccauggugggaguagauacaggcccaguuuggcaagagagguuuaagaaaacuuaaaaaucauguaaaugaacaugaaaccaugugucuuuuagaagaugggaagaggguaaacugaggccggcagugggagaaaagaggaggagccacacuuacagagcugcaggagauguuacagggcacauggguacaggagaugacguugagcugggugcuguuguccaagauguugguacauacacaguccuggcacuuguuggaauacacuggagauccgggcuuuugggaaaaggcagaaguaagggagcugcacgcaccaucaugcaugcauuacuccaucuucagacaagggcaacgacacccauccucccuguccccucccagcucagaacucaccugguauucagcauucuggugcacacacacacccuugggcacuuggaagaaagaguggggaaagccaucagagguuauccugagccucagccuggcauacacaucugaguagaugcucagggcugauggguacacagccauagccaugacaaggaagcccaaggagagagcauguucccuccacuggacccuuguucacagccugccccgcccaugaccuucccuuaccccgcuggccucacuuaccacaggaauaaacuggacagcauuucccgggcacaaucucggucuucacuucgaaucccaacaaacauguggggcguucagcuuugcaucguuuggugucacacucugaaggcagaguaggaguguggugaccaagauggaucccauagguagagaaccucucccccauuguacagcauggguccaggccucuguagagccuaccaggaccaggcccugcaacagggacucuuggucugauccagcagccacuaccaucaccucuccaguaagcagaaccugagcucaccaacgagggaguggcagacagccuaagccucagugggcauguuugacucacuaggaacaugagucccaguggucugagaaggacucccgugcccuggggguggccuuacuacaugaggugauauugcagcacuugucaucuggguuggucucuacaacgagguaggugccauccuccucacauguggucugguugccaccagaacauuucuuugguuggcacacaaugccacuuccacccucccggcaaacacaguccuugcagucaaacucaaagugcucuccaaacugcaaagaggaaagauuagauaagcaccaggcuauccauauggucagacagggagaaaauggcuggaccagguaaccaggugagaaagugagcuuucucaaaugaaagguucagggacagaccagcaacuguucauucaagggcacugauaucacacagaugugaccugcucaccaguccccaccaguaucugccugagaugcagcagauugccuauugaagguauuucuauugagcuaaagaguccaccaaugccugugagcauauacgggaaucaacacugaaguagccaaugugccaucucauauuuagacagaguauuauaugacugguggguagauggguggauacaugaauggauagucucauggauggguggaugauuggauagauagaaggauggauggauggauguuggauuggugguugguugcauggauaaugguaguuggaugguuagauggaugaauagaugauagaugaguggauggugguggaagggauggauauaugauggguaggcuuuuggauggguagaugauggauagauggcuugauggguggaugaugaauggauggauggagaguggguaaguggaugaaugaacaaaagauagguaagauacauggaugauagaugggauaguuagauggaugaauaacagaugaguagauggaggaugaaugguucauuuggguggguggguggaucgauggguauagaauaggugggugaauggugaauaaaugaauggcugaguggaugauggauggaugaaggauagauuaaugggugaauggauggauuuauggacugauggcuaauggauggguaauugaauggauauauaauacauacauaauuggauguaugagcagauguaugacuugaguggauauacagauagaugugaguggguggguggguagauggguguugggugcauaguagguggagagaugaaagauaaaugagugguggguaggugauuaccugauagguaauggauagguauacagaagcauaguauggauggauggauggauggauggauggauggauggauggauggauggauggauggauggauggauggauggauggguggaugggugaguggauggauggauggauggauggauggauggauggauggauggauggguggauggauggauggauggauggauggauggauggauggauggauggguggguggauggauggauggauggauggauggauggauggauggguggguggauggauggauggauggauggguauuggguagauugauggguggucagauugaaaauggauaggcaaguggauggauggguggauggauaaauagaugauaauacauuguuaauuguauugauagaugacuggacaaugaauugauggagagaugcaccaaugagcaggaggaugaguggaggaaucucaccuacuaggacuuacauggcucaugacucaguccuugagccucccaggcugucauauucacucugccccacucauuccccaaagcucaggauuuuagggagaauucuccuagcucaagggggaaccuaccucucugggcacauugucaggucccacacauccuagaaagagagaggaaacaaacucuguuaacacugucaugauauuuuagggaacuaggaucagccuccuagcuuugccucuauguacacagaggaaacaggaguggggugauggagguaggagcauaccacaugucuucacacagacgucauagccaggggcaaacuuuguggugccuucaggacagaagcagccuuccaccaagaguguggaauucugagaggagcuagaacggcaagacacaugcucagaaggaaggagugacagacucugggacacagcucugggaagagagcuaaaacuggcugggaugugugagcaggacuaggaaccagcaggaaucuucgggcagcauaccugggcuggcagguggguucuucuucagggccacaggccugauacugcuugugaggugggcacuucacagcugugggggagggacaagaauaaggaaggucacaucaaggaagccuaucccuccguguagugacagagcuacccagcccuucucacucaggacuucagcccauggcagcagagaauggguaacugcccaguacccuugccugacccacaggccccagcacagugcagucagugggaaaggaugagaggcacuuacagcagacucccugggugugguuccgccagucaaugcagacaccuuccuuggcacagaggguggcauaggccuguacacuggcacacuccauauuagagccaggcacauagcagcuaucaaacaggcaagcuucauaguagugcuugggaggcacgaaggcguggcacugggagaauaggcuaugcagggagagaugggucacauuguggucagcaccaaagccucuccacaugcucucccagcgcccccccccccugccgccgcccuacuggagccuauucagaggcgacugccaaagacacacuaugguuaacagcugcagaagauaggaagggcuggccucuaagaaaggaaggacaugugucuguuucgucagacauguagagauguacaaugcacaccucaauagucacuaguugccaggauguucccuuccaacaauccuagcagagccucaccuagcuuugaccucacccuaacaucuccagggacaggggacauccuccuguggcuccaagauuuaggagucccugaccuguguccaaucccaaaccugccuucccgagaugcugcauucuggucaguuaaucuauagcucagugaaccugcaccuagccaggaggugagaaaugucugagagcaaagaaggaugcugggguauggagugucagagaauaguuagggccuggggagacagaauccaaguccugugacccaacacccauccacagcgacauaaccucagaucuuccagacccacacagaggcugcucuucgccuacuuaguagacagcaggggcaguagagauaagaccucaaaaaacugauuugguuugguuugguuugguucgguuugguuuuuuuuuuagacgguguuucauuugccuaggcuugcccugauccucuugccucuacuucuccacuucccacaggucaccuguccaugaugagguggcagacaggagacacagugcaguuauuaagcgaaagcccuggugucgugguggccggacgcuugguggugaggccuuuguggggacaguguggcuuggaggggucauucaccaaccacucgucagcagcaauuucacagucagagaugaucuucccacugggcaggauacagucaucugcaguauuguuggugcaggugccugugugcagagaagccaccuaucaggccagcaucaagcccuggcacuucuccaguccaggcucugugugucccacugguuggacacugaaagcaaagccaaggccaaggcaacaucugcugccuucuuacagggaccaaacacaagacauugccacagugacuguccacagaggaaagauaacccucauccgggcgacugacaggggcucacacccagucuugcccucccugggugacaggggcucacacccagucuugcccuccaaggaaagaggugccaggaguggggacucaccacacuggcccuuuguguuguugccaaacaguuuguagggcagccggauggagaaagaaaggccauuguaggagaucuuggcuucuagccuggagauguucaccacaauguugaugccagacucguauaccuccagcccauacuucuuguagggcaaagccacuaacugcuuguucaccuguaccuguagucaacaugucugagucagcgaaggccccugagacaggagcuaaagccugccaccuguuagaguauugccaggcucugcccugucccucuauagaccucucuggaagccauagagaugaucaggaaggcaagguugcaccuugggauagcaccagugauaucuccacuucuauucaaaaaggggagauuuuccugucccuccaucuuucucuucccuucuuguuuccuuucuaccauacugaccuuugucccagcucaucccacaagagcccaagaagacucuuccagagacuuugaggcuccaugagagggucagggcuccucagcuguuuccauaaacaucaccaaugaccccaguggauagagaagacagcuagacacagucaccuccuauucacccauccucagagagggaguuucugugcucauguagagagcucaugagaagagcugacaggacccuaaggagccccaacaacaugccauggcuccagucugguccaauggaugugcagccuaguccuaguccucuguugccgguggcccacagucuaaggccauuacagacacacugugaaugcccagccagucccagccacauaccuccaccucaaugggcaucauccucacggucuugaucuguacuuccugggucucguggcgcacaauaagugugcgggggcaggacaccuugucauuggcaucacagugguaguugucaauguagaccccaaaguuguccacuguggggguaaucuccuccaccagcacauagguacaguuacccugguaacuguaguagagcccaucgaaggugacaaaguguggguccccccagccagugcaguagccugugggaaaaguuccauaaauugacaucacugagccagaaccacuggaaucaagucauugucaggauucaagggauaggcuauaaaaaacuaucaauaauuaaagaagucuuaaaagacccagucccuagauugagccacuaaugacauccaagcuggagcagaucuuccaaaagcaucuucccauuugguccagagaucuccuucugcagagugaguccuugcuuuaaagccaggucaaucccauccucagaagcauccuugcucugaaacaugccuugcuccaccaggcaaggcuucuaccugcccaggcuccuacucagaaacauaaaggguguugggaaauaccuaagacuaugugccuagccuucagcaggugcuuaacaauuaaggucuguccccaagaggcugcccuugcaaccaccaauacaaagaagaaagguggaucccccagauagcuaaaggccuuacagucacauucccagugccagcagcaguuaucagcaucaggaacacgcacagguuugaggccauuggcacaggugggcaugggugggggaucgcacuucagcggcacaaucuccacuacguugucaugauugcaaauagccauaguacaguuacacagccaccaggucucauuaaccugcaggagagauaguguggaacaaucaacaugcagcuuaacuuagcuuccccagucuacacaggaggacacacacagucuacacccaggacacucucagagcuggggcugagggcagcuaagauuaggacauggaaaggcaggguaugguuaaaaagagaggacaacagaaccugugcccaugauguuuugggaaacauuaaccccacuguucagugcuaugguaacaaagccacauacugcccacugaccugucugggaggaucaaaaucugggcacccauagggggugguuuugguuggugugcugagugucgacuugggcgauguggauugggguguagaggguguagacuuggaagacgugguagaugguguggucgucugggaggguguugguguugguguugaggguguaggaguugagggaguagauggacaggaccaauugaagaacuggagauggcaguccagagagcaguuuacauagaaacaggugcccccauggguacuguuguagaccaguucaccuacaagggaagagaaagacacagucuuuacacuaucuagaaacagagcuggccacuagaacacacugauagacgcccauggaggucuggggagggacucaguauacugggggagggaccuuaggggagauaacuaggguuaggugagguaugacagugaucccccuagcauaguauuaguggcauucgaagaaaagagagacccagagccagcacauuugugccauuucgccaccugguaccuguuuugaugcagaugaagaacucaucagauuccagugccauauuccuguacuuccuagucuccaaaacugccagcuaaacaacccucuauuauuuauaaaccaucuggccuuaaguguuuuguuacaacagaaaauggacuaagccccaccucuacuuguucuccaagccuuggaagagcucugacuucugguuuauguucguaacaacgugaagcuggccacaaaagccuaccuaugaccaaccuccagccuucacccuccuaaucaagcuucaagugggggucugacccuggaucuacccacugguaagagcagggacaagccucagcuuugugaacauuaaacaugaacaccauaaauaccugggccguagaacaucucauucaaaacacagcagguaaccuguguuucaguguggguccagacagugcugggagaggugauuggggaggucgaagagaaugucccccaagacgagguccugguggucuccaaaguaguuggugugguugauaagggucuugucugagugguaguuuccguuggaacagugaaggauguagggguagauguggaggguggucuun

SEQ ID NO: 4202 - RNA, 43697 nt, Mus musculus
cauaccguaaaaagaugaacugacaugaggaccccuuuuuguggcuaagaggacaucaucauaucuguaccaggguaagauguuuuaguaguguggcugcuuuuggggucacccacacuccuggaacuuaucacccgugcucuauaagugagcccaauaaacucaaagguucaccaaccuggacucugguuggcucauacuuugguuugucauuuguauucuaugagggcagggcagacaguugcuuacaucucuccagggaaagaauucuuguaacaccccuccacugaaggggcucacaaagaggcauagggggggauaaaggaaaaaaauuacacacgcauugguuacuuuucuguugcuaugauaaaacacugugaccuaagcaauuuaaugaagagagaguuuauuuuggcuucugguuccagauggguaagaguccaugauagcaaugugaaagagaauugggggugguaccauacuuugaaaccucaaagccucaacacuacuggcuacuuccuacagcaaggcugaaccuccugaaccuccccagacagcaaugccaacugggcaucaggugugcaaauuccagagucuauggggaacucaacacucacucaaaccaccucaauuugccuccaaauacugcuacauguugagguguuaggagccaggguuucagcacacagauuuggggcagacaugacugacucauucugugacauggcguuguugagacuaccagccucagaaaccuaagugccaaaacagaggagcaauucugcuggggagggugggacuuccgaggcuucccagagacacaagagaaagcagggacaguuuuguguuagaaguggucagguaugauagugcuaucguucaaaucugggcuuugguggaugaagcuggaccaagucacuaaacggaauauuuauccacagcuugaaggacaggcagcagagaaugacauugaacucaugaguuuccugcugcuaccuccgcagugcugggauuacaagugugugccccuaugcacagcucuuuucuguccacaucuuuugcccauuuggcuaagcuguugauuuucuuguuauuggguauaaggaauucuugguacauucugcauaaaaauccuuuaucugauugguaauuugcaaauauuuucuugucccuggaugucuuuuuauucucuuuaacuuuuaaaaauuugaauuuguuuguuuauuuauuugugugugugucuguuguaacugugucccacagcauauguguguggaggucaaaugacaacuucuguuaggcaauuguuuuccaccaugugggccuuggggauugaacucaggucaucauguuuagcaguaagcaccuuuaccugcugagccaucuggucagccuugauaguauuauaaauuguauccauaaguuuaauuucugaauauuacugcuauagaaauacaacauaauuuuuacuuuucuugaaaucugguaauugguaaaauucacuaauuauuccuaauaacuuugguaggcuuuuccaugcauguucuugucugugaaacugcaccugucauuuuucagcugggaugccugguauuucauuuccuuacuuuucuguguuuccgaaauaaaggcgacagaaguggcauucgcaggaugcuccagguccugggagcacucucagggugacccucaaccugggagcacuguccuucauccucuggcaccugcuuuguuuguugcucaguggguacuuuucucucuguccuccuaggcucuuucugcaucccuuuagcugaugcuccuccuuccuucaguggguuaugugagagacucacugagagaugcuuuuagaugaaaaucaccuggcgccccugaggaagaugcugcugcccuggguucaugcucuggcuuuauauagauugauacuugcauuuuuaacacugauuucgguuucuaaagauuuguuuauuuuuuuuuuuguaugaguggcuugcuuucaugacuauaugaacaaucuaugcauaccugguguuuucaaaggccagaagagaggauacccuggaacuggaaugaaaaguaacugugagugggugcugggagccaaauccaggucuuugguguuuuuaacugcugagucauaucuccagccccacaugcuuuuguuuuguuuuguuuuguuuuguuuuuugcuugagacagggucucacuauguagcucugccuggccuggaauucacuagguagacaaggcugaacucucugagauccaccugcuucugccuccuacaggcugggauuaaagguguaugauaccacauccagacaguuuugguucaaaacuuuugucuagccagcugcaguacagcauuuggaaaucugaggcaagcagaggccaaccugaaauagaccacaagaaauagaccacaggaaagaccuggaaagcaaaacaagaccuuaucucaaaaaaacaauagcuuuacaucuagguuuacaagccaagcuggcuugcuggcuucauaguguggauuagaauguguucucucuacuauauucugcggaaccgauguucuuucuaaacuguuucuagaacuuaccaggagaaccauuugagccugagguuucucaguggaaacguuuuauuuagacuucuuuaauaagcaagggcuaacuguucagguugucaauuuccccucugggaaaacuuuagucauuugcuucauucauggauuuguuugaaccaggccugguggcacaaaccuguaaucacagcacucagaaggugcagacaggagguucaugaguucaggaccauccucagcuaucuagggauuucgagacccuguuccaaaauaaagcagugacaacaaaggguuaacuucguuuugcuacauuuaaugcaaugaaagucauugcugacaucacuugugaguuugaacucuguagagcuguagugauugccuccuuguucgugccugggacuaauaacuugugucuucuggcuuuuguucccaauaugccagaugugcaucaacuccacuugucuucuuaagaugcaugauuugugaucucuucuauccccuauacauuuccucucccuaccuugcuuacuuaaaauuaauuuucuucugauaucuaaaggaaagugcugcuuucuuuucuaauauagaaacagugcugugguuuccccuaaacgcugcuucagcuucauuccacagagcauuauaggcuuuauuuucauuuacugcaaaggacugugggauuuccucucuuauuucgucucugaagcauggguuauuuggcugcauuuagucuacaaacauaaaaguuucaagaucuauuuaaaaaaaaaauccaaagauuuuauuuuauuuuaauaaauaaaugccaaggccaugaguuugguucauucccucacuagcucuuaacuuauuuaaccauuuaauuagucuaccacuugguuaguuuccucucuucaguccuggcccaccucuuucuuagcgucuuccucaucgucuuccugaguucaucuaccuguucauuuccaguuuucuccucaguccaucuccuccucuucuaggucugucaccccucuugucucucauugcccucaucgagucucucuuuuaucucuuacuauuucccagaauccucucucuuucccugccagugucccaccuccuauuuccugccucagcucauugaccagcagcuuuuuuauugauagguaauguuuauaagaaauucucucuacauuccccccuuuuaguccaauaaaagucucuuucccuugcaucaauaaauuauauacaauauuaacaauuaugaaaaacgucagguaagaauuauauuuacgaugucuaguccauuuguauuuggcaacuuugaagaaaguacucuauuaucuaucuccaugaguuagauuucuguacuuacaucauuuucuaucauaacuuguaacacuuucuaucauagcuuauaacauuuuucuaaauccuaaaaauuuaagcuuaauugugagacugucuagucuucaaccccaucagagaucugagaaguaauaaauauuaccagaguaugcaggaaguauagagcaagcagcuugcacaacuguugaaaugacagagaaagcuagcuuccuagacaguccccccaaaugucccugagucauaggagaaucauccucagccuucugucccaacgcaugacagacguuuugugaagcaggaauccugaaaggcucaccuaccuuguccuugcgaagcuuggcagucauuguccucacugagucuuguucauuccuuuuggacauuauuuugucugcaauugaugcaagggcguuucaaagauuuuuguuuuauuuuuaguuguguguauaugagcaugucucuguguggguaugugugugaguacaguguccaaggaggccacaaaagguuacaaacaauugugaacuaccugucaugggugcugugaacagaacugggauucuuuguaagagcagcaaacauucucaaccucuugagccauuucuugcacccccagauuucucucuuguuucaaguuuaacucuaguuuuaccagaaaucauacuuuuuauuauuuuaauaaauucagacuuguuuucuggucuaaaauauagccuguucuuguaaauguaugauaugcaacuuccauauucuguuguugucuaauauaugucuuaauaaacauaauugggugauagggucuuuuacaccuucacuacauuuuuauuuuucuauugaauacuaagagagggaugaaaagaucuccagguauaauuugguauuuguuuuauuuuuuaugguuccauuuuggcuucaaguauaauuuagcucugaaacgagucaguaaacuuccaggguuauaucuucuuuuaugaaacgacccccaugccccugggaaggucccuguuucccuccugggguccuuuacaauauccugacagcuaugugagcucuugcucugccuggcaguggagagguuuuugcugccccuccugagcucagacauguuaaguccauuucuuucuggaaguagcugcaugagaugccuguauugaucuguccugagucucggagucucugcagcucucugucgauuguucucugugcagaucucuccuccaugguucuguucacugaaaauucaagccuuuuugcucuccucagcucagggaaccauggucuuugccucaguuccccuucuuuguguugcagcccagaaacucuccugacagcaaacagagacaauuacaggguucucacugcuugcugcuugucucccagggugagcuggcuuucuuccccugauaccugaugcccugaaaacugcugccuaaccuauuuuucuggauuaaaaauaaaaguaugcaaguuguucuguaaacaucugcuuuguugcuucucccugcugcacagcgucccauagugaauauccaucaccguuugcuuauucauuucucuaaagaggaauaauuaagcuaccaacuacugcuacacaaauaacggugcaacagacagucugaagugugcuccccugugagccccagugagaguguuuaccgaacagacuccaagggaacucauuaggggugucuuuugacuuccuuaggcaagccuaucaugucucagagauccuauaccgucugucucccauucagugcuuucccucucuacagcaaucaccugcacuuguuauccccacuuucuaaucguuauucugauaaacacaaguggaaucucaauguuguucaauuucuccucuuauuggugaguuugagagccccuugauguaucugggagcacuugggauuuaccuuuaugcuuucaauuuacaagagagauucauuuaacuguagcuucuuuauuccuuuugauauuucacaguuauuuauauguugugugaauaugaaucauuuauuggauuuggacauuguaaacauuucaucuuccaucucuuacccucagcuugaugcaaaugacccccaaaccacacucuucagggcuguguugcucagucacugagauaauaggcgugacagagagcaaugucuggaacacauuaaguauucaaacaugucacguaacauuuucagcguucaagaaguccacugaucuaggcaugggguuacaagccuguaaucccagccgcacuggaaaggcugaggauccugggcacaagaucagccuggacugcauagugagaaccugucuuuaaaaacagcaguagcagcaacaaaaauaaugcaaccuaaagauaugcgggaaauguaucugggcucucugaauccuuacaaacaugaaggcaccugugccacugugagccuaggcaaaaaaaaaaaaaaaaaaaaaacaaaaaaaaaacgacagaguaggcuuuugcuggcaacauagagaucaucuccuugaauguaaggcucugagcacuggcaucagaagccuaaggcguucacaggagcuacugaaguucaaguuggaauuccuuauagagucuauacuaaggacauuugguugcauuugguugaauuccuagccuucaccacacccccuuuuauaguuuucugccaaagucaccaucucugcucuccacgaugggagaguaucauccuuagucaucaggacaaggagacucucuccuuacucaccugaaugaugugauggccucuucccuauucaccuuaugagaaagucuuuuuuuuuuuuuuucuuucccaaaucaacaauggcuaggccacaagggccuauacucuaggaacuuccucaucuugugaaacucuugugcacaucccuguucauccaggaugcccgacauuccugaaaccugacucuuucacacccuuccccuucaugcuaauagugaauuagcuaauuaugucaggcugugagguugagcaauccaccaauggggugaggcacagucacugcuuggguuaggauagaaacaaggugagcuuccugccugaagcaugcuugcucaucugguuugggucuuggcucacgcuuuugcagaaguaaagauugccuuaccaaauuuacuuucacuuuguucaucuguuucuuuguacgacaccaggaauauccuuuuccaacaaccugugaagggcaacaccuucccugcucacuuggaugggguaggauuuuagugguucaucuaaacagaacaucuuacccacucaccugguugggaaaacacguccccccgucauguagggcuacauuuuuguuuacaucucuccacuccugagaaucuguggugacauauucaccacauuaggagccugugaugcuccuaaugaugcuccuaauguccuucccuaggugggaaccugccuuucuggcccaccugaguuguuuuuccucuccacgagccccaguuuuuucauguacaacaugccuuucuguccucugccaggcugccuuagucugcuggguaccucucugcugugauuggcuuacuaaguggcucuacuuucaaccuucccacuguuucccaacaccuaggcaccugcucaagccuucccaggugaaucacugcacaggugacuuccugaucauaauuuggcaaacacaaaacagacauugaauucaauaguaguuauuggaccaaccguauuaggaauugcugaucuguuuuuuaauuaaaacauuucuuguaucuauauguacaaguuauauauaacccuuuguuauauacaauauaaccuuuuaagguguuauauacauacacacacacacacaaauacauacauauaugcucuauuuccaauaaauauaagcuauuugagaaauugaauuuuagagagcaguuuguggagaauuguucaauuucaaauacgagccuuccacaaugccuuccucaacuuaaacuuuaacccaaaaguuucuuuuuuccacuaaauuguuuuuguuauguauuugucacaacgaugagaaaaaauaaaaugcauauuaacuauucuuuaaaaaccucuuagugguuggccuguuugauguuagauaaauguuuccaucuaacagaacacagcuccacaggugguaugaacgcaguaagagaaauaacucuaaugcuucccccugacccuguacagauucauucugcacauucugccauuuaccaaaagcacaaauaggcugaaauccucaaagaugucgucaugaguguauuugaauaagcuuaccugucaugcuuuggcuuugucugguccugucuuuuuucuuuuucuuucucucuccucccucccccuuuccuuccuuccugauaaggcugaucucaaacucacaguccuccucaacgauuuuuuuuuucaagagcuagaauuaccaguguguaucaccaggacuggcaacuuuaccuaaauuaaagauuuauuuauuuacuauuuuauguauuugagugaucuaucuccauauacaucugcaugugacaagagggcaucagaucacauuuuagaugguugugagccaccaugugguugcugggaacugaacuuaggauuucuggaagagcagccagcacuccuaaucgcugagccaucucuccagccccccucuuaccuaaauuaaaugucaacuaaaaaaugaggaaaauugacguuuuuauuuugccuucacugguuucuucucuguuguucuuccuuuauaugggucugaguuacugauguuaucacucaccccaucauaagaacuugcuucaguaucuuggggcugggaauauauuucagucgguauagugcuugucucccaugcaugcaaaccagguuuagauuccagcacuucaaaacacaacuaaacaaagcuaaaaggggaaugaagaacuucuuucaaugcuccuggcaggcuggguccacuguguguguucccauugccuugugaggauuuuuaaggacauagucaaccccagcauggagguggcuaugucucucgacauuucacuccauaucacugucuuauuugugccauuucuaaaacaaagcuguaaauaauugucuuugcuuucugugugaaauacuuuccucuucuuucaagaguuuuagaaaaugucucuuugguuugguuuugcauuuauccugccuaauguuuccuguaccuuucguuugacaucuaauaguaauugggaggaauucugagccggaugcuucagauguuucuucuauuccucucuuuauguacucuucucuugguauucccgucagaaguacucacaccuucucaguugcccacauagcucucuguucaucuccucuguucuagucaggccucucugcucugcuuuuuuuuuuuuuuuuuuuuuugagggcaggccuucuuaggaaaagcauagcaugugguacagguuacagcagccucccucucugccuacuaugcauuccugggaaguguuucuuagaucuucucugaaaggguucuguagagcccuuggagcugagucucuuguacuucaucaacuaggggccagguuguucugcugugguuucugcuuugcugaauuaaugauucuuuguuuucuuccgucugucucucuaguuuaucuggaaguggcauuucccuggugaccucgauucucugacauauccuuagaucggcugauuuuucuagguguuuuaucagcauauuacugugguugcuaggacagaguguccccauuaauuaucuuuuugagcaugccaucuguuuccuacugggaucccgacuaacacaguaauugguagcagaaguggucccaggaaacagacuuuuggagugggauucuaguacagagagaugagcacauggguauccuugcuggagcgagugaaacauugggaguugguaucacauggggacaaacucccuucagugauggcaagggacugccauagcagaaggauaauggaguagauaagagcuaaggcacuucguuguuaugauaguagaugucuacugaagagaaugggauggccauuugugucauuucugggagcuauacacacaggacuuggcauuuccagccuuggguaugccagaaaccucuggccaaagguuuguuuguuuguuuuuugagacaggguuucucuguguagccuuggcuguccuggaacucacucuguagaccaagcuggccucgaacucagaaauccaccugccucugccucccaagugcugggauuaaaggcaugcgccaccacugcccauggccaaagacuucuaagagcacaccuccagacaaacaaagcgguucauggcucacuuuuuuacaggagaacccagaucauagaaauugcagaguggcuuuaagagagcaguauagugagcuaacaagaugucucagcuaguaaaggugccugcguccaagcacaaucugaguuugauccccagaaccagugugguagaagaagagaaccaauucuuauaagcugcuguucucugacacauggccauaugcaguauggcaagcaucacucacagauaaacacugcuguggaauagauuuucccuugggagaucacacacacacacacacacacacacacacacacacacacaccccucugcuugcaccagaaaaagaacccaauagagaccacaguuacaauugaaauaaaguccaauuuggugagcugaugaguucuuauugagguuacuuacagcaauauaggugauggauuaguuacaaggaucaaagaugacucaaaagcaauugcauuacugaaaagcccaccccaacacaaaggaugcagucuuggagcucucugcauaacuugcagguagcgcaauaguccaagaauccucuucucuuuccauugcagcucaacugguaagagucuccucucccagaagcuacuuaguccuuuuaauacugcuggggaugaaauguaagaauaaaguuucuauuuucccagauauaggaccuagauauaggaccuccuaaggcucaugagagaauguuuuaagucauaaaagugucauacaacauacaagcaugcaaguacacacacaaaauaaauaaaauauaacaaauaacaaagauaugagaaacucuuuuuuuuuugucaaaaguagucaucccaauaaacuucgcuguuucccagaauucccuuuuccccuuugaaucuauuagcuaaucuaacaauggauuaaucuucaugucaagaauaaaagacagccaggugugguggcgcacgccuuuaaucccagcacucgggagucagaggcaggccgauuucugaguucgaggccauccuggucuacaaagugaguuccaggacagccaaggcuauacagagaaacccugucucuaaaaaacaaaaacaaaaccaaacaaacaaaaagaauaaaagacagaugucauuuugguaagugcauucaguaucccugauuggguucuggcacacucuuuuugcaaaaagaaaucaccuugccaaauucuuucacucuguucauguguuucuuugugcaacaccaagauuguucuauucccaauaaaaaagacaacauaggaacauaugggagaggguuuaggaagugggauuuugucuggauuggaugaugcuagggagaagaggcaagucuauuacuagacuucuagaaauucuuauguagacagaacaauaugaggcugagguuagucuggccccauagcugucauacuagguaggacuggaggccugcuuauuugguucagaugguauucuaauugcuuucuauugcaaugauaaacaccaugaccaaaagcaaccugagaaggaaagaguuuauuuggcuuacauguuacucgaacauugaaagaauccaaaacaggaacucaagcagaauagggaucuauaaggcaggaacugaaucagaaggcacggagaaacacugcuuaccgccuugcuguccagggcuugcuaaguuugcuuucuuauccaacccaagacuuacccacaguaggcugcccccucccacacacuaucaacaauugauggagaaaaugucccauagauuugccuguaggccaaucagauggaaguauuuuuucaguugaggauccuguuugccagaugacuuuagcuucugucaaguugaccaccaccaacaaucacaaccacaaaacccaccaguacaaacaguauucagacuguucuccuguuuuugccuaauguucacacaguggccuugcucagcuaaccuguucaugguuuggcaaaauaccagagugaggacagcagacuaugugcccaaagcuaccaaauauuguguugaauccuggcuuuucaggcugugcccuagguaacuccaccuacaaucagcauuuggcuucaucuugaguguaaauggacaggggggaaaaagcucuccacuuguugagcacacagacaauacuaccuguccagcaccaucuauaacacagacugaaaaucacuuguuugugcaaguaaaagaguaccaccuaugaauuuaucaaaguggauuguggacacauggguguauuaaaauagcagaagagagaacuggagagaugaaucagugguaaaagagcacucgcuguucuuucagaggaucuggguucuauuccaagcauucacacuauggcucaaaacuguaacucuaauaccagaagacccaaugccuuuuuuucuggcuuucucaggcaucagguguacaugaggugcacagacauacauucaggcaaacacacauagacacacacacagaaacacacacacagccuauagacuuacugaauauacuagacuaacaaaggaugcacucccucacccccccccuguuggaaauaauauaauaaaaggucaagaugugaaaauaaagcaguuauuuggaacuucaaagccugggucaaauagcucacuuccuccaccuccuaaaguuucagcaauccuccacuuccuaaggguuuagcaaucuuccaaaacaagaccaccaacuggggaccaaaugucuuuuuuuuuuuuuuuuccaagacaggguuucucucuauagcccacacuguccuggaacucacuuuauagaccaggcuggccucgaacucagaaaugcgccugccuccgccucccgugugcugggauuaauguuuuaagcacaugagcucacggggaguauuucacaacaauggguauguggacaaucauguuacuuccaacuucuuucuuucuucuuuuaguuuuuacucuuuuuucuuauaaauuugucaagcuuuuuaauacauugagauuagcaacccugccagauacauaggagguguuuugucacuuuuaaaauuauugagguaaaaguuguauacaugacaacgcacagaucacaaguacaagauggguuuugacaaucuuuuuuuuucuuuuaaagaauuauuuauuuuauguaugugagaacacuguagcucucuucagacacaccagaaaagggcauuagaucccauuacagaugguugugagccaccaugugguugcuggaaacugaacucaggaccucuggaagagcagucagugcuuuuaaccacugagccaucucucuagccugcguuuugacuacuaccaguuaucagaugauuggaucuaacaaaagaaauaggaccaaacccuguaugauggacaacaugggcaaagcuuuguugagacuucaacucaugagcagagggacuuaaugccaguugaagaggugaccaggcugcucacucaacuaaaguggcagcaggcuuuuauugauuguuuuuccugggaaagacuaaaguuugguaauuuuucgauguccaugggcauguuuuccuucuugugaaaaaguauucuggccuucgaauuuacuuaguugauuuaaucuaggaaauuuuaaguuacguuuagaacugguaucagugucuugcuuaaacauccuggccuugugauuuggucugagccuuaaaaggucauagaaccucagauaauuaagucacuaugcuuggcaagaggaagcacauaccugcuccaauguccaaguuagcccuguggucuuggacauaacugcuuuucacccuuugguuuguagaccaggcuggccucaauuucccaguccugcucccaucucagccuccuaaugaucgggauuauagauaugugccacuguacccagcaacaacacauuucucagaguuucugugugucuccauacagaguugaguagcaucuuguggcaguugagcccauaggcucacauuggauuaauugauccucagugguguauuugagaaggguuaggagguguggccuuguuggaggagguaugucacuagggaaagacuuugagguuucaaaagacugaucccaauccuaauaugucucugucuccugcuugccucucagugguugcuccagccaccugcuaucucugcuccaccaucauggacucuaaccuucugaaaccauaagucuaaauuaaacucuucuguaaguuaccuuggucuuaucccaucaauagaaaagcacuacaaauccgagucaagagugaaggcaacaaaggggacaaauacaagaugaugaacacagagaugcuaagccuuucauccauuuucuguuacccauaaccucucugcugaguggagucaguacuagcagcagagcuaguuuucaaguuucugcaaaguaaccuaggugaauuuuaucauaguccaccuauaccagaguuucuaucugcugcaaaucuaguagaaacaaguaagauuauguccagccacgugauccccaccaugagagagcuuuaagucaaggaagaacaaaugcugugguucugcucugacagacugugccagggcuugaacugauuucaggaacguacugaagcauuuuaugagauaaaguuuuuucuugggaacaauucccccuugguguuguuggugguggugugugucuuuuuuaaacugcuuaguacugaaggauuugggauucaucagaggccauauguguggucuuagucacaaggggauccuauugugcuauccagauauaauuuuauacaacagguugucugcugcauguuuagacacaagucacagguuuugucuauaaccaagaagaaaggauugagcagggauguggacaccaggagagaucaggggucucuuuaaaacucugucugccacaauggauagucuuuugugucuuagcuuuaucagcauagagaugacaguuugggcaacaggagcuagagaccggugagaacuggauauagaucaguguccaggaacagagcccagaugcagucccauguuaugccaagguagagacugucacuagaguuggaagauguaaucuuaaagaugaaaggaacacaagagaacauggugugagugaggaaauguucuugguacuccuagacaguaccaagucuauugccgcacaaguaaaaggggaccuacagacuggugaccaccauaggguaaacuccuuauaggaacuacccugguucuaucuggccaaguauucuucugaagagagugcucugaaaaggcaagaguggguggcccggguuuccuagggacagaucuucaucucuccauucauuuagcaaauccaaggcugguggaaguuuuccgucccacucuugucucuccuucagcuugguuucuucuuuuaaaauuuaaauauaaauguucucccucccacagaauuuugagguaauucaagagcuugaggguagcugguucuacugccaucuguuuuuuuuuucgcucaggcagccaaaccucaguuuucuccaagcggaucacgcaccugcaagcggugguaucacagcuaucuccaguuaggugacuagacgcuguggcaacucgaccgaauugagaugugcgucccuguucuagguguaugcgacugggugagcaggcuucugcccgcaggagaguguucagguuuaggcaugcgcaaacagucugacagccauuuuaacgggcugcugagcgcccgaagggagccacugcgcaggcguguacgggagacccauuucccccugaggucggaacacgcgugcgcggauuagccggaaggggcggggccagcuauugccaagcucugugcuuugggaacgccgggguggggcggggcggggcgacugucagcugacugaagagccgauugccucgcgggacaacggucggcgacgcagcuuguggugggagcggaagagcucucccggcgggucucugugcaguuggcgaggcagagggccgccgcagcaccauggcgaccaccgucagcacgcagcgcgggccggugagugcucugggccagagccuggcuggggcaguggagccuggggucggacuccucagucuuuuacggggccccucgcggguugcucuuccgucccggggcuucgcggguccuaccuucggguacccacccggagcagcgacucucgucuaucggacaucugggguggaggaaggcagaauuugaugguuccccagaugcccacgggcccugaagcuccuggccuccuucauggagagggauccugacucccgugguccuccuggguggaggcccugaauaggguuccucuacacagaagaaaccuuaccccauugguccccagauggagugggaccccgacuucccuuaguuccucagauagaaagggcccugaaccccuuacguucucagaucuaucaccugcuuggucucccagauggacacaagcccugacucuuggucucccagauugagagugguacugacuacauuaauuucccaaacugagaggugccuugguuccccgucucucagaggaguggagucggacaccuuuggucccccaaaggagagagauaaccuggucuccuugguuucagaaauggugaaagaucccacuuuguagucuguccuuacuugugacaguuuccucuucucccuaacaucuauagaaaauaggguacuaccucuugagcuuaguuaguggcuaccuuuucaagccucaauuucuucauuuauaaacgaggagaggggagcagagaacuuggaagacccaacaggguugucucuucaggauugucuuggguucuauuauacuaccugucucaccuccccuaguguguauggccucccaguagcucccugagacuggugugggugggauguuguuagccaacuguggcuguguggaguagaacauuguucugaucagcaccucagugccuuuuccccugaaguuaauauugagugugccugcaaagccugugguuucccagaguuuuuucacccugacagcuugguguugauugugugugugugugugcguguguguguguguguguguguguguguguguguguguaacagguaacuccuugggauagauuacugauuuccugacuuugaagaaagccucaggcuuguuagaugcuuuuuaggagggcuuugaagccagaucuccugagccacugucaaacuuggauggagauuuccaauguuggaguuacuuucauguucaucaacccuucuucauccucacggugucucagcaaacuauagaagauugaugguggcugccagaggagaaagggagacagagcuuugcccuuuucauauccccugccaaguggacacauggccaaggagaguggacccuuucuuaccguguggucugagaguguccuuaucucuugugguucaggcugaguuugaauucaucugauggugaacuccaugucugucaugaguaagaagcuaucuuucccuguugcuuagagaaacucugguguuguacagagcugcaauaaccuacacagugaugaguaauugggagugucagaugauguugauacuagcagaaucuguggagucaaauccugacguuugaucuuucuacuugcccagaguuccugggagaauguagucauagaaauacaacauagacagcugagugguuuuagguuuucaugacuuguaacuuugggcuguaagaacuugucauaagugacggguaucucaagguuuauuugggauaugcauaucuucaucauaguauuaguggucacaauauuuagaguaacuggacacugagccacagguguggagcacagggacacagcuaugcaucguaacuuauguaagccagagaaugacagucaccaucagaucugugcucuuuccagugacuugaugugggaggacugcaugggccauagccagggucucuguagaauagaaggccuugaacuucaucugggaagugcuauuucuuagagugcagaccuuuuucaguuuucaacuuuucacuggccacuucaccuggaaugauauacucaucuaccucuggauucacuaauauuugaaaagcuuuuagccaguugucaaggucuaguagaacugccagagugugguaugcuucucugcuauucauaucacacucaggguuguaugaacccuaagugaaccaagugcugcuucuaaacagaugaagugcaugcauuuggucagugcuggguccugcaagcagccuucuuuguguaguccaaccgggauuagaccauggcccagugucuccauccuaugaaccuggacuuaggcuugggcaguugacucuguagcugaccuuuaccucugaggaguggaaaggacugacaagaguaucuuggcaggcuauaaaaggcagaggacaaucucaucagggugaggagggcucucuguccuugguuaaggguuuaggugggcagguaugaggacagauagccgcaccuacaugguuguaaaggaauaaguucuucccugggauauguggucuuuuauaguuuuagacuuuaggguguuuuuuuuuuuuucgugggugggggguuaaaaauagccacugcagggcacugaacccuaugcuauaucuauauugcuuuugaaaaugcugguauuuugaaauuaccaacccuuuuugcuacuaaguccauaaacccacuccuucccuacagugagugacuuguaggauccaacuucuuguggggauacauguaggaggucuugcucccuggaggcugcaccacauguagggcuggcauuuugaagguucuccuuuauagauguguuguguagagucccacagguucugccuuguccugugugagaugcugguuaaccagugagcuuugccagagaccacugacucuggcuuugccccuccucauucugugggugguccuuaguguccaugccuugcugaaccaaugacuugauuagugauggcaaagugauuuuuuuuuuaauuuguagauuacuuuguauguaugaauauuuccccuguguauauguauguauaccaugugcauucuuggggcccauggaagucaggagaggggucagauuccccagaacuggagauacacauaguucugaaccauguaggugcuagaaauugaacccagguucucuggaagagcagccacugcacuuaaccacugaaacaucucuccagccccaaaagagucauuuuuaauuuguucauauguucuguacuugguaacuggaucuccuguuaaagauaagcuuuucucaucacccagaggugccuggguuguuuaguuucuaaaguacaguaaaaugaggcuucuaauuuucuaguaauggagaagggauuugaguuccuuaggauguaugucagauuuauuuauuuauuuauuuauuuauuauuuauuuauuuacuuauuaguguuacuauauaccuguaguuuucaaaccuccugugugaguuagcauccucuugucuauacaucuucacagggcagaaccugagcaagagguugugcuccccagcuggccacuaggccuaugucucuggguccuugagaaugucugcucuggauucugaggugaggcuauaccugaguauaagucuaacaucaggcuguggugaccagauagugaccucuauuggcuucuugccuuuuuauuuuaugcaauuuuguaacuacucuguuuuuccuuuuaaaaaauauuuacaggguuuuucuuucuuucguuuauguuuugacuuuacauuuuauucaacauuuauguuuaggaggagucuacccacaacaacauauagcuguguccuuaaaagucaaaucuaagaaguacagguuucuauugaaaccuauuuuauuuuauauggcauaaauauauacacauuuaacacuuuaaggcuugcauuuguuuugauucauuaaauaguuuuuaauguguguaauuaguaguaaucauauuuuugaaaauguauuuaauaaguaguaaauucuuuaccaguuugguaaauguaugguuuauuucuuuucucuugggaguuaccccaggaauuuuaacacacagucuugcagaucuaaaguugguugugucucugugguccccagucugugcaaagaccauaguugguggugacccgguggucccaucccaccuggugugguugugccauauaugaugguuccccuuccuuugagcaguagcauuuuugucagugcuuguucagaucugagaugugaaucuucuuccucaucccccugugucuguucaucagggucuuggcugugcuuucaagcuguucuuuuagaacucuugaguguaguuccugagggcuguguggaguggcacucaguccacugcaugccugcccugcugucaucucgucacuccuuuacuagucuuccauucuuuggaguuucaguauaaaccacugaaagccuuucaagugcaguuuccauccugacugagggccgaucgccauauauugaacaauauagaacuguugucagggcucaugaggaugcgccagauuuaugcauggagagugcaacaggcccagcucauggaaauaccaugaacuaguaagaugcuagguccuuaugaauuguuuuucauuuuucagaaaacauauuucugugaucgaauccuuuucugauacuauuuugcuuugacaccagagaggcagaagagcuggguucaggugguugugaaguugccagguaccuaugaaggccaauaggacuggcugcagugacuguggggagagagcagcagcuaguuuugugcauaggaaucccugugaucacuggcucuggaaggcaucaggcaguagauccaccucugcccagcugccagauacucuaaacuaugaacugcugcugcuuuaggauucuuccuugcucccguuagccuugcagugccagagccucacacacauggaugcaugcaugcaacucacauacuuguaugcacacucaccuguagaaguaacugugucgcugccuaucuuuuuugcugaacucuagacuagcaccuucuugaguuccuacagugucccagacaugcuagcagauagguucucugugcugggcaggccagaugccuuuggacaaccccuaggagagacaucuagcuucucuguagauagggaagucccaugggcugugcugcagauucuaaauucauuagauucauuaugugugcccucauuuacuagauuuguccgccuguuccuaguuugaguugcccucaaaugcuacacagagccaaggcugaagccuacugugcccugccuacuugucccccuuuuuuuggucaggguccuagggauuccuuucauucuuuuagggacacagaaauaucucauucuuuuugccaguugugagucugggccacagagaugcuuugcuugguggcucuuccuuuguccugggccugaaggaaccagcauacuuaugcuauguucuugcagcuuugccaugggacccgugccuggaauugaauuuguuggcucuuaaccaacauguuugaagucauuuguuaguauucaucuuauacucuuagauaaacugcaaaaaagaucuacugugagucuguuaacagaaucaucauuuaauuuuucugagucuuuaagccaugauaaaaauuuauuucauguggccaauauauggcaaaaauuucauccaccaguauauggcaaaaauacaucuuaggauuagcccuguauuuuaaaacuuuacuaaaaauagcuguuuauugaugguauuuucuagugcugucagugacuuuauagaauuugcaccaaugccugaauucaucucuuguuuugaaguauuccucacuaugcuaacaguggugacuccuuuagguauagcaagagguguccucauuuagacaacucaucagggaccugcagcaacaggcaggcuugucuuucccucccaggacagagaguauugguuguauaaccaccuuguuuaucuggcucaggcuuacgucuuuccuacucucccugcucccucuuuagguuaaggugaaacuuuuucuaguaaaauugugacuugagaaaagcuauagaaaaaaguucucaucucauuuuccuugaugucauauucacggaccaaugucacugccacgaaacuggcuucaguccauguucuacauucagcuuguucagcuuguucccuucacugcuaugggcuccucccaguaccuugccuugccuuugaccacaucucaggcuuccuuguuuuuuuguuuuuguuuuguuuuuugagaaagaacauuguugaggguguuguagaacauccuuggcuuagaugaagucucaccuagcuaagucagaauggguuagcuuucucuaccacaauguugcuuuucuacucuucauuaacacuguuaaauucacaauguuaaaacuuuccuuuccuauuuauaauuuuaugguuagaucuuuauugaaaaauagcacauuugaauuagagcauugugcaugcugggcaaauguucuacugcagagcucuacuucaauccuauccacauuuuaucuuaaucucaccccaccccagcagucucuaucucuuuaaugaaagccuggaagaguauaauaggaaaucucaaugucugaaguuucuagucccaagaagagaaugauaagauacaaaguaaaaaacagcccugacuugucccacauagucuuuccugaccuccaugccugaagaucccccaugacugccuauauccugacuuaucacugugauauccacuggucugcuuacccuccuauguguauccuucaaaggcacaguguguccugcugcaguccuaaaacuguacuauauggcauacaauugauaguuguuccuaugacaagugagaacuuggccuauauagauuaaccccaagaaccugacugaagaaaaucuguuuuugccuaauaaccuauuuaugauguauagauaaaacuggguauacaucguggaggugcacccucgaaauucacuguagacuaacacagguaugggacagaaauuccucugggagggacucaggguuuccucuauaccguagauacuggcuccugucuucucgagccacagcccuuccucaucucuucuggacuccccggaagcauuuguggugugccguggggaaggcuguuuauccaagggaggcuucagguauuggaaacugccuuucuugguaaccaugagucucacuggccacagcuacuuuguggaaagcuucugccuaugagggcugagcucccuccuuguucuggacucugagugaccccagaggugcagagggguaugcugcuaaguagucaccacucacagauaagugugacaugcuuuuuucaaguuagaggaucguagugggaacaucaucaggguggcccacagagaacucugggcuguauccuugguugguucugaacaucugacuagucuguauguuuuggaaacacagaaauggggagagaguaaggggcuagacuugaggauccagugacuuuugcuugcuucuuuccuuuauuaauuuauuugaucuauuuuuugggauagggucuugcuauauaacucaagcuggccuggaacucacuauguagcucagauuggcuuugaacucucugccucagucucccaagugcugggaaugugaaagugagccaccaugccuaccuuuuucaaggaccuuugaaaagaagacccaaaccccuuggaguuucccaggugcugggagcugaaaacccugcagaaaguggaaguguacauagugcauaucagugggaacccacggcuggguggacaggugggagugugugcaguggagguaggcagggugucauagaaccuggauaccaaguguucccagcaggucucaguaaauugacucugucacagcucacauuugacauuggugcuucugggcaagcaugcaugguaggacugcuuuaggcaccugauugcugcucagguccuucuucagugggcuuucagucuucagaacuuccucagcugucccuuaauugugaguauuuucucuauguaacuuagacugguacccacugggcaaggagcaguccuggcuucuguuguguuauccugggugaagcuguggaugcuugcucccaaggcuguccucacugguccuaaguagcuaacaucucagcugcuacaaaaggguccuuagcccucccuucuugggccccagguagguauaccauuuccaauugguguuuucuucccaggaagcccugguucaucauguauucguuggucuuccucugcaguagggguccugugguuaaacuccaaaaugaaucuuagccagggccaccauuaggagucuugguuaaccuuuccccuuuccuuugcucuccucuuuuucuugaaaaacucuacuuucuuagagcacuucaggucucccucgagcuagccuuuuuacugacugagauauauucuuuuuuuauuuauuuuuuauuggauaucuuuauuuacauugcaaauguuuuccccuuuccgggucuccccuucagaaauccccuaucccaucgccccucccucugccuauaugagggugcuuacccacccaccuacccacuucugucuuccugcccuggcauuccccuacacugggguaucgaacaccccuugggcccaagggcugcuccuuccacugauauccaacaagacgauccucugccacauaugcgacuggagccauaggucccuccauguguagucuuugguugguggucuagucccugggagcuccagggggucuggccaguugacacuguugcuccccucauggggcugcaaacccucucagcuccuucagucccuucuccaacuccaucaaggacccccaagcucagcccagugguuggcugcaagcauccaccucuguauuugucaggcucugguagagccucucaggggacagccauauuaggcaccugucagcaagcacuuucaggcaucuacaauagggucuggguuuggugacuguauaugggauggauccccagguggggcaguuucuggauggcauuuccuucagucucuguuccacacuuuguuuccauauuucuuccugugaguauuuugcuccccugaaauauauucuuaaccuuccaagggucugguuugccuugaguaccuccugaauaaggugugugucuucagggaaagggagcucagaugaggggaggcuggaucucuuguuuaaaaaaauaaaaaaaaagcaaaacacucucuaaacuuugguaaggugagcagagcuggacugugccugagugacacaccucucuaagguaagccagauaguacuuugagauugcuuggcauucugcuuugacucuacucuuuuucucuccucacuggaagguguacauuggugaacucccccaggacuuccuccguauaacacccacacaacagcagcagcagauccagcuggaugcccaggcagcccagcagcugcaguauggaggaacaguugguaccgugggucgccucagcaucacugugguacaggugggucuuaguuuccuguugaagacuggugggauugagcagaaggggaggcacugggcauggggcuuugcaucucauuucccaugugcacaguagaauuuuuuugauucuaguuauucuugaaaauaucugguaauaccuguugauuccucagggaucugccuaagauacuguugguccaugucaggcauuguacuccgugaggacgcuuucccugauggccccuuuguagcagugagcugcucauuccugcacaacagcucugccgaccgcacuucccauucaaccucagcuccgugcugaggccuaggaugcgcacacucagugcagugucagaggagaggucuugucuuacugcucacagguguugccagguauggcuagguuccaggggcaugaguccaggagugacuggcagcauguucaagagcagguuacugacacgauuaggugaacuugaaggcuguuuuuucacacacugggaaauaucuguaagaaaagcaguuuacagaugcacuggccuuugucucugcuggugaaugccacauuuuucuaaauuugguguuguuucaggcaaaauuggcaaagaauuauggcaugacucguauggacccuuacugccgucugcgucugggcuaugcuguuuaugaaacucccacagcacacaauggggccaagaacccucgcuggaacaaagucauucagugcacagugcccccagguguggacucguucuaccuugagaucuucgaugaggugagagaugccccaguguuacagaccugucuaguuugggaucugacagacaugggugugcuguagugugccuuguggguuuagucaugaagcuguucuccuggugcucaggcccuguauacauaccuagcauuuagugacuggugacagggugugaccugccuggacaccuggcauuuaguggcuaaaugacaagcuacagauuuuuucucucaguuccuuugacaguguccauugggagccaucaccagcaguagaagcaugaguagagugugaaaauagauguucacgggcacgucagauuucaagcaagucaggcuccacucgugaugggagcacuguucuuguaggcaugaguuccaggcucugccaguaaugucccauggcuguuccagcaguuaggcaugcagcuuuuugagggcaaucaggaaacucagguggaagaugucuccuuguagcuuagcuguggaggucauaugcuuguuuccuugaaacagcaaagggcagugggaaaaaaauggaggcaugagagccaaagaggacauuggcaugggaggcccagugaggggacacaguuucuccuuugucuugacccucugccucuugcucuacuuucuucuuguuuguuuguuuaguugguugguuuugucccuuucuccuccuucugugucugagaauaguaaggauaugagaaggagguuuggggcugugggugguggcuuggagcucuuguccucaucuguaccuacugggcuugauacuugcuucuuauaucuaguggauuaggaguaagggcccaaggacuggggaagauaguguccaucccugaacaaggaugacagcccagagauucuuuauuguccuuuggccuggccucaugguuguuacucagaagaugcagaaauggugguggccaggucuaggugaucuauggaggucuggcguuaugguuuaaugggaagcuccuugacggaagauggagcagugaggaggaaccucuccugccaagaagauagaagguagaugcaggcaccaguccagguggagucacagccauaggaaaagcucgucucuauaacauggguuguugugggccaugaugaggucauuuuacucuugucuuccucagcgcgccuucuccauggaugaccgcauagcuuggacccacaucaccauccccgagucccugaagcagggccaaguggaggacgagugguauagccugagugggaggcagggcgaugacaaggagggcaugauuaaccuggucauguccuacacggugaguucacuguccggagaggccauccucaaagagguuauggcaccuccuugaggcagcuauggcucccagaaucccagaaccuugggaagucaugggaggcagggcugggcaucugagcucccagugucuccuuuguauuaucuaggccuuucauuuuaguuguugcagagucuuugagaacaggggaguauaaagcacucugaugcaggccuccucagcuugaccauccuacaugccucuccugguguugaguguuaccugucuuuaacaggugcuuuauguagcauagguccauuuuacacuaucgcaucuacaguucaagauuauuagagcugguccaggagagguggcuuaacagguaagagcacugcugcucuuguggaaauuuccagguuugauucccagccucuacaugguggcucacaaccaacuguaacuccaguuccaggggauucaguaccuucacuggcaucaggcacacacauaaugcacauauauacaugcacacagaacacuaagacauauuaaacaaacaaacaaaccaauucaguauuucugagagaagcuucugauacuuaugcagucuccagaacaaaccgugaagggggcugugugagaagcgguggugguugcagcucaugugaggccaguaguugauaucauuuguuuucuuuaaucuucacccugacuuuuguucucacugaaacugaaucucauuccucuagauuggcuggcuaaugaacuugagggaucuucuugucuaugacucccuaucccuuggauuauagauaugagcuaccaaacauggcuuuaugcauagaugcuggggauugaacucagguccucaugcuugugcaccacuuuccuaacugagcuaggagucugcagcccaaguugucuagcugaagggaggcagucugcgggaguguugguacagaugaaaccagaggccaggaauacuacauucuugcugaggacuccaugucuuggguguuaaugucugggcugaggcuaggaccacuccucugauaccagaaguaacaagauugacauauggugugguccuccuugacugacauguuuuucuuuguuguguuucagucccucccagcugccaugaugaugccuccucagccugugguccugaugccaacuguguaccagcaggguguuggcuaugugcccauugcagguguguacugcuucuuugguaggcaguccugggacaaaguaggacaggaggagggaagggccugugaagcuugaguaguguagaauuguguaagcauggcugcuuuaaaugaggauccuucuaaaacuuauuccagugucauaucugaauuauuuaugcauacauaggcaauaguguuugcccuaauuauugccacaaguaaggugaguugaaauuuuuggaguuguagaaacauugucauuuuuaugaaugaguuacuggaauaagacaaccugguuccuguuagacaacacucacccugagcaccuacaucuuaaaagaaaaucauggcuuucauugaaaguauuuacccauauaaauuaauagcugcuugggucauaaagucaagauguggcuuuuauguauuuuuuuaaauuucuaaucuuccuguggcuuucacagugccugguauccaacucguccuccuaccagaauagggcaagccagaugagcagaugagaucacacagcuccuuucuuggcuucagccaacaggaaaaacuguggcucugagaguagacaucagggcaggccuguagucucccuagucucuugcuaggguccagggaacuguaguccaagcagaccaugcuaguucugcuaucccaaugggaauggccagucuauagggcaggagggaauaugagauccuggaugggacuuggccugcauggucccugcuagcaggugcucagggugaguguugccuuguaucuaagacagcacaaagcugcuauggcucagugguguggggucugagggucccacacagccagaauggagugacucauuagccuuuauuagacucagccucuaugccagcugagcuagggaacauggugcaggacuugggaaugaaauccacccacacauauccugaaaacaggccugacagacagaacuugggccuucuaccuaugacaaaucauccugcaggaacaaagggcagcacuuugcaaagggaagggaggguaaguucacaggcuucuaggccccuguaguauuuggaauggaguagguuugcaguagagggcaaaccagucaaguggggagugacccagggccuuagagaaaccuuaaagcagugugguuguuccccaagagccuuagaaaucuggagaguggaguuuuaggaugugugcuuucuagaguccccaauacaagguccugaccuguccaguucaaugaucggauccugagguaugaggguuggguucccagaguggcucccagguuccuuuuugaacugcagucccaucagucuguguauggaauuuguggaggucuguggagggagaagcaagcggagugaaaugagcacaaaggguaccccaguguagcagaggcacuggggucacagauggaacaaugcagcagaagucucuucccucaguuucucaggccaggagucaaacgggcugcaauccuuucugaagcuccagagagggaacuucuaaccuuuuccagaucuugaugugacuugguuucuggccauaucucccugguccgucuucauauucuuggagucaccacgcacuuuuuguguuucuguccuguaaggucacuggacaggggcuuuucugcuccuucauggucuuauccaaacaagguugcccucuuucuaaguaaagucaaucuagaggcacuggggcgggggugggguggggugggggugguuugcggcagacuugagcauaucuuuggguggugguagaggguguugagguggggagcaacaaagacaaauuucuguccaguuacaaacagaagaacuacuucuaaacaaaagauaaaagcuguugacuaguuuacuuucuuggcuccuguccuucauucucuguaaugccucuagaguguauuuuagggaaggcuccucuauaaauaggcuuugauccucacuuuugauguacauuuugaaaguuagaaauaguuuccuacugauagaaaagcugccacagaaauaaaaggauauuuuucccuuggagaccagccuugaugucugcucuguccccaugcaagcaugcuuccuggaagugaggacacuucacaaggggacgugcugcggaccacagggcugguggucugggucuucccagaacuuguaacaggcucugccugcaguuauuugugcugcccuguucacuaucuggccaggagaacccagaugcugcuuagaaagcuguucucuuucauuucugcugcucacacuguaguauucgguaaggggacacaguuugccuuuucauucucuugagaauccuuucguaucaccucgaggacuguguucaagguuacaguugcugucuguuuuugucagacugagcuguccacugauaauuguagcaguguggacuugaggauuguuuuauuuucugagcucuuaauuuguuacuauauuguuuugucacucagugaucccagauuggccaagccuuuaggcugaauugugugcuuuuugaugucucacaugcugugugagcuuccugacuuuggcacaggaagccucuggcuaucuuguacauuuccuucugccccagaauuagccacuucucucugaacccagggagaaucaguucuaaaaaaguucuugaaugguuuuuuguuuuuuauuuaucuuaaucauugggggcauuaauaagcauguuacuuuguugaaacuuaaugcccagcuuugguucuuauaauuccuguauguuuaugauggcagagcuguccuagcagaauacuugggguauccugugcagagacgauuaggguaugccauccggucgaugugauguguccacagaagcaggagcagcaguucauucagggcauuuuuauuccuguugcucucagguuucucaggagugaggucaagucacgugguguuucuugcuucauaucagcuucugcugcaguuugcucucuugggaagauucauacccuugacuauucacagugugacguauguguacacagaccaugcaugaaacaggacuacacucaagcacaguuagacaggaaugaggagacucacacguuagccuauucucacugccuguuggucuacccagggaacaaugcauagcuagugggugccugcugcuuuauagacccuguugucuaugucugagguuuugaauuggagaucacagcugcugcuuugcagagcugaagcugaagguggaggaucaaggguuaccuguguguuuaugaguccauuaguuugagagcuuggaaauguccuguaauaugcagccugucccugagcucccuagucagcauggguagccccagaaguuuuuagcuguuggugucaguucuggguuguugcagcaaggccguuuaggacccaggcugucuguacugccaugcuaagcaccaguuuuucuugaauggaaagcuccuuugcuuuuuuuuucugaguggcauccuauuggugaaaaggcucuuguuuuacugaccugugucugcguacugucuauaaugugugcauuguagcuaagugcccugcuauugggaaugaauugguccuacucuaucaguuuguguccauuuaugacaaggcgucaaaggguuaugccauugacuaugauuugcuucaugcucuagcagaggcaugauuuugccagcaauagauaguuucuuguguaguguuuacaacucuggagacauuucaaaagguauauaagugcuagagccccgagaggcaggguggguuguuguuuguuguuguuuguguuugguugugguuuguaugugcaaagaagaaacaagaaguaguuagauaugcuaauggcaaagaucaaacuugccccaaggaucuugaugccccuaaucagcaugaaguagucuaaugauaagcccucccuccuuucuauccuguuuuucuguccuaucuaguguuaggaguucaaaaggauggagaaagguagaagaaagaagaacccacaaaguaacaaaugccagcuacaccacuaucuggugacaacuuguaaggugacagacugacgacagccugucuaggucagucaggacagagacaugaaggugauggccuggcccagaggguacuuaggaaaccugccucuguuucucaauuuguaccucuucaucuaucacaaggugcagggagccauguagcaucagugcuaagcccuuugccagcagccuuuuuugcucucauggcaaaaggauuagcucccgugccccacugggggccuugguaccucaggcugcuggaaagugauguacuuucugauauguauugucuucauugugaaaggcuaauaugcagcuuuucuugaaguuuucagggaguacuuuauguagcuauaccuugccauaugcaugacuauuguaaugccuuuguuaggcugugaaggugaauucuagaaucuugacacaaguggacuuuggaguauuggguaaaacaagcauacuaguuuguugucugcauucucaguaaagacucauguccgugaugagucuccuaaguucuugaaguagcacaugugguuaccaaauuuucaucuugcucccuguaauuuuugacuagauauauucaacuugaauuuuuguucagaaagaaaauaccucaggagagggagccucaguagugaggaggauggcccaucccaucugucaugggcaucccugugggaucuguuuuccagucagauuaagguagccuuuucccuugaggccagugagauguauuauuucuuccuuuggcacugcagcuuugugaucccacugucucuguccuggaacucacucuguagaccaggcuggccuugaauuuagagacucuccuguugccuuacaaguacugggauuaaagucaggcaccacaacaccuggcugaacccacucuuuuuaaccaaccucaacuuuuguuuucagggaugccugcugucugcagcccuggcauggugccgauggccaugcccccaccagcuguggcuccucagccccgcuguaaugaagaggaccucaaagcuauccaggacauguuucccaacauggacagggaaguaauccguucugugcuugaagcccagagagggaacaaagaugcugccaucaauuccuugcugcaaaugggugaagaguccuagacccgccuguggcccuuggcuucacaccacugacccuuggacuuguccacccagggcuccccagggucaccauccccacaagauuccaaugaaagaccauccacauaccccuuccuuggacaucugcgccgccccuuccuacauauuucggggaugcauguggauuuuugguucuaagcaggcaguccucuucauuguugcugggggacagaguuaggggacaguucucuccuagucucuagcugggugaugguggcauggcccuguuauugcacagaucagugguccuguuuggggaccugcaucuccuguccucacccuauucuggaaagcauucuuacagaaagcaacugccucugccaagauacuagaaauuguacagcauccuucugaguugauggauggauggcauggaguuacucaguccagcugggaugguuguugagggugcacugaguucaugugcacuuacuuacagguuauuuuuagaacuuucaagcuaaaagcuccuucccucuucugauguuguaugugaacaugggccccucagcuaguccuggccagugagauaugcuucccagccauauccagugggucucuaaccuccugucuagcuuaucugccacugucuggcuaggcuucagccacagaaauccaacuugaauacagaagguauccagaccuggugcuugguuggccaggccccacauuagcccucacugcuggaggcugcuuuccacauccucuuguuuaguaccagcaucaugggucuuacuccaggggcuguucuuguugauagaccuucaucacagagcccagagucaagcgaaggagauggguggguguggcacuaugugcuuacuacuaaaauucaagcauugugacacuacugaccugcaguauacucuguggacccauacuguagcuuggcuugagugauaaaaauucaugcuuaaauuaaacuuucauaaagguagaggugccuguaccugaccaguggauauuguauaguguauuuuagguugcaaaccuuugagcccgugaccuggccauacauguauuuagggagaaauugaguggugccuugugcuaagauacagaccgugaaagcuuucucagaaccaguacugucacaaggugcuguuaggaagcuccagcauugccacaggguuauggugggacaguuuugccuuacauugccguuacuuuuuguuuucugagaaucugcacacccgguuuggauaugugauccaccaauaagggcaugaaggugacuccuagcaguuuggacuguugugaaggacuucaaauaagaaaauuagugcuucaguuuuuggucuuugccuccuaaaaacgcgguaaaauauccuacuugcuguuaucuacaggggugcuuuuugucaaauguauuguuuauaaguauuuauuuuuguaagccuaaaggcaguauguggugauggugagcaugggauggugguaacaagcacuuuucuuuaguuguaggucuuuaaaccuuuuaacugcaaaauggagaagaaagaccaauguuuauuaaauagauucaaccacuuacuuuaacacaaccaggcacuggaagccuccauucuagacuguugaucggccuugugcuugguaagcagaugcccucuugcaggguggaugagucaggcaggcagaaccuccuuaagugguccacuuaguguuaccagcagacugcagacacugcagagcaggaaccucacucaguaccugucucuaggucucagguguggcggcugugugcauccgcaucugccuuacggagguauagguugaacacagggccacuuuguucugugagguucuauaggaagcaucacgauuugcugccagccccugagcagucccacagcacucagaggcagcguucacuaacuuacgacugcuuaaaugaggaagagugaugguuuuaagacagauuuaagacuugagcugaacacagacucuucccuuugucaugaacauuuuauuuuuuuaauagauugaagaaagaucacauuuuauaaggccugagugauacuccuagguuuugcuguuuuuuugucuuggaauuucaugucagcgcccaucuagugcaaggagagaggcagcacuugucagcgccuguguagguaccagggcaucagagcauggcuuguuggcuuccaucccauccugaaucuuguugagaugaagagucaucccuagaaggagcucagaggcagaggccacagccgagucagacaggcuucugcauggggaccaggcucucacuggguguaauugcugcucuugccaaguuugaagauugauguugguagcaaaauuucucaagguguucacuggagcccccuccccucgggccagcucuaguguaggcaugcaucuagggauggccuggccuguuuucuucucuggacauguugguuggcugaaguuguaaccugcugcacgcuugugggcugacauggccagaggcuuucaucucaccaugugagugaugccuacccgaugacagaaguguugugcgacugggcucugcccucgcccucccaggccacccuuuacagacacugguaucaucugguacacugucuggagguuggugggaaugguucucagaacugucugugauuauuuugggaauggggggguccauguccauauuuuucuuugauuauaugauauauuuuuacuuuucagccuucuaauuuaauaaguggucuauauaaaauagaaaaauaaaguccucugaggaaauguuuacuauuuuuguucuugaguauuuuuuuaaacuuuuuauuaguucuuugugaguuucacacugugcaccccagcaccccaauccgaguuaucucccucuuccccccccccccccaguaccugccuuucacccuugcaaccuccuuccccaacagaggcggaaaauaucuuguuguggaagcuguaguguguuccacuguguuccacaguauauccuuuugucuaugcuucuugcagauguucauugcaaugagucauuggucuaguaugagaccucuggcuucugcuacaccaucuauacuggagccucauugggacuccucuagccuuuccuguuggugcccugugucauggagauccugcagcuuuggaucuguaggaccagccccuucacacacuccagcaguuuaucaagcccuagcucugggccugagaagguaccugagcuggggacagagccagcucuucagcucucaugcucuugguuggcucauccgugucugcacugucagguccaaauguguugccugggugaggcgcagggccuguucuccugcucucucuccagccugcuguggguaguuagggcgaguggagaggaagagaccucucccugauccaugccaccaaacaggaaacaaauggcagggccaccucuccuauacucauaacccugggacugagucaccuaaaacucccaccaccagagucaguucuacuuuacuuuuuguuuucuaggugauguuuagggccuguuuuuccaaguacugcagcuagcugaggauaggggugaggggugaacucuccugcucucacacccccaggcucuccuaugaugcccccccaaggguagggccaguucugcacaacccucaaacaucaacaugucccaagguaucagcucagaccagggacuccaccuggcuuuugauaguaacagaccccuccugcuacugcagggccauggaaccugauguguccaugagugacagcauaggccaggacucucccaugaucccagaugguaucaccaguugcuugcaucaggcuguuccucacuacccuugagucuccaguucugccuuucuuuauugugccuacauuccuguuucucuuccauuucucuaccacuugcuuguuccucuuagugacacccaagguuucugagagucuggggucagcuuccgggugguuucaggaguucuaugcccugccugugcauuaugguaccagacugguggucaucucaggcuagcccccugucugggccuaauagugcaauucuaguuguguucuuaguucacuccuuauccggguccaccuguguggcccuguauagggguugucuguuucagacucuccuccuguucccugugggcucuguuagaaaaauauccugcuggagacuguguggccuggcaggagggagccaaagaguagaagaauccuguuuggggccacagcuguagucaggagggagaugggcacagcgcugggcauauguggauggauauuggucugaagccucagguacaagaugauugauggcaguccugcagccuugacucaagaaugggacuguugucaagcugggauguuaaaagaguguggugguuugaaaugcuuggcccagggaguggcacuauuaggaggugugacuuuguuagaaguaugucacugugggguaggcuuggagacccuccuagcugccuugaagucaaucuucugaguaucuucagaucaagauguagaacucucagcuccuccagcaccaugucugccuggacugcuauguuucccaccuugaugauuaauaauggacugaaucucugaaccugaaagccagcuccgauuaaauguugucuuauauaaaugaguugccuuggccauggugucuguucacagcaguaaaacccuaacuaagacaaagaguuaagauuuucauccccagcuccaguuaggaaaaagcugaccugacagagacaagaaggcaagggaugagcuacaggaauucaugauucaguuacucccugcugucuuaguuugugguccacagucagguaguccagauucuggggcaugcaggaauaaaagcauuccuucuggaaaagcaggugaugaugcaggccuaccagcauccaauggcaaccacauguaaaugcaaugaaaaguuaagaacacugagaagugagcugucugcugggaccagcagaagcaguaaugccccagccguaaugccccagaagccuugcugggacaugugugcaguuuuguuuuguuuuuucuuuuaaaggcuuuaaaaacaagauaaaacaacauugcaagcaaaaaucaacagacugcuaaaagcacacaauaguggcaagaacugaguugaauauugagauugagagguuaaaaacuaagccuuaagaugaacuuuuuaaaaauugguuauuuaguguauuuauauuucaaauguugucccccuuccugguuuucccucugcaaauccuuuauccuguugccuucccccuugcuucuaugaggcucagcaugugggggcaaaguccccuaaggaaguuccucccaggugugaaccaggaaagaaaguacaagggaccagguaguacaugaacauauggggacucagcgacucagcucucugugaggguccuuagcaggcugucuugcaguuagcgcucuuggaacacauggcuuuacugggguuuaucuagucacugcauguaaaccauuugaacucacuucaucuuucuacaggcuguguauuuggugacccagguauauuuguugagguugguugucaaauaguccucggcuuuacuuuugguuuuguucuauauuaugugaacaauuugauucagaaacaaaguguaaaacagagugggcucagagagauugaauuuuccacagugcuccuccaggcuauacccugcggucgauaggugcccaagucagcgcuguuuugucugucucuccuugacucaguguaugcugaguaucugcagccacacagaucucagucucuuuccccucuucugccugucuuacuuaggugcccagaagaccccagcugccacacagccuucuuucaggugccacucacaccacuggagugucucuucuagggacuuuucaguuguuccuagugugacugggacagaucucuggaugacaagauacuaagcgcaggauaaagucuaggaugggcauaccucucagguccuguugcucccugaugggcuccugcaguucagcugucagcugaguuucucuaaccuggagcaagccugagcagguucugugcaucugaggaacauuugcuuucuuuugugagguccccuccagccucuggucaugugucuuuuggggcugugggucucuucuuuguucucagcuaccuuuucuauguugcaagcauuggacucagccauagaaugcuugccuagcaugcacaaagcccuaggcucgguccucagcaccacagaaacuaaaccacaguuucauguugcaggcauuaacucuggcaggggcugcaggggcuuugccuuccccaucucuugucuuuuuacauugucguugauuuuauuucaugaaaagauuuuccuuuucacguauugccaaguuuacuaaucuuuuccuguguaguuuccacauuuuuauuccgcacuuuauuuuuauuaggaaagcuuuuucuacuuuagguuuuaaagaaaguuacaugguuucuccuugcauaguucuucuuuuaccugucugaggugcugaauauguuacuguucuguugcugggaagagacaccaugagcaaggcagcuuauaaaagaaggcauuuaauugggggcgguuucagaaguuggucccugaucauuauggagaguaugguagcaggcaggcaggcuggcuggcuggcaggcuugauguuacagcaguagcugagagcuuacauacugauuugaaagcaggaggcagagaaaagagagauuaggccuggcaugggcuuuugaaaucucagagcccagccacuguagcauuucuccaaguccauaccuccuaaucuuuuguaaaaagccaggaaccaaacauucaaauauaugagccuaugggggccaugcuaacucagaucuccauaguucggaagggacagcagaaagcaugaaaucagauugccucacaggaaagcuaagugggucaccaugauacugugugcuucaggcuccaggucagcugaaaugccagagaaaaggagaguccccuccuggccucuaagguacagagcaggcucagcaagguggcagcccagacuaugcuggagagcagccaccagagugugcacaauggaggggcugggaagaagguuccaggaggcagagcauagucagccagauaguguggagauacagagauggagauaucacuggaucuaggacaucagcaggaugcuagaagaguaaacagagcagcagagagcuaggucaguucuuccuaggaauaucaugugagcacaggaagaauaaggacuugugguaagguugggcacuggcuccguguuucuguucccugacagcuacacucuauucuaugcccacauuuacccugcaucccucaugguccaaguucuuugucucuucaucucaguggcuggcagagacccuccaaggcagugcccagcucuuugacaguccucugcuuguggguacuuggcauguucuccuuguggccuuugaacuuguucacuuguccuuguagggccacccugggcuccucauuccucaggcuucuccuuccugcuuagcuucauaaugguuuaaaugagaauggccuguauaggcucuuaaguucaaaugcuugguccucaguuguagccauuugagaaggauuaggaaguguggccuuguuggaguaggugugaccuuugaaggaaauaugucauagggggugaacuuugcagucucaaaagucuaugcuuguguuucuucucugccucuugccuguggauuaggauguaaagcucucagcuacugccccagcauagcagucugccuaucugcuucccaucauguugauaauaagccaacucugaaguuauaagcaagcuuccaauuaaauguuccauuauuaagaguugccuuggucagagugucucuucacagcaacagaacauuaauuaaaacacuucccucccuucccaagcaaccucccugccucugguggagagagcaggccuuucccagcugugcgugugagcucacaagaguaaugcgugccuccuccuccuccuccuccuccucacauucccccagugcuguuugugggaggaacaguguccacuguguuuccaccacagggccuuggguaggucccccagguacacaaggcagaguugcucagcaccacuucccagagugcuuaccugccugcuuaacacgcugggcccuugagacuuccccgggcgcuuaggagagagcacauuuguuguaaguucaggcaaaggaucaagacgguuccuuuuauuucuguuuuugauauguguguguguguguguguguguguguguguguguucacaugcauguggagguuaguggucaacccuagguguugucccucaggugcugcccaccuugauuuuugagacaggauagagaccaggccuagaccucaccaaguagacuaagcugguggcuggugaguuccaggagucugccugucuucucuaccuucccagcacuaauacuacaacacacaguacaaaguccugccuuuauguggguucugaggauucaacucaaauccucaugucuguguggcaagcauucuaucaaccgagccauuucccuuuacuuaaaguuucauauauuaauauugugugugaauguacgguguaugugggcacacacaugccaucgugugugugugugugugugugugugugugugugugugugugugugugugugugccuucauauggaggucagaggacaacuuuuggagucacuucuccucucccacccuuaugcagguuccugggauuuguacuuaguagccaggcuugaaugacaagugccuuuaccuguugagcuaugcccuggccccuuauuuauguuuuuaauuuuuuaucauuuuuauguguguggguguuuugucugcauaugugucuauguaccacguggaugccuaaugccugugggggccagaagagguugucacauccccagggaugaguuagaaaugguuguaagcugccuuguaguugcuaggaaucaaaccuggguccucgggaagaacaucaagugcucuuaaccacggagccuucucucuagccucucauuuauauuuugaagccaacucuacuggcauuuuuuuuuuuuuuuuuuuuuuugagcuacagaccucugcugugcuaucuauggaaacacgacccugcauccaagaucuauuuaaaagcuauaggguggaaauguggaaacagaaggcaagcaugucaugucggauccagcuuucuccaggcugagcagcauccuuccuuccuccucaugacuguaacacuagcaagaacauucugguacucacacacacacccuccucucucuucagggucucacuguagagcccaggcuggccuacagcuggugaucugcaugccuuaccggcuagagugcuggaauuacagguaugugcccagcucccuuuccgcucuuuccuuugggagaacuucagauguaucaccgauaaccuuaaaucacuucuguaaagccgcccuacuucaccugca

SEQ ID NO: 4203 - RNA, 2199 nt, Mus musculus
ggagguuccugagaaaggcaggaaagcaaccuuuauuaaaugcaaauuucaugagagacauuaaauuugaaaaaaaaaaaaaggaaacccaccaauuauuuggcuauagagaauugacauacaggauuaccuagcaauaaaaaagguguucaauaaauugacucagugugcagagauguugacuuuaauuaucaguguucaccaugagugugaugcucuucuucccuggcagccaaggaacgcuuuggagacacgugaagcaggagaagcuuugauguacaucuccaaacucugaaaagcaaacagcaauaauaauaaaaacuaaauugaaacuauaaauaaucucguuacaggcaagagcaggcgggaugagaaugcaaggcagggcaccucuccuggcugggaccucaccccugccucagaaagcaucucauuaaaugagacaauacaaggagggucaagcuaaagauaaauaaauaaauaaauaaauaaauaaaaauccaugguggaugaaggcauagcuuaccgcuccaucuugauucaaccguuaccagugggcugggaagaccccaugcagagagcgcucugcucaauugcuucggacacaguuucucucuucaucaauucuuaguggcuugcucccgaggcguggagggaagagaaaauaagcaugcuccuggcaacugcaguacuuguauuuacugcauuugcuuaguacugccacugcaaaccucccuccucucuccuccuuccugggugugggcgcguacucccagccugccuuccacugcuuugccauacuguacguacaagacagugaggagccaggauagggcccccuggugcugucuccuagggaaugcauucaggggccugggcuguuucccaggaaauggauuaaugcucuaaaccgauccaggaagccuuggaaacaaugucuccuuuccuugcuccggguaauccugcaucuggcucuggcuucuagagcccuggcugugggggccccagauucuguacaacaacaucccaugugccagacaguuaaggaggaaagaaacaaaagcucccguguuaagaggugacccuuccagucugcuuucaauuuuuugaaagugugggaaaaugcacccagcguacagugucugugguccuuuucagauguauccacagucucuuauccacauuuuggagaacugagcaacccuucccaaggccagugcugcguuuucuuagccucaguuccuucauggacaaaugugaauggaauaacaggcaggguggagaaaccagaggagguaggacuuucuaaccacaccccacacggccauacagguuggccacuugccauucuuaagucccacaaauggaucagccccuucccaaguccaggccccacggcugaauuuuuguaaaagcagucccgaaguaguggccuuuguccugggaccuauacaucucggucuuggguuguguaaccucauugcuuucucuaaaucagcccuggcuaacuagaagcggccugcucugcaggcauuccgagucucuucuugcuucuuggucucccuccuagcugucccccuaaaugcucuguagcauugucccugggcaggcagaaaacaggcauggcaguacaugccugcaaucccaacaacuggaaggcugagaaaggagaaccauggcaaacuugaggccauccagggcuacacaagugaauuuaaggccagccuggaucuauacauagaaagaacuugucucagaacaaaacccaaaugaagcagguggagaaggcugaggagcuacagugggauccccaggcuaauggcucugguaccauccagacacuaggugggcaacgggaaaacauucuuuaaaaugaugcgcacucuaggguuuucuggcccaauggccuaaccuacuaaaauuuguuuaaaacauuaacuggacauuccugggcaaaaucccuacagguucccgugauuucuuuucauguaucacuggaaucaauuugcugacauucuauuaaggauuuuuguuacuagguaguggauuuccacuuccuuuuuuuuuuuuuuuuuuuuugauuuuuuuuuaaccugucuuuaucugguguugguccugaguuaaguaauucugaaagugcugguguagugggaggcugaucugccggaggggccucuugguucgaacaaggaccucccu

SEQ ID NO: 4204 - RNA, 52551 nt, Mus musculus
aucgaguguuuacuuccggccgccggcggggcugaggccgagcgaggcgcgggcuccgcgcagccauggacuggcucauggggugaguggcggaggacggcguagcgcggcgcugcgcggggcggcggcgaacguagggagcguagggcggcgggcagcggguuccaggaggggccggggcacggaaggacggccagccgcugcggggugcugggaggccgggcaggcggccggccggccggccggcgggagagaggcccgguccccgaggcgcugucccgagaggccgcggucccucgccgcgaaucgacgggccgcgagucgggcaccuggcacugucggucgucggucuucgcggggccugcgaaaguucuuccgcccaagugacuuucuuccaauuuacuuuugaggagagugagaggcgggcgcuccuagccgcgcgcgcucucccggcggcucgguucucgacccuguggcgguguccgcggcccugcugugggguccguauaauccugcuggaccacagagagagccggccuucggcuucggcaguacgagggcugcgcgggacucuggagauagaagcggggaaggcggaggaaaguguagugguggcacugucaggacgucugaggcuguuugaccucccagugcugcaaccuagggagacagcggacuaagugagcagccccagggauaaucaagagacuaagggaggccgggagccacauagugccacucaggacguuaagugugggugacacgggggacuaggcggaggcucaucuuauuucuucaagaggaagcccugucacugguuccuaucugcuuccuagcuaugugguccucucuagacuuuuuuguaauggaucgucugucagauggaagcugugaaaucugcaguacagguuuacugaaggguuaacugagguaagggccagcacauguuuugcauaugguaagcuuggcagauguuauguccuggccuuuaacaaggucucugaagcccagggguuuuaagcauaggacacauauuugaaaccagccuauuccagaccauucuuccuuugugcacuuguggagagggccagcacuugacuauaacuuggccaagguaugguuucacugcaagugaacuagaucugucagcuuggugacugaggaagcugaccacugcuguauguguaauuuuuccaggcucauacccauccaggugcuuuuugcuuggaggcugaccagaagccagucguuaaacuccucugucccucuuucauaguauuacuauaaaaguaggaagaauggaaguugcagagugagccuucagaggacauccccccgcgcccccccccccccaucuacuccacuuugucuucugaucccuggugagagcugacaaaguagucgggagugaagccauuuuuugcuucagaguacccacuguuugcucagggcugaaacucucucuguaauuaaccauuuaaguaguuuuucugucuggaagaauaggacaaauguaucaucuuuuauugugucuuggucuuggucuuuuucuuaauucagaccauccgauaucaaugagggguuuggaauguuucaagguuuguuuguuugcuugcuuauguuaaaguaaagguuuuguuaauuacuucauguugggugaacccaaguaugggugcaagaguagaggucucuuacagaaauuguuagagccaacagggaggucuacagaaguuuaaguggaaagcuacaucuuucucuuaguugggugaggaucacgcugggacuuugagcaucucacagccuuaucuuuuguguuccagcugcucaggaggaagggaggcccugcagggaagcaugcuuuggauaaccagagcagaauuuggcacguugggacuugaugguaaaccugcugggacuuuucuggagaauguuguagguguggcucuuagccaccucuuguccuguagguuuccucugcuuggagaagcuuugagcuuguuaagcaguauauauagucaggcucccuucauucuuuauuagaaaggguuacaauuuuuguguaguggguguuuguucuguuauggacaaccacgugcaggguaacacccaggggaagcugcucaggauuuggaagagagaaccccaacauguuaugggauacuuuaggcaacacuugaaucuuuucugggguaagcauuuaaccaggaggucugaguguaguuugaauuuuaucuagcagaaagcacaguccagaagccccuuggagucaaaagaacauauuuucuccucuucccacugaugauagugaguuuucccuccugccuggccaccuuaacugaaccucuucccucuccaguagucucucuccagccugcuacugaggcucccuuuccgggugcaccugacucuuaugaagccuuuagaucucuccaguacagguagaaagagaugaaaccugguguaggccauuugauacaguguauauuugaaggucuacucuugcucagcuaacagauaaagcuaaauggccucaggccuuccagccugucuggggcagccuuuagcaguccuguacucugagcaguugaguguagguguuugcaagguuggcauaggggugaaagguuuuaucuucugggaaaguauaucuggugacugacaccugacugguaagagucuguagguuuuauuugaacagccucaugugguaucauuuacauaccacuaaguuugcuuguuuuaaguauaugauuagguaauuuuuaauaaaauuauagacuuguuucuuugaccaugauuuaauuuacuuuaaaguguauguguguguuccuauggguggaacccagggccuuaaguauguugggcaagcaccuuaccauggagccaucuucucagcucaauggaacauuaacauuacucuuuggagagcccucugguugcugcagaugcccaccucugcgagaggcagcaccaaucuguuuuauuccauuauuauguguaaauggagucaugagaucuggugugugauggauucagugguaggugucggcaaugacguccguuuguuacuccacuggacauugugaagaggccugcauauucuguuucucccuuuaccuuuggguagaggugguuguggaaaauuugcaggcaugacugaugaugcuguaacccagucuuuuaaaacugaauuguacuacuucccagccaaggauucugagcccaccuaugccgagggcaaggcuucugaagacuccaaggucagugcuuugagggcuaaggcuggcagaggaggacaggacaagcacaguggaaggaucagagaucugaggaagggagggagugagugagugagugagggagggauaugaaguagagcauagggaccuucuuaaaggauugugguacaguaaguggagagguaccugcaagaggccuagaggcacgaugaaggucccaucccuugcagccaggcucuccaguggauggcuccucuggaagaugugauucuaggaauaaccucaugaauagccucuuuccaugagaggcugcccaggugaacaucuggguuggguuugcaaaggugugugcuuugggucucuuguguucccacucccuuuuuaaaaaguaguggucaugaaugcuguguacuucaggacacucugaacaacacuucauuucucuuguuugcuuagaguauccccuaggaguucaugcaagcauugccaagcuggccagcagugagcagggugaggccaguguuguauugcacaagaguccuguugacuggggacaguugggugguacuccuguguuuuccuauaaaggugugccugagcauagugugaggcuagugguuaauauccuuagcggguccuuagucuagcuguuggcuggugcuaccauacucuguaccugcucagcaaggcaucuucccaagcugccuccagaacuugcuaucauuguugcuugucauaugacaguugagagugugcuugcaagacuuccucucaucugguauagcaagguuuugaaggccagcucaguggggaacucccauaacagugguccugguagcccaacauuuccuguaucuuccuugcauuggcuauggaaacagaaacacucaaaccccacuuccuguguuuguguagacaugcuguacaaccugagguccuucagccuaaaggguuggcagggugggcagacccauauccuggugggcaccauuugcucucuguugcucugcuguguaacuaaaaaugcuggggugaggugguuaggcauuuccugcuagggauuuuagugcauccugccuguugugggcuagucuggcagaagaaggugugagcugcuccugccugccuugccagaaguuccucccgcucugugccuaccuccuguuuguuuuucuucugcacaggauuucucagcuggggcacacccacugguguucacuguagcuccaugggauggugccuggaacacggaaguaaaaauaauuggaauaaaaacaaaagguuaaagagaggaggaagagguuguuuaacagggcaucaaggccacccauggccucuccacuuggcauuauuagugucugugccauggaccaugaccauaccuacuuacugguuuucuucucuuugaagguucccuuugccagaaugcaugcaaucuggguugcaguuuucaucuaguuggucuuauaauccuuagugggcacaucugugacgggguuauggggcuauuuuauaguuaaguccauguaguuagcuuguauccugcuuugagcagcagugauuuuggcugaaguauuucacuguuguggagugucaggauggcaugggugcucacuuuuguuuuugaguuugugccuauagguuaugggugguugauagguugaaacaggagggaagaccugaccucugccuuuugccuguugccaucucagugucaggcacuuucucuugguugccuuuucacggcacuucuuuccuuuccuccuugagcuagccuguuuauucucaaccuuccuaaugccucgacccuuuaauacaguuccucauguuauaguaacccccaacuauaaaauuguuuuuguugcuacuucauaauuaauuuuuugcuauuguuaugaauuguaauauaaacaucuguguuuucugauggucuucuuaggugaccccugugaaaggcaacccacuggugagaacuacugagcuagccaaagggauacagucuuaggaaccccugagggguuugaaugacaguaucugugcugaaugccccagcucucaccuuguggggcugugucuugguccuugaaaaggccugacaaugccaaguggccccaaggaagugaugucugagccugaggcuggccuugggaguaaguccaggaauguaaaauuagcuuagauaugguaugacacacagcuuggcuugucugcaugggaccuugccauaugacguccuggccagguccccaggccugucucaggguccucugcagagcaucuguaagccaguggagcuacucugccacccagcauguugccuccuuagccuguucuuuugaugccauaugugacaaggcgguuugugagagaucuuguguugugagaaagcgugagccagagauugugauggaaucaaggagcugccaaaggugggugcuauaugaacagagguaaguggcuggccuuuuguggccacuuucugcugcuuagggggacaauaaagaaauuagggcaugguggauauagggacaggaaaguaguuuuaguaaagauccugggguuugagaaggugcuaugaagaugacuggacuugggcugacaugauggacaucuucacagaagggcugccuguguuauguuuccuaggcuaccauauacuuguucaguauuauauagucaaguacauucuguuauuuauuacuuuuauucuuuuuuauuuugaugaauggcuugccacaaauuuagcuaguggaaauacuuuugaauuggcucuuuaccccuugaauggggaaggaguugggagaaguggcuggaagacggggaucugaauuucacucuagggagauaguucucaacccauggauugaaaucccuuugggaggucaaacaacacuuucacagggguugcacaucagauauuuauauuacgauccuuagcuagcaaaauuauaguuaugaaguagcaauggaaguaacuucauggcuggggucacaacauaaggaacuauauuaaaagguuauaacauuaggaaggcugaaaaccccugugcuaggggguuauggcaaagcuauuuugacucaugauuugauaacugacuucugaguauuguggcuuaaaacgugugugugugugugugugugugugugugugugugugagagagagagagagagagagagagagcgcgcaagcgcagguaacaaguugcuccgcccuccaacccccuuugguuuuuaagagucaaagucuugcuucaaccuuccccaggaucugucuuugaguaguggaauuaaaaaccaugccugguuuuauaaccaaguuuuuuuuggggguggggugggggcaggaacaaaacaaaauagaaaauauaauaaacuaacaaaacccuuauacuguuucauuguaguuacuaugaacauaacuaugaguuauguacagaugcccucaguaugcugaggggaguggucccaggaccaguccucaaguaccaagugcucagaugcuccuuauguaagugacaugcuuauauggaacauagccacccuccuauguacugcaaaucaucucuauacuuucuucuggcauaugacagguccaauugcugugugaauaguugcaaauuuguauuauuuagagaacaauaacaaugucugccaccugcucagcccagacacuauguuuuguuuauugguuggucaguugaucuaaaacagggcuggucuacaacaugcuacccccucuugagugcuaagauuauagguauguaucaccacacaugguuuaugcccuacugggggaugacagagaacuucgugcaugcuagacaaguguuguaccaaccaacucacauccguaaccccagauauacuuuuaaaaguauuuauuauuaauggugugucugugggucucucaaugaauguaggugcucacaaaggcuauagaaguuaaaucuccccaaagcuauaguuauaguagguugugaggcgcuagaugugggugcuggaaaucaaacuucuguccucugcaagaacagauuguauucuugauugcugagccccuuucuaucuuucuagccccuuccagauauaauuuaaaaacaauuuuuuuuggcccuuguuuggguggaucauggaucccacagaucaugguauuguuucauggcuuuagacuuucaugcuuuagacuuugcuuguauaugaggaacauuauggguugaccuugacuauucugguacuuggauaaaaccaauggcaagaaaaguccuauccagagcucuccuuuauucuuuccaagaugcuuuugccacauuuugaagcaguguugguucucaacagagagcacaguugucuauucauugugcucacuguuucugcacacaacugugacagagacacucagcaaggguguauguauaucuuauggcagcagccccagauggggcagugauuggggggcugcucaucucuggcugcugcuuguugccccugaaccuuugugcuuuagauaaaaguuuuuuguuuguuuuguuuuuuuaccuaaccuguccuaguucuuccagguuaccugugcugcuuccauugguggcuauucugagaggcccaagagaaucuuucuuucuugaguuuuugauauugguugucuaccagagcauguuuccccaauguagccuuucuuuuuaugaaguuuucuccuuggccuacagcauucucaaacguuuugcuccuaggaccucuuuacacuccaagcuuuaacuauauuuguguuacuuguaggcaucaauauuuaccauuuggauguuaaacagaaauaucuuucaccauuuaaaaagaauaaggacuaaauauaguuuagcauaaauaacauuuuuaaauugaaaaauaacugcuuuuccaaguggaaaagcugacaagaacagccuugcuuuuuaccacuccuggagcuggguuccaguguggccuuguauugguucugcuggaauuuggccuuuacuaagguaugcagagcuucauugaacacuaauagggugagaguaagcaagggauuuuuugucaacuucugggucuggacccuacucugagcucuaucucaggaguucucccugggggaagugaguggaaggggagaacaguguucuugucagcuucuguuggucaguguuacagcugcuuggauaagugggaaggacugggaggaaaagcuggucucuggaugaagugagauuauuguuggucauguuagcccuugguucuauuccuaauaggaagcugggcagaaggguaagacacuaaacauuacuaggguggcauuucuuuucuuagcagguggguggaguucuguggcaguguagcuucaaguugaccuccagacaggguaagauagacuucuaccuauauccugcuacggaauuccaucccuaagugauuauuaccuucgguuugugccugcaguugcagucuguagggccacuucugcuguaaacaauggagagcuacugaggccugacaccucacuacugggauagaaggaauaaacuuucauacuaguuuguccucaguagugugacuagguucacucuucuuacugugucuuuuuucuguaaccuugugaaccgucuuugugccaucacaagaugugauggacccuaguacucaagggccagugcucuugguagcuagcaagggaaaacauagaagcagccauguugaccggagaaugggagucugcucugucccuagccugccugugcugggcuuugcuuuuuaucaaaaugauuauuucuuaauaaaauguuuagcuuuuuguuuuauuuaguuuuguuuuuugagacaggguuucuuuguguagucuuggcuguccuggagcuagcuguguagaccagggugaccucaaacucacagagauccaccugcuucugccucuccucugcugggauuaauggcaugugccaccaccuucugguguuuaacaauuuuuaaauuauuauuucuuauucuauauguauguauuuuggucugaguacucagcacuuccuacacauccuggauuuaccugcugaguaugcugccuggcaccuuguaauuggcagagugguauugcugaaggagggaagaaucuguaacaacagaccagagcaagcaccugacuccucaagacacugugcuuccacuuagugacuguauuuagccagguuucuuugagagcugcucaccuuagucaugggccugcgcaugauauaagcuuugcuggcagcagacuccacaggaucuuaccaaugaguagaaucuguguaugagggacugguggccuuacaggaaggguaggcuggggguacauaagagacuaucauugagcuggaguuguuauagcaggguagaggacacaccacacacggcaggcagccagauacucccugagcucuggugucacugagugggugggcugagaugggaggggucaaaccauaaucuuggcucuuggcucuaacuuguggucucucucugaccugcuuuucuccugaaaaaugagugaaucauuauccuuuccuuaccgaagguagagacaacucaguccuugcaguggcaccccacacaguguuuagaaccugggaagccaggagagaaaguuagguugccauuuugccauguuguauugaugguguuuaagacaaagaagaaagaguauaagaagggcacuggauccugcugcuguguuaacacagaggaaggagagucugaucuaagagcccagagggcucugccaguccuggguaaaaauggggucagugggaaagaugugauugagguacacauuuccuuguaaaugugagcuucucuguccucaugagcuguucccugguguuccauggugcugccuugggguuuugaugaggcugggccuuuggguuauucacaaugaguucacaaugaguauugguuucuuugucccccucugaaguugugucacuucugggagcuggguacauaggaauguuuagaauucucuguuguacucacaguccugucuguccagagcuuauggaauucugaugagugugcuuugaagccuuguaugggaugucaugggagagggagcagguuuucugcucuuguggaacuugguauuaugugucuauuguagaaggaugaaucacagcaaaaaacagaaaacacaaaguuaauuaucccaucacuuagauggcucaaacugucacacucugucccccuuucugugcuggacauuuaggauguuuccagaccagauugugccuuuaaagguccagucugcuauaccugaugcuuuaauggcauucuugaguggcugcuggcauauucuacagugguuuuggcccaugcuuaucccaccuucccugguagcauuaggcaggaacagugucauugcauggcaccgggaccaugcgauuuucuuuugugauugucugcuuugccuacuuuaccuugauugguuuugucuucauuugaugggcauugaguucucuguguggaugaggaucugaguauuaggauuuagccuugaguagguuccuagagauaaguaaaagccaaggcagacacugugaggcaugauagggccaaagcaucucucuuacucugagcugcagugaagcagaggaucuagaccagagggcagaguugcauggggccaggcaaugguggcugaagggguuagggguggcagagauagauaggccauggcauaccuggcaucuguugggauuugugccuacccuuuucuuugcugaccuuugagggaugcucuuguauuuauuguaucuuaccuccuuuacagccuguuccucucccuccaacuuaguuccuuaguuaggaguucagugcucauugacucuuagcaccacauugcccuuauguauucagugcugaggcugcagggaguuuugagaaagcacuggguacaggauauuguggaaggcauauagcaauuccucauauugucuuucagggaacacuugccagcugaaaugaccaagugaguguaggagaccauggauaaaucuaggaaguuuaguagacagugguagggcucagagccauucugaaugacaacuaagguugauucuaaccaaugguuccuacucccugacuucugucaccuguuuugcuuaccugauauuuacucccaugcugaggcaggguugucucuuucuagucuuuugucccuguccuccucuuagcuacuggaggugauaguggaacaguagaagggacaagagaccuucagggccuuggauggcauacaaacauccuccuguuugucuuuuugugcuuaugggaauacagaugggaauauaggccagggcauuuucccaguggucuuccagaaauaucuacuucuugccauagguuuuugggcauuuaucccuuagcgauuuuuccuucuaugcccuggguaaacagcauggcggcccaggucuaagggucuucugaauuggcugcggacucauaugcucugucuccuaaaggcaacaucucucucucuguaacagcaguauuguuugugauguccuuuccuuaugucauccuugccuugauaaaaugucuucuacauaccucuuuugucuuuucucuguucuuuuacucuuccucacucaggaagaccaggaguggugcuaguggagucucucugccugcuccuucauaggcagcgggagucucucugccugcuccuucauaggcagcgggagucucucugccugcuccuucauaggcagcgggagucucucugccugccuuccuucauaagcagcggggcuguauugaguuaucuugucuucuuuuaugccauggaaaugcaauaacacugauggcaacaucuccuuauccaucacuggaggcuggagccuuucuggaaaugguacugucaguaggaaggucacagaaucuuauuuuccaauacauucugcugugaggaugucuucuguuuugguugaaguggugcuugggaccuugaguucugcuguacuccaggcaugaguucucuguguggucaggguguuaguacugaguauuaggauuuagucauaaguugauuuguuuguuuuuucuuuugagacaggguuucucuguguagcccugacugucuuggaacucacucuguaggccaggcuggccuugaacucagaaaucugcuugucucugccucccaagugcuggaauuaaaggugugugccaccacuguccagcucuuaaguugauuuuugagacaggugaacaccaaggcagauagacacuaaugguagguuaggcugagagcaucugucuccaccacucacagcuguaguagaggucaugggaaagucaguaaugucuggcugugccaugugacugucauggacuuccacguccaccacacucagugggcuaaaugcuacagucauuugguucauguguguuuacacucuucuuguugcuguaaauauuugggggguucaaacccauguaagaucauuuaguucccaaguaaaagacacaagaccuuucuauuuauaauaagccuuaaagcaugagagcuggggagaucaacccuuuacacuaguuugucucguucacuaucaguaacuccgagauaucacuugccauguuccaccuagucugcuccuacuccaacuggcuggcccugguggccaugugcaugugcucaugaaauaccuccuccuggugccuucuuccuucuccuauccccucuuuguggagcaagguuugcacaacaaaagcuggcauaggugagaauucacuugucuugaggcaacuagaccuugggauacaauacaguacauagcaaaugagaucaaaccucaacaauuccuuuuuuuuggucuaaauaaaaugacucuuuuucuuauaaugaacaccauuuuacugcugugacgacaccaugaccaugguaagucuuguaaagaacaacauuuaauuggggcuggcuuacagguucagagguucaguccaguaucaucaaugugagagcauccaggcaggcacagcuggggaggagcugagaguucuacaucuuaaucugaaggcugcuagaagacugucucuaggaagcuaggaggaggaucucuaagcccacccccacagugacauguuuuuucuaacaaggccacauuuacugcaaggccacaccuccuaauagugccacucccuaggccagcauauucaaaccaccacauuccauuccauauuguccccauaggcuuguucaaacauaugagacuaugggggccauaccuagccauagcauaaugcaaaauauauuuuauucaacuucaaaaaucuccauagucugucacagccucaucaauguuuaaguguccaaaguucaaagucucuucagagauucauuuuucuuuuuuuuuuacuuuuucuuuuuuuaaauuuauuuauuuuauguaugugaguacacuguagcugucuucagacacaccagaagagggcaucagauuccauuacagaugguugugaaccaccaugugguugcugggaauugaacucaggaccucuggaagaacagguagugcucuuaaccacugagcuuaucucuccaguccccucauuuuucuuuuuaaagauuuauuuauuuauuucaugugaguacacuguagcugucuucagacaucacagaagaaggcaucagaucucauuacagauggccaugagccaucaugugguuccugggaauugaacucaggaccucuggaagagcagucagugcucuuaaccacugagccaucucuccagcccuuaugcaaucucuuaacuguaauccccuauaaaauuaacaucaaaagcagauugcauaccuccaacaucacaggcuauacauuaccauuccaaaaugacauagugaggaaauccuggauaaaugcaagaugaaaaggcagcuggacaaacuucaaauuccacaucuucaugucugauguccaacuccuuucugcuuuguugacugcaacacaauucuugcuuuggcuaguuccauucccagcuuuccuuagcagaugucccacagcucugguaucucaaacaucuuggggucuccaaggcaauuacagcuucuuguuccagugucugggaaccacauaugaucuucugggcuccuucaaagggcuugggucaccacucuagcucuccccucuguagcacuccagggucuaguugacucuacugcugcugcuguucuuggugguaaucucacgguacuggcuucucuaguucccugaagucuucuccuguaacuagguuucaccaauagcuucucauagcuuucuucauggugucaagccucaacuucuuugcaugaccucuucaguccugggcuaucaacugcaacugaggcugcaucuucaccaauacuuccccuggccucucacagugccaagccucagcugcucucuaugacuccauaccuucaaaaccagucccaccuggaugauucuuacacauuaccaaguccagcuguagcacaaguuaaacacuggcuaucucuggaacauagcuuugugcucuuaggaaacaccucccagaagauuucaccacagugaugcuggucucuucuuaucuuaaucacugcuaauuucuuagccccagcuaacuaccaugguugggagcugguucaaacuccugccguucucacuuaggaguuuuauugggguucugaacuuugcuacuacauuaccaguucuucugucugguggcaugguccacugucccacagauaaccagauaauaaugccuuagggauaugacuuuuccuuguucaacagcaaaugcaaaaccaauaaccuuaucuggguggucaccacucccuuuauauguuuauuuccccaaacacaggauugagcucuauugcacuuccugguacccuuuauaacuugaaccauauauuuuauacuuuuccuuuucaaaccuugcuacugaucaaaauguucuucaugaggcuaaaccagagaacaaaguaucuguuggguuuuuuuuuuuuuugagacuuccuuuguuaaugcaauuaauauaaucucuuugcuuuagcuucagggagacuccucagacaaaaguggcaaaagcagccacauucuucaccaaaauaccacaaaaacagacuauaggcuacauacugaaauucuucuccacuugggccaggucugcacaguucaaaucacccucagcaccagugucucccauauuccuacuagaauggcccauuaagccccacuuaaagcauuccaaaguccacaaacccacauuccuccaaacaaaagcauggucaggccuaucgcagcaauacccaacccccagucccagcuucugucuuagaguuuuacugcugugaacagacaccaugacaacggcaauucuuauuaaggacaacaucuaauuggggcuggcuuacagguucagagguucaagagguucaguacauuaucauccaugcaggagcaugucaguguccaggcaggcccggcugggaugagcugagaguucuacaucuugaucugaagacugcuaggagaagacugucucuaggaagcuaggcagagggucaugucccacagugacauguuuucucugggacuggaauuagagauauuugagucaccaugugggugcugagaauugaaccagaguccucuggaagagcagcuggugcuuuuaacugcugagccaucucuccaguccccaaguugauucucuuuuuaaauuacccuucuuccuaaacccuguuaauuuuuggaguuuugcacuucccugucuuuuuuuuucagccaccuacccaugcauccugaaccuacaagggccagauaucuaccucccuguggcuucugacacaggagagcacacucaggcacuauuacauccuggaaauuggaauagauguuuuaaaaaccuaugggcgaguugaguguaaugauacacaucuuugggaggcagagacacagagagagagagagagagagagagagagagagagagagagagagagagagauagauugaguuugaggccugaucuauauauuauaaguuuagggacauauagauucagauuauauuuaggggagagagagaaagagagagaagagggagggagggagagagagagagcgcucaaaaauaaaauuaaaacagcaaaagcuuguacaauugcagcccccuagauguuguaguuguuuaguuucucuagcauuucugugagcauccuggaaucucuguuccugggcuuucugguaugucuccauuuccucugaccugucuuucugccuucagcaggccuuccaugccuuuuaggugacccuauaugcugguggucauuuccucaguauuucagucuugaaaacuacagucugugcaugguguucuuuuagccugcuauaaugucagucuguuguuuccuggcuuuagcacugauguugagucagcugucaaggagucuggugugcacacaaacauacauacauacauacauacauacauacauacauacacaugugcacacauaaacacucuuuuccucccuaugcuucagagugacuugcuuacuugcccugcauguaauugacuguguucuggugugcaaaugucugagggucauuuugacacugaaggacuuagcuaagggaucagagucuuuuuccuuguucaauacaacucauccccuaccccugacuagauaacucagaauggcuuugaauuuuaucuacagucacuuuuaaugagcaguagagaaaaaugaaggcuuacagcugacgcuagauaggguauuaggauagggcaauagccccgguaugucuguacuugcuguuguguaauucucucucucucucucucucucucucucucucucucucucucucucucgugugugugcaguuauagagcagggucccuugggaauggaaggggccagugggaccuccucugcugucaguccuauggacuguugccucaggguacacccacuguagugacgaaaggaaaaacauagcugcucccuaaaagcugcacuaauguugaaguaucuucacacacuaguaucugagaccuuggagaccaaccuccucucugcugacaggaaaagugaacagaauagaagggagaaaaaagauaggauguacaggaugcugaccccaguucugugcagaacaagaugcaaaaucagcaggcaguccucaauguaucuuguaaccuaggucuccuagaagaauucuaaagaaaccaucacuggugaacauuaguaagaccccguuuccccuucucuuugccaguguagcagucuggauucugaguuguauaaagaaacuccaggccacuuguuucugugaauuauggaucuccuugcauuguugauauugagccaagugugaggcuagugguucucaaauccauuucuagauacuguccuagaugagauuccuuuuccagcacaacuuuaucccgaaguucuaguuuuuauuuauuugagacuguagcccugacuguccuagaacucuuuguaugcuuggcugaccucagacugacaagagauucaccugccucugccugggauuaaaggugugugagccauucuaccuggccugaagcucugguuucaaugagaccuuucuuguuuguuuauuuuucuuuaaaacagcaucucauauagcccaaacuugguaugugguugaggcuggcuuugagcuccugauccucuuaaacaccuccuggguacugugauuauaggcauaagacacacauauggccugguauaacuuuuuuuuuuuuuuuuuuuuuugagacaaaguagucuccugguccugccuuuauuucccuggugcugagauuacagauauaagccaccucauuugggccuaauguaacacacauuuauuauuauuuugagacagaaucacccaaucaugccucugucuucucagugcugggauuacaggaauguuaacauaaguaacuuuuauaaaaucugugccaggcaaugguggugcccgcaggccuuuaaucccagcacuuggauuucugaguuugaggccagccuggucuacagagugaguuccaagauagccagggcuacacagagaaacccugucucaaaaaaccaaaaaacaaaacaaaacaaaaaaaaaaaacccugcucugugacaugcuugcacuacuagaaccuuuacuaaucuuguugguguuccucugcuuggcaacaacccagaauuccuuucagcuuucagaaacuuauguucgguugcagcuuacuuucugaccuuuguccugugucacuggccaaugccaugaccuaucuuuacuaccagagacuauccagaaaugguccaggucuacauuccuuugcuugcuuccauccacugugugcugagauucucucccccacaguggaguaauaucucuuccuguagacuccaugugcuagccuuccccuagaaacuggauggaacuguucauucuuggguucuuugugcuauggucucaugacacuggccugagaaagacacugugcaucaaugcucccucuguugccauugcccagcuucuggcugguauucuagagaggcaaaagggcccuucccaugcauguagcuuguucgggguaucugauaggacagagccuugccaucaguuuuagagggcucaucaagguacucaagagagcuaugaugacuucugguagcuacacucagaacauguaauuuuuggcuauucuuuuuuauaaucuugugaaugagaguuaggggccuucuugaauggcuugggugaauaucaacccacuuuagagguuaacuauaaaugggucccacggcauuaaauccaccagguuauaagauauucugcuaccugugguggguaugguguacaaacacuuugucccaucuguaguccaugaauaccuuagggcccuucgucuuucccuguuagcacagcccacugcugcagcucauugcacacugccugaugugcaaacuuacagccuuggggcaaaauagacagacagguaacuauuuugacuaccuccucuaaccucauucugagcaucucuguccacauguuugucagaacaagcuauggcaaguuuuuucaguggcuagggcagggagacagcuccauugguaauauagccaacuucccaggucagaguugaacuuggguucucauucacuguuucugguuugcucuguguucagauaacaagcaaggacaucuuuuaucuucuacaucuuucuauguagagucuauguaugggacuugacuacaggucccauggucugauggggcugcuuagcggguaguccagcaugaaccugaggcugauccugguucuacucaugucuugauuuguucuucuuuccuggguagggaacuguuuugccauaccuccucaacucuagacacugacuccucccuucauucacacauugcccugagccguuaggacuucaucuuagggcagguaugugaggaaacuaaagaaaacaugcugugucuaggcaaauguguaccuguuugguguguuacaucuccugcaggaagcuccucccccgagagacauuggaagagccagagagguuucugagagcuuuucagaagcaagagccuaaaagucuuaggccagucgccaguacauacuuuacccagacccuaggauuacuuuugggucuuucuuugguugccaccuuuuucuagugggagcuccaguggcuccaguuguguaggugugggugugggaauacauuaaugcaagaaguugcuguuucuagauuuggcauccucugcauacacccaugauaaaugguucuacagcuguuauucaggaagugugguggauguggcugguuacguuguguccugagguuggaaagggaggacccagaagggucauuucuucuguggaaacugcuugugaggaaggaagugucugugaccucaucacaaggcuggaccugaggacagaccaagcuaggccuucaggucugaaaugaguuaauuguguuaacacaagagucacuacaugguuauccuggguugugguggcgcacgccuuuaaucccagcacucgggaggcagagguaggcagauuucugaguucgaggccaaccuggucuacaaagugaguuccaggacagccagggcuauacagagaaacccugucucgaaaaaaauaaaaaauaaaaaaaauaaaaaaaaagaagaagaagaaaagaaaagcugugucagaguguaugauacagugagagggugaaccugagagaguucugggccuguccuccuuuuuccuuucucccuucuuucccugaugcagugccaucauuuccaaucaugccacgaucaugacugugggucucuggagucuagaaggcugaagggcacaacccuugaugugaaauguugcccaggccaccgaaucagagaaugguguugauagcaucaacucguggccaaauuccugcucuccuuuguguaccuuucccuuccugaucaaguguuauuucuguacauggugcuggggagcaaacucagggccucucuauacaagguggcuaggcacuuuaccacugaacuauacauacuugcaacacucugcccaaacauauugaagucuucuuccaguaguauucucuuggaaguaugucaauguacaucucugaaagauagagugggcuuuguuuuuguuuuguuuucuuugagauaggaucucacuuuaucacucagcuuggccuauaacgcccaauucucuugccucugccuucuaagugcuggauuauagaugugugucaccacuguagucacaggaagucuucuuucaguguuuacauguuccuaagaaacccccauauaucuguuccucuuccagcuuuccacuccuuuuucuuucccuuugcuuaucccucccucccaucugagacccagauaaaucccauggguggcucuguugguguugccagaugccgucugagcuguaagagcaccgucucuguacuucucuguugaggaaacagguuuugcucuaugacgucaucuggacuaugucuuucacaguauuugugcuugggcuaacuguuccauagguaccuuagcaaaggccuagacuuuuucaccauuguaggugcuuccucaauuaugguggugcucucagccacugaucgauggcagcaucugcgaagucuuuguucuggacacugcaggauacuucccugcuuuucucacuagguaguuaucugugaagaagugucucucgugccugccuggcacccccaagaaagccaggguauaugcuuguuuuuuuccucaguuggccaacucucagaaugaagaagccaacccuacuugucuuucagaagugccaguuuaagauucauauaucuguaagcacuuuggacugaaggucugucaccuguuauagcuuucacuauacuuaugaacaccauguuccuuccaucuugagccauuuuuuguggucugcucagcucugguaucuacuguauccucauguauauguccuucagcccuguucaggcucccuguugcugucugcagucugcaaaguggcccaaguauguuucuugagccuugacucaguauuuacuucaggguacaaguaaugcauauacuagauggacaucaucacuuaaacccucccugaaaauggaagccuggaucaggaaaguuuggaagguauagagggggugggggguaaacuagauacaguuuuccaaaacaagugaaggucacaugucgagggguuuagauaccuagcaggcacuaaaacagcagccuucaugguuucagcaugacuauauuuguguuuuugcaagagcacucugaugacacagggaggauucuaucucauaaguauggcuuauuggagcuaugaucacaucccuuacaucuacuguagaggcagccucucauuguucucuguggaaugagcuaccuaggcagagagauggcagauggcagugagcauaggcaagguccagccaggcccuaaggcaagaguaagcugaguaaggguguaguaaagaaggaacacagagaagugaacacaagaaggccugcauggucaggaguagggugcagggccagaggaugagagacagcagguggauuguagguguguaucucuguaagcagaagagcuggguacugguacagagguggcuuguuggauuaggcuugucuggggcauaaaacagggauggcccugucaaugcagcuaguauuugacaucaucugucuggcagcuggaaaauucuucuucauguucacagcaagcugucuagacaaguccccucuacuagaguucuguuaaauuugaaauacuaugccaaucuguccagacauucuucaaguaucgauagccuuuccauuuucagccaaggguguccugggcuauugccagauuucuagaaaagugcuauauucugcucucuugaacacaccugagccauuaucacaaguacgaaggugaaucacagagguugaugagcccaggaagucugguucugcagagcucaccuggccugcauggagggccucuguggaggcaaugcccaagaaauuauugcuccuucaggaccuugcaaccacuguguugcagugccugugcucucuaguuuucugaagaccucaaagaauuguaggccuggaaccugcuggcccagaccgaggcagcccacguggaacccaccaaagcugauugagaagaacuggcuauuuauccacauguuaguaugucccaucccuauaugucucauccuacccccacaccaugauguaacugcaugcaggcuaggcuaggcuaggcuaggcuaggcuaggcuagcccuugucuccacuagagggcacucuugaccacuuagggccccacagugauccuguucacaguacaaagaacaguuacucuuuugugauuuuacugugugguugguugacucuccugaguugcugugggguuaaugagagaaggcuggaggaagcucugcauaguaagagcauauccaauaccaagugcagagcugccauuggggcuagugccuagcagccuacgcccuuaggugugucuguacacaugcacgugggacccaggagccaugcccuaagaccaguugugccuugucccaggaguggugggagaaucugagugcuccucugugccagcuuagggagacacuagcauuuucaucucugacaguccagugggcaaaagagaguauucuaauuggaucacuuuugacccaccauccucauuacugaucuuuguuuuaaugguuucagguugccuuugaccacuccuacaucucaagagcguaaggauagccauggggacauguccauucuguuuaugucugguccucuuggcucuuuauagggaaugccauguaggggcuguuuguuugcuuguuuguuuuguuuuuuguuuuuggaagggaugucuagaggaagggcuuuuaauuuauuacaucauugacccuauuuagauagcaauccugcuuaaagauuauggucugcuauuauccccucucacagauugccguggguuugggggucaugucacugccagaauuguggcuggugacuuugcaccggagggaaagggagccauaagaccaccuaaaagugguugcagaauuuuguguguguuggauaugagguagguacacaguguuaagcuaugaugaauuugugugugucaucuucaaugaccugguuugcugcauccuucccuguauauuuuggcaagacaaugauugacagcucuacccaggggagagagaacauagcugggugucauuuagucguuggaacaaaucaccuuggaaacaguuaugguuuuguuuucuuaguuucuuccuuuuuuuuccccuuuuggugcugggcgagggguagggggugggacccacaccuuugugcauguuaaggaaguacccugcuacugagcuguauccccagcccaaguacaucaguucugaagccuuaagccaggacucuggugugguccauggacuuaggcaugauggagucccugaccuucagggucacaguagugacacuuauuaugggauagguguggaacaaaggcucugccauaggccuguuugcugacuaagaaguagggcagauguggagccaacccaucugucgugcaugggaaucugcaguacaggcuuccucuggaugcccuagagucuaccugagaggggauugauaccccugauauacccagaccuccuacuacauggaccuccuacuucaccagcugcuguauuuguagaagagcaaucuuauagccuucaugaagguaagggccaucuuguucuuucugaugugucauucuaaaaucagugcuucauucagccucauuauuuguaaguuauuaugaguuuagauguuugugaugaauuacuuaaaaaaaaaacagacuuuuugguucauggguguucaugauuugcaugcugaagcauucugugagguggacucugggcagggaauaccuggccugcugugauggaggauggugauagucauugucuuuaguuguuucuuuuuuuuuccuuuuguuuguuggccuuuuguucucccaccccaguuguguauauuuucuuccuugccuuuuaguacuauuuuugaguagaguagacaucuccuugagguugauuuguaaacgcuugaaccuaugccauugucccucugcuguuuggauccuucuuuaggauucagaugucaacagccuauagaccaggcaagacaaggaggauaguauuccugaguaaccuugggaagagucauaaagaccuucaggagcagugggaaccugugggcagaggguacagcaaauucugggauuugaagaagggcuguguaugcuagcaccuguaggucaugggaggccauagagaccccaagccugagcagucagagcaaaaaaggacugcucugguuuaagugugcucaugcuaguauuaugcauaggcaauauuccuguuuguucuuuccuuuuuuacccuucugcuuuuugcuaugaaugccauagcauggaggccuucaccagaugccagcuucuuggacuuaggcauugagaacugaaugagccuauuauaaauuucccaccuagguuuuauuaugcuuuaucagcaggaaaugggucaagagggguguugaaaacuuggauccaagagcgauuugggcaagcuuggcuuugagaaggcuuucuuuggccaagggccaaaguugggccaggguuagcaagguacugaaagguaaacuacugugccaugaccauguagugagguggcagacaguguugucaggcauuuccacaggugcugugugcuggagagucuucuccagaagccacagccucuuacuugcugccuccuugaaggaugugaaggaugggcccuggcaccugcucugcuguuccucucacuuucagagcacaggccacuccuacaucuaaugccuccccucugucuuuaaaagcaaaaacauuuucaauuagagaggaaugugccuuugaggggacagccugccugccuggugaccugcagcuguuggguuggaacagguggccagugaaagaccagugcccugugucguuuuggaguccugcucuucuacccacucagucuuucccuguacaaaaugacaaagacugacagagcccugauaaggccuggacaccucccuuaccuaguauuugugacacaacaaacaaggacugcacacaaauaccagguacugcacugaccucucagaucuuaagagacuacuuggugguuucugacuccuccuuagagcacauuggggguguguguguguauaccaugcugugugauugaagcugcacuucugugacaguaggccuaggcuuucccaccugcaucagguggguuccugauggacuggggcagugaccaguccucaguggagcuaucugcauuggaauccucugcacucuuuucuggagaugccuuuuauccuuccauagaaguucccuuucauuuuccucagacagacaguuucucuauauuuuuuucuucuggauuucaggcuuuucuuauuugggggaggggggaaaccuaccuuaacccuacugauacucaguuuuuguuuuuguuuuuguuuuuguuaagagucccacaauaaggucucuguucuuugccuaguauauaacauggaugggcaggauuggaacccaacacucaaagagcagagacacccagcaaguucagagcagcucugcuccauauagccaaccuugucagaacugcugcuucccucuuguguagggcucccugccucgucucuguggacugagcugggcuauauuuugcagcugagguuuuuauaccacuaggcagggaggggcaucuuggcagggcuggccauugcccuuucuuggcugucugugcucagggccuguacagcuuggugacaugccaagggugugugauagacaggaugucacagucuuccugcuaugaauggacuuggcuuuggaaccuacaagcuccugggaauggugagcaggaggguggguguaggccccaccugugauugcagaugagccuagaacugguucugugucucuaguacagggcgugucuuagccauaaacgcaagucuuucuuccucucuagaccuccuucccauuugccaugugugauaguuugugagcauaggaaguccaaaaggaagugaugcuuaggcccuuuaacaccucugcccuccuguugguacaggagcugggccaggcaggcugacuguguagguuccaacagccucuuuaauuguucaguuucugguaggacaagagcuuggaacugaaggauuuguguggcacgguggugcauuucuuugccuucuaaauuugucuuggaauucuugccuuuccuccuuuucccucuugauuguaccaggcagcacuuuguuuccagucuuaccuugcugcuacuuccucacaaucagugccuaaccuuuacuuuaggaggguguuuggccugcuguguggccccugugaguccucugcuugcugccuuggaggagggguucuugcuaacuucuuguagcugaguugcgugaguuuacagggcaugaggggguuccacuuggcuuccucuuguagcugggguccccugguacguugccuacaccuuucuacauuuuauguugaccuguccuguccagauugacagcuguggaagggaggcuccuccugacagacaggaaaggauguuucuguccuugucuucucaguucaucaauugaagagacagguacugaguucaaauaucacuggcuggcuugugggagcagugguggguuuagggguggagcucacaguggcuuugucucugcaacccugagaaggagugggauaucucaucuugaguaggaguggacugaaccaagcacaagauuuuuugugaagggccauggaguccuagcacaggagcaucaccacauggguguaaauaugguugccuccuuacccuguguacuguacucuugaagguggucaaggauaaaagcuccagugcuagcugccaguacaggaaaccacauggaacagccuugagguauaaggacugggucagaccccaccucaagggcaggccugccucaguuaccaaccucuaccuuaguuucuucuccugggugcaugaugcugguaaguaagcugauucugaaagcucuccaugugucuccagccuucauggcagcuccuuuucuugugacugcuaggauguuagugaaaaguugaagcuuuucuuaaguugcuuuugugccaauuccucccucccucccucccucccucccucccucccucccucccucccucccucccucccuuccuuccuuccuuccuuccuuccuuccuuccucuuucuguacucuuuccuuccccuuccucccucccuuccucccucccucccucccucccucccucccucccucccucccucccuuccuuccucccuuccuuccuuccuuccuuccuuuuuucuucucuuucuuuuaaugggauuuaacugauuuuuaagauucauuuauuuuauucuauguauaucaguuuuuccucacauguauaucugugcacaauguauaugccugaugcccaugcuggucagaagagggcauugaacauccccagaaccagaauuauagguggcugugagcuacuauguggaucuuaggaauugaacucacauucucuguaagaacaagugcucuuaauugcugaggcaucucuucagccuugugccaguuuuugugcugccugguacauagauguuucucaaggaccggcuuucuucuccuuuccuggaguuucagccaguaguuugguauaugccagaaagcaacugcuugguguccuugccugacuccugcacaggguaucccuuuuuaccuagucuagccugaaauuacucuggaauuggcaacaagguuugguucuagcccagaagccuccacguaaaggcuaucaccuagcagguguggacgcccuauagucagaagggagucuguagcuacugcuagucaucuuagcuaccucuacccuuccauuuacucaggcuacucauucucccgaagggagcugauaagaugagccccugagugggauaaucugccacccagaaucucuugguguagccacauaggguggaugagguacuugcgugcaggaagccuucauggagaaggaugaagggucuuagggagccuuccuucaccagcuggaaagguacagcccagcaucuuaguuuugaacccuauggcacaccaggaaaagaguaugaacugccuggaaguaagcaggacaaagauugucacccugugauucauugccugauucuccugggcucuggaggagggauugccaggagccugggacaaaggagucuucacccuaggaguccuugcucucuggcagugagcaggcagugcuccuuuugcccaaccuuggcucuuuggcuauacugccugggaucuugcaggcucucuauaacucagggaggagcagagagcugcugcuuccaauacgacuaagcauaggcuaauagaauacugcaguuggucacucuagauuuuguucagggagucuuuucuacaggcaugcggcuugugaggaauuccuauagccuugauaagguauguucccaauggacugggaccuggcaugccucugcuuuuuguaagaugacuuagguugcaugacugguagcagcauuauuuacuuaacccggagcaguuaacuagacugucuaauauaugucuggaggacacacuuacuuugcuugggcacaguagggcacugagauggcuacuuuguuuugagaucuauguuccuggcuagagugggucugugggcccuagagcuucucagucaggaauuugccucaaguauguaagcgaaaggcagaugugugcaugagggugcugggaauugaacucaggaccucuagcagagcagucagugcucuuaacugcugagcugaugauaucuauuaguuggggguuuuaugcuuugauaaaauacuguaaccaaaaacaacuuagggaggaaagaaguuuuuuucaucuuaaagcuuguggucuaucauccagggaacucagggcaggauaucaaggcaggaaccuggagucaggaacugaugcagaggccauugaggaaugcugcuuaccaguuugcuccccauaguuuucucugccugcuuucuuauaucaccuuugaccuacccagguuuguaccaccuacagugggcuguguccucucauaucaauuaucaaucaagaaaauauccuacagacuugccuauaggacaauccuauagaggcauuuccuggauuaagauuaccucuucccagaugauccuaauuugugccagguugacauaaaacuagccagaacacugugugugauugucugccuuuguaacauaucuuguucagucuuuagcucuucuugaaaacaagauuaucuuuaaaucauugaguuguaggacuucuguacuuagugcagauaaaaguauuuuguuugguacaugcaaguuaugguuaccuacuuuguucauuuuuuuaauuuaaugauuaauuuauuguuauuuuaggcauauauauauauauauugccuguauguauguguauguaccaugugugugccugguacacagguguugccugcagaggccagaaaugguuaucagcugccuuagaacugaguuucagauauuugugagcugccacaugaaugcugggaauagaacccagguucucuggaagagcagccagugcucuuaaccacugagccaucuuuccauccccaaguauguuuauuuuuaguagcauuaaaaaaaagguugaguauguuuaaauguuggugagauccuuuuuucucuuuuuaauuuagugcuguuuauauucugaaaaacuuugucugcucugaguuuggcagaggcacugcugagcuuugguuguguuuaguucucugaugcaucugggugugagauggggcuuaccauuguuucuuaccaacacauuccuuucuccacugaaugauuucauaccuuuuucauaccuuuguuuugacauaguuuucauuucucuaggucacaugcccaggagagaagugguugagucauauguuaauugcauguuucacuuuuuagaauaccuucaaacuguuucccagacuagcuggucauuuuagauuucauccaauaaugaucaaggaaucuacuuguuccauguuuuuguuagcacuuuauuuuagccauucugauaggugcuguugucugaauaugguuugcguauaucccucccccaccaagccuauauauugacuuuaauguccaguaugagacauucaucaguggagacugauuccugucaugauguucagaggcaagagcuucagugggugacuaggauuagagaaaucuuucguaugauaccuuggaacuuagcaaaaaggcaguugauaugaagcuggagagguggcucagugguuaaucuuccagaagauuggaaguuugauucucaguauuuauauggcagcucacaaccaucuguaacucugacuucuggccuccauguguaccagacacacauguauagauauacacgcagacaaacacccauacacauaaaguaauaauaauaaaaaaaggauauuugaggggguuguuguuguugugguugguugguuuuagucuugacaguugccagaugggagccccugaacucagaauuguaagcuaaauaagcccucucuuuaagauuccccagcuucagguuauucuuaguagugagacagaauaaagugauggaguggcuagaugcugucucuuccaucauccauaccaaguucaccaucaggccauggcacugucuccagagcauguugggcaagugcuucuucccaccccagguaucucaaugcuuggacaaacugcuagcccagauuucuuacuccauucccauuagcacauaccacaaccaguuaaacuugugaggaacauaaauuggaucaugccucuguccuggauaaaucuuuugaugguuuucuguccugaucccucccuggacuuugggcuuuguaccuuuuggccagccucuguguuuccaccacuacagagcacugauucaccuuuucaguucucgccuuuuuaaacguuuuucuuuauuuuuuuauugguuauuuuauuuauuuacauuucaaacaucaucccuuuucccagucuccccucugcaaacccccauccuauccccucuucccuuugccucuaugagaguacucuuccacccacccacccacccacucccaccucaccacucuagcaucccccuacgcuggggcaucaggacuccacaggaccaagggucuccccuucuauugaugccaaauaaggcaauucucuacuauauauguagcuggagccauguauccuuucaguguauacucuuugguuggugguuuagucacugggagcucugggaaguccaguugguugauauuguuauucuguugcaguccccuucagcucuuucagucuuccucucucuaacuuuuccauuggcgucccugggcucagccuguugguuggcugugaauaucugcauauguauacacuauugcaauguauacacccaagaagcauuugcugacaggagccugguauagcucuuucuaucucucucucucucucucucuccccccccaucucucucucucucucucucucuguguguguguguguguguguguguguauguguguguguauguauguguguauguauguguauauguguguguguguguguguguguguguguguguguguguguauguguguaucucaauaguguugaaguuuggugucugcagaugggauggaucccuaggugggauagucucuggauggccuuuacuucagucucagauccauuuuugucccugcauuuccuuuagacaggaacaauucuggguuaaaaauuuugagauggccaggcagugguggcacaugccuuuaaucccagcacuugggaggcagaggcaggcagauuucugaguuuuguagccagccuggucuacagagugaguuccaggacagccagggcuacacagagaaaccuaucuugaaaaaaaagaaaaaaaaauugagauggauggguggcccaauuccucaacugagggucaugccuaucugcuggagguggucucuacagguuccgucuccccuuuguuguguauuucagcuaaugucaucccuguuggguccuuggaaaccucuuccuucccugcugucugggacuuucuaguggcuaccuauaguuccccaccucccacugcuccguauuucuauucauuuuucuaauccucuggacuucucuccugucuuuucccauacaugauccugccuccucuuccccuucccuuccagguccguccgucccucccucccucccucccucccucccucuaccuccugugauuauuuuguucccccuucuaaguagaaucugaagcauucacacuuuggucuuccuucuucauaagcgucauauggucugugaguugaaucauggguauucugaacuuuugggcuaguaaccacuuacaagugaguacauaucauguguguucuuuugugucuggguuaucuuacucaggaugauauuuuguaguuccauccaucaagaaauuugcagguucuugccuucuaucuguucuuuagccagcugguuggcuuacccugccuucucgugucacuaaggucucauuucacaguguaacaguuugacaucuguguguguucauuugaauacuguuuuuaacuucuaaaaguugacacauaccuccuuaugggguuaguuacucaggaucuguuugcacuggcuuucucucuugguccuaguuugcauuuuuuguuuguuuguuuguuugcuuuuucacacaucuagcacuuuuuuauauacuacuagcaggaaguauauuauucagaggcucagcuucuuguaaccagaucacccuucaggagguagggccaaguuuuucagcacucaccugcuuacuuguggccuuuucucuuccugaggggagaaagcucuguacagugggagaccuuacagacagcuuagcaggagagccaggguuccuggcucagagcggacccuuagugagagguuaagagaagaccaucuuccuuuuucauccuauagccuucguuuaacuuuggggaaaacauaagaaacacccccaucccauccccccuuugccucuaugagaguacuccuccacccacccacccauucccaccucaccgugacuuuagcgucccccgcuggggcaucaagacuccacaggaccaagggucuccccuucuauugaugccaaauaaggcaauccucuacuauauauguagcuggagccauggaucccuccaguguauacucuuugguuggugauuuagucacugggagcucuggggaguccuauaccuauuaccucugaggagaaguucuacaguguccaucucuugauugacaggagaaugggagcuugacucccagcaaaccauaguggagcuugggggcagugccucccuuucaguucauauugacuauucugacgcugcaguggggcccaggaagagauggggugggagugaccacucccagguaucugguuucuaaggcuugguagucucucauaaacaaggcuuugacuacauaauuugggugcccauaagguguuccagauauuccugcugccuauggcucauaguggcagugauccugacuggcagaccugaggaacagcacugcccagaaccagcuuuguguccuccagauucucccgaagccuguugacccuuuucaaaaagcuugucugacacccaccugcagagcaguagcagcuagugcccgcucugcagggacccuaauggccuguugaucccuguucugagugugcuugcuaaagaagcucugccugccuucaguuuccaggcuccccuugucaaggcugugcugagucuggucuagguggcaagggagggccuccaggugugacuuggaucucucugaccggcccuuccagcugcuggguccacccugucuccucccuucuggccuugcugauuccacccugcccagacagcucuucacuuugcaaaagcaguucagacacuccccuauuucaccagccugggcagcccuuacuauguaaaggagcagcuguuugucucugcugugguccucauuggccuagagcaagggcggagggcacuuccgagggagggaccgagagcuacauugccuggaccccacuuucccucaccaguucugcaaucuucacaucaugauuggagaguacugcagucucccuucagagcgaacucugcucagccauucccccaaaacuggacuucgguguaaaauggugcuucaggccgucagcaaagugcucagguaacagccugcccaaauuuaaacgcagugugucugggaggugguuggcuauggcucugauugccuucucaguaaagcagccugcugugcuggaguaggugugccaccugugggguuggugcugggguaauuggugcagcuuggccagucuagcaacuuagcucauugcaugcuacccaggagcacagccaccugcauuggaccuuugcuacaugagcuccuugagugucaggaguccuacucugcucccucuggaaacugcuggacugcuugccuuuaucaccagcaaguuugucugagcuuguguuuuuggccaguggcugucucucuuuggcacaaaccuuggcuacgcaaggcuagaauauccuagagcuugcccuugaguguccagagaagugacauguuauaucccagaugcuugauguaugugauacugcuucuggaguguugccaggaaagcuuuucagacuuuucugaccagcaguguuauuccuuuccaagucugggguguguguggaauguaaguggaugagugagggggguugugauugacuugcuggugggauggcaguuucaagucaauuuggggcuaugcuccccagccaggagggacgaggcacugccuuuuggacucuaguuaguuuucccuuccauguaggagucuuguguuugucucuuaacaaaaugggccacugucauccaucuuuucuuuucccuuucauguccuguccuccuccuucccuuucauucuuccuguuuuuuuguuuuuuguuuuuucuuuuuagacaugaucucacuguauagccuuggcuauccuggacucacuauguagacuaggcuggcuuuguacucacaaagaucugucuaccuuugucugcuaaguguuaggguuaaagauguaugcuacggugcccagcaggaccauuauuauuuaccaugaaaguaaauagcauuugcuuuucuagcgccccuuuuaacugugaacucccaaagcauagagcucuuggugaggcuuugacaugaauccagccucugagagccccuugcaaauggcugaugaguucuggaacaucuuucuguguaccuaccuaucccugguuaccucuuacccuaccugcuccucugggccauugcuaccucaucauuaucugaacauucagacagggagcauccauaggagaugcaagcaggaaccaagaacugcugucaauuucaauaugaagguguaaaguuuuaggagcaugucagcaaggugguggcaucaucugcccuaauuuggaaugugauugauggcaguaguagagggccacacauauguuaacguuuauauuucuguauaugugugguuaacagauaccaacaucagcuccagggaggcuaaggaauggcacucaccugccagugacuccuggcuaccuguacugagggaggucccauugggagacaccuuagccuggccuuccugaggaucacacugaguucagugaggauaagugguacugucuaagcauaccucagcucaaaugugucugacucuucacugccuuguucuccaggugagugaguccuuuacuggaucagggacauuagugaaagugugccuuauccggggaguacuaaccuuucuggauaggggcacagauauuuuugagagagcucuagugacccucuucacugcuucugaccagcccagccuguguaguaugguagugcugaaggauaauaggacuggaagggucuuccuaccuuggcccaugaagccaggcauugggcaguggaguuagugaggacuugguucaggaguuugaacuaaacuuucugagcaccacagagaccuaagcccugauaauugcugcagaagagaugguaauuaggagugacuaaacucagcagugagaguuuggggagagucugggaguauuuggcuaggcuaugagggccaugcuagcuugugcccuguugucaaaggggcuccuacagugaugggaaaagaggucauuaagcuuagaguuagugcuuugaguaggcugcagcauggauacuugcccugaccagggacauaggagcccccaguagcacucuccucuuagcuuuuagcuguguucuaccuaaauaaauaguguuucgcagaacuggccugagagggcuuguaucuuuaagguccucaggccccugccugcuugccauacucccugguuauuaauauucaucccuugaguguuguuauucuccaaccccagaauguguuagcaucuccuuccuuaauguuagccccagaccucuagagguuaacuucuggucccucauugcuaaauccccacucuaucuggccccucacuguuuaccuagcuggggcuguucagguggcagggugggaugcaagcacauucucugucucucuagagaccuaagauguccacacucaguguuccuuacuucuuuggaguauauguacuuugucucaagacucuuggaugccucccccaccacccucagaccuuaguguucuuaaguccuuugucuucaugacuugccauguaugucucccccaagucugagcauuucucuccuagagugcuuugcuuucugagcaucuguguugggucagaggcugaggaaguuaaauggggcuuuguggggagggugcaggcuaagccucacugcagggcaagaacagaugggaacauagcaucuuaucauccuggucccagaaaaaugcugcuagcauacuucccaccaacaauaucaaagccauucuagccucaugauugacaccacauugucauagagauucuuguuauuaacucugcaaauuucuuuugcucuucauuggucagacuuucaauaaggguuggcuaacaccuggugcuagggaugucaaagaguucaguguuaugggauguggccagcuagaauagaagaugugacauuucauaguuggggucuuagaggacuggggggggguugccauaugggcagggugggcagaacacuguggcagcagagacauugaagcagggagaaggagucuagggccagguggaugugugagaggcaagaagaaggugauucugguagagcauggauaacucucaaguagguauuuuacuuaaguaaaaugcucauuaggggcuagccucauccucgcuguugagagcuuugcuugggggguguucucccaggagcucauagcaguuuuguugguauacugacauguggcacccacucccuggccccuauaguacauucucugugcugcucacucaaugcuuugucugcauaguccucgcuccacaugggucacaguggugagugguauaagggaagcugggagagccugugaccucaggcaagugugcagguguggcaagccacugauggucuuuucaccuugccucagagacugggagauauuuguuugcccaaccuaccaugugaaaacagagacacuggcaaaggagcuaaaacugguccucuacaugauucuguugcccuggccaagaaccccucaggcaaagaaauugaagugaggcuuuugauguccaucaagaggccuuucuacuagcaacuaccauauucuucucaagcagaauguggacccugugugaccucuuguuccucuugcuggagugagggcucugugacuaggacugagaaacuuagguuggcaggagagugucccagaaugcacuauguuccaggguccaaguuggccccauguaaugggggacagcagcuaaauggggauaugacuaaaacaggaaaggcuuggggcuucaugugcacaugcugaugacuagcauggcauccgcuugcugccuuuugacuuuacccugagugccuauggccuuuuauagagggaggcaggccuucuagggacuccuuuccccacuagguuggggaguagcuucugcccagaggaacuaucuccucccuuguaacuaugagugggaguaaggguaggacgcuguucauaggauacccucccugagugaguccucaacuguggucaggagccauguugauggcugguuccuaccagccaccuuccuaguuguccugucuuuacuuccuuuagcuugcaaguaaacaucccaagccacagaacauggaaauggcuugacagcuuggcccuuaccagcccccuucucuguagucuugguuucuaggauaggauacacagaagacagaagguaguugauagucucaaggaaaaccuauccuuugagggcacuacaggccugauccagcauuagagaggugggucucuucuuucugacugaaugaauaguaggugaacuuagcacacaucacuaguggaagacgaggauucagagaacagggaguggacagguagaggacagguaguggacaggcagaggacagguaguggacaggcagaggacaaguaguggaugugucccaaagucauuggcagagcaccuccuggagcugaugcacaacuccacgagagagacugaagccuacacggcugggcucaugccaggaggccuuaaagugcucuuucuguguggugcauccacaccuguucuucagccccaacagauuucugugcuguuuaccuuagagccugugcugugccaggacccuaaagacugggugguacccaacccuguccucugccugguuuuggcuguuuuggcccugcccuggaagccaaguacacaucgccuuuuaaggcuaagcucugccaugagaagccgaaaggaaaacauuucccuggcauucagggaacauucuucuauccucuuucucuuaaauaaaccaucagcaaccuuuuaaagcacaagaaaggaaaaaauaggucacagucaaaaagaccuuucacccuacccccauguggccucucagggguguggaacacggggcugagaaccaagccagcugcuuccugauggcaugcaugguagcuggccuaauugccuguguuuucaggacaaaaagacagguaucuagcugguacucuggccugagggccuacauuuugcuucaucuggacaggcagcgcuaaccuggaaagggcauggugagauucugagucaaaggcuaccuccugcacuaccacuuccauccuccugacugcaaggauuccaagucauuccuuuaauauacuguucuucccugcuggguggucuagcuacuucucaccccugugcagcaggguggguacaaggagacugcuucugggagaggccucugcuggaucugcuccucuccucacucuccuggucugcuguaggcuuuggauagcuguugcucuuugcaauugguugccuuacuagagaaggccaaacuguguuucuuuccuuggacuuccaacuguccagcacuucccacagaaugccauauuaguuucugaucaaaaaacauccuuuucuggucacaaggcuucaugccaguaucaauuuaccucuuauauuuuaaaagucagaaaguucacuccugaagaauuaauuugauuaugugaggacaagacucagguuugcuaugggaacguuuauugugcuucucagacuucucacccagugcucucauccugaagccucaccgcgucggaccugugggugccagcaguucagagauugguagagccuccuucguuucuagcauuguuugcucagugccuagaagggccugcuaucuagugugcuggucugacauggacagccaggagcaucuguagacuacuucacuugacuaccucaaggagcucaccagggagacuucaggucaacaagucuuucuaaccauucauagacuuagcuaccugacagagacuucagcagaauuaucuguucugguaggcuagcaccccauagauaacucaggccaaguaauccuuggcaguugggcacuguaggucuccucucauaaaggucacacccaucucagugccugccuagaagcuuguucaccaagugcuaaaggcucagugcugccaccaguguuugaggaguaccucgacuggaggaaugagcaugggagagauuggggugugcugcuccauaaauuuaggauuucuguucaagugaaagcaauacauuuuaaagacauauucguuguuuaaaauagacauaaauaagcucacuuucuguuaacagagcaacauaguuuuauuuaaaaaacuaguuucaaagcaagguagaaacuuaacaaagaguccuguguagucuggaaugugaggaggcuggguucucuaauugccucugccuuuauguggggacuaguagagggagucucagugcugaggcagagccuuaacccuagggguuguuuuuguuuucucuugcauucacuccacgaaggguaacaagguggggguguuauacccuggccauaccccagugaaaguaugcugcuuggugguagagcacauuagcaagacauaaaggaggaguuagcucucaccuggggaggauaguuuguucuuggggugcccccuguggguuggcaaccagguacuucccaugguugguccuuccucuaaagcuuugaugguagcugugcacauuucugaacuggccugccuggaaggaagagccuugguguggccuguaggaccucuguuccggaaugucuuucuguaaguguuacaucucugaggagaaagguauccuggcaguugggagccaaggaauaccacaaagucacacugcauaacaaacuucacacaagagauuuauaagacacaggagggugggugcaucugcucagaugagaagcagcaaaaaacugagcaggagauaggcuuuauauaaccuguggguugcaaccacagggguuguaauacauaucagauauuuacauuauaguucauaucaguagcaaaauuauaguuaugaaguaauaguuaggcagugacguuauuuuaugguuaggggguuaccauaagaugaggaacuguauuaaagaguuacagcauuaggagggcugagaaccacagacacagguguuuuuggagguggaacucuccaggguagggaucuccaggguaggaauuggugagauuucacagcuugagcuuaaggugagcucagggauugguggguuuuugggcucagggauugguagaauuuuaagccccgagcuuggccaccugugucucuagggccugggucaggccauuauggccauuagaguguucugugagcagagccugucaguuggagauucucagggaugggggcuggccacuugagccccuuuaggagucuacagucucucuuuuuuguuuacuauugcuaaacagccaggggucaagaaaggagcaauguaaucauuagacuacuuccuguugaaugggggcauugaagucuuuagggcaaguuugaucuucagugucagaguauaaaucaggaguuucaggucucugucuuccuagcuaggaaccaguaauccuguaacagcaacugauuaaaagucagguuagaaaucuuuuggauuuguuguuaaagagaucuagacaagaaguuuauaaggcagggugugacaauagucuuaagacaaaaagguaggguaagaaggguaguguuugauucuguaauggacuaucaacgauccacuggccugaggcauggaguguuucuuguuucuuauguuuuagagaccuuucuggaguuguuggaucuuacuuuuuacuauacccaacuaguugacauaaaagcaguauuccuccuuagggaaagacaaagaccaccucucucugcuguuaguaaaggugauucucacuggcauuacuauggccggcguuucuauuugguacuggaggguggggaugaucugagauacccguuggagauccuggaugaacuuagaggaaaacugauggcaaauagcuagagaaguagucagucccacacuuagugguuaugcccaggacugucagaaagaguaggaccugaauccuuccugugaacuggcaaggguucuguacuguguaccaucccuaguuuugaaaaaaggaacaccagagcacaagucccagaccagccaguggauaggcagcaguaaaccugagugcugcagagaauugaggcauugugaauguuuaugcauaucagcugcgugguaguaugggggguuaagauauuuuuguagucugaagaauccagugugcccacaaagcacguuccugaggaguuaaaggaguuugugauacuggaggggugggggaggggugggggagauaagagugguagugguacucaguuuagagcaauuaaugagcagccaggugagagaguuuuaaauaagccaaaugggugaggcuacaaaugguggucguaaguuugacacacgaaggacacacaaccaacauucuucaaagcagccaggcagaacauuauucaauagcugauguguggagguaaggucuaaaacaagaugaugugagagagaggugggauuaaaaaaagggguaauauuagcauguuaggaccuuugaggagcccuggaccacuucuucuaccaugucuaaggguugagagaguggggauauguacccucuguauuuugacugucccugacggccagcugugauaauugcuagaguaaaguuuaccagugacccccccccccccgccaucuggggugccaugguccuuaauuaggauauaaagauccccccauucugcauaaaaaacagaacaccuuccuggaauaugcgucacgucucuuacaaagcuaauaauaagucucuggccaacauggacaguaaucucuaguuugaucauagagaaagaaaacacaggggacagguguuuucgaaaucuauuuagguguuaaagggauaaauaucucuguuuggcaaccugcugguaagcaguucccagacccaccacaccgcugaguauagguuccugagccuuugaaauagcaauagcauagaugggaaaagaaaucugaaacuuuuuuuuauuacuuuaacuuacuuucuuagaccuucagaacuuuaaguuuucacauccucagagcuuuauguacuuuuuaggcccucagaacucaagcauuuugaaagagguuuaugcuuuaggcaucaggugcugcccccugcugucacacauguguugcagcacagguccacagugucauccaccaggauauuucuauagggucaugaccguuuggauugaccuaugguagcauagccacccaauugcccagagaagucuggccuuugguggcaucuuuccuugccugcaucugacuuaauuaacccaaugugcaagaauccuuccucagaacccugugguuugggcccaggugggacauaugauggccaugcccuccuuucuuucuuggcaggaagucuaaagcuaagccaaacggcaagaaaccugcugcagaggagaagaagguguaccuggagccggagcacaccaaauccaggaucacugacuuugaauucaaggagcugguagugcugccccgggagaucgaccucaacgaguggcuggccagcaacagugcgugcggguggggagaugggugcagcagcugcagggcagggagccuuccccaucuccaagcacccccagagcaguagucaauggacaggcugaacucaggugaacccacucccugucacaccagguggagcaggggagaguacucacaggcccuuugcuucucuuccagcaacaacauuuuuucaccacaucaaccugcaguauagcacaaucucagaauuuugcacaggagagacgugucagacaauggcugugugcaacacgugaguagcagccuggccauagcacuuucugggagugugggaugggcugugguugaccuugcugucugggcuacuagcuucucaaacuacauucuuaccuagcuagauuuccuaaacaaucucaggcuagacaaagucuuucuguaucugagaggccaggugcucagcaugaguguuucugcugggugcugucagaggccaugcuuaaaugguccugagccuggagagugagugcucaguguccuaaggagcugcagggccaaaugagcagguucauucuacuagaggagguucuuauugacaacuucugaacaggucuagugcugacagcucccuucugauguauauguguguacauucauugcuguaguaugcagauaccuucaggggcaccaaggacccucacugccauugaguggcacauguuucccagcagcucugagucgaugguaggagugacuaugcuggugcuggcagaaggcuggauguggccaagaaggcagaagagugucuaugauggcuccuugucaucaagaugcuaugggcacauggaaguguguguguguguguguguguggguagguguaguauaguguacacucaagcaguccuucauguagaugcagcucuccccaaacaaaaagaguccacuuuaaguccugauauagcaggugacaggagucuuucugccucagcuagcuacgccugcucauauagcuguaguggccacagcucaguuucuggugauguagggggaacagagugcuggcucuguuccuccaggagggucagguaucaccuaagcauuuccagagaaagugggcaggcuuuuggugacaaagguguggccccugaaggaaccaugacagauuuugaguuggcauuugagagugucugcccagucuagacaaugucaaacagcaugguacucucccuggcuucucccaugugccuuuuaguccugauuuuguuugggagacgcuuucucaagagcauacauaggagcuaguguuguacagaccugcauaugguuuguguuggagagccugggcauccaagccuuucgcuuacuuugugguaucacuuaauuucuacuauaacccccugggaggaaucauguuagaccaagggaaacucaaaguuaguuuaaaagaaaaagggaguuagucagaaauccacagaacuccuugcugugcaccagcccuggugguuugccuagguuagggaggguuuauacuaggcuaggucucuuuuccauccuugcagcaucugcaggauaaccucaaaaggcuagcauuugggauccagggggccaaggcauauuuagaaacauguccaaagaggucccucagagacaucccuuuacauuggcagcugagugaacccuuaaggacuaaucugugaaauagcaccgaugccaagcacaauaaggccccacggcauccagggcagaccugugggccuuggggaagcacccccgugucucaggugcuacagggauaaaucauuacuccacauuccacauccagcagccauuaccuucaggagcacaauugaauggaccacugcaagcugucugaccuacugcaggagaguuccaaccaguuuuuuggcugugugacacagcaacaugagaaacacagacucuuccuuggaacucucagaaguagcuugagagugaauggacuguggucugacacauucucagaguucagagaagggacaugugaacauuagugguaacaggggaguggugccuacuucuguugcugacugaccccagcugauggccaaacucagagcaaaaucuugagugugaagagccaaauauguacuuugaaauucuuuaagcaauuucaaaauugacacaaagacauacagucagaaccauauggguaaauugaaaucgaauaguuaaaaaaaguggagagcauauagucccaaauacagcaagaccacagaaguauaaagauuuaaaaacagaacaagcagaaaaccaacaaugacaauguaaauccagcagugacaaccacaaugugaacaagaaaguuuccaagagauuuucaugaaaauauucuuguagaacuaaaucugagcuucccuaugagaaacacacucacuguugucugucaggacugcuguaaugcucacgauggaggcuccugaauagauagccugguauaucucauggacugcaagcucagauccagguuuggagucugaggagagcuuuuugguuuauuucagcagcuccuuuugaaaggcaugaauacuggucaugagagcacugccauuguggcuuggucaccuccagaagcccacuuacuaauaccaugaccuuguaaggguucauuuuagggguuugagggacuuagauacaccaaaguguucauuuugauugauugguugguugacugauugauuuaugcuuugcuaccaagccauauggccugcccuguauaaaguuuuauaagagacagaauucggccauguaguccaagcuuaccuagagcuggcacucuccugucuucaucugacaaguagcugagaucacagguauacuccacccaccugcuccuggcucauaguggcacuuuaaauaaagugggaagguuaacgguagaagaugacaaacguagaaaacacuaccaaaugaaagcugaaguaucuguguucauaguaauagagacucaaaaucagccagguugcagaaggaagcuguaaauugggaagagcuggucaucaggcagugguguuccucagugcuuguaugcuagauggcagagcugcacaaagcaaaccaccagcugcagggggaaggggaaagaggcugaggugccaguuaaggacuuuccauuccgguagcaaagugaaccuuauuuucaacuucauaaggaguacucaccaaacaagaugcugucccagcucccagaagagcccuugacaaccuuuaaagucauauuaaguuaucugaucauuguggaguuauacugggaaucagugucagagaaauaacagacaaauuuccaaacacuuuggaacuagcacauuccugaauaaucuauaggucagugaaaaacagucucgagggcaauuggaagcuuguugaacuaauauaaguagaaacgcaaaguuucaaauacagccaagugugguaguugguaguucacauuugggaaguugaggcaggagaauugcugugaguuugaggccaguccuagcuacagagaaaaccugucuaagaaaaugggaaaagaaagaaagagagagaugggggaagggaggaagggagggaagaggagaggagagaagagaagagaauuugugggcuguagcuacagcaagguggugagagcaguuuacagcaccaagugcacauuuuaaaaagagaccucagacagagcaagaguagaaccacccuaaguagacauaagaaaggaaaucaugaaacaagaguagaagucacucacguugaguuuuagaaauuguaagggaaauacgugcuugcuuggaaagaacaauaaaguugauaagcuuuagcaaaacacaaagaugagacagaagguaggaauuaugaacauaagaaagugcaacaguucccuauggcucuaacagauguuacaaagguaguuaggaaacuccaggauccucuccagcugucacacagcgagcaugaaaucaaccguuguuuggugaagaaggcuugaaggcucauccaguucaguaagacagggagaagaggggaguccgugucagagaugaaaagccagcagcgagcacagcugugagaacagucaggugugugcuagcugugugacugaaaguccuacuaauaaaucaggaccauuuacaguagcuccagaggcaagaaaauacuuaguuauagacugcauucacacagcuuuguuucuuagacaccuaggauggagagucaaagacagugcacaaacacaggccacacuguguucauggauugaaaaacaacagcuuaacauacaaaucuacacugagugaaucugugguuuguuauguucucaguuaaaaaacuccaucagagcuauuagcuacuaaccuauuguguuuuggaauuuacaugcaaugggcagcaggaguagccacaacaacaguacaucuggaggaggcccacaguuugaagauaaauuguuaaacacaaugacaagaagugugguguugaccaagugugagacagagguuagugggucagagcagaaucuagaaggaaacccagaaguccuuugauuuuugaugaaguggccaaugaaacugagcguagaaaaggacaguuuuguuuuccaacaacugcuucugugaauguaauauuacacagaggaaaggaaaaguacuaugacuuuaagucucgcccugauacagaaaugggaaaauacaacagcuuuagaggacaggagaucuuugugaucuaguauuaggcugguggacauuacacaaaaggaguggcccacucaugagcagaacucagccaacuggacuuuaugauucagaacuucucuaagaaagauaacugagaugaaagaucaaacacaaacuacguggagacaucucagaggcaccuguggcacaagagcuacuauccaggacauacagggaacucagggcagcagcaugcaagcaguggcuugaccaacaagaauagggaaggaccaguugcugcagugacagauaacacuggaguuuuaaagaaaacgaagcccacacuggcacuguagagcacuagguacuggggagcaugcccugcuggugagauacaaguggcacagcauacgagagaacuuugacauguucuuaugaaaugaugcacagaccugcugugaccauaagccuguccuuggcuuugcuuuagagacaugaaaacuuguauuaauauagacgccccccccccccauggggacaaguguaacaguaugguccauaauugucuccaauuggaaagaaucacaggcccucagcaggagcuuggggaacaugcugugcccugagucuagaauuccuacguggugugacaucuccacagcauguccagauaccagagguuugugagaggccccugauuaauccaagaucucccaaggcugagagagcagcaggcaguccaccagggcagcacuagcucuucuugacagagcacagagugacuaugauacuguacgugguaagacccaggagcucuguacaucuaguauuugcccaucccugaugcaggucuucucggaacuggcaaccucaugaauagucuaaagaguuuuggggggggcgcucuagaggucaagucacuugacugcaggcaucuacuauuccccauggggacagaauggcuucuaauucugggaauuggguacugccaagguucuagacucuucccaguugcaggccaccuccuagacagauaaccuguacccaauuaauuauaaaagguauggauuuauuuaaaagaaauaaaauaugcagaaguaugcaaugaaugugucacauugggcuaccuguacaagaggcccuugcucuccuuagauacuguucugagcacuuugucccauuggaacaauuguacauagcucaccacacccaguugccacugccuuugaguuuuugcuguauaugugggagccuacacugggguggguauuuggcaggguugacacccugaccaaagucucugucccuacagacaauacuacugguaugaugagcgggggaagaaggucaagugcacugccccccaguauguugacuuugucaugagcucugugcagaagcugguaacugaugaagauguguuccccacaaaauacgguaugucuuuugcagcuuguaccuaaauccuuaugcaaaaccagcaaguucuucagcauugggauagagagucucuggguuaugguugcaaguggggucuagaagggcuacaguuccaugauucuagcuccugcucagcacaggggaccugggauaaggagggaggaagguucccauggagaguucagccuagcuggggacaaaugccucccuuugcaaaggaggcucacucaccauuuggccuccuuuggcccugcuaucagcucugcacaaugaggccaucacaguccaucuuccugggguugguauuuccagaccugucaagguccugaugggggugaaaaacucauccugaacagucaaggggccagcacuggcuuacaggaauucccauguacuuguuacugcccccuaccuggucugcagauacccugggugucugcuggaggaagcauauggagccugagugcccaccacauauucuuugcuaugcagguggcuaccauggcucagccagcaccuguuucucuaggcagaugccacccugggggacagguuucugggaacucuguggaggggugguagcaauugugagcucuugaggcccauccagagaagccuaguuguaggagccuggccuccuugcaggucugugacauguggccucccccuaggcagagaauuccccagcuccuucgaguccuuggugaagaagaucugcaaguaucuguuucacguguugggccacaucuacugggcccacuucaaggagacccuggcccuugagcugcauggacacuugaacacacuguacgugcauuucauccucuuugccagagaguucaaccugcuugaccccaaagaaaccgcugucauggacgaccucacugaggugcugugcagcagcccggguaacaguggugccacuggggauggggccaacaguggagcuucuggagcacagaaccacgugaaggagagaugaguuuccagggccagaugggugcacaugugcaaaaagacaacugugugucugugugugcgcacacaugcccgggcgugcugguggcaaggucugagggccccgggcugcucagagugugggcuucauggaugccgcuggagucaaggcguguuuccugacuucccuguuggauggaugagugcuguuuguagugaagagccuuuggagucauucauucauucaacaaacauuuauuggacugauguuuugauuuuucuucugugggguuuuccuuucuugggucuuccauguggcucuugccuuccccccacucccgggguggggggagcucugcggcuuugaaaggagcaccuugugagaggugucucccccuuauggggcuugcccugcagaucuggaguucugcugugcuuuggggaugggcucuuacagaggccugcccugcagcuuuccucccuagcucuugccuggaucuuggcucagagucccugggguagagaagucugccuggggugacccaggagggcccacaccugcugcuugcuccuauuaccccuucuugcugccuccucagugcccaaggaggccccaauugugcguaggggccagggcagcccaggacuggcugaggcccuguguggagacagggcuaucagcgaaaggcagaaucugcuuuaguucaucuguucagacauaauaaacauucucucaggucagagccuguguccucucagccugccauuucauauuau

SEQ ID NO: 4205 - RNA, 1266 nt, Mus musculus
ccuaccaagcccuuaggcuuacaggaagugggaauccucaacuauaggagaacugucuccaagcagagaaagaccccaccuaaggacagaugcugggcaagucccccaugacugccccauccuccaaagggcuucucaggagagagucccucuguaugcgcacuucccaggcagcauacuuccccagugucuucaagauguuaugcuagccuccacccaagguggcuuuuuuaggcucagagccaaucuaggagaaggacaaggagaaaagugccagccacccuugcugaauauccucuuggggacccaaaguuuugaggcagaauaggaguucuugcucuuagaugucuuuaagucuuggagugggucuguccuuugaggaagaagcuaggggcuuguuaacaaguagcuggggcaggaucuaggguggcaccuuucuaccccaccucucuugcuguguccuucugucuguucuucuuuugaccugcuccccauguuccugucacccuccuucuuaagcaaaaguccuguccuaguucucuugaucccacccauccugaucccugagaaaauaagcuauuguuguauuugcaaucuauggauuagagguuuaaguauuuauuauuauugguuaauuauuauuauaauuauuauuauuaauuauguaaauuuaccuccugucugucauuggauuucugaggugacccuggguguggagggugcacuggcuucccccuccaugcccccacucuacugcuguccaggagacagugguguggggccaccaguuggacccuaaagcucccccuugggucugguuccuccccucucuugauggagauauggcaucuauccuggauacacggggcccguuggccucagucugucucuguucucacuuacacaugacccuggucuccccaaagugagcagacaagauggaggaggucucagcuccccacuccuuuguguugggggagguggagcauaggcuuucccugguggcuuuccacccacuguccacuguguggaggguauaggguucucuaucacucucccaccacucuuaccuggucacugccggcacuggaauggcccagaaugcaccuggcucccucuguuguccaguacaggagaggucccuugcccaaggcuuccaguccccgagggccagggugccagcuucccccuugggaccuugccccaugaggccgcacuuuccugucccuccuuuuguauuugaaacaauguguuguaauaaaucau

SEQ ID NO: 4206 - RNA, 1208 nt, Mus musculus
uuccaccugcuccucugaccuacucaucccucaaaccaauaccagaaccaugagcugcuguggcuguucaggaggcuguggcuccagcugugggggcuguggcuccagcuguugcaagccugugugcugcugcaagccugugugcugcugugugccagccuguuccugcuccagcugugggggcugcaagggaggcuguggcuccugugggggcugcaagggaggcuguagcuccugugggggcuguggcuccugugguggcugcaagggaggcuguagcuccugugggggcuguggcuccugugguggcugcaagggugguuguggcuccugugguggcugcaagggugguuguaguuccugugggggcugcaagggaggcuguagcuccugugggggcuguggcuccugugguggcugcaagggugguuguaguuccugugggggcugcaagggaggcuguagcuccugugggggcuguggcuccugugguggcugcaagggugguuguaguuccugugggggcugcaagggaggcuguagcuccugugggggcuguggcuccugugguggcugcaagggugguuguggcuccugugguggcugcaagggugguuguggcuccugugggggcugcaagggaggcuguggcuccugugggggcuguggcuccugugguugcugccaguccagcuguuguaagcccgguugcugucaguccagcugcugcaaacccuguuguucuucaggcugugggucuuccugcugccaguccagcugcugcaagcccugcugcugccaguccagcugcugcaagcccugcugcugccaguccagcuguugcaagcccugcugcugucaguccagcugcugugcuccuguaugcugccaguguaagaucugagacuuuccaagaaguaccucuacuauuccuuuacuucuguagucuaccuucuuuggaagcugugggauuauaaugacuuuccuacucaaguucaaggcuuccuucuccagcccuugaugggaaggagcaaaucacugcccugaugcuucccugacaggcucacauuguaacuuaguccccagauucuuuaaccugucuuucucacauucccuacuaugucuaaccaggcuugccaucauaaagauaaucugugaaguucugaaauguauccaaaauuuauuaaauaaauccucccccaccaucc

SEQ ID NO: 4207 - RNA, 737 nt, Mus musculus
cucagaucuugcacuggcagcacacaggagcacagcagcuggacuggcagcagcaggguuugcagcagcuggacuggcagcagcagggcuugcagcagcuggacuggcagcagcagggcuuacagcagcuggacuggcagcagcagggcuuacagcagcuggacuggcagcagcagggcuuacagcagcuggacuggcagcaggaagacccacagccugaggagcaacaggguuuacagcagcuggacugacagcaacaugacccacaaccugaagagcagcaugguuuacagcaacuagauugacagcagcagggcuugcagcaacuggacuggcaacagccacccuugcagcucccacaggagccacaacccccacaggagccacagccucccuugcagcccccacaggagccacagccucccuugcagcccccacaggagccacagccucccuugcagcccccacaggagccacagccucccuugcagcccccacaggaacuacagccucccuugcagcccccacaggaacuacagccucccuugcagcccccacaggaacuacagccucccuugcagcccccacagcuggagcaggaacagacaggcacacagcagcacacaggcuugcagcagcacacaggcuugcagcagcuggagccacagcccccacagcuggagccacagcccccacagcuggagccacagccuccugaacagccacagcaggucaug

SEQ ID NO: 4208 - RNA, 509 nt, Mus musculus
acugacagcaggaagacccacagccugaggagcaacagggcuugcagcagcuggacugacagcagcaggguuugcagcagcuggacugacagcaggaagacccacagccugaagagcagcaggguuugcagcagcuggacuggcagcagcagggcuugcagccuccacagcuggagcaggaacagacaggcacacagcagcacacaggcuugcaacagcuggagccacagccuccacagcuggagccacagcugccacauccaccacagcuggagccacagccuccacagcuggagcaggaacagacaggaacacaacagcacacaggcuuacagcagcacacagguuugcagcagcuggagccacagccuccacagccugagccacagcccccacagcuggagccacagcccccacagcuggagccacagccuccugaacagccacagcaggucauggcucugguguuugguugaggauggaguagaucagaggagcagguggagagg

SEQ ID NO: 4209 - RNA, 744 nt, Mus musculus
uucagcagcuguccugacagcaggaagacccgcagccugaugaacagcagggcuugcagcagcuggacugacagcagcagggcuugcagcagcuagacugacagcagcagggcuugcagcagcuagacugacaacagcagggcuugcagcagcuagacugacagcagcagggcuuacagcagcuggacugacagcaggaagacccacagccugaagagcaacagggcuugcagcagcuggacugacagcagcagggcuugcagcagcuggacugacagcagcagggcuugcagcagcuggacugacagcaggaagacccacagccugaagagcagcaggguuugcagcagcuggacuggcagcagcagggcuugcagccuccacagcuggagcaggaacagacaggcacacagcagcacacaggcuugcaacagcuggagccacagcccccacagcuggagccacagcugccacauccaccacagcuggagccacagccuccacagcuggagcaggaacagacaggaacacaacagcacacaggcuuacagcaacacacaggcuugcagcagcuggagccacagcccccacaauuugagccacaucccccacagccagagccacagcccccacagcuggagccacagcccccacagcuggagccacagccuccugaacagccacagcaggucaugguucugguguuugguugaggauggaguagaucagaggagcagguggaga

SEQ ID NO: 4210 - RNA, 12131 nt, Mus musculus
auagagaucaaggcccaaaacaacuuuauuuguauuucaacuuuggcucccagcugccuagcccaggaugagggcagcagaggccagccaaaaccagucagucauccuaccucuaccccaggcugaggcaugccuucccaggagggcggggucaagcccuagguaaccccccagguucauaguuuugcuucuguccucuugcuccuuccugcucaccuucaggccuuugccaggccagaguuggaggggcaguagaacguggugccauccccaagcugggugaugggucugggucagagcagguuucugggagggauccuaagacccauuugccugcuucagaguacugcccacacagcaaagggcggcaggacaagacaauccaucucagcagcuauuaaaccaguaggggccuuugaaggcagccucguguacugggugggccuuggccuccuucagacaggcagagggcagcaaucugaacccagggugaggaaccacagaacagaacagcuggacaagcuccagccaggucucccccaaggguccagcaacacuaagcgagugugacuaugugugaguggggcagguggagggauggggcuggcuggcuuccucuacuggacucugauccaguucccugacaguggagaaggagcaaguuagaguacgacagcauuggcaaagccgacccuauuguugucucugucaaacacaguguaguaggaaccaaugaagacaucgcccaggauccagagcggcccacugggaggggguauguccauucccaugaagccacucaggcagauugucuuuccacccugcgauaccuguaaggccagaaugggcacaugugaucacacgguacccacacuucacucaaggugucccggcuucacacugccaccgcccacaccgacucaccuugaguauauacuugucuggguguaguucauaguuuuugccuccuagcuucagguagaccgugggcaggcuggacaccuucucacaaggaaucauauacuaagauacacaagagagaagaaugugguauugaagguauggucucgggaacccucucugccugcuggccagcccacacaggccaguagcuuaccucacccuggauaagaggcacugccccgauggccuucugcagcuccuucaccucuuccacaggccccaccagaagagaugucccuguguccacaauagccucacagccucccuugcacagggucagcucauugcccaccuccaaccuaugaggcaaauauguaucagucacuuuacccugucacaggugaguauagggcauagcuugucuagacccugccuuggaagacaccugcuuuuuuugcccaggcuucccgcacaucaccccuacauaauacucccagcccccagcgacacccacgacucacugguccaugugcaccugccaguaggccuuucgagugacguucagguaggacagcuccccgugguaguacuuggagucagugccaccaagcauuaguucuccuccggguugcccuucugggucccuaggaggaaguaagugaucagcuucuacccacuaguucagaagugucagcaaaggaucagacaucagaaggaaggugauuaaguggggcaaccaaggagggcuccccugcggagagaccuggggaacuguugaggacaagguggaccugcucugaaaggaacguccuuagccucagcuauuccauucugaguguaaguagcaaaaagaaugacucuauuaucuuauuuacacaagcaaauucccaccucuuagcgcaccaggagaaacgaacugauaaaaccacaacugaaacuaucggauccuagcucguacagacuccagcuuaucagucacaccagaaaugacagccccccucaccugggauuuacaaagggacaaccuaagacugaaaugcagcaagccuaccgacaagccugguccaggaauucugucauuggcaaagaacccuugguucuguccccaggguguaggcucaaacagauucuccugccuuugaacucaguacacuuccaaagugacccugaaaaaggucugucaccaaaaccugcaacugacauuucugugccugugaccacuucuuaugcaguucccuacucuucccuguguuuauaucagcucucuacuuccaacuucuauacagcgucuccaggcucugcagcccuuucuuagcuagucuggaaccugaacauauagacaguauugggugaaggguaacaugugagcucuuaguauuuuuaauuaagauuugaaaacuggcaagagagauggcucaguggcuaaaagagcuugcuguucuuagagaggacugaguucacuucccagcuccuaggaauccaacacccucuuccuggccuccacuggcaacugcauucagacgaacauacucccacgcagacacacauuuaaaaaaaaaucagaauaaaagaaucaguaaugccaacgguuggcuaucaaauaaauuugggacuccuuggcaaauuacaguaaauaaaacguauuuaguauguauaauucgaguuaauaaauucuaacacuguugaaagacagaaacaugccuguauauguuucugaccugacacauucaugaugcccugccuggccagggauaagccuagggcucacccagccuagggcucggauccuaagcuaaguucccauucugcaucugcugcccuguugaggauccuuggcccuauagauauaggcuuccagcccagucccacaaaagcugcuggguacagcuggcccuucucuucaggauguuggcugggggugaucagggccagccauugauagccaagcucaaggcugagagucaggcuggagcugagggacagggaugcucucugccuggcaaaacccaaggcaggcuucuaagaggaagccagggucacgguccugagaagcugagcuggcuucagccauggacauagcacuugcuaucacucugcuucuccuguaaacauuucucucaacuccccuacacaauaccuucaaacagaacacagggagaguggucuguaccuacagcaguaaauguucuucagcaaccagcgaguaaguaugcaagcuugccaccuccgaccugaggggccuggguaaugugucacaucuggccaggcaucacucuggggcacgauuacccaaagcugaagggaagcuuucaucucaggagcugccguccuggcaggccucuguaaccaucuuccuccuggcccauggaucccucagccucacccuguucucuugccuaagucuccaccuuggccuggcuuuggcuugucaucaccucugcaaucccggguggaaacacaauggguacuggcccugccucuccucaccucgcccacguuccacccacacugccuggucacagagccgcagccucuuugccccucacucugcugguuucacaccugccuacuuagcagccacaccucugggucaccagccgggggacccagcuggcagaguaagugcccuggggcccaggcuguaacuaccacauccuuuccuaguugcugagccuggggggcuccuccuaggagacaggcuccagcaagggggauguguauccugagaucguagaacagagcccugagacuuagaggcaaguguuacuugugggccacuugccccaaggcaccaugggacugggaaaagacaggucuccaggcuucaaccuggccaacuuguuuuuguuuucugagagaacaucucuugaugucucuggcuauccccgaacucagagagacccuccugcuucugcugcuugagugcuggaauuaaaggcacgugucauuacacccagaccgccuaacuucugggcaccuaccuauucuaggaagcagaggcccucgaagucaaugacccuauuuauucauccacaccccuaccucuagggagccacucugcccagagcuaagcuggguaguuaccauuuaaacaugggagaagcaaaacuagaagacuuugggcuagcauggggccaguaagccucaacaaggggcuaggguucaggccuagagagcauggggugggcauuugaagguuacccuugcuagacaugcaaguaagucagcccagaaaaggaagguguggucagcagcagcaacucagagcaguaggccaccuacuuacaccccauccacacccaggagcuaaacccagagagugaggagccccauacacccagcugcccaucuuguaaaguuccuaaacaagacuguuggacaggccugcuggaagcuccuugcaagggugugugcagggagggggaaggguguguguagggaggaggaagggugugugcagggagggggucucacuuguacugaggaggggggagaucgcugcuaacagaaaaguucccaaaucucucagggagcgacaccccuccuccuccaaggacacucucaauguauaacccagggcucuuaguccuccccagugacuccugaccuuguccuagggaagguuccuggacccuguccccagagcggugucacagaaaguucauacccaugucuuuccuagcaaccagcagcccagagaccacaucugcucucaccagugccuggaucccagcagcucagacucugacccaggcaaccagcaucuccugacugaagucccuggcucauggcuuucucucccaagcagguaaaguaacuaacuccuaccuaccagauacccuuaggucugaugccacggccaagccuacagcacagacucuuaagucccaucuauauccuuugcccugaagcagagcucaagggaggguaagagccacgccucuccugcugcaccuguucagguagaaggagaagauguucuuguccaccagcuucuguugcaucagguugucaaagaccggaagcacguuguuaacagagauaugaggguagcccaugcccaagaugccaucaaacuuggcugcaacaaauacgauuccaggcugcuugguggcuucuccaaagaucuguuucuccaccuugauaccucuugccuuugacuggucagacuuacauggaaccugcaagccagaacauauacaacacagcugauauuuccccucagggcagucaaaagagcagaauguagacagaauguuugacacagccacacagcugaagacaaggacacaguguuccucucugagauacuuaggaggacuuugugcuaacuagacacgagaagcaggcgagagacgauacugccucagcucccaccuugccuacacccucccacaucuauauccacuaggacaguguaguucuugcccuuggacuuggggacaagccacugagccugcagccugagcagcuggguaaacccacaacugucaccgugaagccacacucuuucugccuaccaucagccugucccacaaagcuguggcugcagauagaaccagagcaggaaguggaaagagcugcugcugagaacaugucggaagacgguaacacaggcggcuaacauccugugcacugaggggccccugagaaguaccacaaggaacccuccacagacagggaaagggcagagccagguacaggguacuacaccacccagacaaaggccagguaagcaggaugcuagcuggacuccuagccaggugacaggauuugcagcuuccugccccauccuggcaggauugaucucuggucccugcaacccugcuguccugaugcaaacccaggagugaauggccucuccuuuaaagaaggcuaaaacgauaagaucuuccuacagacaaagagcccaguccagacacucucccuccuggcuccuucacaguacuuguuccaacacagauaggguuuuccaacccaacucagccucaacaagcuucggaacccuuuccauccccaggccuggccccuuggcccagaccuuccucaaggccuucugaagacaguaugcuggcagcuaagagguuguggcacacaucuuuaaucccagcacuugggaggcagaggcaggcagagcucugugagcuugaggcuagccugaucuacagagucauuuccaagacagccagggcuacacagagaaacccuucugaaaagccaacaagaaagaaagaaaaaaaagacucugcuugcaccucaaucuaaagcauccugcacaguccuccugagcuagugccaguguccccaaccccagcagcugagccaguguccccaacccuagcagcagauuugcucauggcucacucaccaggccaggcugugucagcagucguucaggguggcaguccccacuagcugacacugcaugucccaccuuugacucuuccccucacucugccaacccugagaacucuugacugucccuccagcugcacacauugaggcugcccagucccauguccuucccaucugcucccucaucacuuggcaugcugggcucuccugcuccagggccuuugcucaaacagcauccuaauggucuagccucugcucccaaucacucagcgcuaccauagucgucccaauucagcagcuaucuugggugguuggaguugggcuagggacaccaugcccucuccccucagcuguaguugcucacaugaugaaccccuugccaugacagggccucugagcuccaaggacaggccccagggacucaccgauacaguguccuggcucagguacccagagaggcuuccugagccguaguggaugucaaaggacgugccguucuucacauaggugcuggacuugucacuguuguacuuaugguggaccccugcaggggaacaggccuguuagucugcuugccucccccggggugcuguggggccaguagcucaggcuaacucuccaauuuggcccauggccaugaccuaugcccauacacugaggaccccuggaccaugggcuauauaugcaaagccuuggucuuggccuuacaggcuacccagcccucagcuuguucuaucauugaccagcaaagauccccagcuucuauaccaaagcugcagcugacaagaccugguaagugaguacuucagggcagaagagaagaacagggccuguuugauguauuguccaggagguggucuauauccaggcaccagcaaaucguaagcccaaccugccucccacagccucaacuauauuucaacucucuuuaaaaguugaacuucaaaggcaggacuaguggucaggcaggccuggcccuccgcaaggccagccaugaauaaaggaaggcaggaaggccccucugcuguuucagaguaucacaccugacugaaggaugggacuagaaccccacucucuggagagagggaaauagauauuagcugcucauggauucucacagaagggccucugucacccugauuguuccaaaggccacugagcauggcugagaguguaacauagcagagccagagcaccccagagccaggcaucucaaagggucccaggagagaggacagcagagagacucacagcaggcuaugucaaguaucuugcaaugaauggaggggacccacagguuagaggagccaguaucaaagacgacugugaaacacugcggcgggguuccgaugccgauaucgccauaguacugggccuagggaagaaauaauguucaucaagguaagaggagguaccugagaggccucuggcuguauauagaacaccaaaucugaaaggcccaggcugagggagggagugcccugggguccaggccucagcuagaacauguaucuccaacuacuagaccccgaauagggaaagggacucccaagaauagauugcagaagaguaggccugagacccaguacugaacuccaggacucuaggccccuuuaccuacuguacuguggggccgggaaaaacugggcacguggaaggugagacuaguggucaggcaggccuggcccuccgcaagcccagccaugaguaaagguaggcaggaaggccccucugcuguuucagaaugucacccugacugaaggccuuaaucccugccuggcccugcucuacaggucuuagacuggagacuguccuguggaauaaaugagaggggccaccaugggggcaacacuacuggccccaaauuagucacugcgucagagcaaagaaaccuggccuugguuucccauuuauucacacagacagcagaguccaccaggccugccaacuucagaggcuaggcaugcacagagguuuccaaauccucugaggggaagcccaguuguuaacuagugguggugggucauucauauucucucugcccaggaaggagcugagccacugguggauaccagaaccaggguccaaucccauuuaacaacagagagugucagaaaacccuagagaaguaauuggugggagggguacagggggguuacucagcaaacuguacuuugcacgugcguaagccugucuaggaaauagcuggcuagacccagacagaucgaccuucuucacgaagucacaagccugggucucauguuuccugucacugccauagcuugggucagacgagacagaggcacugccaauuuagcccaguggacuacaaagcccagagcugcaaagucauccuuggcuuauacgacugggggugggguggaggggguaaugggcggggcagggacauaagagaugccaggcuguggcccagaaccuuccacagagcucggaccagcucaccaugugacuuccagaaauguuucuccucggggccuacauucccuccgaggagagugggcugcugagccagaccuguaaccucaaccauucgggaggccaagauaugaggaugguaaauucaaagcuagcuugggcaauuaugucaaaaguaagaaaaaggagcggguacagugguagaguuugccuaauauaagguacaaggcccuagucgguucaaccccagagaaagggggaagggaagcacuaaagagccgggggcagguugaucuugggaaaauggcaaaggggaucagagaccucuccuagaacuuguacagagggaggcaccagcaagguggaccuauauagguccaguaacucucucccagacucccaccaggcuagguuugguucuaggcugcucugucagcaugggacaguccuaaggaugagagucauucccagcaguagcugaacugagagaucuauguucaagacuuaauguggggcuggaaaggugucgcucagggacuaaguacuugccuauccuacagggggucccuagacucaguccuagcaccaccccacccuauucccccucaaaaaggaaaagaaucucagacccagaaagaaccuuuugcaaauaccaagcaaugccacccuaacccauccuuuagucugagcauuucagagaagcaaggauucuaggauggcaagaaugaggggcuguuaagcaaggaaugguguauugugggugggcuuccaugaagaacuggcuacuuagcccagggagcuagcuccucccacacucaccccucaaagcaagaccccaaaauacaacugcacucacauccagguaguuuuugaguaacucugacacuggcuccguggucuuaggcgaugacugcauggaguacuuggugauggggccuuugaggaucaggucuuccacagagccgcccaccuccgucauaguccgacggauagaugugaacuugcgcagagggauucugucaagaugggacagagguauuagcacccagcuuugacugcuguguccuccaaccucccaccccaaaauaccccaggcugggccagggcagcccucuaguacagaaugacugccagccaggcaugcaccuaggugccucuagcaaauuaaauaucucaaaauggccacaacaugucacaaacuccugccccaaagccauaggcccacuggcccacugacccacugaaucagcuaaggacauccuaucacuaccacagacaccucagguucagucacagaagcucgcuccucauguccaaggauaggcuagugugcccaccccuuucccucaccaaccacaccccagucaggugguucucagucacccuagagugaaacaaacagcacauacugggccagcucuugcucugucugccuaccuggguuacuggcuaguggguucuguuuaggguguggccaggcacuuguaccuggugcccuggugaacccaauccuacaucaggaggagguggaggaggaggaggaacaggugcauccaaagcaaggugcaccaugggacucugguugauccacugaaccuggccccuagccacaucgguucccacguggacucuacaaaaaggagccccaccaaccaccccuaccaggccugcagugacauuaucauccuggacagucccuggagguucuuccccuaaccauccaagaggcuucaacaccaacuccucaugcucucccuagccaucccugcacacaaucuggcaacucucacccaagaaaccuacaugcccuaccaccacagacucaaggcccuuauaugcucccugcagcccugaugcagacaacuaaauaggggacgccaccauuagauagcagagggagaggggucccugcccugcccuccaggucaccucuccaccaccaccccaccccccacccccaguuugcuccuguucccaaggagagcugaucuguaaucacuuguugaaacuucucugcccagggauuuguagccaaggucacagcugaccuuuccuggcaugcacagugcaugcucugagagacauaggagucuugccuaagaguagugggcuggaagaggcaggcuucuggccuggggcuuaggggaggcacacacccugcaaaggucaggaaacaugccaacaagccuaagaguguggcuuuguuucuggugccuagucucagggauccuggaguccacaacaccucuucccagagaagagaagccugagggcagggcaggcaagcccagggcaggaucaagccuaggccacucccuacaauggcuccacugaggcuacccacccacagcuugcagccuacagacugggcuccuucccacccaacccuggugcccagccggcagagccagcucuacucccgcagccuacggccucagccaccugccacgaccagggacucacagagugggaaaacacacgggcuaccaccaagaccucaucuagcacaaaggccaaguccacgggccugagaagggccugguccccagugggguagaccucagcuccaagguauuugaacugggccacuccauaccuucucucucugggacuugugcaacucaggagggaggaggagagauucaccacccaggacaggggggaucaucuuugaguaaacuucuagggcuaugcaccagugcacagcugucaaacagggucccuuaaaaggaaaggccugaggaaguucaggggggcaagggccuacuagguuuuccaacuuccacagcuggguucaacagaauccuauccauggggcagcacuucuccucagaagcggccgccccgcuacacacacacacacacacacacacacacacacacacacacacacagaggcgagguuggagucagacccacuuguggccacccuacuguacccuccuguucgaccauaggagucauaggaguggagaggggcccaggagaccccugccuuuugagugucucgccccauagucugugggacccugaggaaggcugcgcugggugcacaggugcauuccagcacggccggagcacgcggcacuccaggugacgagccccgcaucuccggacccagagcggguccucaccugauaaucgcgaaggaggacgaagccaggaggccgagaaugagcagcaagacgccgggagucuucauggucgcggcggcccgaagagagcaaagcuuaaagccagaggucgccggcuuauaggcaggaugacgccgcagucccgcggagucagcugacccgcuuguuuggcccucaacgggucacgugagacgcgggcgaggggcggggcgacccgaacccgccuccaacacugcccgggcgcaggcgugcccuacuccaggccuacgcacggcucucgggaacgcgcccgcccacuuuccu

SEQ ID NO: 4211 - RNA, 12131 nt, Mus musculus
aggaaagugggcgggcgcguucccgagagccgugcguaggccuggaguagggcacgccugcgcccgggcaguguuggaggcggguucgggucgccccgccccucgcccgcgucucacgugacccguugagggccaaacaagcgggucagcugacuccgcgggacugcggcgucauccugccuauaagccggcgaccucuggcuuuaagcuuugcucucuucgggccgccgcgaccaugaagacucccggcgucuugcugcucauucucggccuccuggcuucguccuccuucgcgauuaucaggugaggacccgcucuggguccggagaugcggggcucgucaccuggagugccgcgugcuccggccgugcuggaaugcaccugugcacccagcgcagccuuccucagggucccacagacuauggggcgagacacucaaaaggcaggggucuccugggccccucuccacuccuaugacuccuauggucgaacaggaggguacaguaggguggccacaagugggucugacuccaaccucgccucuguguguguguguguguguguguguguguguguguguguguguguagcggggcggccgcuucugaggagaagugcugccccauggauaggauucuguugaacccagcuguggaaguuggaaaaccuaguaggcccuugccccccugaacuuccucaggccuuuccuuuuaagggacccuguuugacagcugugcacuggugcauagcccuagaaguuuacucaaagaugauccccccuguccuggguggugaaucucuccuccucccuccugaguugcacaagucccagagagagaagguauggaguggcccaguucaaauaccuuggagcugaggucuaccccacuggggaccaggcccuucucaggcccguggacuuggccuuugugcuagaugaggucuuggugguagcccguguguuuucccacucugugagucccuggucguggcagguggcugaggccguaggcugcgggaguagagcuggcucugccggcugggcaccaggguugggugggaaggagcccagucuguaggcugcaagcuguggguggguagccucaguggagccauuguagggaguggccuaggcuugauccugcccugggcuugccugcccugcccucaggcuucucuucucugggaagagguguuguggacuccaggaucccugagacuaggcaccagaaacaaagccacacucuuaggcuuguuggcauguuuccugaccuuugcagggugugugccuccccuaagccccaggccagaagccugccucuuccagcccacuacucuuaggcaagacuccuaugucucucagagcaugcacugugcaugccaggaaaggucagcugugaccuuggcuacaaaucccugggcagagaaguuucaacaagugauuacagaucagcucuccuugggaacaggagcaaacuggggguggggggugggguggugguggagaggugaccuggagggcagggcagggaccccucucccucugcuaucuaaugguggcguccccuauuuaguugucugcaucagggcugcagggagcauauaagggccuugagucuguggugguagggcauguagguuucuugggugagaguugccagauugugugcagggauggcuagggagagcaugaggaguugguguugaagccucuuggaugguuaggggaagaaccuccagggacuguccaggaugauaaugucacugcaggccugguaggggugguugguggggcuccuuuuuguagaguccacgugggaaccgauguggcuaggggccagguucaguggaucaaccagagucccauggugcaccuugcuuuggaugcaccuguuccuccuccuccuccaccuccuccugauguaggauuggguucaccagggcaccagguacaagugccuggccacacccuaaacagaacccacuagccaguaacccagguaggcagacagagcaagagcuggcccaguaugugcuguuuguuucacucuagggugacugagaaccaccugacuggggugugguuggugagggaaaggggugggcacacuagccuauccuuggacaugaggagcgagcuucugugacugaaccugaggugucugugguagugauaggauguccuuagcugauucagugggucagugggccagugggccuauggcuuuggggcaggaguuugugacauguuguggccauuuugagauauuuaauuugcuagaggcaccuaggugcaugccuggcuggcagucauucuguacuagagggcugcccuggcccagccugggguauuuuggggugggagguuggaggacacagcagucaaagcugggugcuaauaccucugucccaucuugacagaaucccucugcgcaaguucacaucuauccgucggacuaugacggaggugggcggcucuguggaagaccugauccucaaaggccccaucaccaaguacuccaugcagucaucgccuaagaccacggagccagugucagaguuacucaaaaacuaccuggaugugagugcaguuguauuuuggggucuugcuuugaggggugagugugggaggagcuagcucccugggcuaaguagccaguucuucauggaagcccacccacaauacaccauuccuugcuuaacagccccucauucuugccauccuagaauccuugcuucucugaaaugcucagacuaaaggauggguuaggguggcauugcuugguauuugcaaaagguucuuucugggucugagauucuuuuccuuuuugagggggaauagggugggguggugcuaggacugagucuagggacccccuguaggauaggcaaguacuuagucccugagcgacaccuuuccagccccacauuaagucuugaacauagaucucucaguucagcuacugcugggaaugacucucauccuuaggacugucccaugcugacagagcagccuagaaccaaaccuagccuggugggagucugggagagaguuacuggaccuauauagguccaccuugcuggugccucccucuguacaaguucuaggagaggucucugauccccuuugccauuuucccaagaucaaccugcccccggcucuuuagugcuucccuucccccuuucucugggguugaaccgacuagggccuuguaccuuauauuaggcaaacucuaccacuguacccgcuccuuuuucuuacuuuugacauaauugcccaagcuagcuuugaauuuaccauccucauaucuuggccucccgaaugguugagguuacaggucuggcucagcagcccacucuccucggagggaauguaggccccgaggagaaacauuucuggaagucacauggugagcugguccgagcucuguggaagguucugggccacagccuggcaucucuuaugucccugccccgcccauuacccccuccaccccacccccagucguauaagccaaggaugacuuugcagcucugggcuuuguaguccacugggcuaaauuggcagugccucugucucgucugacccaagcuauggcagugacaggaaacaugagacccaggcuugugacuucgugaagaaggucgaucugucugggucuagccagcuauuuccuagacaggcuuacgcacgugcaaaguacaguuugcugaguaaccccccuguaccccucccaccaauuacuucucuaggguuuucugacacucucuguuguuaaaugggauuggacccugguucugguauccaccaguggcucagcuccuuccugggcagagagaauaugaaugacccaccaccacuaguuaacaacugggcuuccccucagaggauuuggaaaccucugugcaugccuagccucugaaguuggcaggccugguggacucugcugucugugugaauaaaugggaaaccaaggccagguuucuuugcucugacgcagugacuaauuuggggccaguaguguugcccccaugguggccccucucauuuauuccacaggacagucuccagucuaagaccuguagagcagggccaggcagggauuaaggccuucagucagggugacauucugaaacagcagaggggccuuccugccuaccuuuacucauggcugggcuugcggagggccaggccugccugaccacuagucucaccuuccacgugcccaguuuuucccggccccacaguacaguagguaaaggggccuagaguccuggaguucaguacugggucucaggccuacucuucugcaaucuauucuugggagucccuuucccuauucggggucuaguaguuggagauacauguucuagcugaggccuggaccccagggcacucccucccucagccugggccuuucagauuugguguucuauauacagccagaggccucucagguaccuccucuuaccuugaugaacauuauuucuucccuaggcccaguacuauggcgauaucggcaucggaaccccgccgcaguguuucacagucgucuuugauacuggcuccucuaaccuguggguccccuccauucauugcaagauacuugacauagccugcugugagucucucugcuguccucucuccugggacccuuugagaugccuggcucuggggugcucuggcucugcuauguuacacucucagccaugcucaguggccuuuggaacaaucagggugacagaggcccuucugugagaauccaugagcagcuaauaucuauuucccucucuccagagagugggguucuagucccauccuucagucaggugugauacucugaaacagcagaggggccuuccugccuuccuuuauucauggcuggccuugcggagggccaggccugccugaccacuaguccugccuuugaaguucaacuuuuaaagagaguugaaauauaguugaggcugugggaggcagguugggcuuacgauuugcuggugccuggauauagaccaccuccuggacaauacaucaaacaggcccuguucuucucuucugcccugaaguacucacuuaccaggucuugucagcugcagcuuugguauagaagcuggggaucuuugcuggucaaugauagaacaagcugagggcuggguagccuguaaggccaagaccaaggcuuugcauauauagcccaugguccagggguccucaguguaugggcauaggucauggccaugggccaaauuggagaguuagccugagcuacuggccccacagcaccccgggggaggcaagcagacuaacaggccuguuccccugcagggguccaccauaaguacaacagugacaaguccagcaccuaugugaagaacggcacguccuuugacauccacuacggcucaggaagccucucuggguaccugagccaggacacuguaucggugagucccuggggccuguccuuggagcucagaggcccugucauggcaagggguucaucaugugagcaacuacagcugaggggagagggcauggugucccuagcccaacuccaaccacccaagauagcugcugaauugggacgacuaugguagcgcugagugauugggagcagaggcuagaccauuaggaugcuguuugagcaaaggcccuggagcaggagagcccagcaugccaagugaugagggagcagaugggaaggacaugggacugggcagccucaaugugugcagcuggagggacagucaagaguucucaggguuggcagagugaggggaagagucaaaggugggacaugcagugucagcuaguggggacugccacccugaacgacugcugacacagccuggccuggugagugagccaugagcaaaucugcugcuaggguuggggacacuggcucagcugcugggguuggggacacuggcacuagcucaggaggacugugcaggaugcuuuagauugaggugcaagcagagucuuuuuuuucuuucuuucuuguuggcuuuucagaaggguuucucuguguagcccuggcugucuuggaaaugacucuguagaucaggcuagccucaagcucacagagcucugccugccucugccucccaagugcugggauuaaagaugugugccacaaccucuuagcugccagcauacugucuucagaaggccuugaggaaggucugggccaaggggccaggccuggggauggaaaggguuccgaagcuuguugaggcugaguuggguuggaaaacccuaucuguguuggaacaaguacugugaaggagccaggagggagagugucuggacugggcucuuugucuguaggaagaucuuaucguuuuagccuucuuuaaaggagaggccauucacuccuggguuugcaucaggacagcaggguugcagggaccagagaucaauccugccaggauggggcaggaagcugcaaauccugucaccuggcuaggaguccagcuagcauccugcuuaccuggccuuugucugggugguguaguacccuguaccuggcucugcccuuucccugucuguggaggguuccuugugguacuucucaggggccccucagugcacaggauguuagccgccuguguuaccgucuuccgacauguucucagcagcagcucuuuccacuuccugcucugguucuaucugcagccacagcuuugugggacaggcugaugguaggcagaaagaguguggcuucacggugacaguuguggguuuacccagcugcucaggcugcaggcucaguggcuuguccccaaguccaagggcaagaacuacacuguccuaguggauauagaugugggaggguguaggcaaggugggagcugaggcaguaucgucucucgccugcuucucgugucuaguuagcacaaaguccuccuaaguaucucagagaggaacacuguguccuugucuucagcuguguggcugugucaaacauucugucuacauucugcucuuuugacugcccugaggggaaauaucagcuguguuguauauguucuggcuugcagguuccauguaagucugaccagucaaaggcaagagguaucaagguggagaaacagaucuuuggagaagccaccaagcagccuggaaucguauuuguugcagccaaguuugauggcaucuugggcaugggcuacccucauaucucuguuaacaacgugcuuccggucuuugacaaccugaugcaacagaagcugguggacaagaacaucuucuccuucuaccugaacaggugcagcaggagaggcguggcucuuacccucccuugagcucugcuucagggcaaaggauauagaugggacuuaagagucugugcuguaggcuuggccguggcaucagaccuaaggguaucugguagguaggaguuaguuacuuuaccugcuugggagagaaagccaugagccagggacuucagucaggagaugcugguugccugggucagagucugagcugcugggauccaggcacuggugagagcagauguggucucugggcugcugguugcuaggaaagacauggguaugaacuuucugugacaccgcucuggggacaggguccaggaaccuucccuaggacaaggucaggagucacuggggaggacuaagagcccuggguuauacauugagaguguccuuggaggaggaggggugucgcucccugagagauuugggaacuuuucuguuagcagcgaucuccccccuccucaguacaagugagacccccucccugcacacacccuuccuccucccuacacacacccuucccccucccugcacacacccuugcaaggagcuuccagcaggccuguccaacagucuuguuuaggaacuuuacaagaugggcagcuggguguauggggcuccucacucucuggguuuagcuccuggguguggaugggguguaaguagguggccuacugcucugaguugcugcugcugaccacaccuuccuuuucugggcugacuuacuugcaugucuagcaaggguaaccuucaaaugcccaccccaugcucucuaggccugaacccuagccccuuguugaggcuuacuggccccaugcuagcccaaagucuucuaguuuugcuucucccauguuuaaaugguaacuacccagcuuagcucugggcagaguggcucccuagagguagggguguggaugaauaaauagggucauugacuucgagggccucugcuuccuagaauagguaggugcccagaaguuaggcggucuggguguaaugacacgugccuuuaauuccagcacucaagcagcagaagcaggagggucucucugaguucggggauagccagagacaucaagagauguucucucagaaaacaaaaacaaguuggccagguugaagccuggagaccugucuuuucccagucccauggugccuuggggcaaguggcccacaaguaacacuugccucuaagucucagggcucuguucuacgaucucaggauacacaucccccuugcuggagccugucuccuaggaggagccccccaggcucagcaacuaggaaaggaugugguaguuacagccugggccccagggcacuuacucugccagcugggucccccggcuggugacccagagguguggcugcuaaguaggcaggugugaaaccagcagagugaggggcaaagaggcugcggcucugugaccaggcaguguggguggaacgugggcgaggugaggagaggcagggccaguacccauuguguuuccacccgggauugcagaggugaugacaagccaaagccaggccaagguggagacuuaggcaagagaacagggugaggcugagggauccaugggccaggaggaagaugguuacagaggccugccaggacggcagcuccugagaugaaagcuucccuucagcuuuggguaaucgugccccagagugaugccuggccagaugugacacauuacccaggccccucaggucggagguggcaagcuugcauacuuacucgcugguugcugaagaacauuuacugcuguagguacagaccacucucccuguguucuguuugaagguauuguguaggggaguugagagaaauguuuacaggagaagcagagugauagcaagugcuauguccauggcugaagccagcucagcuucucaggaccgugacccuggcuuccucuuagaagccugccuuggguuuugccaggcagagagcaucccugucccucagcuccagccugacucucagccuugagcuuggcuaucaauggcuggcccugaucacccccagccaacauccugaagagaagggccagcuguacccagcagcuuuugugggacugggcuggaagccuauaucuauagggccaaggauccucaacagggcagcagaugcagaaugggaacuuagcuuaggauccgagcccuaggcugggugagcccuaggcuuaucccuggccaggcagggcaucaugaaugugucaggucagaaacauauacaggcauguuucugucuuucaacaguguuagaauuuauuaacucgaauuauacauacuaaauacguuuuauuuacuguaauuugccaaggagucccaaauuuauuugauagccaaccguuggcauuacugauucuuuuauucugauuuuuuuuuaaaugugugucugcgugggaguauguucgucugaaugcaguugccaguggaggccaggaagaggguguuggauuccuaggagcugggaagugaacucaguccucucuaagaacagcaagcucuuuuagccacugagccaucucucuugccaguuuucaaaucuuaauuaaaaauacuaagagcucacauguuacccuucacccaauacugucuauauguucagguuccagacuagcuaagaaagggcugcagagccuggagacgcuguauagaaguuggaaguagagagcugauauaaacacagggaagaguagggaacugcauaagaaguggucacaggcacagaaaugucaguugcagguuuuggugacagaccuuuuucagggucacuuuggaaguguacugaguucaaaggcaggagaaucuguuugagccuacacccuggggacagaaccaaggguucuuugccaaugacagaauuccuggaccaggcuugucgguaggcuugcugcauuucagucuuagguugucccuuuguaaaucccaggugaggggggcugucauuucuggugugacugauaagcuggagucuguacgagcuaggauccgauaguuucaguugugguuuuaucaguucguuucuccuggugcgcuaagaggugggaauuugcuuguguaaauaagauaauagagucauucuuuuugcuacuuacacucagaauggaauagcugaggcuaaggacguuccuuucagagcagguccaccuuguccucaacaguuccccaggucucuccgcaggggagcccuccuugguugccccacuuaaucaccuuccuucugaugucugauccuuugcugacacuucugaacuaguggguagaagcugaucacuuacuuccuccuagggacccagaagggcaacccggaggagaacuaaugcuugguggcacugacuccaaguacuaccacggggagcuguccuaccugaacgucacucgaaaggccuacuggcaggugcacauggaccagugagucgugggugucgcugggggcugggaguauuauguaggggugaugugcgggaagccugggcaaaaaaagcaggugucuuccaaggcagggucuagacaagcuaugcccuauacucaccugugacaggguaaagugacugauacauauuugccucauagguuggaggugggcaaugagcugacccugugcaagggaggcugugaggcuauuguggacacagggacaucucuucugguggggccuguggaagaggugaaggagcugcagaaggccaucggggcagugccucuuauccagggugagguaagcuacuggccugugugggcuggccagcaggcagagaggguucccgagaccauaccuucaauaccacauucuucucucuuguguaucuuaguauaugauuccuugugagaagguguccagccugcccacggucuaccugaagcuaggaggcaaaaacuaugaacuacacccagacaaguauauacucaaggugagucggugugggcgguggcagugugaagccgggacaccuugagugaaguguggguaccgugugaucacaugugcccauucuggccuuacagguaucgcaggguggaaagacaaucugccugaguggcuucaugggaauggacauacccccucccagugggccgcucuggauccugggcgaugucuucauugguuccuacuacacuguguuugacagagacaacaauagggucggcuuugccaaugcugucguacucuaacuugcuccuucuccacugucagggaacuggaucagaguccaguagaggaagccagccagccccaucccuccaccugccccacucacacauagucacacucgcuuaguguugcuggacccuugggggagaccuggcuggagcuuguccagcuguucuguucugugguuccucacccuggguucagauugcugcccucugccugucugaaggaggccaaggcccacccaguacacgaggcugccuucaaaggccccuacugguuuaauagcugcugagauggauugucuuguccugccgcccuuugcugugugggcaguacucugaagcaggcaaaugggucuuaggaucccucccagaaaccugcucugacccagacccaucacccagcuuggggauggcaccacguucuacugccccuccaacucuggccuggcaaaggccugaaggugagcaggaaggagcaagaggacagaagcaaaacuaugaaccugggggguuaccuagggcuugaccccgcccuccugggaaggcaugccucagccugggguagagguaggaugacugacugguuuuggcuggccucugcugcccucauccugggcuaggcagcugggagccaaaguugaaauacaaauaaaguuguuuugggccuugaucucuau

SEQ ID NO: 4212 - RNA, 34059 nt, Mus musculus
uggggggcugaggcucuaggccaccgcccaucuacagagaaacaccaggagccauaacaagugcacccacaccgaagacaccaggcccauggcggaggcugccaucgaucccagaugcgaggaacaggaagagcuccaugcagaagacagcgaagggugaguuccacuaugggcaguuugcuuugugccaagugcugaguaggcagaaucucagauaggacuuagauagccuucagaaacccucucuuaccagagagguguguaucuccucuaucucccucugcagcuuggccuaacugggaaaggcuaucuuccuggcuaggguucauagccagaauagagaagauggaugcuugguguggaagggacugggaguggcuggauauggccugaacagcaggagagagcaguagcuguguugggagaaacuaggccuaggaauccugaccucaugcaccuauaggcuugucugaggggucuggccugccuuaagauacugagaggugaccaggccucagggguucccaaagcugcuaugugaggauagagaaggucaauggugucuuauggaccaggcacuguuguuaaguacaguggguaugggaaugaacauuggcaaagguaaagggggccacugcccugcaacagacagggcugggcagaggccuuuaggcugucagcugcuuaagggcaucugcaauuuaaagggaugugaaggguguucccugucuuuccuguguugggucauaagguggggguggggguaaugagaagggaagcuguuaguggguagacauggagaccaagccaggccauuggugccugcccugcccugucccaggaacaggucucagaagagggugucaggucuuggggacaggucagaggcuagcagccucaugggagcaggaugugggggcugcgguccagguguguaagaggaaggggaagaaagagguaaaacauaaaauugcuaccggagcugccaggcugccagggagagugugacucuuaggguucagccacaggcucaaggagauaaggcccaccuuagcagggguugcagggucucugcaguucgcaagccggacgccagaucuugggcaggaacagcaauuccucaauccuuaucaaugauaaugggaagaaaccucacuuugaggggugcauguuggggggucuccacacuauugcuuugcauuuggacccugguuagaaaguuguccaaggaacccucaggcuaggaaaggagucugaggcuaagcagagacuggccuggucugggucagcacccuugugccagccuugggauuccagggccauguuguucccagaaaggcucuaugaagucugucuccugggaagggggacaugcaucgugacaucccaagaagggcuccaaggacacucugcccaggcuggaugaggacacaagcugcgggguguguggaacagggugaucagucaacagcugugacccuguucagaaaugacugcacgucagugccccugccaccuugugcccauagaagggcagcuucaagcagccaagccagccccacccuccuccuaggcccuuccucagcccccucucucagcugucucaaaugccgaggucuaagcagcacagugaagggugcccacagcucuggcggucccagccgaucccuagucaucuugcuguaggaccggagcugggcugcaccugugccugucagucaggaacuccuguuccacaauccuacagccuuaaaggggccugggagccccuuaaagaccuccuccccaaaauggaggaagaaagaacaaagugcaccaccgaccuuucaaaaugaaacugagacccuggaggaggagauacugugccugcuguacagggugacucacagaccagggauucuccuguuugaagugguaaaguccccagugcccagaagggguuauuuggucuaagaaguucccauucaggaagccccagaagcccagagcugaacagggucaguuugggcuggaucagaucagggggaauccccaugcugugcuguccacaguagagcaggugcaucaggcagaagccaggcucuuccuucauaccugcccugguauaccaggguaagcauggcaggacacaugcacgccaaguccaaggcagucaaaccccucccacagagccucagaaggcaggaaggcugcuugcuguguaccacucccgaguuccccacaccacugaugcaagccugccgcucuuccucugcuagggugcugucucccggccugacuacccaacaguagcuuauuccugucccuugggagcaguguguggcaucuccauaggacugcaagugacuugcugauacugcugggugacaccuagggaaugucuugcccuaagaccaaacuugaacacccuuacaucucuacuguguggugccuuagaagcuacaaggcagucauguagcucacagagaggcucagcaugcccucacaggccucagauucaaacacuauccauguccuggaacccuagcucuguguggagccaugccuccucucacugggagcagucucauguagagggaugucucugcacaggccugccugacccauucuaccuggccaucuguccucucauuuguauggcuuauuuggcuccugggaugucugcauucugauuuuuuuuucagcaucugauguugcuuugcugaggguccugcucuggaacuuuaucuauccuggaaaccuuucuggccuaugucuagaccugcugaccaacaggacaaucuaaggguuaccuaggcaggguuccuuccuggaccaugugugccucugaccccugaucucuagucagagacuuugaacacuauugagagucuucuucuaagaggcaggagcccaguggagggacccccaccccaaccuugcccucccaaggugugcucugaggauugaaagccuagaagcugaguccuggagcucucucuccagauggcagagcugagccaggcagagccaagucagagcuuccugaagacagaaaggaggccaaacagugaucuuccuccugguagguccuaggcuuucuaccaccuuccauccagcuucaacagauccccaucuugggaucuguuggguuggaaaggggaaaccagaugccuggcacauuugggacaucacaggccuaccuuucccccaacugagguaggcagaucuggaauaggcuggggacugagggcccaggacgggauauccuuacuagggugacacugcuacuagggguucccacugccucaguuucccuaagagguuuaugugggaaggcuuagugagccaugaggagguaaaggcuugucuggggaagagacccaugggaaguggaccaggccuuuuccucuaggaacucggacuuuugggauagggguugagaugccauuucaaggugaggggaagaaggguaaagugucaccuucuugugacucaguuuccccaaccucacacucagaaugcagcugcuuguuucuagcauucauggacugagugucuuugccaagcucuuaaagacucuagcaggcaaagaucuuguaacaccaucacugcaagaauggccauuuuagagauggcuuucugugucuagacaugcccguugugagcuuaggguaaagagcugggguuaggcuguuccaggcugcuucuuaggguacucuggugagaguccccagagugugcccaaugcuauuaugcaaaggagguugauaaggaaucaguggucuuuauuggauauagacugggucaaggugagggauacuuuguggggaaagcccagguugaguggcaagugaucuguggggacaucccaggcugcaguagaaguguucuguggggcacuguccagauuggcauagccaugaaucucugcaucugcuacgguagcacuggaccauaaggcuguggggaguucuucugguucuacagagccccggucuuccugucacacaguaacuuuugggugauuucccauuggccuugaggcauagggccuccuuuuggauuucagugcuuuaauucuugcagaggacagguuuggauaaaggggcuaccugaugacagcccauccaauucccaggauuagguuuucaccagccagccacuccuacccagcaccaaggagcuagcagaaaagcaaggagcuauggguuuagaguauaggaguuugugaguggauaguggguaagucaggaaagccccuguuuuuucuuguggccaggucacuauuaccaggcucgguuugcugaucaccuccaaguugggaaguuguaaguuggcauggaagaaagacugcccccaucgguuggcagaagaaacuaauuugcaaauucaagaugcaucuguucccucugagcccuucuucauaucaggacaccucagagguggaacaaaguaggcugugggugguauagauagggccaguauaaacccuagcccagugugaccaggugcuaugggaaggcugucuagaaugucuuggagcuccugucugucagggguggcauggguccuaucucaacucuccuuucagagccuugguuuuaccaccugcccuuuggauaugcacaugaggaugggguuucaucccuaguagauaggucuucucagguucacauccuucugucugcaugaaggagaaccacccucccaccacaaggugacuguaccuccuuuccuaaaagcagccuuuaggaaaggcuuucuuucucuucucuuucccuuccuuuucuucccuucccuccccucucuucccuucccuuuccucucuucucuuuacuucuccuuuccucuccuuucccuccucucuuuuuccucuucccccucucuccuccuuuccucucuucuuuaucuccuucccccuuccuucuccccuccucucucucuuucuccucuuucucuccuuuuauuuucccuucuccuuucccuccuccuccucuucuccccaccuucuaccucucccuccucucccaggaacaucucuucaaagagcaauaggacucaagacagaugaauauagcuaguuuauuccaaagaaaucuggaaagacucuguuacccuuucuccuagucucagcuccaaccacaguuggcuuuaccacacccagaucccuggucccacccuuagcucuggcccaccagaccuugcuuggaaaggggaacacauggagcugaugaauguggggaaacauuuggagaguuccuauuauguaaaucagagccacauuacuauuaaaagccacuaucccagacccugccaccaguaggcuuauugugucuuucuccauauaguacauuggucuguaagcaugucuguuggaauaugucugcuggggguuauaaagauauuuggacaaggaagaagaucuaugccucccaaguucuguuuagggucuauuuuauaagagggaccuaaccuccugaggcuuuauucucaagccaugagcuuuugagccaugucuagucagaagaagaagaagaagaaggaggaggaggaggaggaggaggaggagaacaagaagaagaacaagaagaagaacaagaggaggaggaaggaaggaaauaagaaaauaaaaaaagaaucaguaguggaaaauauaugaauauagggaaagauggaugaaaaaagaaaguauggaaacagcaagguggguagauaaaugaauauauggaaggguggguggauagaugaauauguggauagaucuauggauaaaucaauaaauggacagaugaauggauacauaaaaggauagauagacagauggggucaaugaacugauugaugaguagguggauagguggauauaugggugugugggaggaagcaugcauggauggauggguagcuggaugaauaggaaguagacggauggauggguggauagucagaugauauauaagugaggacggauauaugguugguuaggugaaugugggaugaauaggugaauuggugaaugggugaguugguugguggacggguagauuuaugagugaguagaagggugcaugaauggauggaugaaugcugguuagauaaaugggggugaaugaaugaccgaauggguggauauguagguagguggauaagugggcaaaugggugaguggaguuagaugaaugaauggauggauugauaaauaaauggguggauggaugaaugggagaugaguggaugacugaaugucgaugcauauuugagaagaugacugaguugauggauggauggauggcugaauggaugggcggaugagugacugaguagauggaugaaugaguaaguggauagauggaaagauaaggauugauaaaugagugaauaaaugaguagauaugugaguuggaugggugacuggaugaauguauagguggaugaagugagugaaugaaugacuaaauggguggauauacaugaguggaugaaugagguagaaaauggaugaacagauggauauaugguugauauauauccaucuguuauauaggugguauagguguagagggauggauguauagugaauggauguauugaugagugggcgggugaauuggugaauggguagauauaugggugaaugggugggugagugggugguuggauggauugauggauggguggguggguggaugaauagguagguggguggauagauggaugaauaaauggguagauggacgaauaaaugggugaguagaugacugaauauaugaguaggaagaugggugaguagauggguagaugaaugcaugcaugaguggauagauagaugaguggguauguggauaaguaagaaaugauggauggaugaauggaugaagggguauauaugugaauguguuguuggauggaugaguggauaugcagauggguggauggaaggaugagguguggguggaugagggguggauagacggaugacuggguauguggaugaauaaaggggugaauggaugacugaaugaacugauauauggucaaguggaugauacgaauauauaaggguagauggauggguugauagauggauaaaugggugaguauaugggugacuggauguauggauagaugaauauacggaugaguggauaguuggauagauaaauggguguguaguugaauaggagggugaauagaugacugaauguuguuuggauauauggauggauggauggauggauggauagguagauggggguuguauggauggauugaugaauggaaggauauauagguaaguagauggguauguaggaaaauggaugaacagguguguguacagugagugguggaugggugguugaauggaugguggauggaugauugagugagugaaugagugcagucauaaauggaugacugacuggguggauagauggguggauagauggauggggguagcuggauggaaggaugaauugaugaauagauagguggauggauggauauauggguaaguggaugguggauggauggauggauggauggauggauggaugaguggauggaugaguggauggauggaugaguggauggauggguaaauggguggauaauauaugggugguuggauggaucugaauggauaguuguguugaugaguggaugagcugguugguggaugaguagauuuauaaguggguagauggguaaguggguaguuggauaaauggguugaugagugagcaggugggcaaauagaugaauggauagauauauggauggauggagguuggauagauaagugcaugagguggauggauauguggauggauagauguauagguggauaaauggaugcagggaauacauaaauggauguguuggaggaugggcacaugggaugaaagaauagguagaugaaugaggagauagguaggacauagauaaaugacuagacagauaucaagacaggcagauugugacuguaaauaaauaauggauaaauagauauaacaauagauuuguggguggcaagauaaacaaaugacaaaucaagagauggauaaauugguaugaggugaacuauugaagauacagaucuauaaaaagacaccuuuccaucauaaauuuuauacuaucuuucugcuuucucccauugugagaaagucucucuccaucauuucuaaaccaggaaacacuuauuccuccccacuaaauucuucuuccuuaauaucauacaaagcaucucagucccuugguccccucuauuuccuuacccugacucaugcuuuuagcagcauuaaccaucaucugcaauguguugauacauauuuacuuauuuguucccauuaaaaugucagugagccuuggagaguggugcugaauucccagaacauuaaaaguuacuggaauucaguucgugcuucuugaauaaacauacagacugauggauaaacguguggauaauuacauggauaugugaguagaggaauggcuggggcaggggaagcguagauaauaacugggcuggaggcugauuuccuauaguguuauugacuugcuuggaugaccaugcauacagugcaacacacaaagaugugugcagcugugugugcagcuuccuagaagaugucuuagacagauuuaugaaugaauauggaaaauguauaaauaaaacauagauaucugugcagaugaaugaaaauaagagcagaaggcugauuuggagaugaaaguauggauugaagaaauguuccugguuagacaaaugcacauacaaauugaaggaugaauaugcagauaguauuaguuaguauguaacaggagguuauugugcuccaagcagcuugcuaaacauuucuucugaguguacuaaugaaauaacucagugugguaaaaugguaauugccauaaaagcuugguauccugaguuagaucuccaaaaucuguauaaagaaggaaggagggaaccagauccacaaagaucuucuaaccccugcaugcucacugugauauacccagucucccuuaauaauaaguggauacauggauaggugaaaguacagaagaacgauaaauggauggauggauggauggauggauagguagguagauaaaugaaugaguauguagguauaugaguguaugaguggguguacauauccgguauacauggauaaauggauaaguggguggguagguagaaaaauaauagacaguaaggccaguuucauucuuuccccuugucuauauaugucauggcuucaaaaccuuaaaucaucccacaucucuucaggaaaacuaccaccgauuaaggcagcccuccccugucuggaaacauucuuccuucuuuugaacccaaauugccccaaccacaugucauuccuggcugucuagcuggaauaggaacaggggccaggaaguggugugguaaguuaugaugcaggcacagaacaagcugguuuccugggcaaucugguuccacuaggugaccucuuuaagucaccagagggcucaccagagggaguuucagaguguguuguuucuuaugucuuugugcuacuaaggaaacacaguggacucugcugucucuuuucuacaccccccuggcucuaucucuuccugggagauucugggggagggagaugcuguaauugcuaugcucagaacagccggaucucauccuguagcaaguguggcagaaaaggcggguagucagcuuuuuggucacuguagaucugagcuggggauccaugggcgaccgcaucuguguugccacuuuaaggcguuucuccuugccaccagugagcuguucaugugaccccccaacaccuaccuccguccucaggaguccccaggucuccugggaucugacuuccuggcccaccuagaggucgcaguaacuugucugugccuauuuuccaaguguggagauagaggacaacuagaggccagcauguagagagagacacagugggcaguugcuggcagucaaagacucaacuaugguguuggcucugccagacucuggcucuaugaccugagucacaagugcuguuggccagccuugguuuucccauccagcucaugggucuagcaguacugcuuauccacagcuaugagugugggugaucccggaagccaccagauguaagccuacuagcccaaaacuggccuauggcaucuuccccccccaagcccagccacuagccuccaguguucuccagugagucacagugacuaagcccaaccagcaaaacaaugggcugggcugcuuugucccugguuccgagccagaggauaggguaggggggcuggcuggugagggcaccggguacccuccuacacucuggggacuuuggcucccuacaccaaggaagaugcucucugugacauuuacucccugcuucgaauguagccugagauucuggggagggcaguagccucccaacuaaaagaccugggaagauuccuggggugcccagccuccccuggagguuauacaagagcagggaucugggaauaaacagagggaaagugaagacccagagggagggagggagggaggagggagggggaggagggagaggaagaagggagggaaaggaaugggggagggaagguaggaggaauacugagauagggaugaaaccgccaguggagaaaagggcaaggaggggcagucagccaggucaggggcagcugaggcccagaccugggaggagaggaccaggggucagggagagcaggacucaaagcagggaccagaaggcaggcagaggugggcaagaggcucugaugauggugaggugaccuauggccaggcacccagagugaagugguaggcagagaggugggaaaugacagaagcugccaagauggucugaggggggcagaccaccaugcugcccacaagcgggcguggagguccagccaggcccccacacugcggggcugggaggguuucucucugacauuuuuacuagucucggaaggaggaggaggugguggagguggaggagaccaagggggcggagaagggggcugggggacaaaaggaaagcagcugcuaagcauccugagaaaggagaggggagagagacccacagaaacaggguccagggacaguggaagggccuggggcugccaucugggagccagccccagacccccgcccccacgggcuggaggggcugagacagacagauauccuucagacagacagauggaggagacagggaagggcugucagagccugagagaccagacagacugacagggggaggaggguagggacaaggacacaaagagagggacaaggagaagggacagggcagggcagggaagaagaaaggaaaagaaaaaagggaaggggaaagaggagaaagggaagaaggcagaggagaacagaggugcugggccagagcaccaggagccuuugaagcugcaggcuguguccccagggccaggggucaggccaggucaucagcgucgucgggcaggccugcagcaugaauggccccgcacuccugaggagaaaugcuagcaaacggggccuggagaagcugcugagguaggucccucccagcccaggcacggugcccgcggugcccuugccgacagugguaaccccugugcccagacuggcaagauauguggcccacaggcugugcccggcugccuaugcacguguacaggaagauagugaagccuagcacgaaaccaucgucuuggccagccagucagcugcacuucuuccucccaucacccccuguguguccccaggacccacagagaauuuauccucagaguagcugccacaagccucccucccaugucuuuuuccuaaccagucacccccacuuuacaaaugagauuggacuugcagccauagaucucaaaaaccacugagcugacaguccugggagugggaggcacugaaaccuuucgguacccugacucucuggccacugggcuuuaggucuuugagucuuuccucugagucuguuuucuccuauguaaagugugugagagaaagcagacaaugguaggcccagaaccugcaacucucagguacugccaauaauuaagggcucauugcugcucucugagccaccugcugugccuuucuuuucuucccucuucuagccuuaaggcucugcugcaguaccaccuccuccaagaagucugccauggucuuccuagccaggaaggcuuggcucuucugcucaucugguggccuauucccuggcccacuuccauggcugcuuaaaccccaugcuccugaaggguacaccuggcauuguuucauauuucuuuguguuuugguccuggcucucgguggugagacagggcacagaugggguggugggcagauggcuaccucuacauucuagcucuagcaugguucgagcuggcaaccaaggucagaaccagcagugggucuaagcuggccuuccagcuaacccccagccaaauacuauguccgugcuucaugccagucuuucaggccucgcccaaccugcucagaguccuuaugcauggccaccucacacaggcuauaugucucuccgguccagacugggauguacccuccauugucacaaucccuuaugguauuccguguccugaaaauuuaggggcagcuuugaucgaucuuccuaacucacuaguaccauauaacaaucaggaaacuggucccaguacccugguggcuuuaggguggcagagccucaaguccuaccaccaagcugauguccugguaacccagaagcagggcgauggggccauuaaagcucuagacaaggcaagaccuugagcagggguuaggcuuggcaccacucaaagucuugagcugaagaaauguggaaggaaauccagagaccaaggccuugcaaugguuaagcagugggcaugacagggggggcaggucccugggaggucuuagggaacucuaaugguguagaggauagagggagaauggauccagggguuuaucccuugugagggaugauagagaaauacguguccacauguacagugggucuaaaauagaugaaaugggguggugucugggguagauauaugcuaagcugugcaucuuugggagccugguccugcgauugaacuggggucacauacccucauguguacugauacacacauaugugcagacauauuaugcuaccaucuuguaccauuaagacccuccaccccugaccccuucauguuccuuguccacaugucuguggcauccaacacuguccacuucacccaccccucgaggacagcucucuacuuugucucuguuaggcagacaaagaaaguaggcucagagaggucgagugacuugcucaaggucacccagcaggcaauggugaaccuaccuccucucauccauugccuuugucuagauccuuccccaggaacccaaggcucucucaccacaccugguagcagaggcccgacaguccccucugugauaagcucuggagggguugcuguguggucaguagaggccaaggugcaaagugaauccaguuuaaauuuaaaaauacaauuuuauggacuaaugagaaaauagauaguaaaucccccaagucuacuacuuugagucugugugugaauuggggucuuaacauguugcugaccaaaccccaggcuuacuccuacucccuuguccuagggauuuaaguagccacuuccugucccaggagagucaggguccuuccagguccaccauaggucagaccaggguuaaggaugauuaccugggcucucagccagcuaccugguucugcaguccucugggccuagauuuaagagcagcuagacuggucaggagcaccuuguguugauucuggccuaagagucugagccgggagucccuuggcuagcaucaccaaccaaagcucccuugaguaguaggagccucugucucaucgguuccagcacccaucagcuagcagauagcauggcaucugucuauggcuccccagggguguaagacucuucaggcgggcucccaccccaacauguggcccacuggguccuuggggaucccaguguggcagaggguagcagauggggcuggcagucugcuggguggcccaguggggggaggggaagccaggccuccaaccacaguguccagggaggcguggcuccacgggcccauuggaggccgagaucccgagggugggguagccccacccuggcaggccggguggccggugggcggcacccccacgguccggguggucugucugccagagccuguccugccuggagccuggccgagcuagcagcaggggguacagggaccaaguggcccagcccccugggcagggugucagggccagagcccagaggacugagguuccgguuccagucccagccggugcgucagagcuggguagaucaggcagcaagcaacaaccagggcgccaaagcacccagaaacucacccacuccauguuucugcuggagucaggaggggacacccaggggcucuugggacccuugggauagcagcagaggcauagcccccagagacacugcuacaggcccagagcaucucuccagagaacaaugccaggauggaccaccaaggucuacagaggacaggugggcacauggauggcaggagggcagagggauucaggugggcauagggguugaagugggaaaguggcuaaaagugggcauagggguuuuagaugguaucugggguuaaaccccucagauguuucugugggcagagaaagguucucagucucuguuaccaagugagaccagaucuggcccucagccuaagauccggcugugcagguugaucucccaaggauaaggaaugugacucugagggucugcuacuagccgaugguacucaggggagacagagggccugcccuggagaugcuggugccaagggaguaacacauugggugcuccuggaggcuuugaagguccccugagaaaacgugccuuaucagguaggaaagaagacgaggaagaacugagaaggcggaaaagaguaagacacacaaaggggcuugguggggggaggggguuccuagccagcaacggagggaggguaccuucugugcugucccugccuagcugaacugggcagggagcccuugguauuaaaaggggacugauaaagguggcgguggcaggaagaggcuugggagccagcaagcgauggguaaaggacaaagagcugugggaagagagggagaagcugguaucccccugaaccaggacaccccacacacacacuagguccugcuucucgacuccuauugcugccuugucuccuagcauguauuuuaaagagagcaaggggcucacccugucaugcacaggucucccaggucuaggacgcugcccuucugagccucagccuaagugguggggacauugugagaaccaucaugcuuguucuuucucucaaauauggcuguucaguuuaucucuaggcauuggccagggaaugggcccaggggaccagcucaggucccacuggccucagcugaugugacauccauagggaugugugagucuaucacagcccaugggaggcuugcccuuuccugcuucaugcaguaacuggguucagcuuuaaggacuguucgaucaucucuggcugaaaguugaaauaggcgaccugggauagaccucuuucucccuucgcaccccaggaaugaacagucccugagggguuuaguagcacucagggcacagauguggccacagggccaggcagggugucccuugauccgggaacagaugcguguugaaaacaaccaguaggugcccagcuacuugucuggcuccucagagaggcaggaaaauugaggcacacagggacucagggccaggcauaggaugaugggcugggagagugacuugacuacacacggugaccugccacacaucuguccaggugggcagccaagugagacaauguguaaaccugugaccagaugaaggaugagccauuugagcagcguccauuaagagagcuauagccaggccuuuggggugagguagaucuggguacagccagcaagggaggaaagaggagggaauggcagucucaagccagugccagccaccgucgcgugucagggaguaugccagagccuugccucgugagcgcugugaacauucugccagggcugucugcugcugugagccacggucucucugagcccaguccccaccggaagcuuggugaugaggaugcugaaggcaguucugaacagcagagcucaggcaccagggaagucucaugccugcugugcaguuggccuccgccugugacaagucuggucagugacacggaggacacggugugcagauccagugaagggagaaagcaagcucaggccagcacaagccgccgucaugacaggaugugacagaugggaggucuagacccugguguccaccccuagaccugagggugaccugggacuggucagauugguccagagaugauuugaguuagaaguucugaaugaggaagcugccagcaguggacugaccaggaaacacaucauaaagagguaggguucccaaacccaggggaggggaugggcuucuuugugggacaaccagcuugguucuagacccuacacugauggcagaaucuugguccagccucuggaugaggugugggauagaggggccugcaccauucuuauuuucucagccucaagaucauaaagaaagccuuggcagaacccagcuauagacuccuuugaaacagccacaccuugaguugaggcucugacugucugacaccuuuuccaaaugcagacuugugggggcgugggggugggggugcuugcuugggcaguuugagugcuguaauggauugguguggacuaccccugacucagccagguucuuucaaaggguuuuguggucccuagguggacugauauacccucucucugaagugugacuccaagguacaucccuucuucaccccagaggagagauggugccugccucaccugagugugcaugaccccaggaaagaguacacagguggcaagauacuaaguggguagcccuagauugugagguaaggauagaugggaggcagauacaagauucccuucccauguaaggcccccagaggccagggagccacaauaagaugguugugggccuagaccaaagacauagggacaaaaggguguggcucuguuaaagaugggaauaggagaacacucuuggggaaaaccagcuuuggcgcuggacaccuuccucuccccagaucccucacaccauggucucuccuggagaugucucccagaugccuauguuuuugaugcccugauuacucuguagcagccccucccacccccacgccaccagggcaagcauggguaaugauacuuugccuuaaguauccugugucgguugcaugucuccaccugcugcccugugugacugagagaaccuguggcugcuuagguggcccuugaucuacaccaagggucggggcuggccucuccguacuacuaagaugcacuggguaguggaacgcuuaccauaguuggcaccaguugucaggggaaugcuuaagaaagaaagggaggguaccaugguccuaggaaggcaacugcagcuggugugggggcaguagagcauguaguagauauuggggugucauugagcagaagcagguucccaagccuucagagccagggauggugucagaaagaagccuuggucucucugacuccccuugcgggugguaagcccagguacagccucugcuucccuacuccucaacugcaagaaaauagaggggcaguccugcucuguuccacagagagaacugaagggaugcuggcugggugggguuuguauccaggggucaagagaggucaggugggacaaaggcagaggagagagccagaagcacagccugacacugugguuugacaggcuugacagacagacagccuucucuaagagucccuggcacugaacgccaggcagagaucggcugggaagacuacaggauuggggguccuggguagagacaacuagaugucuuccaacacagugugcugccccauaagaaaaggcagaauugugggcaggguauggccuguggggacagcacagguuaugauggaggcacauugccuuagcuguucaugaagacaguccccaggagccuuugcauucaaaggguacuaagaguggcggucaucuggcccaccuacaaugaacaguaccuccgucuggugggaaggagagagcuggaauucacagccucuucugaggcccucuguaggaggucuaacuccuagaaccccaggcugggccuggauguguauaggacguguguguguguguguguguguguguguguguguguguguguguguguguguaugggcacaugcauguguaggagaguuccuucauuccucauucccuugcagagcugcgaucccaccuaacccuuauccuugcucucccagggacaugcacccauaggcucuccccacugccuucccaccugcuagcccauucuucuuuuccccagggcaggaaacagguauguucauccugauucugcagcuuccuccauguuguguccccaucccagggcccuugugcugggcugcucccaugacagcaauuaacuccuuacugacugugcucaccccucaucugccuucuacccuugaggcagccagagcuuccuggcucugagaaucuuuucuuccugaccaggaccuucuaugacucccauagccccagccaaccaaucuuaacuuuuuaaucuucccaaggcccaccccuuaggcuuggcuaccauaacccuucagagcuaucuaucccuuguacagauaaacacuaaccaagucccaagaauguggacugcuugugucccgaggacagggcagagaagcacucagaacacaauagagggcucaauucuuaaaagugggaagcccagaucccauaggugugcuugguuguccauaucugugaccacgggcaguagccuaagaaucugagccacugaggcugagccccagguaucaacuuggguguuuuuuccuccucuccuggaugccuccucuccacagugccuugagcaguacccuggggugggaagaccuggguaccaggcggccaaauaauccagccuucccugugccaucuaccccggcuccacuuggcuaccucugagcuacucaggcuacugcugcaggaccccuuaaaggucucugcccucaggauggggcucuggcagccaugaccuaguauugucuaucuccaggggcacucacaucccgugcugcagauccaggcuucauucagugucucucccagcccagacccaggucuugcugcacaugucauggacacuggaccauucugaaggccacuucccugucccccaugcccagcuuagaacagaguuggcuucucuuucucccacuuacuucuggccuacaucucacuccuccauccuuccaugucugauccugaacagaaccagggcuucccacaugugggaucuacucaugccuggaagggccacccugcuggcccauggagucccuccgaggucuacauacuucuugaacaguugacuucaugucacucuccuucucuuuggccuaaaggucccauucauccuucauaauugugaucaagaucgugccccaccccuucaaacaacuuccugcagugcuuuucugggcaguggagacagggucuugcccaauucaauacacugacccugacaauaagaaaagagugaucccaccauguccaugcugugcuagaaagaugauggagagcacacugaaccagaaccagaugggggccagguuccuuucuccucaucugagccucagggagggaacuuguacucuccugccugccuuacauaaccacucuccuacuaaccaggcucugcacccugagcucaccccacauacccaccuccacgccucuuuccggaguuggguggcaauuaagcauuuguacacccgaaccccucuguagauuguccacagggagugggacccccuauauccaacaaucaauggguccugcagcuaacagcuacagggacuggugcuuagaagugugagacauggguggggaccuacagcaaccacucaagacuuacccugaaccccccuucagaggucugccccuaucucugggagccuguaccaggagguuuuuuuuccuugcucugccccuucucccaaaggcucuaccacuugcacaucaagugcaccccugaugagcagggcugugaccuugggaaagauacuccccagaggguaagagacccugguggucccagagagucaauucaacuacuccugguggcugccuccaggcuccucacuacuuccaguccccugcuacucaggagauggugauaggaggggucccuggaggaggccugaaggaucccaguccccaguccucucuacuguuucccuggggaguguagaaacaguacugaccuuuggguucaaauuagcuggagggggcagucacaugggcagccugcagggggcagaauugcaacagggacugaagccugccgaccuggaauuauucuugggagaacaaagaggguggguaacugggaaaacuggacccaggaugggcgcuccuggcucucagcaggaucuagggagcgcgggaggggggugggaggagaaggggugcggagggugaagagggacaagacauugagcaggggugcagaaggcagggguaacugccuugaguuaaagagcuccacucagagcgggagcuggugggggucuauacacccuggagcaccuggguggggccccagccccaggcccagcuccaaccccagccccagccugugguaagcccugugacugcgugggcaggauguggggggacagggccccauuccucagcccccaggcugagcccugggccccccgagccagaacagacucaggaaauggucugauugcguuuguacgggaacgccaaaucccuugcagcugcgcggggccagggccacgggcggggcggccaucgccagcgucuugacagcuccgaagaacgugccaaggggucugggccgcuggcggggggcgccuuucccaggccagaggcccccaccccaccccaccccaggagagccacccccuuccaguucccagaacggagcccagcuguggaauagugacggggugaggucauggggagggggcgcauuacucauugcuugaggcaggcgggagggaaaaggcaggggaaaggggccccaggccuccucagccucagagcagggucaggagcugggacaagcuucuucccagcaagaaacaggaggggugaugcuaguagaccccuacccuguacccccacuguguccccaagacuuuguccaggaagggcuaaauugggguaacuuuggaggggugugggucccacaaaggauguucucagaaaauacacuuuggccuccugccagucccaggcucaggccggcaccacguugucggggugaugguuagcaaaacaguaaauagugaggcaggggcagcccccugagggagcuuggaaggggaugggaccugcuguuugugauccccuguucccaacccuugccugcacagguuugagagugacccuguguacucacgugugagcacguguguaugagggccugugugugagugccuacguggccacaccagauguguguguauccuguacccaggucaggagagagaucuguguuugggucccuguacucauuccuauacucauugcaaacccagcucccagccccucuucccaggcuuuucgugcuggugacaggcugugguagcuuggacuuucugcuccaagagugaaguaccccaaggguuccugcaaauaaaaaugcuugcaggaagguugcccuuguuagaacaggugaagcucugaucccauucaaagugagacacacacacacacacacacacacaccccauacuccagagaugagcucaguccugugcuccaaucuccagucuuaaagugcuugcacacacauacaagaacuuuacacauaggcucaaauacauguacacuuacccugcacaugcauagauucagauagcaagaacaaacugaccccaggggguaucucuuuauggucugccucugaagcaggcagaauggggagcucucuuccccccacccacucugcccugauaucuuuggggggcugcugguaaacguguaugcaaggagcgacacacagagcuauaauucacuagguggagaggggccaaaagcagcccccacauugauugaggccauggagggagccaggaggcccucugcaucugccugugaugggagccagguguugggaauuaaggggcuuucucaggcuggaagcugaaggcccuugugaggcugaggcaggcagcucggcuugggggugcgagguaggagcgggcagacagcuugcguggcugcggucccauguggcugguggggcgggaggugggggaugagggaggagugaaccucauccugaagccugcggagaggccuggcuuucgucugagaggcuuaggggagaccuggagagauuagaucauguacuggcagggcuuccuggccaggggacugaggcccagaggggagagggauguggggucauucggcggacacugcccggggagcacagagaccccagcagagagacaacucuuagcaguuugugcaccuuggccuuggggcagcaagaacuguagaaacaaaggacccagacccugucagcucuagcuggguuguuugggggguggggucaggauaggggacaguggugaaggccuaagguaucuacuagacaccagaaacacagguuuguuuuguagggucuccagauccucugagcccagccagccugauuccucugaccauccccuggcuuaggggaaagggacucuaaggagccugggugucagcuugcucuaaggacuguagauauugcuugccucaguuuccccuccuucaaaauaacccagagagacuccacagagaacucuggggugagggugagguacucuaaugucccuaaguucaagguagagagaggaagaggcuauagaaagacaaagaaaaucugaccugguggcuacuagaugcagucucacacuuagaggaggcugugugguagcuaccaacauggcauucuuggggggaagaaaagaagguuccagauggggaccuuagagguagcuaucugaucucucucucucccucccucccucucuuccucccucucucuccaucaccuuuuccaaaguccuccuugguccccuacauggaacucugcucuaacuuaggagacagccagcaggacaguugaccaucagccccaacauugguuugccugaagccuaugugaacacugauguuucuuccagagggucaccuguauguagagcccugagauuacuccccuggccacaggugcuuuuacaacugccuuugcauagccuuuaucuuggaccaaacugaggccugcagacugguccaggggcuuacccucaccagcuggcaaaagggcucauaguaugacuaucucagucacauagaaugacugucucugugauggugccuccaggcucacaacucaguggagagaagaagacgaggaagaggcugcccgugagcagcgucaacgggagcgagagaggcagcuacaggaccaggacaaagauaaagaagaugaugguggccauucccuggaacagccaggacagcagacacuguaagcugcuggguccuggaccccuaucuacuaccacacaggaccagggcagaaacacauacuggggguaggggugugugucuuggccuuagagccacaauguaggaauuagaggaagggacugacucguggggcaagcaucauuauagucuccaguaaacaccaucugugggaugcugacuagccaaaggaaaggguccacaaguuaugugagaccucccccucccaaccuccaggggcccugacucaggcucuagacacccugaauggccccagcccuggcuuggacuagugcugaccccagccaugaggccccagcucccaagccccccgcccaaacuccuggcugccggugacucacggaggccacguccaaguuggcggccacgggccggcucguuuccuccucaggcccaggaggccuccgcggcugggcugggcuguuuuuccaauaacucuccccuuccuccuggcccuguuuuguuccauuuucucggagucagcagcuuugggcgggguggggugcugcuggggucauggccucucagccaggucuucaguuacuggguccuugcuagcccccaacuccuucuuacccaguagcucacccuguagcuugagaaaggcuguaaggaccagcuugagggccacaggagccucagggaacccuagauggauggaggaaaacacagcccucucuuguggagcccuagacugaaggaagaagcagaucccugcuuugggggaacugaggauugaugagggaagcacagcccuuacccucagggagcccuagacugauggaggaggcauagccuugagcucagggaacccuagacugauggaggaggcauagccuugagcucagggaacccuagacugaugggagaggcauagccuuguacucagggaguccuaguguggaagaagagauaaagcuaugcucuuggagagaccuagacugacaggggagaaauaucucugcccucagggagcccuagacugauggaggaugcauagccuugugcucauggagcccuagauugauggggaaggcauaguccuacuuucagagagccuuccauggaaggaaggaaaagacauagcuguacucucaaggagucauagacuaauaaaggaggcauagccuggcccucagagagccuuagauugaugguggggccauaguccugcccucagggaguccuauacugaugguagagcuguagcucuguccucagggagcccuagacugaugguggagccauaacugaguccuuggggagcacuagacugaugguggaaccacagcccugcccucauggaacccuagacugaugguagagccauagacuuauucuuggggagcccuagacuggugcuggagccauagcuguauccucuagaagcccuagacugaugguggagccacagcccugcccucguggaacucuagacugaugguagagccauaguccuguccucagggagcccuagaugaauaaggaaaacgaacacaaugcuguucucaggaagcuauaggcuguuagggaacgcgcagcucuacccugggugauuucagaccacaaggagacaaauuuagucauggagagccaccucugaagcagauggucacucucacacuggaagucaggguugaaggggaaagacaagggaagaaugaagaccaucccuaacccucucuuucacugcccuugcagcaucagccugaaguccucugaacuggaugaagaugaggguuuuggugacuggucccaaaagccggagccacggcagcaauucugggggaaugaggggacugcagaagggacugaacccucucaaagcgagagaccagaggagaaacaaacagaggagaggcaagugugaaccaaggcacuggaucucuuugaccccagccugagucuggacaauucuuucugccuacccuuccccuaaaaaagaaaacccaaauuguucaaagaguaugaagaggauagggaggagggaagaaagggagauagagggcaguauggccagcgaggggggcuacagggagagaguaauggagauauugcauuccuggguuccccagagcuggggggccucauccugacuagcugcggccaacugggggggcugccacaucagcacacagcugcagcccacuuacguaauguacagcccacgcccgccagcccuccccaggcuggcugaacuccauucccacgaaggggagcagguacuuccagaugugagccugugaggcggcccaggggacacguuuuccagauguguggacgugugugccugucuaaaucaggaugaacggaggcccaaagcccccuugggucuggagaugaggggcugcugcugaagucucaccuugccuucccacacuguucagggccagguguggggauaaaucugcuuuuuccaucaggccuagggucucuggcccugcuagggagccccagaauuggaggccagagcccuauugccuugagugagccagagccaaggacugagcugucuucccucagcaauuaccccacuccuagccccucggaggccccugggccagcaggagcaacugcugaacucuuucucauuuaacgaacuucaguuucaacucacaaucauccuuuacacuccaaaaucucugucuuuuccugaggcccugguucugagccugcccacugccagcuauccugagucugcccaucaccagccuugauuuccccuuaucugccugugugcuuucugcauauucuggguuucuaggcaggcagcugcagcccugcccuuagcucauuccuuucuccugcuuaacagcagggggcacuuuagaucuuccagcagaacucuagcgcucgagccuccgcccuacccucaaacccgccuggcugccuguccugccagcucuugaauggccccucuguguggcugcugcuggcucagaccccagcccaccuugggcgguggguuuggguuuuggcuggcacauucaccaaggggccugacaucauggaaaauacaagaauuuacuaucuucuccuccagguucagagccgcucaaaugcagagucacgcccggcugcccauuggcuagcugccccuccccaaggccccucgccucaguaaggcagucccuucccuggaguguucugcugacccagcacccccauacacucugggccugggccccuaauggccucuccucaauguuauguucuacugacccauuuugcccauauauggacaaagcaaaagcccccagaagcuggccuugcucagauagcuauaggaggcauucagcuucaguacuuggguggcccuauacagugaggagcuagcgucuucaaaagggccuuguaggaccucucugcacagaggucguagcagacagugcuggcuuugaacaaagcccuauacauccuuuuacaaaaguucuguggcuggaccuguaagaugcuuaauggguaaaggugcuugcucagccuaacacccugaguuugaugcccaggacccacaugguggaaggagagcacugacucccugaguugucuuuugacaugagagagagagggagacggagacggagagagagagagggagggagagagagugaccauuuuuuuuaaucacugcggucuuaagagcucugcauauugacucauuggacuucccccauuuuacagaugacacaccagaggcuuagaacuguaaauagccuagaaccaagcaaaaaaugauccuccacauuugucuuugucuucuuuuucucccauaguucucaccaagccaaaguccacuuggaggagucaaaccugagcuacagggagcccgauccagaggaugcuguuggggguucuggggaggcggaagaggugagagccuccucaggggcucggucugugauacucugugguugcuaugcucucauaaacuggccuagaagagacaucacccccaacccuauacuugaguccuuccaagacauauuuuuggaggguggugaggcuggugacccucugggcaaguuccuccuccaugaccaagagacucuucccugcagucagggauuccagaguuauagcaugucagggccagaccaggccugaggccccugaaggggaagaccgcugcucugacaggcccuggguggggcaggagggugcagggaggggucaucuaagcugccuguguuucuuauucuuagcaucugauacgucaucaggucaggacccccagcccuuuggccuuagaagacaccguugagcugaguucaccuccccugagcccuaccaccaaaguaggugaugucugagcacccacuuuguugcuauuuaugucugcuucucauguucucugaaccuccugcuauacugauaaaccucugggauaugagaguggguuuggguaguggguagacucacugggagauagaacauggaccugcuguugcucuccaugacccacaacucugugcauacuccacagcuggcugauaggaccgagucccugaaccgcuccauuaaaaagaggugugucuacuuguucucuggccuucucaaagacagggugggagagugucuguagguagaugucaggggauuuagugcugugggaggggcuuugggugggcugggaggauuuuggaagguaacauaaggcuuauccuuucuucuaucccuagcaacagugugaagaagucucaaccaaccuugcccauuuccacaauugaugaacgccugcagcaguauacccaggccacugaggugaaguauauucagaucucugacaccaaaccuucucuuuaauaugacaucacacauccaccuaagcaacucucuccaucccaucauauccccccucucuauccaaccaauguccuucuauccaacucacacugccucuuccguaaacccuaggucucuuacaucacagcaggcaugccucuguccugucauacacccuauucagccaaugcccccucccacuauacagcauacccuuccucugucuaacaaagcccacuuacguaaacaacaucccuccaucuaaccuacacuccuccaucagcacuguucuucauuuuauacccgucuacguaaccaacauccucugucuaaccaguaucccuuuaucuaacuagcacaccuccauccaaucagugucucuauacucaaccagcacuccuccacucaaccacuggaccaacauucuucuguaugcucuuucuguauucuucuguaugcucuuucuguacagucuucuggccgaacuccuaagcugucccgccagcccuccauagagcugcccagcauggccguagccaguaccaagacucuuugggaaacaggagaagugcagagucagucugcuucuaagacacccuccugccagguaggaguucuucccaggauagccaaacugggaaggcugagaaugggaaguuggccaugguguguguguguguggggggguguuguccuuuggaaaagcaaaccugagauagccaaaguggaguguggauggacaggcuucagggcucaaggaaaaauucaugcuguccugaaugcaguaugacucuccuuuccucccugccaaaagugagccugguagauccuccaccuuucagccaggaaacaccaggcagaagaaaaggucccaugaugaguaucuguccugugauagacccugugucugcccccaggauauaguagcuggagacaugagcaagaaaagucugugggagcagaaaggaggcuccaagaucucauccaccaucaagguagguagggcucuaugugauaggcacagacugauugauaguaauuaaggaugauugcugcugccaucuccaaagucuucccagagucagucuuuccuuccauagcuucucccugacacuuagucucaccuaacagagcaccccaucuggaaagcgguacaaguucguggccacuggacaugggaaguacgagaaaguacuuguggaugagggcucagcaccauagaccauguuugcauccuggugaguccaagaaccagagaaugacaugggucuuccugaggacauggguggacccuaucucaggucuugaagacugaagaccuggccuuagaguugccauaucuucugucuggcuaccaguuaucuuuggcucccugaagccuagaacuuggucccuauaagcagggucuuguucacccaguacuguccauaagagacucaaaacuccauuuaagaacuucuacucuauucagucaucaucgugugaaccagcacuggagaggguggguguggcacagccucuaagaguguggguucucauacauccaguaaaggagcugagaccuugccuuggccccucuacccaacugaaggccccugagaacucugcguguuuuccccaucccacuuaagaagacaaagugauaucuaugucguauacauacauuuauugcauggcuccaucuacaacuguaauacccauuacaucccagguggggcuaccagcucaauccuugcugagucuuguuacaccuggcucuucuggaucacuccucucacagcugaugagagucuggcagaucuuaggaauuucucuaauccuggauccugccucucuguagcccucuagcucgaccuacccuuacccaacuguugaaacuuggcugugauuuuuuucacuacaccaugcauuuggugcagucuuaaucaguaagcccuugcugucaggaaaccagaagggauaucuacaggaccacagaaaauucuuucucaauugcccaguccuauguaccucugaauacuccucauccaagccuucuuucucuggaacuagagccccccacagucucuagaccugaagccagguucccaccauccaugaacauucuccagugcacacucuccacaaccccaaaccaccuccagccacaugcucccagcuucauucacuucucucacuuugccauaucucuucccaccaacugaucugugucuguccgauaggcucuucuuagcagcuagcacucagcuaccaaggucauacacccugcugacccaucuuguucacuugugagggcuaagucucucugcucuguaugcucagccacagccagucucuguccaccagaguccagagucccagaggccacucugguuuuguuacugaagccuccaaccuucugcuguccgguugaaauucuugggccgagaaugcagcuccagaaugggguggaagguaggagggggccggaccaccuccuguagcuuccgggcauugaaacgaggucggcacagaaauggcaggcgguugaggcaggccagaggauggccccuaucuccaggccccacaggguggucucuaugggacucagccagugacaugcgguacagcacugcaucccacauccuggaugcucgggaggcagggggcugcaggcccaccacaggggcuggcaccucugguugcauuggcuccagguucggcuucaguucuggaaacgcaggcuccuuugccuccuccaucagcugcuucuuuagccguguccagccacuacgggagggcuuaggugcaacuuugggaacaggguauggguggaggucugaggggccugaggcuccggggaggcuagagacauuccugggcuccauggcaggccuggcugugggcggcuccucuacauguuuugcuucaggagcugcaggagguggacuauaaggugaggguccaggugagcgguauguaggggcuaugggcaccaccacccuagcgccacuuucucuguucacugaggccugaaagcuaggugguggccuuguuauagagggcuccucgggccuaggacuaacugucuguaccccagcaggcaguggccgaauaugagccacugggaugagaggcugggugcuagaaguacacaggcuuuuaucuccauccagggccauucugggggacucagaagucccaauaugugaggauggugacagccggauauguacuugagugauguggguaccacccgcuguaggagcagauacaugggcaaagccacugugggggcaggcaguuucuggggcuggagcgucaagacuagaaggugccuugaaaugaguagccagagaccuuugcuggggaaggcugaaagagaaaguggauuucugcaggggugaugccacauggugaauaaugggaguguguggggagugggguaaaggggccacugugugaggggcuugagcaggacacaggacuguggucuccaggucaugacuggccucacucacaggggacagggagguacggaaggccccaggugggguggcggucacccccgacaucuucuuccgagcagccuuucucaguagcuucugaaguuucugguuguccuuuccugguuugggcagcaaggguggugggggcccaggggagggcucaggucuugggccaccugcugccggggguaucgacacaaccgaaauaagcaucccuggccugggguagaggggagaaacagugguuagacuacccucccuccccugcccacaggagaggcuggacauuuuccuacuguaugaggaggugggggaauguguagacccagcuacuagaagccccacuuagucacuguggguggcuucaccauaccuugguguggaggugaaccuacagugguuccaggucacuugugagugacaauggcuacuaucugcccucaaagcucugucuucuaagauggccuagcacaaagcagucaccuucgagugccugcuuggccccagacucagaguaacgcaggacgggaacagagacccgcugaugaacuucaagcaaacugccucugccuggccaacuaccggacagugguggagagcaggcugucugcagacacaugaggggcuccaugcuguugccagccugaccacaggcggguccgugugcuuugagacaguggugagggguggcagccaaaaggcucaggcaagcugagguuguauucuuagagguagauuggccggaagacgggagcaguuuucgcugagcuauacuaaaugggauauccccacagcccuccugcugaggguggucuuggccacgcugccuaucuugguuucugggcgccacguguuugcaaggacauugacaaauggcaucugggccaagcuggaggccaucugguuugggguagaaggagggaggccuguggcuguuacaguaggggcuggcccugcugaagcaggagcaaacccuggaagggggcugcaggagucuucccacuugcucccagcuucugggcuaccucuagggaacugguacuugggaauuggggcaaccauggguucuauuccacaagucugccccagucgguagucaguauucucuccuaagccagcccaggccaagaauacugaguucacucuggcagcaggucuuccaggugacugaccgcuguaagcaggagcuuuccccugauaauaauaagggguauaguagggucugguggccacuaggaagguaggguuguggagggggcagaccaugccucucccucaauucuagccuaauggaccccauacccuugccuauguucccaggauagacuccggccggaugccacucccagcccugaccaagaaauugcuuccuguugccagucuggccugcucuccugccuccaacaaccaagcugccgauagccucuccuuuugcuccuggacccuccaucuucucuucccucucauccuuugaccaacccuccaacucugcuucucaccaucagcuaaagggaccagucccuaggggagccaagagcucccaaggaaggaugaaggagagaaggcaagcaucccaaccagauccaaggggacacuguccccaugcugaaugcucaggacucuuggguccugcccuguuuacggaucccucauuuuguguaauaaagugcauugaguguccccuaugcauuuggaucuccugugcucacuaacagggaacacggugaucaaaacagaaagggccauaucuguuggccacuugagacuugaucagcucugugggcaaccacucugucuugucuuuuggccuugcaguguguuauguuccaggaucugagguaugaggugacccaagcugggguauuaauaauggauguggccuacuccucuuccagaacaugacacuuugaugacccuuccuuacuuggaccaaaauaaaccugaacaagggcac

SEQ ID NO: 4213 - RNA, 8065 nt, Mus musculus
gcucuuucuccacaaagaauuuuuauuugggcuugucagaaccacugugcucacuagggucugugguccaaauccugcugucauaggucauaggccaaaccaggaagggauaccagggcaccucaggucgcugcuuugccucugcugggguagcuccucuuccagagguucuggagaacggggguccuucucuggaaaaagaucugggaaagugaaggucugcccaugggccuggggaaagaaacaggggcuuaauugagagucacaggcuagccuuccuaucacacccagggacucauggcuggacugcuaaugauccuggacucuggaagacagacaacaggaugaugagccgccagugucucuaggcaggguuccugcugggaaaacaaacaccuugcaggccagcccuccaaccuuuaucuaucagcagcaggcuauuacuaggacaauggaccuuuucauggacauuaucucuuuacaggggucugcaccaacccagggcucauuaaaagcaguccagcaaaggcccauucaccaggcggcugccgguggaacugggggcaggaacuaggagcagaaaaacaggacacaaaugacgucuggugccaugcuaaaacuuuuuccauccaaaauaucuaaaggccuucagccacauuaaaggccgcccuccuccaggcuccaaacuuggcaaauaaaaugcacacaacguacacagaaaccuacauacgcagcagucuauaaaucaagcccggcuuugcaaauuaacugcuuuuacgucuuucacuacaaguucagugugucagcauggcugagucccagccuggagccccaagcacaugggccagaaccagugaaggcccuagaagggagaaagaagccaucucugcaaagcucucagggcuaggaagcucacuugcagccccuacuaacgucuccaagauaagagguguaagauggaaggggcacaaaagagccaaccuggagacagagaccccuuccugccauuccuccuugucugggagguggacaaauagggaguucugaaucugggaacuuaguaaguucugucagagguggacacucuggggcugggcuuaguugguagaguucuugccuagcacccacaaggcccuguguuugaucuccaguaccacauaagacuuugguguuguucaugccuguaauccuagcauagagaagggaggaggaggcacaaggaucaaaaacugaaagucauccuuggcuacacaaggaguucaaagacagccagugcuacuggagaccauguuacaaaaguaaaaugggggaggcagcagccuauaagcagagcuggcugcccauccagaauugacugcuggcuuugauggcagaugaaguccuaaacagcuuaagguccagagauaaagacagccuaugcaaggggcuagcgggggauuuugaaagagcagaugugagggacccgcaucaccaucuauggguaccaguaugaagacuaucucuaagagauaauugcuucauacuuuagaaaaaaauguagccacccacccucuaaggagggagagccgguuuugaggggcccaaggcaggaaaggaaaaaaaggccaggggaaaaaguggagaagccaguccugacuccaguaauccuagggccccuacgggccauuguugggcuggacugugccugcccgcagcauuuacucuggagccuagagcucauggccugugugcagcacucagucaaacacuguucuguguaaacauggucaaugcucuuuuuguuguguggggacugagagcuugcuaaggcucccuccccaccagaccaaaaagauguuuaucagguucucagaagaaaaauguggucgcccaccacgugggaccugccuuuccccugccacacucacgaugagcuuucucuccccccuccccuaguugccccuuccugagccucacagugccguuaccagaagccagaagcccccccacccguaaaagacacacuaagaagacaaagacuaagacaaagacaaagacuaagaagacaaagacagccuuugcagauacaaccagaagucccaaacacgaaccauuucuaggcuggagccgggaaggggguguguuacaaauuuuaacucugguugagaagucucgccuagugggggcacaacaggccccuccauuuaucacaauuucacagaggaagguggacauggcugguggcagcugcagcugccagauguaagaacuacugaguccagcuuucaugagugugguggggaagaggaggggaauguaggggcucagaugucucaaaagccacuuguaaccauagcugucucugaagugacuuguggcaaaugccagcauauggauguggccccccaggccgugacagagacagauggguggauucaacaccuagcucacaaacacacacacaagccuucagagggcccaggccuuccuuucccaccugcaugggcugauuuuauguacagcaaauauuaggcccuguuuagaacaacuguagcucuuuuuccagcaaagcugccucccucccuuacagggucuuugaacaaacagccaugcagcacgggagggugggaggggcccauucucaauagcacgagacugccaucuagcggccugcuguggaggcuggggcucccuggagagcuguuuacacugaaacuggagaaauuggaggaagccccccugugggguucaaacaguggggggccaguuaauggacccugccgaguagagucuuccuugagagauucccggaggucaaaagggauucuguccagagacugagaccaaaggguacuuguagguuaagauuuggucucaaaggcagugggucgaggacagaggcucuaaaagagagcaagcuugaaaauguggcucuuuccaggcaagucuggucuugugaguaaaggcccagacuaggagucugcucccaggaccccaggcaaggaugaggugaaggggcuuugguacccacacucacagaaucacugucauggcugacuaacagaagaauguguaggguccguauaccccagaugucucaaccuuuucacagcacugggcuucuaggggaacauaaacucugcaccaggcaagguauccucacagagcgguggcuuuucacauucacccucugauuucuguuuccuccaaacacauguaacuaaggcaugggcuuguagcacaaaauaaggaauggauuuacugaggacuacagagaugaucugcggaggugcacuaggaccugggcuccuccugccccgaucuccaggucugggcucugcuaagguagagggaauugcacaaacagccccaggacacagaugagacagugagcagaaacagaggcggcaggucagccggucucacucaccagcugcacguaggccacuuuguagucugguuucuugauccucacauucuugugaucccuccuccuguuggagccugugaggggacagcagaccagacccugccuuaacuucuggccccuugaugagccccacaaucuagaaaccauuuucuaguaaggcacaggauaucaucuggagguggaguggggagggggguuucaaaaggcaggcugaacaccagagggggggucucagacaaacaucccaguuucucuguuuaaguaaaaauagucuuugagcuggcuggugguggcucacaccuuuaaucccagcacucagguggcagaggcaggcagaucucugaguuaaaggccagccuggucaaugacaaaaaaauaaauaaauaauguuuuugagaauagaaaugacaacagaagaguuuaaaagaacaaaaggaauuuuuuuuuuuuuuuuuuugguuuuucgagacaggguuucucuguauagcccuggcuguccuggaacucacuuuguagaccaggcuggccucgaacucagaaaucugccugccucugccucccgagugcugggauuaaagacgugcuccaccacgacuggcuacaaaaggaauuucuuugcucucuggugaaauggagauucucuaggaagggcauuucuuuuuguuguuguuguuuuguuuguuuguuuuuuuguuuguuuuuguuuuucgagacaggguuucucuguguagcccuggauguccuggaacucacucuguagaccaggcuggacucgaacucagaaauucgccugccucugccucccaagugcugggauuaaaggugugcucuaccacgcccgguaggaagggcauuucuaagaggguagcacuacuagccagccuugggcacuaaucaaucugccacugaugggcuacuuuaggaucuacuacaggaggagacuguggaggccuacuagagaccagcccaggcuaaggaagugguucuaaggaacagaggacauuucagggucacagcuagaaguguuggggaccuucaaugagcuacauagaaagaggcugggcacccucuggcaagacaaggcacccaagccccucaaggccuuugcuuccccucuggagucugaagacaacaagaaguagacaaggggcuauguccugguggcaagccaccaacacagguacccaccaugcugcacccgugugcgcacggcagccacgggaacauuguaaaucugcucaagguaauuccgaagguccacccuggucauccuggaugagacagaaagcaaacaaguuugagcuaagccuagauaaagagauauccuacccagggauaagggugaaaguccaaggagcagcuguggccaggugaggcuggcuccaguguuguccccuccagacaaaaggaugagcuaagaguuaaugagggugggauuucaucagaguuguuuacuugguccucuccaccuggauccuugaccauuaccuggagccaggugggcucacccugaucaaauguaagauaucaggccugucgccaggcugggcuccuaucuguaacuaaagacucgccccuagggucuaugagacaugugcugccagaggggccucucuaggacuugggggacaaagcccaugguggcuuucaguacaacccuggcuaccauaagcuccuguguaugucuggaaagccaaagagacccuaacccagcuccuccagggaucugcuccugcccccugccccugcugagcuggucccuguggauuuuaggacucagagcaguacaagcaguuggguugcacugaaccuuccuuaaaagggggcacauggaacugcgaagaaugagguaagggacucagagcucacauccuagaagcccugcaaaucucagcaugcuccaacccagccuccggggacuccuuuccugggaaaaggauggaggcaagaauucaacaaaucucaggcuuucuguuaagcuuuccccagguggagggcgagccaggaagccagccaagagcaugcuuacucuuuggcugccugaagcucugcaaacaccaggccccuccaccauccgcugagcaagcaaaguggccccaggucuuuccaccacaggaaaagccuggcccuggggagcuaagcuaaaaaacaggacaggacccacauccuggaggccacuccccagccccugaacuccuuugggccucacuuacuccauggggauccggaacugcacgguaucuucaggcugugcaguaccaggccgcaccagcugaaugaagaaguuaguucgaaauacacggagcugggggccacccaguugguaaaggggguaccugcucaggagaaaucaggggauugagguuauacacacaguacugcaggcucauguguccacucacaucagcagaaucgaggcagggugggacaguuacacauaggaccugucccuacuauaugguuucauuaguaggggggacaagcagcuucccagccuaguccuuggccucccuacuggguuccagggcuacugacacuacagccuuccuauagaaaggucaaaaggacagcuaaaagagagaaagaaagaaacaaaaacaggaacuaaggcucauagcugugguaugggagcagaauaauggucccagcuuguaaaauuguaagaacaaggaaggaaggaccucauaaacagggcaguggugguacucagcuugcagauaccaccucuuccaaaggccugcugcuaacuccugcuucuggggaguggccagcccggaaauaucacccccacccccacccccagggcccacagaaguuccuugagagggaggaaaacaggcugggggcuagagaagacaguguuuccaacauggcuccgagcuagcaacaccucacuggacaccuaaaacuaucuaaacaagcaggacuuggugggauagccaguuuccaccauuaucaggccuguagagaaagcaggaucucugccuggugguccugcucgccuccaugcccaccugagcagacauggagaaggacaggagaaacucaaggacugggauuacuagagacucauaguucaugguccccagguggaggguggguacacaggaccacccuagggucacacugauaaccgagguguggcaugugggccagaccucuaagucuugggagcaccacacuggaagcaccaagcugagggcaccagagaaguuucagggcugagaagcagguaccagaguuucagaugacucccaagguagcauggugggagccucagaagcaggccccaucgcuaaauguuugccaaacucaaugacucaagagccuaccuaauggucaaauuagaggucuggccuuuuagggcucucuuaacuucuuuucuacuauuauuauuuuuuuuuuuaugagcagccccaaacagcauaucucaaauggaacucuuggcucucucuucucgcugggagccugguucccaacugguaggcuguuaaccuaguccuccucaaagcucaggucucaucccuggucucacucugcccccacccaccugucacucauucacgcauggguccaaccagcucccugcaaagccagggggugagcccaaaagcugaacuagacuggcccugccucacacuggccugguucagaggucccuggucucccagccagucugcggaaagaaaucacaagguugcccaccagggaaccagcccucaccccuucuuauugcaggguccccccaauucugcuuccacgagaacucucaaaaccgcauuaaugcucaaccuagggccacccaaccagugggucacguguuuacugaacacauguuuccggcucagacugugggaggcuagcacugcuggccacguggagaccggugaauguagcaacuuugggggacuugggccagggguccugcaggcaacggccaauccuggcucagcccuggcugucugccaaagcaggcuguagccgcuggcugugauugacagccaggacacuaagccgagguggcccugccgcguggacccuggcggguuucccgccgcgugcgggcgccuccggcuuccggcccgggccccgcacccacccgaccugggcugcuuagcccguuccgcgggucacgacuuuacucacaacacauuccgcgccauggcagccgcaccuccuggucaggaaggagcgacacccgccccgcacagcgcccgcgcuggcacagcgcccccucgcuuccggaggccgcgcuacccucucccugcaccgcagggccccgcacuuucggugucccgcaaaccccaccccacccccaaccccgcacccgaaaagccccucccccacccgugcaccguaagcugcuugcgcaccgcccccggcacagcgcaccccgccucucagccauaaaaacagugaacagccccgccccucacccggccccgcaaaaagccggcauacacucuguacccauuugccccaucccagcaccacacagaauccugcauaccucucgguguauaguguaccucccuguucuucaaccuguaagcacccuacaguacaugcuuucccacccacaagggcaccacacuuugccaugagcagucccgcaucucugcacugcuggcugguggauucuacaaagggcaacua

SEQ ID NO: 4214 - RNA, 2620 nt, Mus musculus
caaugacuguaacuguauuuauugauggacccaggaccucuggugaggcccuggugaggaggggcaaaggaugaaguagggcauguugaacacuuuaugauggaacugcuuccagacuaggcgaggggaaggcgaggccucaagcacacggccacacccaguugcccucagacggagauggacgacagguggguacuggggcagcauugccaaagagguuuacacacucgcuguauacauucauacggagagacucaaagcuaucuccgggacuccaaaccagugcaaucgacuuagugcaaauucaaaaggggguaaauggggaaacagagucacgggugcuuugagucucucaagcaaggaaggaacaaaaggaaagaaacagaauuacaggaaaggaggaagaagaaaaagacaggagggagaugaugaagucaucccgggguagaggcuuggcuccaggaugaugugggugguggucucccgggucaggcagaguuggccaugaagauggauucucaggggugggugggugcuaugagucugcucuuucaaaauguugacaccaucuguucuuucagcuucaccugcaaagagaauaaagacaaaugagguggggcggggggugggguggggagugggcuuggcaagcuuccaaagggugccccagcucaccuuggagcagauuccugaggcagguaguguagugguucugauugcagcaucuucuugauucagaacgagacggacuuaaagaaguccccggauucaaaggcccagacaugagcuggguagcaccauuucuaugggugggagagaaugagaccccuguccuuggcaucccacccucucccacccacauggggcagaagagaacucaccuuucaucuugaggguucaagguagggggaggaggauccagagagcagcagagaaguguuagcucuuugggaaaagugaaagaacagacggcuucuacgacaaggcgccagcccaugguguucugcaaaggacagaauccugagugaguggguggacaauuaggugguugagcggacuagcccuguggcagggaguaugcucaccaagaaggcuggaugacugcccuucuguccucuccaucacaccggaccaugucaugucuuucugucacauugaccacaccugucauccucgccuucagugacuggcaggcacauccaccucugcuggagaccuggcuauagggagaaaugaagacaugaguuaauugaacuugcgugggaggagacugggugaccacgagcgggacagacacuuacccuagucuccaguccgagcucuucgagacaccgaucacugcuccgucgccgcccgcaaggcccuccuuggccacggacucuggaggccagugccucccuggcucaccaccccagcuacucgcucuaccugcacccaaccucccucccuagaaacucauucauucugccccgccugccucgccucgucuggcuucauccugugcccuugacuccccuggaaauguucugucugucaugccagacccagggacugagcgguuagggcauacaguguaccaaguccacugugggcccuuuccgcaccagucccugggccgcagugccucaugggaauggugugucugcaggcuggacccacugcagccuccuugcuguaaaaucccucuggaguccgauaccugcagcccccacuccccuucuggugacacccugcacugcccuucuuuuccauucuccaguuauugaggcucuggcaaacuugggacuuugccagagccacucuugaaccuucuucuaagugaauuacggugggugggauguuguggcggcuggggacccaucugugucuugugaccccaucuugcccuguuugaccccagccuagaaugcuucuguucuugcuggaucccauggucucugccacugucuccaaggacuccuaucaccucccuggaggcagcggccucagucuuuacuggcaacccugcaccucuucuuucuucucucuaagagcucuuuccaccuggggucgccaauggucccccagccuccuucugucucggcuccccccgagacgaugucuccuuugcuaacuauccugccuuucuaugugccauucugcugcgaggccagccgcuucuucucaccaggcccccucucuaaaccuucguuuagaaggucaguggagcgaggccaagagagaagaaggagacucaccugcccagcagacggcgguccucaccugcccacugcugccagcuauaccuucacugcccaggucuggggucgaacccuucccagcagcuccccuuuauccgaccagccgccacguccuguaaccaaaaguaaccgggaugaaugucuggcuccccauuccucuccaacccuagcucaggcccuucagcuucacuccgauguuuuccagccuuugcgaugccuuugcucugccugagcuagccccucaguccuucaacauuccugccagacuccagaugccgaggugcuccucggaccccacgacucuccuccagcucucccaucuuccccaguuuccccgauaccccccacccccaccccccaccccccucccacacccggug

SEQ ID NO: 4215 - RNA, 2620 nt, Mus musculus
caccgggugugggagggggguggggggugggggugggggguaucggggaaacuggggaagaugggagagcuggaggagagucgugggguccgaggagcaccucggcaucuggagucuggcaggaauguugaaggacugaggggcuagcucaggcagagcaaaggcaucgcaaaggcuggaaaacaucggagugaagcugaagggccugagcuaggguuggagaggaauggggagccagacauucaucccgguuacuuuugguuacaggacguggcggcuggucggauaaaggggagcugcugggaaggguucgaccccagaccugggcagugaagguauagcuggcagcagugggcaggugaggaccgccgucugcugggcaggugagucuccuucuucucucuuggccucgcuccacugaccuucuaaacgaagguuuagagagggggccuggugagaagaagcggcuggccucgcagcagaauggcacauagaaaggcaggauaguuagcaaaggagacaucgucucggggggagccgagacagaaggaggcugggggaccauuggcgaccccagguggaaagagcucuuagagagaagaaagaagaggugcaggguugccaguaaagacugaggccgcugccuccagggaggugauaggaguccuuggagacaguggcagagaccaugggauccagcaagaacagaagcauucuaggcuggggucaaacagggcaagauggggucacaagacacagauggguccccagccgccacaacaucccacccaccguaauucacuuagaagaagguucaagaguggcucuggcaaagucccaaguuugccagagccucaauaacuggagaauggaaaagaagggcagugcagggugucaccagaaggggagugggggcugcagguaucggacuccagagggauuuuacagcaaggaggcugcaguggguccagccugcagacacaccauucccaugaggcacugcggcccagggacuggugcggaaagggcccacaguggacuugguacacuguaugcccuaaccgcucagucccugggucuggcaugacagacagaacauuuccaggggagucaagggcacaggaugaagccagacgaggcgaggcaggcggggcagaaugaaugaguuucuagggagggagguugggugcagguagagcgaguagcugggguggugagccagggaggcacuggccuccagaguccguggccaaggagggccuugcgggcggcgacggagcagugaucggugucucgaagagcucggacuggagacuaggguaagugucugucccgcucguggucacccagucuccucccacgcaaguucaauuaacucaugucuucauuucucccuauagccaggucuccagcagagguggaugugccugccagucacugaaggcgaggaugacagguguggucaaugugacagaaagacaugacaugguccggugugauggagaggacagaagggcagucauccagccuucuuggugagcauacucccugccacagggcuaguccgcucaaccaccuaauuguccacccacucacucaggauucuguccuuugcagaacaccaugggcuggcgccuugucguagaagccgucuguucuuucacuuuucccaaagagcuaacacuucucugcugcucucuggauccuccucccccuaccuugaacccucaagaugaaaggugaguucucuucugccccaugugggugggagagggugggaugccaaggacaggggucucauucucucccacccauagaaauggugcuacccagcucaugucugggccuuugaauccggggacuucuuuaaguccgucucguucugaaucaagaagaugcugcaaucagaaccacuacacuaccugccucaggaaucugcuccaaggugagcuggggcacccuuuggaagcuugccaagcccacuccccaccccaccccccgccccaccucauuugucuuuauucucuuugcaggugaagcugaaagaacagauggugucaacauuuugaaagagcagacucauagcacccacccaccccugagaauccaucuucauggccaacucugccugacccgggagaccaccacccacaucauccuggagccaagccucuaccccgggaugacuucaucaucucccuccugucuuuuucuucuuccuccuuuccuguaauucuguuucuuuccuuuuguuccuuccuugcuugagagacucaaagcacccgugacucuguuuccccauuuacccccuuuugaauuugcacuaagucgauugcacugguuuggagucccggagauagcuuugagucucuccguaugaauguauacagcgaguguguaaaccucuuuggcaaugcugccccaguacccaccugucguccaucuccgucugagggcaacuggguguggccgugugcuugaggccucgccuuccccucgccuagucuggaagcaguuccaucauaaaguguucaacaugcccuacuucauccuuugccccuccucaccagggccucaccagagguccuggguccaucaauaaauacaguuacagucauug

SEQ ID NO: 4216 - RNA, 16053 nt, Mus musculus
ugccgaggaagcucugcuguuugguggcccugcaguucacuggucagguacuggguagggaccagggagguagaggcugugucugguggaauacuggagacuggggggcagcauguaggucuguguccuugugccuaagccucaaauggcacaggcuucccagcaggugaauuccaccccucuuccaggauaucaugcucaugccagaaagaagccaagaaucuucuuucaaauguugguucagacacuaaaacaauuacauagugguauggcuucagucuauccagacccaggacacuggccuucccugcugaccccucuccagugcccccacagcaacccuuacuuacuuuugguguggguuguguugaucaguuuggugcaauccucauguuggugguucagguagugacuucuucccaggcuugcagauuggcauagagcauugcuugggucuuccugguguggagucccuaugugguguccaagaccgcagcccaguugaguguguccucuguggcaggcauccagcacaggcaugaggaagagcaugcuggggacccucggagagaaguaggguguguaaaagucuuggcuuauuccugagcaguuagcccggagacuacaacaagcuaggaaaagucacacggggggauaaggaagccccacugccuggagggagagaggggagacaagcagaggcccuggcugagggugccagccaggcuuaguggguaagucugaaucuuaaaggauauuuaguuucuucagaauuugagcuuuuaagcccagaaaggagaccuaggcugccucggugguggggcagagcaggggagggcaaggauugggaucagcacagggcuaaagucuagugggccaggcccuaucuagaagaaacaauagaccccaugcaugcaagguaggccccuuucuaccuuguaggggggagaggguaggcaaaaauaaggaaaaggagagggccuuagagaaagaaucugucgcugauccuagcuggggguaggcugugugcuuuugagcccuagguugacccggaacuguaccaggcucuucccugccccuugagccacacuuugacuaaauaaggucaggugaaggcucugugggcagccacauagaggaagaagaacacaugcauacccuggcccccacccuaucccgccugcaugcccugguggcucuucaauggacaccuuaaggugaccucagcguuuuccuaccuggcaaaguccaggaguucaucuccggggugugagucagcggcuucuccagagaccucuggagggcagaaagcagagauuaggcucugaaacaggccacagguugugauugcugcccucucagaugccccuuaggaaaaggaaggcaggacuccagaaucgggacucuguucccagaaccuugcucaucucuggccugugccccuucuuggggaaagguagagaaccccucugccggcccuugccauuuuuuuuuucucuaaaggagacccuuagcagagggcuugcagccuaaucuggccucacaaggacuagagguguucucaaacaccuuuuuaaugcuccuuacucccaacaaauuuacaagucucccuggaaugaggaacaucaccauaccggucuuccuagcuggaagcuuccucaaaucuauaggcacaaacucggagaggccagaaaagccagggauagaggcugguggauggggggaggggggcagcauggguguggguggggggagacaggccagauguucuuggaaugggacacgggggugauugaugcagacuggaauuugaaaggggaacauuccccacgugcuucaugcuccggguggaaaauggguggggugggggcucucucaguccugccaagauaauauggagaugccucgcccugucuagguccccacaccuguccacugacuuuaacuccugccuccccagagcguuaggcuuugagaguccucccugcauaccauccucuacgggugguuauagaggcaagccaugcuuacagucauggccccaggguuuuccucauucuccugcucuccagcugcuccccuaucuaacaccccacccccaccccccagguccugcuagaaucauggcccuucaccuccagcauugcucaacuuugaggggguggccuuguucccagcaacaguacggugagccuguguaugguguguggguuuaauauuugccuuuaaggagcuggacuuuccccagcuaggauugggaggcuaguggcagaaauuuucugagaaaacgaaaugaggguucuagcauccggcaacggucaccacuguaucauucugcuaugcucuuuccccccacuuucuccucugcucccccauuuuuuacccacuuuccacagugcccaaacaaaacuauuuccuacauuguucaucguuagggagcggacacggccggauaggcguguguuagcacaggggcggucaaggguagccacugggggugccccgggccccaaaacugagcuagggacgagucugcccccggcggcugccuggccccgacuucgccuaggcucgcggcgucugagcgcguggggcgcaggggcggcggggagccgagcggggcgccggaaccuaaggagccucggggagcagcgcgcugcuccccgacguuccgccucccucuccgacgcccgucccgcucggccucugcuacccaaacccucucguuggcuagaaggcgaaagaacgaaaaaugaagcuggcucgggcgcgcgcucuguggcguccgugcucccaaucugcgucgccugugccccuuucccgcgucuggguucccccgugagggcgccccugcuccgugugaguuccuuggcaccgcggauccuggcgcccuguccuucccggcccgggagcucacuuucucaaauucagcucuaguucucuguggucccccuacaacccgaggaacuuaccggcuucucugaaccucaggacuuaguuugacugagauccuugaaauuuaagcauugcuuuggggggugggggugggggcuccaaaaucggucagcauuuguucuguucacagggaaaagguuuuguuguuguuguuguuugguuuuuauuuuguuuuguuuuguuuuguuuuugauacuugcuuuccaaauauuuuaaagggugggaauucugccucugcugacuccucacaauuagaauauuuuggcuugggcccccaaguuugcuucuggcuccuaaccauuuuaaaugcaagcuccuauauauagauauaaaaccaccauucucaguucccuaaaauuuaaaguaagccuggguccuuaguccuuuugacaaaauuuccuuacuugggagagcggacauuuugacagcauuuaggcacugucuccaggggaugagguagcgggguguuuuccccauguuccuaucauuuuauaucugcaguaauguuccugcugacucucuucccccgccacccguccucugguuuuauuaacguggaacacuagauucuguagucuauugcccuaacuccaaauuuuacaaguugaaucccacccagacagcuuuaacaauuuuccuggcaccuucaaagucccaaccuuuuuuucuauguccuccccuaaauguagacaccucaaauagcccucacucucauuucucggauuccagaaaauggaaagaguacauucaccaaucacaucuaaaauucacuuaacaagacccccccccaaaaaauuccacgaauacacacuggucacaaggcuuuggggcucccuagagcuccugcaagcauucuggccaugguuaggguucuuuaaaauauaaaauauaaacucucucacuaaagcccccaaagcaggcugagcaaugauguaaggcaugaacuucuauguggcagagggcuuuccaugcuaucccaagucuuauaugacuguuccaugucuuucugggucacagauggcacaaaauuaacucuuggccaaguccuuuuucuuuauauuagaauguugaaugucuccaauccuugaacacugaucauuuuuuucugcaucaaaucugggucccuuuaacuuaacaauuuggaaaaaaaaauuuuuuuuaacucagacaccaauugcaaaauccaguaccauccuguauccuuuucaucccccguguuggcucaugccugguguccucaaacauuaggcaauauuuuccaggccccccaaaacacacuuaguguuagccuugggucacaaaaagguucugauuucucccacugcaauaccagcuauacacccacucagccccccuacauuucaaacacaccccccccacacacacacacacacuaucuugcacaaucucugcagauugcaaauuugggggauugguucucaggccccauaauuuaggaacccauaaucucuauuccuuguaauguagagacuggcccugaaggaccaggaaacuuuagauucagaaauuaucuuccugggcccccccaaauucagguacuccaaaacaaauugagauuuuuuucuuccaaagaguucgguuuuuauuaaacuuuaaugaacuuuguugaauuuaugacuucuacuggagucucccuauauuuggauaauguuuuaugguccccaaagcacacugaaaaaaaaagucccagaucccccaauuccuagguuuuaaaggucugugucuuacaaauuuccuagcuacuaauucuauucccugcaauuuagauuucaucauccauuggguaauuuuuauugauccacaaaacagggaguauguuucuccaagaacaaacauuguccaagaaaacauacaaacucccccuuguucaacaaaaagaucaauaggaaucuguuuaggaaauuaaaauauuaaaagacauugauuuuuucuggcuuucucaaauggacuucuugcauuucuaauuccaccacauuuagacagcauuuccucauucucuagaggacuucucugaagccacagaaauuagaggugauuuuucccggguguuguagggcccacuggcuucagggugaacccuagucuccacucccaccccucaaaagaacugaccugaauucccuaaaauccaucuguuguuuuucaucucccauuuuuaagcaauuaaaauuaagcuccccuaaauuucauguugggaauuuucuuaaacccaacagcaacaacaaaccaccuaacuucuacaaauuagucuaggauuuuguggguuccccaagcuuucuaaccaagauauuggguuccccucguuaggccuggaucaagaugccccccauuuuugcauagaauaauuuuccucauuccccaacuuggauucuaauuuuucuggaaucucaaauuuagucauucgccacaguuuucccauuuauggagucgccuucgagucccccuacuuugggccgcucauucccaggaccgcaaaucagacaagggucugacuugggauccccgaaauuugaucauuguuuccgcuggccacuuucggcagcuucccguccugcgcauaacagugguaucggccucgucacuucuccuacggugucccagcggcagcacagauuuuggaaaagugugugugccccaaacacgcacuggacacugcgcggcggccaggacgugggcaguguugcucccguguccaggaaaacgacugggcauugcccccaguuucccccaaauuugggcauuguccccgggucuuccaacggacugggcguugccccgguucacuggggacugcccuuggggucucgcucaccuucagcagcguccacuucagcagcucccacuucauccgcucucccgcccuucuccuccgauccuccugcgccagcggacccgaccuucggccuuguggugagcuccccguggcgcgcucccucgugccccagcucuuccacugcggggcaccggcuaccucgcaguuuguccucagggcugcugcggaguagcgcgggagcgggcugcuggcuucucccucggcggcagcgcuccuuugggcugggcgcuccgaaacgcgcgccacuuugugugcacucugcaaacaacgcggugguagggaaagcgccugggcggccaggaagcgggaagggcagagcgcucgggcggcuuggagccuccaacccuacaggucgagggcuuggggaagcgaguguagagcgcgggcgcggugauugauggucgggccgggagguuagccccgggugcacugguuuccgccaguaguggcccuuuagaggccuagaggugcggaggucgggagagggaaacaaggugcaccgguuuagaagugauuuugacuugguaaaaaucacaauggcuucuuauaucugaaaccacccggggagaguuucuuaauagcccggaauuaucgcauuggccccuggggccgaaccugcaacuaagcaaauucaaagugcugaggacagggaacuguuaucugcucauacuggguggggucccaaaggcgcgccgcuuagaagcacuucagugagcucugguuuacaggucugguuugagcuacguuucccgcccugcuucuuuuucugcugaagggcgcagacauugugcgggggcuccacgcggggcccagauuuggcguggccaagccagccuucccuucauggugcaccugguggccccccaaaggcugcuaggagaucccaggcaaagcagagguuaggggcgcuuaguaagaucuaucuggcugcuauucgaggugccucacagcccgcccugccugcucaggcagguggaggcugcgcgcucccccccccccccccagccgauccaggggacuguccccugcuuagcaaguaggucccugugagaacccucuacccagcuaccugcgccuuaacucagucggccgggaugcgccuaccuuguaacccucuaacugagcacagguccugccacuaccacugaggccuagggugccacgcacguugguucgcaccacgcgcccauguugcacaagcacagggcaccccggaaacaugacaugggaccucgauuuuuagggauagacacccaggauuuagugggccuguuggggcgcacagcccccccccaucuuugccaccaggcacuccacuccccccccccaccggcaacccccgugcccagggcccccgacccgcauuccccgcguggcucgaguugcgggggcggucccggggcggggcgagggcccugcggacgcccauuggcgcgggcguaaggccagcggggcccgagcgggcgccgagccgcgggguggcgcggcuauaagaaccgggcguuggcgcccggaguucgccugcucuccggcggagcugcgugaggccaggccggcccccggcccccccuuccggccgcccccgccuccuggcccacgcccgcccgcgcucggcccgccagcgccuccauccgggcuggcggccccgcgucgacgccguccgccaccucgcugcugcuaacuccugugcagggcgccgucggcggggccgcgcuccgucgggccugcggaucuccccaccgccuccuccucuaucuaccucaacaccccauuccugcuucgccagaggaggcgguccccaccgcaggcaguccggcuugcaggucgccggcguugucaucccccgcgcuuccccucccagcccuccccggugcgcagcccggcugcuccccucuuuucgcugcagucccgagcagcugaggcgccgccacgccugucccccccacaagaagcccgggcuuacgacggcugagggcuccgucgacccuaaccgagcugggugcccguggccggggugacgccuccauuccuccccccucaacaccguccucgguccuucgaaguugcauccucuccucugcuuagggugcgcccccccucgcgcacccgcuuacccgccaccuuuccuaagcuccccuccugcccccuccccguuccuccucgccucagacucccucccccucacguccgcccucugccuucgccuacccaaguggauuaauuauacgcuuucuguuucucuccgugcuguccucucccgcugugagccuacccgccucucgcuguccucucucccucucucccucucuguggucccccccuuucacguucacucugucucucucacuaucucugccccccaacuauccuugauacaacagcugaccucauuucccgauaccuuuucccccccgaaaguacaauaucuggcccgccccagcccuaagauacccuaaagaagcagaagagacgccccccuccccaccaaaaaagccaucuccccguucugucccgucgcacauucggccucugcgacucgggcagagcggcgcuggcagaggagugcccggcagaagggccuucgcccgcuguucgguuugcauacccgcagcagggagaugggcggcagcgucgccggcuuccagguaagggcucucaggggcccugggaguggggggugcgcagagcccggcuugggcauggcgggacuggugcgguggguggggggcugggggcucguucccuaagcaaacuuuuguucccccuugcgccauggagugggggaaggggcggggguaugggggcuguuggggaggggguguguaaguugaacucacaggagacuuccuggugcuuuacuguguguuggggaagggggggauggaugagcugcauaaaauguacgauucgugcugugcaggcccuguacacccccccccaagggugcugagugaugaggaggggggcagagucuccgaagcccacccugguauguugacuuugugccaaugagacaggaaggaaaagugggugggcggggccaagagccccccaaaauugguaaaagagucaagccagaccccacaguuagcuuuuccccccacccacacaccccaacucuguccccaacauucccaaccuggaauguuggggggagaggggacgguuucgggcucagaagggcagaaauguuacaguucaaagagaaauaacugccccugccuuuuacuggguguaacuuuccauaggaggaugugggaaggagcccccucccuccccccauuggucugugcagaaagggcugggggcgcacgaugaggccccccucccacugguggugcuuugcuaaggaaugguccaaggcuagcucuugggggugcaggagaaaagggacuggcuggaaggagggagggggcgggugcaaagggggcggggggaguggucagcagggagggggugggggguaggguggagccgggacugggaggagccacucagacauaaaaagcggaggcacugaccaguucgcaaacuggacauuagcuucuccugugagaaccuuccagccuuuuccugucuucauccucuuccagccccagcggccuccuuacccaacuucagguaaccagggcuguggagccaggacccugcugccauccccacuccggcuugcccagugggguggucagggcaccggguagccugaggccucugcccuugcagccgggccugcuaccucucccaagccuucguucucccucagccucuguccuaugccccccacuagauccaggcuuccuuaccugcccaguccucuacuuuuccuuccucucugccuccccacuccaacaaauucgggccuucccugggcccucaccugucccuugccuccuggucaaucuccugcuugcuucuccuggacaccugggcugaaccagccaguguggucuuggcuuugggaagggacuucgaggucagcuccgucugccugccccccgcccccagaacuaacugcuguagcuauagccugcugaucgcaagugguugguggcacagaggguauugggaggaucggucugggucuugaugaagugggcaaagaugacuuuuaguuacccaagggagcucgaacaaauuuguuucuugauuauuccgcacuggucucucacauguuucuuugcagcaagaaauccccugggccuauggagcagagauugaggcugcggccuggagggcucuacuuaacugaagggucaaggguggcuuacugugggucaucguggccucccaccacuaaaaaagcuagcuaaccauuguccccgccuguagccacauagccuguggagggggugugucccuccaaaaugggguguuuagccucccaaggacccaaacugcugcccuggguaaauuuagcucuuaucagaaagaugauucuaugggccauaaagggacccucuagggucccugaccauggauggcaagcucugaggugcccaggaaagucuauacuuggaggacugggugacccuggagagcaaggcucacaggagugcuggcuaucccauugcgcuaaccauuggauucugacaugggcccugcucaccauggccugggaggugggguggauggguggggcuggcucugcugcuuagggagggguggccagcuggggggcggguagguugggaauggucccuuuggaugcacaugcuccauggugggugggguggagcuaucugccaucuuggccaaugcuuggaggccagaguaggaguggcaguagugaugugcccuugggcuggccccacccccaugaugucauagcauggaaaccagguccaguguccagcacuggccccugcugcugugggugugguuaagcugcaauugcgcccauggaugggugguccucaaggguuucuuacaguucaaagccaccacggggugccuuccugggguccauugaauuucuccacacucaaaguaguuuuugaccucagcaauucaagucccccuguuuucacagguuaaauaaauagugacauggcugucuuucagauuccaauugcauuuuuaauuaagagaugauaggugucuuugguggggccugggugggggugagccauucuccugggauuagggguguggcuugggggccucuagcucaaagccugcguuucuuucuccagguaccaauggggaucccaguggggaagucgauguuggugcuucucaucucuuuggccuucgccuugugcugcaucgcugcuuacggccccggagagacucugugcggaggggagcuuguugacacgcuucaguuugucuguucggaccgcggcuucuacuucaguauguaacuccagagaggugggggcgggggaagcaagccucccuggauggggugacaauuaguacacuggucuggccuugcucuuaagcuaccccuucccccccccccccgggcaaggucguaaucucaaagucacaagucugauaguuuuaaaaguuuuuaaaguugauaaaagcaaaaccaaauguggaugucaagucucagccagguugagagugcacguguaguuuggggguacaaggggagagcuggaccuuggccauccaacuugagggguucccaggacuacaacauggggugcuugccugcuuucaauguucaugcuucucuugauuucccaguuggggaaggggcugggcaugggcucacugcucacagaaggcagugauggggacacauggguggggcaugccugggaggggcaggggcaccagaauggaugacuauccuugcuggcaugggccacucuaucuuccucgccugguccuggacacgcagccucuucuucuucacuucugccuaccugccugugaacugcucuggaaacaacuacugcucauggguacugcaggaccaguccuuggucgagagccacuccugcacggaggggcuucacagauaggagggccccaagcccaaccucggaccgugggggagagggggaagacgggagaagagaagggagugguuuuugggugccucacuccuccccucccgucuuguucucuccugcccuaucuucccuuccugucacaguucagcgauggggguugggggugggccccucaggacgggccccaaguacagggaccacaccuguguccaccauggcccccucgaggggcucacccccuccuccucccuguuuuccaaaccacuccaguguggccucuggucuccauggagucugugggacagugaagcugugcuguguuaguuaccagacaggaggcaccagaugccaggggcugguccugcagcaugcaccuuuauuuuuccuuucugggcaucuuggccugucuggcucacacuucuaccacaucccugcagggugaccuaguauccggccagggucuaguggaagggcagggguaguuccuucuucagccuuccccuccuggggggcggggcugggguggccaccccaaugggugcugaccccaguagacacuaacugaaguugucuguccuguggaacuuccaggcaggccuucaagccgugccaaccgucgcagccguggcaucguggaagagugcugcuuccgcagcugcgaccuggcccuccuggagacauacugugccacccccgccaaguccgagagggacgugucuaccucucaggccguacuuccgguagguagcgaggugggguugaaggaauuauggggugagacaaagagaccacucacuucuugauuugggguaccacgaagccccccucacacauuuuacugucagccucugcucauuaacauagauauuucagggaaguugcccugagguggggugacucuaguggggcuggggauaugcgacaccuagaugggagcucaggcuaacaugauacccugaaaccugcugacuagcaccuccucuccaggacgacuuccccagauaccccgugggcaaguucuuccaauaugacaccuggagacaguccgcgggacgccugcgcagaggccugccugcccuccugcgugcccgccggggucgcaugcuugccaaagagcucaaagaguucagagaggccaaacgucaucguccccugaucguguuaccacccaaagaccccgcccacgggggagccucuucggagauguccagcaaccaucagugaaucaaauuaugugguaauucugcaauguaguaccaucaaucugugaccuccucuugagcagggacaguuccaucacgucccacacuaagaucucucugcuccacucccuccccagguuucuccuuacccacccccaugccccgccuccccacaucaggcuguuccccuugccccacaccaucgggcaaggggaucucagcaguucuaaaaaaccaaauuugauuggcucuaaacaacccaauugacaccccccaaauuauauauucacauuaaaaaaaacuuuaaaaacuacagucccuuuaaaaacaaauuggcuuuuaagaaauuccauaacugauaaucuaaaaauuaaauaacuaaagaaauuaauuggcuaaaaacauacuaaaaauuaauuggcuuaaaaacaauuggcaaaaucaaauaauucggcgccccccccccuucaucuucuuuccauuuggaucuuuagucaaauuggcuaagacuuggaucccagaacccaagaagaaaggaaggggacccaaaauuuugcagguggcaugucauugcuucagugcccucuccuuaucccaagcaccuuuaguguaaagcuggcugagaacaacaauagccgcccaaacucuuucuucacuggucauuccaucacaaaugucccccaugucaccaagggggcugggugaaagaacccaaggagaagaacagaacaugaaaacuggaaauagaacuuaauuggcacaagcccccagucccaaaaucucacuuuucccuaccuacccuaaaaagcacaugauuauacucacacccacaggcauuaacacacacauacacauaacacauaugcacacacacacacacacacacacacacacacacacagagguaugcacacccacauaauuggaugaaaacauugaaauggcugaacaacuucgauuugaaccacauuccccaaaacaaggcccaucccaaauuuccugagcaguuugcaugguuugagcucuccucccaauccaucuaguuucugcugcugcuuauuggcucuaugugugaccaggcugcuaguucugucuuucucagugagggagguguucuagcaaggcucaauuccaucuaagcaccuguccacauggugagcccggugcuccccaaccacccccgccaugaggaccaaugacuagccaguguagaauaaguuuggccagauaaggagauggcacugccaagugauacaugcugcccaaguaaccugaccccuaguugugcuccugggaggaaagaucugggggacaaccccuacccugagcacaccuaugggccaucuuugucagucuccuggggagcccccgcuuuuuaggggcuccccaggagacucacacugauguggggagugugggaagucuggcgguuggagggguggguggggggcagugggggcuggguggggggagcuauggguaggaaguggucccagagagguuuuagguggaagaaucaggaggagucacaggucaacuugcagaauuacugaagaauuaggaccccaaauuuuaugccaauugaucuauuccccucuuuuuauuucuggggccgguuuuuuccuuuuuuuuuuaaucccuccuuagcuuuuuaugcgcucauaaucaauuguacccauucccuacauaacgggagcagugaucagguaaugaaugcaucgagccaucaacaccagcuagagccaucaacaccggcuaccacaauguccugcucuccacaaccuugauuuuuuuuuuuaucucucucuaucgcuuggccugaguugggaguggagucucuguggggugcuggccacgcacccacagagaaauaaaaggaauugagaaggucgcuaccuggccugacuucuggggacaguggcugguccccagaaguucugaggaguggagggggcguggggcaguguccccucagguguuaggaaggugcucggaggccacaaaagauggggcucccagcuggccacugccaguugggggggaaggggauagagaugugagaguagacagguuacaucaggcgggagcaaguggcugccuucugagcauuugggggagaaccucucccgucccucagugucaucuugcccacuccucagcaccccaccuugcccccaggaggucuggagcucuacagaccuccugggggcaagguggggugaggcccggaguuggggaagcuaggaggcuuaaagccuacagagccaggagaacuguauacacggggucaucugggcccuggggccugagggucuggcgagccguagcagccacuccacggugccuaggacugcggcggggaacagggcggcuggagguuuaccucacccccacuucugcuuccagugcagucccccugcccaacaguccaacuagcaaucuagaggccugaggcuucugggcccaggugacaggacuggcaccacccugggggcggugugugucagccaagcauggcacagagggucccucagcaagugccuaaagaaugggccauuuggaacauuggacagaaacucaaagaguaaauuguuauaauuggagacuaugaauuggccugguauccaaaacaucucgaggcacccuaaauuaccugcccauuuggcuggacacccacccaguguuaauaugccucgugggaugggugcuuucaggggcauuugcugaccacccucuguguccccacauuugcaguucuccccaucauaggucaccuugaugcaggcaccucccuggccuccuaugccuaguguggcccuccaucuugucucuucccuacugucuucagugggauccccucuugggucccucccuuugucaucaugugaagacuucccacgcgucgaacgccauaugucaccugugccacuguccaugucauccagcaguggccccagguguuugccucaacucagucccucuaacaugcauuuucuggcaaaauccaaagcuuggguuuuguuuuuaaccuguuaacgcucgcaaaccuaauaaagcauuuaaaauacuauuu

SEQ ID NO: 4217 - RNA, 1426 nt, Mus musculus
gaagucuucacaugaugacaaagggagggacccaagaggggaucccacugaagacaguagggaagagacaagauggagggccacacuaggcauaggaggccagggaggugccugcaucaaggugaccuaugauggggagaacugcaaauguggggacacagaggguggucagcaaaugccccugaaagcacccaucccacgaggcauauuaacacuggguggguguccagccaaaugggcagguaauuuagggugccucgagauguuuuggauaccaggccaauucauagucuccaauuauaacaauuuacucuuugaguuucuguccaauguuccaaauggcccauucuuuaggcacuugcugagggacccucugugccaugcuuggcugacacacaccgcccccaggguggugccaguccugucaccugggcccagaagccucaggccucuagauugcuaguuggacuguugggcagggggacugcacuggaagcagaagugggggugagguaaaccuccagccgcccuguuccccgccgcaguccuaggcaccguggaguggcugcuacggcucgccagacccucaggccccagggcccagaugaccccguguauacaguucuccuggcucuguaggcuuuaagccuccuagcuuccccaacuccgggccucaccccaccuugcccccaggaggucuguagagcuccagaccuccugggggcaagguggggugcugaggagugggcaagaugacacugagggacgggagagguucucccccaaaugcucagaaggcagccacuugcucccgccugauguaaccugucuacucucacaucucuauccccuucccccccaacuggcaguggccagcugggagccccaucuuuuguggccuccgagcaccuuccuaacaccugaggggacacugccccacgcccccuccacuccucagaacuucuggggaccagccacuguccccagaagucaggccagguagcgaccuucucaauuccuuuuauuucucugugggugcguggccagcaccccacagagacuccacucccaacucaggccaagcgauagagagagauaaaaaaaaaaaucaagguuguggagagcaggacauugugguagccgguguugauggcucuagcugguguugauggcucgaugcauucauuaccugaucacugcucccguuauguagggaauggguacaauugauuaugagcgcauaaaaagcuaaggagggauuaaaaaaaaaaggaaaaaaccggccccagaaauaaaaagaggggaauagaucaauuggcauaaaauuugggguccuaauucuucaguaauucugcaaguugaccugugacuccuccugauucuuccaccuaaaaccucucugggaccacuuccuacccauagcucc

SEQ ID NO: 4218 - RNA, 1426 nt, Mus musculus
ggagcuauggguaggaaguggucccagagagguuuuagguggaagaaucaggaggagucacaggucaacuugcagaauuacugaagaauuaggaccccaaauuuuaugccaauugaucuauuccccucuuuuuauuucuggggccgguuuuuuccuuuuuuuuuuaaucccuccuuagcuuuuuaugcgcucauaaucaauuguacccauucccuacauaacgggagcagugaucagguaaugaaugcaucgagccaucaacaccagcuagagccaucaacaccggcuaccacaauguccugcucuccacaaccuugauuuuuuuuuuuaucucucucuaucgcuuggccugaguugggaguggagucucuguggggugcuggccacgcacccacagagaaauaaaaggaauugagaaggucgcuaccuggccugacuucuggggacaguggcugguccccagaaguucugaggaguggagggggcguggggcaguguccccucagguguuaggaaggugcucggaggccacaaaagauggggcucccagcuggccacugccaguugggggggaaggggauagagaugugagaguagacagguuacaucaggcgggagcaaguggcugccuucugagcauuugggggagaaccucucccgucccucagugucaucuugcccacuccucagcaccccaccuugcccccaggaggucuggagcucuacagaccuccugggggcaagguggggugaggcccggaguuggggaagcuaggaggcuuaaagccuacagagccaggagaacuguauacacggggucaucugggcccuggggccugagggucuggcgagccguagcagccacuccacggugccuaggacugcggcggggaacagggcggcuggagguuuaccucacccccacuucugcuuccagugcagucccccugcccaacaguccaacuagcaaucuagaggccugaggcuucugggcccaggugacaggacuggcaccacccugggggcggugugugucagccaagcauggcacagagggucccucagcaagugccuaaagaaugggccauuuggaacauuggacagaaacucaaagaguaaauuguuauaauuggagacuaugaauuggccugguauccaaaacaucucgaggcacccuaaauuaccugcccauuuggcuggacacccacccaguguuaauaugccucgugggaugggugcuuucaggggcauuugcugaccacccucuguguccccacauuugcaguucuccccaucauaggucaccuugaugcaggcaccucccuggccuccuaugccuaguguggcccuccaucuugucucuucccuacugucuucagugggauccccucuugggucccucccuuugucaucaugugaagacuuc

SEQ ID NO: 4219 - RNA, 2466 nt, Mus musculus
caaacaccaaugaaaaacaacuuuuauagaauaguacacuuugcaacagcaggguucccacacuggccaaacaucagcgucaguauaggcuucagaagaggaagaagggugcagccaggcaucuugcccucagggcccaaccgguccacacuuuggccagguuggaaaguucuagacagugggggugagggacagaggucaucuuuauugugcuccaagcuuaaggauccuuuguauaaaaauaauucuucauauuuucaguagaguccuacaacaguucaaguuaauugauaaaaaguagauugucauuguaaaaaucuuuauccugagaaauuuccaaguccugaugcugcaagguccggaagauggaagaugucauuccgcggcguggaggccgagcagaggucagucagcacuuggcauuuggucaggcugcacuagacagcauggguaaggcauaggcccagguuucuugggcuagaagcagguagguccaccaggagucacccagggaugcagcugugaagaagauaaaaggugucaauguguacggacaccgccccaccucccaaggcgcaguaggcaguuucguuugcuugauuaguuuuggagucucaacucaugggugccucgauccgcucagaggcgccgacgggggcggggcgcacgcucagaaccugcccgccgugacucaggggcccgcuccagccgacucacuccgcaccccggccuaggacgcgauuugcaaugcaaacucaccccgccuccagcacccgacucggccaggcucugacagcacugggaccucgccggcccggcccugaggccgcuccccuccccuggccuccccuucccccacccacagcagagcucugagaggaaguuuugcaaucccggacaaacaaacgccggucuugcucaggcuugaaaaagguugaggaaaaaugaagcgugcgcgaaauccaagugaucgccccagcugaguccuggcugcacaggguccccguggcgcuaagugucaggcccgcccaccacgugucucccuuacugcuucgccuccccgccguccuggaacuuaccuuaggggggugggaugcucaguagcccccuaaccaacuggaaaagucaagcagcuccugcuccaucgggcuuagcucucccucgcagcugcuuuccuccgacgaguaggcggagcgcggggagguaggcucagagcagcccaggcgguccggggacggagacguagaggcgcaggacagagacgcgcuggcaggggaggcagagggcugcgcgcacucaucggacggcggaguagcggguguuaacagccccccagcgagcgcggcacgcaccgcgucgugcucugcgagcagccgcugcagcgcacgaauguacucuaccgcggagcgcagcgucuccaccuuacucagcuucuuguuggcgccgccgugcggcacgugcugccgcagcgccuggaagcccaaguuuaccagcuuuacgcgguugcgcucgcgcucauugcggcgugccacggcagccgagcugcugcuggccucgguugcuccagaucgccgccgccggcugcagcgcagcaauuccggagacgcuugucuccgccgagcagcgcaggcuccagcgacuccagacgaggugggcaugagucugggcagcgcgccgccguccaucaagcuugcauucagccccugggccccugcuacgaguucuggugcggcacaggaaaagugcucgcgaggaaccgggugcggugggaaguggacguuugcaccuucacgggccucaggcagggcacugcugcaggacucccuagggcacgcgucgcuggccuccugcaguccugggaccccguaccagucaaggucugaaagaguagggaagcgugguacucucgugucccgcgcgugcugucaggcgcuccccaagucucccuuuacgcggcucaagcggcuccuuuuuuuuaaaaaguauagauaacucuccuccgcccgccaccgccuccuuucucacgcccuccuuccuucgccucgcccucccgccacgcuucacccuccccuuggcguacacauucugcaaagcugacaccgugcgcuuccacccccaccccucccgggugcaguucauggccuacugacgugcuuccaugcuccgggcagaugcuuagcuuauugcguccucgaaaaauccucgagugcagaucccgaacugcgcuccgcaggucccgcacacucaggggcugagagaggguccgagagaggguccgaauguacucuacaggcaccuccacccguccuggugcucagcccuuaagccccaagagcugccaggucuccgcacaccuagcgcuugcagccggaugaagaaccggaccaagcuuugcggugaccaagagguaggaggcagaagagcgcgacccccuaggguagcacgagccucaaacccgcacccacg

SEQ ID NO: 4220 - RNA, 15221 nt, Mus musculus
guccucugggcggggccucggaggggcgggaccuagaggucuauaaagagugaggagcuaggcgcgcgcgcccgguccgagcgagcgcguccuugcuucaaagagauagugacucucgcgccuccggcuaggccuccagcccuucucuacccuacgucucauucuccgcaacgcaguucuccggcccgcaagcgcuccaggcuaucugccagucccggaccccgguacugcguccccauaccgcccgcuccaggaccaauccaagcuccgcaggccgcgcaccgccauggggguggagggcugcaccaaaugcaucaaauaccugcucuucgucuucaauuucgucuucugggugagcagccacuggggacagggcgcaccccacgguagccaggcugggcagcgcgcuaggcccugcugagaaggcgcagcgcaaccgcgaaguugcggcgccaccugugggcuccgugcgccgaucgggguccuggcgccccucgccagcggguugaggccgagggcugagcuucugggccucggcucgaggggcuucuggggccgggaaaucaggggaucgcuggccuguccccucugagugcugggaacuggugcaagagucugcgggcuagagccagguaaucaagagcccucagcuaugaaggggguacucgcacccuccugaauguuguuuuggggaccauccugcaucgcgagcagugaggggggucgagaagggcgggaucuuggcgccccgcccccaugagcucauccuagccaccgccccuggauaggcggccucgaaguggugggggcacgcuccguacuugccucggagaccucaaccccacuauuacuccacccuugcuuacccuccagcuugguauugccacccugggggcucgagcuccaggccuagaaggcagggcagcccgggccgcgugcugcugcgcacggugccccaguucuuggccacccccacccccauucccccagcugccccuccuccuugccugucgucuccugcacagauuacagccccggccugacccuuagauccugagaggaagaggguaugcaguucugaguuggugaaggccaggguguugcaaagaucugggaucuguacaaaccaggagcuuaggaucuuuuccuauauacaggaucuaagcugggcucuccacuuuggaaagaagugcacacccauuuggucaucuuggaaaggagacauggguauaagagggucuccaagugucccuggguccugacugucuucacugcuggggaguagccauuggugguaugggcuucuuuccauuuccuaacuggguugggaauggggagucuuaacagaccugccugcgggcacuugagugagcagugcuggccacuccucuggacaguggugccacccucccugcugcagugcacagacugcuguucccaccacccuccuucccaggaagaaaugagguuaugccaagacaauguuucucuaaaguuguuccugagagggcaaacuuguacaacggccccuggagugaguguguuggacaggggacaccuguuuuccaucgaggacugcugaagaucccagggcgggucagggugggguggaggggaauaagacguuggggaugggcaggaacugggcugaacucagcuggggcuauguaugcucacgcggugcugcagggaccaagauugucagucacggugacuccagagaacacauucuagggagcagcaugggcgaugggguuaaacuugcucugcccgggcaugccuuggggucucgacuggguagucauguuggacagugcuugccuacucugaaccaugcaaggaauugaaugcacccucaagaaguguguuauccaccccaccccacccccauuauucuucagaugugggaugucaggauccuguaggguauuucuuucuuucuuuuuuuucuuuuuuugcucacccaccugauccaagcgcuagacccucagacucccuggagugcugaggcugggugaagcugcucguuucccaggcagcugggguggagucccaacaugucccuggggucucuauugaggcuccaggaaacgguucugaagccucucccugcucccagggaccugccuacugacugcagaacagugaaaacuguagccuuucacaaucccacagaccucuccucccuacucauguuggccccacaguggauagggauguggagcagaaccaggcuacaacugguggacaccacccuggcagagggacuccuuuugucccucguguggcaagguuuguacuguggcugauaguucccugauaucaugaaauugaaccuuuggggagccccaccccaccacucuggcccuuagucuucacuuccucccucuaaagugggaguucuugggggucucugucuccuaggauuguguguagacuagcuaauguacuccagaguggggcaaggggcuuggagcagagaaggcucaggaaauggacacuggacacagucuccaaaagggaguggggccaaaggaagcugagcaaugaugucagaagggccuaaggagggggcugagagguccuuugggccguggugggggcgggggcuaagagcucuaagaagggagauuugguugacaguaaauguuucgauggacacuuuuuaaaauuuccaguuugaagauuaaagugguuucucugugggaggggacauuccgggcacacuaaccugccugcugucacucccaccaguccuccuugggcuugaguucagaaccuauauuggggccagcagaguucuggacucccaagauauauggggcaggacacaaaccugaaagaugagcggugagcagcagagaccauguaagaugcucuuagaagcagggugguuacucauccccugagacaggucugggauuaaggguccagucuccucuggcaauagucaccggcuggcaauagggcaggagagcaggggaugguuuaucacugugccagccuauggccucgggugggucuguaggagcuuugugugacaaugucuccauaggaguagucaguuaaggagaagaaucuucacuguguuccccgacagaacaggcuguuccuccagccuaaggcugcugguggcccccguccaguagcccaggcagccagacccaccacaaaaggcugauuacagccucucaacuggcauuuaauucuccagacugaacaugacugucuguugugcucgcuucagcaacacacauacgugacugucugucacauaguggucugcuggcugccuuccggcagaggggcucuaauucugugggcucaggguggaaugagcacuuccugugacuugccccuugcuccuggggcugucugcuccgcccggcuuugggaaagacaaucauuggccugcaaaggggaagucugugguucaucccugggcuggcuucaaaaaaaggacauccgaacagugggggcacagagcuggaguagaccuggcagccucuacucuggugcccacacacugcgaccucauaauaagagcccccacccccauucuuuccgaacccuuuaggcauucucucggcacuugccuucuagcucaguccuaccucaaacggagcuucugugaugcucuaggagggaaccaacaacugccaaccuugauuccagaacccagaguccugccaaggggauuggaaccucaguuauuaaaccucuagccuuagaguccagcugcccuagggagagagcaaucauccuuguacacaagagagggcguaggguggggcagaguuauggagaagucaagguaccuguggcucuggcccugaugccagggaaccagguaggacacggugugaguguugggugacucugagugugaguguugggugacucugagacccuauagguagggccauuuuguuccuaggacuguugcuagagaaccagguguccugagaacuggccuucaguagccuucaacuguucaguacucugaccuggcaugccagugacuugacugugaccccuaguaccucccucacaaacacaaacacacacacacacacacacacacacacacacacacacacacagagagagagagagagagagagagagagagaucacuucuagauccagucuaagcuacucucccuggcuagcugcagggcauaggcuaugccauucaaaacuauuuggggucuucugagugggcucaaccuuugagggaacuguucacaagggguuggccagugagcagcuagcugguggugggcauccuggaauggcuaccaaaguaacugcaaggggauguugggagagggcaccugccuuccuucauaugaagucuggagugugugugggggggagugcauuagaaccagggcacccauaguuuuauagccccauagcacugaguugguaaccgaagccaagagccugguugccaggcagcuugggcagaagcugcugaguaacagggcccccgaguguccuguguuuccuugcacuaucucucggaucacuccauacaugaugucagcuugggucuucagaacuuucucagggugggucuguggcauccuaugacucauuuagcugugcuuuuacccauggucaagcaucaauguuggcucuguacugcagcuaaacagugagggguuccaaugguguuuaaagaugucccgugugacggggagcaguaaugaggaagcccaggccaccuguccuccugaagcccaucccugagcucuagaguaggaccuuguguugcaagggcuuguggagugugacaaacacauacuguggaguguggcaggcacauacuguggagugacaggcacauauugucacugccaccaacccacuaguguuaacucaccuucucacaacuuuuuuuguuuguuugucuguuuucaaggcagagcuuuucuagccauccuugaacucacucuguaaaccaggcugggcucaaacucagagauccgccucccucugccucccaagggcugagauuaaaggccugugccaccauugccuggacucucauuacuuuucauggcuaaaaauccucaugguuggggcaugacauggccuuugacccuggaaacagucuucuccuguacucuggaguccgugauaacagcucauucagcucaccgaaaguaacacuccguugggcuguuaucagacccguugcgggugauaaggggacugagguuuccaagcaacuagcuaccacguucggaaguaguaggaucggguagaacuacacuccacucugccaccauguuccauagucaaaguggccuguaagacccugccagccccacagccugaccuugggacagagggcuaugcccagccuggaacagauagaaguccuuuggugcugcugguggugaugccagaacuacauagagcucuucuacccacucucaguccccugccucccuuuguuccuuuuucuggguaccaggacucccugcagcacuuaucucuggcagacugcuguggcgggcuggguccacacagucucccuauggggucucacgagacauuggccuuccuagaggagggcaagugcgggauagauggggaagguccuugccuucuaguuuccuugccugagaaggagccauguagucuggcccuggaaggggcccagcuggguggcccagcccaaucucuugaaccucaagacagcaguauauucucccauggccaugccugggccauucacaccacugccccuagccugucaguugggccccagagcuaggcauuugcuuugcugccuauuuuuagaugcuaugacaguggcuuccugagacgaggggccuugugaaaggaaccaugcuuccugcccaaggcgaggauuccugccccucucuccagcuuccuuccugagcuuccuuugguagacuguaagucuuuaccucuccuaggaaggccugagcaagauccauugucucucagagaggaaucuggccuuguccccauccucuauaccccagaccaggcccaggaccccagcuagaaggacagcaccuaagucagccucuaccuaaccaaugccccuaaaaccagucugagccucuuuacucugacuuaucccagcugcccagggucuucacaaccucugccaucacaggagagguucuugggccccucagcaccuccgaauugcuuaggugggugagcacuuuguggugcaccuucuagcuugcaucauguacucaggaggcuuugaguaagccccaacccugucugccucugccuuugguucuucucuugcggcccaaaugguaacucaaaggaacaagcugcuguuacagccagccuccaggagcauuuuggggugcuuuguggugaccauucauaccuaccaagcugguuucaggagcccugucccuuccuagagaacuucauauggguagcaauaggaaugcuucagagaagccccuaucugagucuggccaaggcugggcagugggcagcuagcacaggguagaaugcugucccaagccuguacccuuucagucgcuucugggaaaccacaagagcagcugggcagggacccagcaugcuuggcagcuccucgacuuguuaaaguuugagucuguuauggauuagcccuuaagaaggaggaagcaacacaauccuguauagagucaugaaugcauccuuuugugccagggaaggagcuccaggaaccuggacaugccaccugggugcgucccacccccaccucuaaacagaaggucuuuuaggcugcaggagcagguggcagggccaccuggagaaaggaagcuuugggcagagguaucuuagagccccugaguggauucgggaagaaaugccagguucugcuuuguggaucacuuccucagcucugucaagagcuaaauacagugacaucacacuuagcagccuuuguguauuacuuccccuguuuacaaaugaccauaaggguggaggagauagagauggauuugugacacccuagcuccgauaugacacagauagagauucaggccaucuuuacccuuuccuggaccuccaucuaauggcacuacuccauauucccauggacauuggacucacacacucucccucccuccuucuuucuuucuuucuuucuuucuuucuuucuuucuuucuuucuuucuuucuauuucuuuuuuuucguuuauuuuuuaaaugaguguugcccagauuuugcagaucauucugaccuaugguucuguaaacaagguguauuccuaauugcugcuaauacugggacaccccuauacccuucuugggccuggggaauauacuugagcagagccacugauccagggaccguggaguggagggggguaaguagcuuucuguagcugugcuuggcauuuacacccccaugaaacuuagcaccaucaggagaguacccugggcucuuuguggucuaaccccagaacuuccauuggguuaucacuguacuaucuugaacgaccuuugaauucugcuuucaucugagcagggucagaaggcgcuagcugcuucagcuucuguguccuccuuuugcuccccaugauugaacuguccuccgugcucucucacgggucugucuuuucccuggagauucuaccauucgauggacccagggccugugcauucacugacuggaacuagaacuccagaacucccucuaccucucccuagaguagcaggguagacggucacuuugcuggaggaagccaucucaguaccuggcauuccuucccacucagcucugauugccccugggacaauggggugaguggccaaguccccauuuccagaugccuugccuacccccaccccaguuuggccucucuucugauugacagucacagauccuuagccccccccccccgugcaccccccauucaggacugucaguuaaugaauaaagcccagagacuuuucuagaguuaacguccucaucccaccucuuucauaaaacccggcucuaagugguggcuuggccagacacccacauuagcagccuuuggggcucggcugaacagcaugccucacuccccuuugccccucagcucacagacaguauucccguaccauuagagaagccagagucaggcaugguugcaugcucagcuguuuuacagguaagcacacagacugaggaaagcaaggugacccaccagcugccccuuagccucugugacuaucagggauugucaccagggucauguuaucaaugagggaaggauggggaacaggugugccaccugguucuccugcccugggacaucucagagcagccuccagaccagaucuuaaacaaaauauaggauguuuaaaagcugcaaaggaagccugguuaccagggcaacucagacccgucaccucccacccuccugcuucuguugcccaagcugauucgagcgagguucuuaagggcagauggauaaagagcugucaguguaacaugcuggaaauucuggggaucccuggcaucgcuagggccguuacaugugaaggcacugucagagucucagccuucaugccauuugugguuugggcaacgggugcccgggugugacuuugauugcuguaucacacacccucuucucucaggcccugguggagguugggggcucaucccuccuggauuggagugugaaaaacgaaauuaagcacuuaaagaggagucugagaaacugagaaagaagggguggagggagagggagauggugaucaggaaaguaccccuccccagcuuccucucugaggguuaagcagcggacaugauccuaggguagaagaaggcagauggguccauaggucuucuuuccugaaccagccugcuugcaaauuucucccagagcuuucuugagcuuguguucuggccuggauccccagagugaagagcagauacuuuuuuuuagacccagguuuugguuucuauuugcuguuucugcuggggagugccacugacccuucaagaagaggagaccuggcgcuggggaggagacugccuuccuuggucuguucugaggcccagcuucugcucccagguaccugcuucucucugcggggccugguggcaucacauggucaccccugaggacuuggugucuccaccacagaguucccaguauccugccugaagcagucucuaaucaaucccaggacuguugggacaggguaccugaggagagcccaccagcauccugaguggcugggccucacuguggccauuucuacgguaaaaauguugcauaguuggucaaucuggaacaguaggggggggggauguuuccugcugauuuuggagacaagguuucauauagcccaggcuagucucaaacucacaugaccuugaauuccugauccuccugccucuaccucucaagugcugggaugacaaacaauugccaccaaacccuacgugguacuggggauugaacccagggcucccuacaugcccaaguacucuuaucaacugagccauauuuuucagaccaaacuucuuguaugugucuugcgcuauuggagguacacuugaauucuguucuggaguuacaaccaagaggagcuggugggacccagggcucaguggcaguggcucagacaacugcuuggcaucuggcuccacaacuggaagugagggcucuacaugauaagcauuguaggcuuccauuggccccaguacucuggccucuauaugacacuguuccugguuuucauuucuuucuuucuuuuuuuuuuuuuuuucuagcuggcuggaggcgugauccuagguguagcucugugguugcgucaugauccacagaccaccagccugcuguaccuggaacugggaaacaaaccggcacccaacaccuucuacgugggugaguaccaaggagacggguuccagucacagugcagaacagucagggagggcuuccaagaagaggcugaugguccaaaucuggugggugaggcguuagagcugggaguggccuaggccuaguaugagcuggguagggaggcugccuauaagaggagaaugaguuggcuguggugcugcuggugaccccacagaucugagacuagacuaggcagaaaggaagcaacgggguggggcaggggccuuguaggaccuugcuuauuuuaacaugggcauuucuagugaaccucccugggcaggguggggcaggaugccugggcuagcaacagcugaggcuccaggaguccugaguugggaagggcuggagacugggccgacagugaaugacucagacaccccaccccaccccacccccaccagcacacagcccagacuguuacaccugccuuauuuggcugccuguaggggcugaacacccucccuccuaaguaagaugauggcuguugugcugugugguccuaugcucugguccacuacacugugcugaaggagaaaacuuuccucuuuccucccuggaagagggaccugguguccugagaacugaagaaguauuuggagaugucuuuacccuuccaaagcuccuaccuucaucagggcucugauguggaucuuccuucuccuccuguggagccuagaagaggcuugggaggcaugcuugaggcugagugggggaccaggaggucugaaauauucucccuuucugcccaauugccucagagcagacagggcuuuugguuaccccauggcucgcucuguuuccuuccucccuauacucuguccacagccuuagcauggguaaaauggacagcaguggaguccaggcaauaugggcaggggcagaaccuggucuccuuugaggaaagccaugagggguagcaguuuucagguuugguuguuaguagggaagggcccacacuagcuaucccuccuucuaucugguaccuucagagaaggaggaugcccuccagcucauagaaacuggauuguggcaacugguaggcaucuucacaagggaaaucugggaaucagagacagacagggguagaacuggccggugggcccuccacaaggggaaggcugugcucccacucugcacagguauggcaggagaggcuggcuacccugcagagcccagauagggugguuaggaagcaagucucuauccuaauguucucauaauagucuauaccaggcuccaguuccagagcggcucagccaccugccugucugguuauggccuccuggguacuggggaaauagucuuagggacuggacccuguagcagguucuucuaccuauggguagaagcuacucuggcugccaugucccuggccaaucugaauuggcuuucuggagccccaugcugccccuguacugagucccucuaggagcagauguggcccugaaaaaggugucuuauuuagugcuuaggagaguucauucagagcuugcuaaacaucccagacaacaccacaggggcuucagaugagacaugugcuagacauaggagggugccuagggccuagaaaguccugggacagugccuguguguugggugcccuguauguauccuccuguugagacagagccuccuguugagacagagugagguugggguuuuagggccugacaacuggggugcucugccaguugggaggcaagggggaaaacaguuucuaggcagcccuggugggaggccuuccccggaccagacguguuuagugaggccaaaggauuuggccuauuuuuaagucuggcagcagguccaggccauggugccuucuccucuggucuggccaggcagggaacaaugggccugacuuugugcaaggaagcuuggacugcccuacaguguugccguggagacugggggauggacggcuucugccgagggaccaagagauggaacgcucaucaaagacacagugggcuuucccaggggcagaaggggguauugugggcacugaggcagggacauggcccaguugguaccucaugggcuacagugcuccccuguaaacugugacagacauugggugcucugcuuaagcuuccccuaccauucucuuagccauccacccacacacaggaucccguccuuagaguuaggugagccaaacaguuauacaccaguguuccugagaugaggugccuggaguugguuacugccauagcuuacccuugauuucacacucaccgaguauugggagucuugggcauuggcuccugacacccaagccacuuccccuaacugaaacggauaguccgucucagcccuuuacagugcgugcugaggguuccuguucucagaugcagguggugggagacuggcuccagagcagagcauaccugugaaauggagaccacccauguucucuggucacugaauugcugcuuuguccccugguggcaguggcagcuccuccagcagcacacggaggcauaaacggcgcacauugcuaaacucugccugcugugguugugaguuaggccuuccugugugauucaugcagccugcucacucaggucuucccuuccccaggcaucuacauucucauugcugugggagcugugaugauguuuguaggcuuccuggggugcuauggggccauccaggagucccagugucugcuggggacgguaaguagaaagggcugaagggcuggggagcaggguuccuagcaacuuauaugucuuccccaagguuuugguuuuccuaggggcuugauuuccauugaaucugaguaugaauauacauguuggaaaaggggguuucuguuuaaaaaagcauaaacuccagaagggugucucaccccuaaagccaaccuuagugcuccuggccacacuagcugcuggugaagcugaaucccagauuugccagaaucuggccagccugggagggaggcgcugccaguaucagaagcuggggaaaggcagcacacgucauagaauguaggauaaaggaggugaggaaacugagguuaggguuggggagugucuugcugcaugugccucagugaaggcuguggacacuuugucaacugcauuucuacaccagccacauccugcaaaguaggaugcaaggugaggcuaugagaacuugaacaucucagugcaggacuguaucaggcucuugucucucaauggcucuguguggcucaugcuuaaucaggacaugguugguggauauggccaacccccuuggcacauagcuguuggucaugugggcuaggccugggcuugcuggucaaggcucugaccucuucuuuccccuaguucuucaccugccuugugauccuguuugccugugagguggcugcaggcaucuggggcuucguaaacaaagaccagguaagccuagguucaccgagugggagauaugcccucugcccuccaacagauguggguugcucugagcccauaguuauagggugcuuuuugaauuucuuggaccugcugcuugggugggggcagggucuugggagcucaguggaagagguggcaucaggcugagcccaucgggaaguugagugcucuugggcguagccccgacacuguaugugacuaugauucucccccagaucgccaaggaugugaagcaguucuaugaccaggcccuucagcaagcugugauggaugaugaugccaacaaugccaaggcuguggugaagacuuuccaugagacgguauagcuaggcucaagcaggaggggaggcugugggguuccuagugugugagggcaugggucuccuuucuuuccaacacaacagggccuaggaaagggucuccucuaugauuuguggguccucagguaggaaucuaaugggccucauuuucccagggguuugaaggaacagggcuccugugcagggugacaaacagggcagaaggacaacucccaaguguauuuuggggugacggugugcugugugccugaucuuucccuugucuccugaagcuccaaagcugacaguguuguucuuggucccugcagcucaacuguuguggcuccaacgcacugaccacacugacuaccaccauacugaggaacagccugugucccucaggcggcaacauacucacccccuuacugcagguagcauggaguggggaugaggugguggugguggucgguagggugguguggccaaucaggaagaucagcacuuugagcaagaccucagaagucccauagaccaucucuauuacugggguaccggguccucacagcuugaguuaaccccugcaacaucccagaaaacuguucucuugaguggucccucauacccuggugacccuagggugcuagugagguaaaaaaacacuccccugugacaaaaggcugcaggcagcagguccgugugucuuaaauuuguuuugggguggaagauaagcugugauacauagguccugucacugaguagggugguggcugugacuuagccacugaugguuaaccacgcucuugccaucccugcagcaagauugucaucagaaaaucgaugagcucuucucugggaagcuguaccucauuggaauugcagccauugugguagcugucauuaugguaagcacagggucucuggugggugggugggauccuucccagggccuuaggugcugacuaugccccucccuccugcagaucuuugagaugauucugagcauggugcugugcuguggcauccggaacagcuccguguacugaggcccuuugcauugcaccagaggaucccuggagugaccagaggccaccuugggggacauggccuguguauauaauauuucuguaucacucugcuacacuuagucuuuuuacuuuugaguuuuuuguuuuguuuuguuuuguuuuuguuuuaguuuuuuuuuuuguccugaacuuuuccuguuaccuuuugggagcugacaucacacauggguggcauaugugggauguagggguggagcuggcccuggcuugcagggcccuguacgucugggaccccuggagaguucugccugcugagccaaaccuccucuacagcuacuugcccagaggcuuuguagccuagcuagagggccaugcccacccacucaacccacugugggucacauugcucacaucuuuuuaaucuuuguuccuuuccugccuccauuucaagagcuggguuuguaagcccucuuaugccuucaaugcacuuauucuuucuaacgugucaccuucaacuguaauuaaaucuugaaacagucauuuaauaaaggaggaaaaaaaucaggcaugcuaauggga

SEQ ID NO: 4221 - RNA, 15221 nt, Mus musculus
ucccauuagcaugccugauuuuuuuccuccuuuauuaaaugacuguuucaagauuuaauuacaguugaaggugacacguuagaaagaauaagugcauugaaggcauaagagggcuuacaaacccagcucuugaaauggaggcaggaaaggaacaaagauuaaaaagaugugagcaaugugacccacaguggguugagugggugggcauggcccucuagcuaggcuacaaagccucugggcaaguagcuguagaggagguuuggcucagcaggcagaacucuccaggggucccagacguacagggcccugcaagccagggccagcuccaccccuacaucccacauaugccacccaugugugaugucagcucccaaaagguaacaggaaaaguucaggacaaaaaaaaaaacuaaaacaaaaacaaaacaaaacaaaacaaaaaacucaaaaguaaaaagacuaaguguagcagagugauacagaaauauuauauacacaggccaugucccccaagguggccucuggucacuccagggauccucuggugcaaugcaaagggccucaguacacggagcuguuccggaugccacagcacagcaccaugcucagaaucaucucaaagaucugcaggagggaggggcauagucagcaccuaaggcccugggaaggaucccacccacccaccagagacccugugcuuaccauaaugacagcuaccacaauggcugcaauuccaaugagguacagcuucccagagaagagcucaucgauuuucugaugacaaucuugcugcagggauggcaagagcgugguuaaccaucaguggcuaagucacagccaccacccuacucagugacaggaccuauguaucacagcuuaucuuccaccccaaaacaaauuuaagacacacggaccugcugccugcagccuuuugucacaggggaguguuuuuuuaccucacuagcacccuagggucaccaggguaugagggaccacucaagagaacaguuuucugggauguugcagggguuaacucaagcugugaggacccgguaccccaguaauagagauggucuaugggacuucugaggucuugcucaaagugcugaucuuccugauuggccacaccacccuaccgaccaccaccaccaccucauccccacuccaugcuaccugcaguaagggggugaguauguugccgccugagggacacaggcuguuccucaguauggugguagucaguguggucagugcguuggagccacaacaguugagcugcagggaccaagaacaacacugucagcuuuggagcuucaggagacaagggaaagaucaggcacacagcacaccgucaccccaaaauacacuugggaguuguccuucugcccuguuugucacccugcacaggagcccuguuccuucaaaccccugggaaaaugaggcccauuagauuccuaccugaggacccacaaaucauagaggagacccuuuccuaggcccuguuguguuggaaagaaaggagacccaugcccucacacacuaggaaccccacagccuccccuccugcuugagccuagcuauaccgucucauggaaagucuucaccacagccuuggcauuguuggcaucaucauccaucacagcuugcugaagggccuggucauagaacugcuucacauccuuggcgaucugggggagaaucauagucacauacagugucggggcuacgcccaagagcacucaacuucccgaugggcucagccugaugccaccucuuccacugagcucccaagacccugcccccacccaagcagcagguccaagaaauucaaaaagcacccuauaacuaugggcucagagcaacccacaucuguuggagggcagagggcauaucucccacucggugaaccuaggcuuaccuggucuuuguuuacgaagccccagaugccugcagccaccucacaggcaaacaggaucacaaggcaggugaagaacuaggggaaagaagaggucagagccuugaccagcaagcccaggccuagcccacaugaccaacagcuaugugccaaggggguuggccauauccaccaaccauguccugauuaagcaugagccacacagagccauugagagacaagagccugauacaguccugcacugagauguucaaguucucauagccucaccuugcauccuacuuugcaggauguggcugguguagaaaugcaguugacaaaguguccacagccuucacugaggcacaugcagcaagacacuccccaacccuaaccucaguuuccucaccuccuuuauccuacauucuaugacgugugcugccuuuccccagcuucugauacuggcagcgccucccucccaggcuggccagauucuggcaaaucugggauucagcuucaccagcagcuaguguggccaggagcacuaagguuggcuuuaggggugagacacccuucuggaguuuaugcuuuuuuaaacagaaacccccuuuuccaacauguauauucauacucagauucaauggaaaucaagccccuaggaaaaccaaaaccuuggggaagacauauaaguugcuaggaacccugcuccccagcccuucagcccuuucuacuuaccguccccagcagacacugggacuccuggauggccccauagcaccccaggaagccuacaaacaucaucacagcucccacagcaaugagaauguagaugccuggggaagggaagaccugagugagcaggcugcaugaaucacacaggaaggccuaacucacaaccacagcaggcagaguuuagcaaugugcgccguuuaugccuccgugugcugcuggaggagcugccacugccaccaggggacaaagcagcaauucagugaccagagaacauggguggucuccauuucacagguaugcucugcucuggagccagucucccaccaccugcaucugagaacaggaacccucagcacgcacuguaaagggcugagacggacuauccguuucaguuaggggaaguggcuugggugucaggagccaaugcccaagacucccaauacucggugagugugaaaucaaggguaagcuauggcaguaaccaacuccaggcaccucaucucaggaacacugguguauaacuguuuggcucaccuaacucuaaggacgggauccuguguguggguggauggcuaagagaaugguaggggaagcuuaagcagagcacccaaugucugucacaguuuacaggggagcacuguagcccaugagguaccaacugggccaugucccugccucagugcccacaauacccccuucugccccugggaaagcccacugugucuuugaugagcguuccaucucuuggucccucggcagaagccguccaucccccagucuccacggcaacacuguagggcaguccaagcuuccuugcacaaagucaggcccauuguucccugccuggccagaccagaggagaaggcaccauggccuggaccugcugccagacuuaaaaauaggccaaauccuuuggccucacuaaacacgucugguccggggaaggccucccaccagggcugccuagaaacuguuuucccccuugccucccaacuggcagagcaccccaguugucaggcccuaaaaccccaaccucacucugucucaacaggaggcucugucucaacaggaggauacauacagggcacccaacacacaggcacugucccaggacuuucuaggcccuaggcacccuccuaugucuagcacaugucucaucugaagccccugugguguugucugggauguuuagcaagcucugaaugaacucuccuaagcacuaaauaagacaccuuuuucagggccacaucugcuccuagagggacucaguacaggggcagcauggggcuccagaaagccaauucagauuggccagggacauggcagccagaguagcuucuacccauagguagaagaaccugcuacaggguccagucccuaagacuauuuccccaguacccaggaggccauaaccagacaggcagguggcugagccgcucuggaacuggagccugguauagacuauuaugagaacauuaggauagagacuugcuuccuaaccacccuaucugggcucugcaggguagccagccucuccugccauaccugugcagagugggagcacagccuuccccuuguggagggcccaccggccaguucuaccccugucugucucugauucccagauuucccuugugaagaugccuaccaguugccacaauccaguuucuaugagcuggagggcauccuccuucucugaagguaccagauagaaggagggauagcuagugugggcccuucccuacuaacaaccaaaccugaaaacugcuaccccucauggcuuuccucaaaggagaccagguucugccccugcccauauugccuggacuccacugcuguccauuuuacccaugcuaaggcuguggacagaguauagggaggaaggaaacagagcgagccaugggguaaccaaaagcccugucugcucugaggcaauugggcagaaagggagaauauuucagaccuccuggucccccacucagccucaagcaugccucccaagccucuucuaggcuccacaggaggagaaggaagauccacaucagagcccugaugaagguaggagcuuuggaaggguaaagacaucuccaaauacuucuucaguucucaggacaccaggucccucuuccagggaggaaagaggaaaguuuucuccuucagcacaguguaguggaccagagcauaggaccacacagcacaacagccaucaucuuacuuaggagggaggguguucagccccuacaggcagccaaauaaggcagguguaacagucugggcugugugcugguggggguggggugggguggggugucugagucauucacugucggcccagucuccagcccuucccaacucaggacuccuggagccucagcuguugcuagcccaggcauccugccccacccugcccagggagguucacuagaaaugcccauguuaaaauaagcaagguccuacaaggccccugccccaccccguugcuuccuuucugccuagucuagucucagaucuguggggucaccagcagcaccacagccaacucauucuccucuuauaggcagccucccuacccagcucauacuaggccuaggccacucccagcucuaacgccucacccaccagauuuggaccaucagccucuucuuggaagcccucccugacuguucugcacugugacuggaacccgucuccuugguacucacccacguagaagguguugggugccgguuuguuucccaguuccagguacagcaggcugguggucuguggaucaugacgcaaccacagagcuacaccuaggaucacgccuccagccagcuagaaaaaaaaaaaaaaaagaaagaaagaaaugaaaaccaggaacagugucauauagaggccagaguacuggggccaauggaagccuacaaugcuuaucauguagagcccucacuuccaguuguggagccagaugccaagcaguugucugagccacugccacugagcccugggucccaccagcuccucuugguuguaacuccagaacagaauucaaguguaccuccaauagcgcaagacacauacaagaaguuuggucugaaaaauauggcucaguugauaagaguacuugggcauguagggagcccuggguucaauccccaguaccacguaggguuugguggcaauuguuugucaucccagcacuugagagguagaggcaggaggaucaggaauucaaggucaugugaguuugagacuagccugggcuauaugaaaccuugucuccaaaaucagcaggaaacauccccccccccuacuguuccagauugaccaacuaugcaacauuuuuaccguagaaauggccacagugaggcccagccacucaggaugcuggugggcucuccucagguacccugucccaacaguccugggauugauuagagacugcuucaggcaggauacugggaacucugugguggagacaccaaguccucaggggugaccaugugaugccaccaggccccgcagagagaagcagguaccugggagcagaagcugggccucagaacagaccaaggaaggcagucuccuccccagcgccaggucuccucuucuugaagggucaguggcacuccccagcagaaacagcaaauagaaaccaaaaccugggucuaaaaaaaaguaucugcucuucacucuggggauccaggccagaacacaagcucaagaaagcucugggagaaauuugcaagcaggcugguucaggaaagaagaccuauggacccaucugccuucuucuacccuaggaucauguccgcugcuuaacccucagagaggaagcuggggagggguacuuuccugaucaccaucucccucucccuccaccccuucuuucucaguuucucagacuccucuuuaagugcuuaauuucguuuuucacacuccaauccaggagggaugagcccccaaccuccaccagggccugagagaagagggugugugauacagcaaucaaagucacacccgggcacccguugcccaaaccacaaauggcaugaaggcugagacucugacagugccuucacauguaacggcccuagcgaugccagggauccccagaauuuccagcauguuacacugacagcucuuuauccaucugcccuuaagaaccucgcucgaaucagcuugggcaacagaagcaggagggugggaggugacgggucugaguugcccugguaaccaggcuuccuuugcagcuuuuaaacauccuauauuuuguuuaagaucuggucuggaggcugcucugagaugucccagggcaggagaaccagguggcacaccuguuccccauccuucccucauugauaacaugacccuggugacaaucccugauagucacagaggcuaaggggcagcuggugggucaccuugcuuuccucagucugugugcuuaccuguaaaacagcugagcaugcaaccaugccugacucuggcuucucuaaugguacgggaauacugucugugagcugaggggcaaaggggagugaggcaugcuguucagccgagccccaaaggcugcuaaugugggugucuggccaagccaccacuuagagccggguuuuaugaaagaggugggaugaggacguuaacucuagaaaagucucugggcuuuauucauuaacugacaguccugaauggggggugcacggggggggggggcuaaggaucugugacugucaaucagaagagaggccaaacugggguggggguaggcaaggcaucuggaaauggggacuuggccacucaccccauugucccaggggcaaucagagcugagugggaaggaaugccagguacugagauggcuuccuccagcaaagugaccgucuacccugcuacucuagggagagguagagggaguucuggaguucuaguuccagucagugaaugcacaggcccuggguccaucgaaugguagaaucuccagggaaaagacagacccgugagagagcacggaggacaguucaaucauggggagcaaaaggaggacacagaagcugaagcagcuagcgccuucugacccugcucagaugaaagcagaauucaaaggucguucaagauaguacagugauaacccaauggaaguucugggguuagaccacaaagagcccaggguacucuccugauggugcuaaguuucauggggguguaaaugccaagcacagcuacagaaagcuacuuaccccccuccacuccacggucccuggaucaguggcucugcucaaguauauuccccaggcccaagaaggguauaggggugucccaguauuagcagcaauuaggaauacaccuuguuuacagaaccauaggucagaaugaucugcaaaaucugggcaacacucauuuaaaaaauaaacgaaaaaaaagaaauagaaagaaagaaagaaagaaagaaagaaagaaagaaagaaagaaagaaagaaggagggagggagagugugugaguccaauguccaugggaauauggaguagugccauuagauggagguccaggaaaggguaaagauggccugaaucucuaucugugucauaucggagcuagggugucacaaauccaucucuaucuccuccacccuuauggucauuuguaaacaggggaaguaauacacaaaggcugcuaagugugaugucacuguauuuagcucuugacagagcugaggaagugauccacaaagcagaaccuggcauuucuucccgaauccacucaggggcucuaagauaccucugcccaaagcuuccuuucuccagguggcccugccaccugcuccugcagccuaaaagaccuucuguuuagaggugggggugggacgcacccagguggcauguccagguuccuggagcuccuucccuggcacaaaaggaugcauucaugacucuauacaggauuguguugcuuccuccuucuuaagggcuaauccauaacagacucaaacuuuaacaagucgaggagcugccaagcaugcugggucccugcccagcugcucuugugguuucccagaagcgacugaaaggguacaggcuugggacagcauucuacccugugcuagcugcccacugcccagccuuggccagacucagauaggggcuucucugaagcauuccuauugcuacccauaugaaguucucuaggaagggacagggcuccugaaaccagcuugguagguaugaauggucaccacaaagcaccccaaaaugcuccuggaggcuggcuguaacagcagcuuguuccuuugaguuaccauuugggccgcaagagaagaaccaaaggcagaggcagacaggguuggggcuuacucaaagccuccugaguacaugaugcaagcuagaaggugcaccacaaagugcucacccaccuaagcaauucggaggugcugaggggcccaagaaccucuccugugauggcagagguugugaagacccugggcagcugggauaagucagaguaaagaggcucagacugguuuuaggggcauugguuagguagaggcugacuuaggugcuguccuucuagcugggguccugggccuggucugggguauagaggauggggacaaggccagauuccucucugagagacaauggaucuugcucaggccuuccuaggagagguaaagacuuacagucuaccaaaggaagcucaggaaggaagcuggagagaggggcaggaauccucgccuugggcaggaagcaugguuccuuucacaaggccccucgucucaggaagccacugucauagcaucuaaaaauaggcagcaaagcaaaugccuagcucuggggcccaacugacaggcuaggggcaguggugugaauggcccaggcauggccaugggagaauauacugcugucuugagguucaagagauugggcugggccacccagcugggccccuuccagggccagacuacauggcuccuucucaggcaaggaaacuagaaggcaaggaccuuccccaucuaucccgcacuugcccuccucuaggaaggccaaugucucgugagaccccauagggagacuguguggacccagcccgccacagcagucugccagagauaagugcugcagggaguccugguacccagaaaaaggaacaaagggaggcaggggacugagaguggguagaagagcucuauguaguucuggcaucaccaccagcagcaccaaaggacuucuaucuguuccaggcugggcauagcccucugucccaaggucaggcuguggggcuggcagggucuuacaggccacuuugacuauggaacaugguggcagaguggaguguaguucuacccgauccuacuacuuccgaacgugguagcuaguugcuuggaaaccucaguccccuuaucacccgcaacgggucugauaacagcccaacggaguguuacuuucggugagcugaaugagcuguuaucacggacuccagaguacaggagaagacuguuuccagggucaaaggccaugucaugccccaaccaugaggauuuuuagccaugaaaaguaaugagaguccaggcaaugguggcacaggccuuuaaucucagcccuugggaggcagagggaggcggaucucugaguuugagcccagccugguuuacagagugaguucaaggauggcuagaaaagcucugccuugaaaacagacaaacaaacaaaaaaaguugugagaaggugaguuaacacuaguggguugguggcagugacaauaugugccugucacuccacaguaugugccugccacacuccacaguauguguuugucacacuccacaagcccuugcaacacaagguccuacucuagagcucagggaugggcuucaggaggacagguggccugggcuuccucauuacugcuccccgucacacgggacaucuuuaaacaccauuggaaccccucacuguuuagcugcaguacagagccaacauugaugcuugaccauggguaaaagcacagcuaaaugagucauaggaugccacagacccacccugagaaaguucugaagacccaagcugacaucauguauggagugauccgagagauagugcaaggaaacacaggacacucgggggcccuguuacucagcagcuucugcccaagcugccuggcaaccaggcucuuggcuucgguuaccaacucagugcuauggggcuauaaaacuaugggugcccugguucuaaugcacucccccccacacacacuccagacuucauaugaaggaaggcaggugcccucucccaacauccccuugcaguuacuuugguagccauuccaggaugcccaccaccagcuagcugcucacuggccaaccccuugugaacaguucccucaaagguugagcccacucagaagaccccaaauaguuuugaauggcauagccuaugcccugcagcuagccagggagaguagcuuagacuggaucuagaagugaucucucucucucucucucucucucucucucuguguguguguguguguguguguguguguguguguguguguguuuguguuugugagggagguacuaggggucacagucaagucacuggcaugccaggucagaguacugaacaguugaaggcuacugaaggccaguucucaggacaccugguucucuagcaacaguccuaggaacaaaauggcccuaccuauagggucucagagucacccaacacucacacucagagucacccaacacucacaccguguccuaccugguucccuggcaucagggccagagccacagguaccuugacuucuccauaacucugccccacccuacgcccucucuuguguacaaggaugauugcucucucccuagggcagcuggacucuaaggcuagagguuuaauaacugagguuccaauccccuuggcaggacucuggguucuggaaucaagguuggcaguuguugguucccuccuagagcaucacagaagcuccguuugagguaggacugagcuagaaggcaagugccgagagaaugccuaaaggguucggaaagaaugggggugggggcucuuauuaugaggucgcagugugugggcaccagaguagaggcugccaggucuacuccagcucugugcccccacuguucggauguccuuuuuuugaagccagcccagggaugaaccacagacuuccccuuugcaggccaaugauugucuuucccaaagccgggcggagcagacagccccaggagcaaggggcaagucacaggaagugcucauuccacccugagcccacagaauuagagccccucugccggaaggcagccagcagaccacuaugugacagacagucacguauguguguugcugaagcgagcacaacagacagucauguucagucuggagaauuaaaugccaguugagaggcuguaaucagccuuuuguggugggucuggcugccugggcuacuggacgggggccaccagcagccuuaggcuggaggaacagccuguucugucggggaacacagugaagauucuucuccuuaacugacuacuccuauggagacauugucacacaaagcuccuacagacccacccgaggccauaggcuggcacagugauaaaccauccccugcucuccugcccuauugccagccggugacuauugccagaggagacuggacccuuaaucccagaccugucucaggggaugaguaaccacccugcuucuaagagcaucuuacauggucucugcugcucaccgcucaucuuucagguuuguguccugccccauauaucuugggaguccagaacucugcuggccccaauauagguucugaacucaagcccaaggaggacuggugggagugacagcaggcagguuagugugcccggaauguccccucccacagagaaaccacuuuaaucuucaaacuggaaauuuuaaaaaguguccaucgaaacauuuacugucaaccaaaucucccuucuuagagcucuuagcccccgcccccaccacggcccaaaggaccucucagcccccuccuuaggcccuucugacaucauugcucagcuuccuuuggccccacucccuuuuggagacuguguccaguguccauuuccugagccuucucugcuccaagccccuugccccacucuggaguacauuagcuagucuacacacaauccuaggagacagagacccccaagaacucccacuuuagagggaggaagugaagacuaagggccagaguggugggguggggcuccccaaagguucaauuucaugauaucagggaacuaucagccacaguacaaaccuugccacacgagggacaaaaggagucccucugccagggugguguccaccaguuguagccugguucugcuccacaucccuauccacuguggggccaacaugaguagggaggagaggucugugggauugugaaaggcuacaguuuucacuguucugcagucaguaggcaggucccugggagcagggagaggcuucagaaccguuuccuggagccucaauagagaccccagggacauguugggacuccaccccagcugccugggaaacgagcagcuucacccagccucagcacuccagggagucugagggucuagcgcuuggaucaggugggugagcaaaaaaagaaaaaaaagaaagaaagaaauacccuacaggauccugacaucccacaucugaagaauaauggggguggggugggguggauaacacacuucuugagggugcauucaauuccuugcaugguucagaguaggcaagcacuguccaacaugacuacccagucgagaccccaaggcaugcccgggcagagcaaguuuaaccccaucgcccaugcugcucccuagaauguguucucuggagucaccgugacugacaaucuuggucccugcagcaccgcgugagcauacauagccccagcugaguucagcccaguuccugcccauccccaacgucuuauuccccuccaccccacccugacccgcccugggaucuucagcaguccucgauggaaaacagguguccccuguccaacacacucacuccaggggccguuguacaaguuugcccucucaggaacaacuuuagagaaacauugucuuggcauaaccucauuucuuccugggaaggaggguggugggaacagcagucugugcacugcagcagggaggguggcaccacuguccagaggaguggccagcacugcucacucaagugcccgcaggcaggucuguuaagacuccccauucccaacccaguuaggaaauggaaagaagcccauaccaccaauggcuacuccccagcagugaagacagucaggacccagggacacuuggagacccucuuauacccaugucuccuuuccaagaugaccaaaugggugugcacuucuuuccaaaguggagagcccagcuuagauccuguauauaggaaaagauccuaagcuccugguuuguacagaucccagaucuuugcaacacccuggccuucaccaacucagaacugcauacccucuuccucucaggaucuaagggucaggccggggcuguaaucugugcaggagacgacaggcaaggaggaggggcagcugggggaauggggguggggguggccaagaacuggggcaccgugcgcagcagcacgcggcccgggcugcccugccuucuaggccuggagcucgagcccccaggguggcaauaccaagcuggaggguaagcaaggguggaguaauagugggguugaggucuccgaggcaaguacggagcgugcccccaccacuucgaggccgccuauccaggggcgguggcuaggaugagcucaugggggcggggcgccaagaucccgcccuucucgaccccccucacugcucgcgaugcaggaugguccccaaaacaacauucaggagggugcgaguacccccuucauagcugagggcucuugauuaccuggcucuagcccgcagacucuugcaccaguucccagcacucagaggggacaggccagcgauccccugauuucccggccccagaagccccucgagccgaggcccagaagcucagcccucggccucaacccgcuggcgaggggcgccaggaccccgaucggcgcacggagcccacagguggcgccgcaacuucgcgguugcgcugcgccuucucagcagggccuagcgcgcugcccagccuggcuaccguggggugcgcccuguccccaguggcugcucacccagaagacgaaauugaagacgaagagcagguauuugaugcauuuggugcagcccuccacccccauggcggugcgcggccugcggagcuuggauugguccuggagcgggcgguauggggacgcaguaccgggguccgggacuggcagauagccuggagcgcuugcgggccggagaacugcguugcggagaaugagacguaggguagagaagggcuggaggccuagccggaggcgcgagagucacuaucucuuugaagcaaggacgcgcucgcucggaccgggcgcgcgcgccuagcuccucacucuuuauagaccucuaggucccgccccuccgaggccccgcccagaggac

SEQ ID NO: 4222 - RNA, 1841 nt, Mus musculus
cuuuuucgucauuucuggguggguuuccgugugcgcuccggguuggcacgcuuguuaagguuacaagucccggcugacauuaggcgggaacccauugccuucugggaguuguaguuucucgggcgcugaagccacgaaaaucugaucgcccgagacucgguuucccaggaacccgagcgagacuggacaggaccgaaucccggggaacuggcgggacgcugcgagaaaggcggcaggguauugaggcguguacggacgcuggaacggugagcacuggccucccuaaggccgcggccagggcauucccgugccuguuucugccagcccuucguccggacccggguggcgcuuguaccuagagaggcugcgcuuuacugagagcccgugaugggacaagcagcugauggagaucuccugucaccagcaucucccagugcucaucuauuguauguccacacuguuaugaucucaugguugacucucuccuuaaccccaccuaaccugcagcuccuguaucugugcgcgcuaggauacccuuuaaccacccagcuucgcgaggccucccguccggcugugaguagaggcacuugacacauaguggaggugaaagacgggagccugggaggacggggagggaugaggccuuaaauacaccccucacggcggaacugggacugcuucgcuacaggugggacgggugucaggucguauggcggagacagaggcuggccuggaggcugaugaacccaccgaggaugacacccugccuucugacaccgucucccucagcgacucggacucggaccuuagcuuaccuagugguguggagguccaaguguuguccccagagaggcuuucggaggagggccaggaggacuccggcccugaggacccuccaucgccccccacgggcacccucaccacugcagugcagccauuccaccuccgaggcaugaguucuaccuucucccagcgcagccacagcaucuuugauugucuggagagugcagcccggcaggcaccgugcucugcuccccaaaccagugugagugacaauggcagcuucaggcggcccgugacucccccaagucagacuccagcaaggggccugagcagagugcaugggaacacuggcccgacuaggguacucccagucccugacuaugugucacacccugagcguuggaccaaauacagucuggaggaugugucugaagccagugagcagagcaaucgugaugcugcccuggccuuccugagcucucgaagccaggugucccacacagacuaugugccuucuuucaaccaggaccccucuagcuguggggagggaagaguggucuucaccaaaccagugagggacagugaggcuagggcugagaggaagaggguccuaaagaaggggguugggucaggugcggggggugaggccgcuguggagcuagcccaucucgcuggaccugaggcugaggaauggaguggccaccagggacagccagagguggugguaccuucagaagcugcccauccugaguccucaucaggccccauaggugugaaggcuguugguuuccauggcagcaagaagcggagcagagaccacuuccggaacagggacgguaacccuggggggccggggucugagagaggacccucaguuugacugcagugcuaucacucuaccccucaccugcuaguccaagugggaaggugugggcugucugugguagggggaugugugcagccgcucuggcagagacugugggaauugugggucaggggaccucgaaggccuuugugccccaguguuuaggaugaauaauaaacguuuggaauauuuc

SEQ ID NO: 4223 - RNA, 319808 nt, Mus musculus
ugccaagaucaaccugggacgucccaacuuuauuuggaaaagucucucaaucaagaucauacuacgaaauucauuaaaacacaagagucugaaucaccagaaauuaucuugauuucugugaggcguggugcccaagcccaaggaaccaauccuggaagaaucggugaugccccuaacuucaauguggcgugaaagaggcuggagucugagcauugguccagcaccucugaccagcaagaaggaggcaggcugcacauguggggcucauagggcuugagggcccugcuuuucacuuuaggggagaaguugucaguccauaccuggcuaggguggacaguggacaaucccuugcuugggauauccuuuggggggggugugaaaaucccgcuaguaucuuguuguggucaacaucacuagagaaugaaggagucaggcucuagccugcugagcucccacugggcuacagccugcaguuagugugggccgggccugucuugcccugcacguucccugauggucucuggauucagggcugaggguggaaaccccagacucuuccuguuucccuuuaggaagccacuuggcauaccuggaugggcuucccucugccugagcugcauccugcuuuacacauauacuccccaucccuauguuccagccaucagaagagcagcaucaacaucuugauaggggccugagaggaaccccaugcccagacaaguucuaguucccacuggcugggcagagggguguuggugauauccagauccaggccaguggcuuggcccauggguuucggggccuuagggagcuaggcugucauaucaggccuucaagggggugagaaccaggugggugugccccuguugagagggagguggggcagaccugugggggguuuacccuggaccucccuucugagcuccuucaggaacccucaucagggccugucuggggcacagucaguuguucguaggugggcaggcuguugcuggguaggaagagcucaggguugauggagccaccuucauugcuggcuacaacuugugaccugcuguugcagguuggaccaccuuguugcauggacagcagcugguggagcaugucugugaugaucaccagucucugguccaguugugucaccuguaaggacagaaacagagaugaaccuggugcuagagacagccuagugcaggccauauuagggccugggcauucaaagccugaaagagaguaugucacaugucuuuauagcuguggguugaauuuauguguguaccaugccuagaggcccuuggucacccucaugugcaucuguuauugggguacaggggguacaguauaguauugaguucuuguguguguccauacaugcauaaaccugggcgugcuuaacaguuaucucuuguuucuagguagaccuaguggcugagagucaccucuuagccccuucccgggccuuuuggucuuugagacucuggacaaaccuuauggagcuccuagaacagucucuggguuccuguggccaagaggugguagggcugguggcaugaugagugggaccccagagucccaagcuaucugcucagcuuggauggguuuggaaccuuacacagugcgggggggaggggagcuuugugggagggguuggcacccggagagagggauugggacagcucaggguugagcaggcagaggcugggugguuucaugaaauaauguccacccuuaaagguaacucaaagguacuacuuuaggacaacaccaccuuucuagguccccaugggucaggacagugacugaguagauuucuugacugugugguccuuaccccaugccuggaaagggcuuguuuugcucuaagcacuagguggguagcuaaggaacuggaggggagacaaaggcagggcagaaccugaguaggcccuugacagaggccacacuugcugugcuuguaggagacacaaugaagagccauuggagaacuccuuagaaagaaggagccauugugcaaggggcuggagcccagcccugggggccugaaaugcucagcuacuuccuuuucucuccuagaagaaaauacccacuguccagagaggccagagccccuagcauaauaaccuaggaagcagggcugucccaagggcagcugggagacucauggagggggcaggguuggggggauauacaggaaccuaccuagcagaagcaauagagcagggguugggagagagaggaccucagcugcugagcaccuggggugguuccuccagcaugcucugucaguacaucaggggucuuccucaugucuauauuuggaacuaguguaaagggaaugccugugaugcagggauggagccagagguucugacagauggcgucauauugucaaaccugcaaagcugcuuuagggaaaaccaugggaugacucagccaauugcugaccgcuggccucaaaaccugggugacuagagcccugaggacaagaggcaggcagggaauggaucccaucuuccuggacaagugugugucaugagugaagucugugucccaggcaggcuuuugaugcuuucuguacuggcuucucuguccuaauacuuguuuguagucugaaagggcuggauaggauuauccaggcuggagggcucacguggggaaacugaagccagggcuuaagaguacaggggguggaagcuaaagcuagguugauccuggcaggugaagccagaguccaugaccgguccaaggccuuggugaguucuguaccaaaggaggguugucugaggcuagucuuggucuagcuucaugcaacuuuaaacacacagcuaaucugaguaggcaggagaaaagcaucaguuggcucauggagauggauggcuucaugaauguuuccuaacccacaauugagcaccuguggacacaucucauuugcuaguggauagaguccuuaaggagaguucuugggaguggggguggggcuguuugaaaccuccuaugggacagcugccacagggucuaucaagccugugugugcuaaucaagggugucccugaagcuucccuggacauuucccaagcucacaaugaccccauggaucccacuugaaucaacugggguuuggaggagucuguguggguucaaagauaucguauuggccaaguugcuaggggcaggauaugggcuagagucuuaagagugucuagagucuaggaccucacugugccacugucaccuugacaggccuuugaagacagcaaacagugcaagggcuccuuugaaugugcccacuccuucaacucuccagucgccucagaguuugccuggauuucauggucauguguaggacccuucugggucuucuuggccauccauaggaucuuccuagcuugucuagcuacucauaaauagaaucucuugcuugcccuggcugucaugggugaggaacaguaaguuguggcugaguucuuaagcuuuucuggccuuguucagaccagauugccuaagccaacuuggauugaggugggaauaccagggcuuggguucaaggucuggaacauauuuaaccuggggaauccuugcuggugagcuuaggaccuucuguaggauugugagaggauagccuuugggggacauucauaggccacuuucaggggcuaucuuaaaaauguuugauacccaacaaagagccauuagaugccaaccuggcaacagaagggccugugggggaguuggccagcgggaugucuguacuucauuuaugcucuagccuggaucuugguagcuggccacggugcuugcuggcuaaucugucuagcaaagcuugggggucagggguugcccugugaggugggacugcacguggccaugcaugcuccuuguugccucugcuucccuagcugugaaguggaacaugcugcuguccacuggauguguugcacaaggagccuggggagauugccugccaugcuucuugccuugagggcagggcacaggguggucuuagcuuguucuucugggcucugcauccuuucuagccacuuaggcucccagaguagcauauagagaggcccuucaugcccaagcuugucuugggucuugcugggccacugcaggaaggguacuggccugguguaugguggcuccucugccuagaacucagcuccaaagacaacuuuuagugaguguucuugaagccaccuggcucuacuuucuccuuuuggcguuuggaauucagcuagagagcuugugagcauuggugcccagugccgaguaggugaaggcagggagccacgucacacaggugcccugagaggugccaccaccuucagggaagagaagaucugcucugggcucugggcuggugcucuucaagagccaccgggacagaucaguuuugaagaucucagaucucaucacuauuugcaauuugauagugauuaacagggcaaggcagacaaaagccuuguugugccccaucucugcucacuaaaggagaaaccauagaugacuucugugggccucagaagagaaaaaagcaauuagaauaacagcuaguuagagagccugcggcggcuggugaucagacucaaagcgacagggauuccuguuugaugugguuaugaacuuguuuucaaaggaaaaucuugaaaagucuuuuuuuuucagaaccugcccagccuugauccuuggucaguacccccccccccaaaccagcuuaaccuggggugggggauaccaggguguaaggcucugggauguauucaggcugggcauccuuguuggucaguucagggucaugagaggauggccuuuggugacuugagcgacauugguggguuaauuucagggccauauuaaaaauguuugauacccaaugaagagucauuggaugccaaccuggcccuagaagggccuguggggaguuggccagugggauguagagaaggcaggguacucagcaacccagagcccaguugggcugcucccuggcugggucaguugacccugcucccacuggccucuauuugugcaucuuaugaucaggcaacuaccgucuggauagaacacugccuggcagaacuugaugauuuucaguccuccucuaggcugccugcccaucccuuagucucugcucucucucuccucaucauucugacaccaccaccagaaagacuccucuuuaaccgucuaggcuaaguaugacccuacuuuuugcagaaggaaagaagucugccuaagguccuaugggagaaggaagagcuggggcaaaaguugggagucagguugcaagagagcaaugggcaguagaccuuuauuaaggccuuuauuauguauuggguaccagugcuccaguggguuuauacaugaugguccuuuccaaacacaaacaagcucacgcacaucucaggagguaguauuacaaguccucaucuuaaacacccacagagagggacugagagagcagguauguaguggagcuucuacaggucaucuccuugcaaacccuuugcuggccuucugcaauguaacuuuccuccugucucccagaaucccuucagcaggaggccagcaccccugacacagcugagcugcaccucaccaguucaucucgcccagcuaucuauccccaguucugggucucuuacaggagugucuacugguuggcucacuucaguggguuuaugcaugauaguccuuuguaaacacaaaacaucacggucuugcuggcccaaggagugccuuguaacuuacuuccauuuuccacgaaaccuuuucucuuucuuauucucuuguuuccaaaccuacugcuguuccucaaauguggcagcaugugccugucucagggcucuccacucuuggcuuuuucuuuccucugcugugucccugucagcucauagucauggguuccucaggguuccagcugucuuuuguuagucaccuguuucucucauuggaacugggcccugucaguugcgggucucugcacacacuugcuauaguacucuuuuaaguucaugaaaggacgcagccagugcuagacaugugagcaccaucauuccagagucuaagugugaggggaaggagugcugcccacagggcccauccucacccaacaugcaucugcauggugagaccaugaagaacucccaugaauuguacacggucaguuggagcuugugaaggcuggucuuguggacugcaugugagcucacauuaggugcggugaccaagagaggcugugcuuacaguuaccguauuuaugacuuugcuuuagcgcuccagcuuuuguagaaaagccugcaugcuggaucucuggcugacaggauggccuucagucuuuggcucccaguauccacaggguacauggcugagcauaccugagaauccaggcaggggccaaacuggaagcuuccaggccauguagaacauugacuuuuuguaccaaucccagggccuccaguuaauaaagcaaugucuucaaccucaguuauucauuuuacaaaggucaaaaaggccaggcguggugguacacaccagaaucccagcagaggugaucgaaucucugugaguucaaggccagccagggugaugauauaaagagacacugucucuaaggaaaaaaaaaagucaagaaauaacaacuugacuucuggucuuguuuaugcagauaaacaccugccacagccagcuuaccagauacauuauuuauuccaacaaaugaauauuccugauuaucagcaacacuagagugaauucaucagccacaccagaugggacaugacacuaaaaagagcacccuaagacugagaugugguaggaaccccuacuauucacccagccaguuacuccucaagagccuccucacacaagagaauuagucccugggcuuugucuaggauacuuagcuuacuuuauauguacuuuggaggugcuuugucauguagaccugcacccaaauagccuacacacacacacacacacacacacacacacacacccacacaaguacucauauaaauccagccucuuccaaccucugcggacagggcguggcuaggccugccuucucaccucugacccaggugccuguguuccucuccucuccucugcuuugcucuaggcagcauuggcugaccuuugugcuuaguucugugccuuuucucagauuucccacuacacgagugaaugcccucucucuuugcagcccuccuccaacccuucccucacacagauccugaacacauccuccauuuaccugaggaccuuugcacucacuggccccuuugccuggaaaccccacucuacacuucuuuguggacuuucaacucaaaugccuauugcuuuagcaaaugcuucugccuaucccgcuuccccuagcauacucugugaccacugccucuccacagacuuccugaguuuauuaauuuacuaguuuacuguuucuucuucaaacuugaggcuccugagaucagguccugagugugccauuccuguugagucccuauuauuagggacuuuuauuauuaggaucuuuuaauguaugacacacaguaggugcuuaguaaacucaugugauccaguacaaauauuuguggagggaguuaauuaaucucuggccuuucucuuggaugaggggguggaagcccccaagagcccugcucccuagaaagaccugggcaaaggccaaugagguuagccagcaaguccuuucauguucauugauuuguaaaggcucuuuguaugugaaggcuuaucuuuugacauguagaucacaaguguuuucucuugcaugcauuugguuugugucugcaaugauggugaccauugcuuuuccaaauagaaguaccauuuuuuuuuuuucuccaugguuuccaagucagggugugcuuggaucacucuucuucaguccaaugugaauuuuuugggugcuuuuuagguuugcauuuuaccccuaaaucuuuuaugugugugugguugcuucaggguucccuguagcagcugauccuucacauagugggggggggguguuuucuacauacaaagcucucagcacauaugagaguucuagaguucacuauaaacagcucccuucuauccuggcuuucacuauguaaaccaagccagccugacacuuaugaucccccugccucagucucccaagccugugaccacacacuuggcuuccagcuuuaauccuuggggcuuugguaugggaggccaggaguguccuuuacagggcugcagguggugguucugugguggaaucuugcagggugaugagagcaauacuucccucccagucaacccuguugacuuugcuccugacucccuaacuugagcugggagccuuugucaccucucccauaugauccuauugggcugccucccuucugcuucuucugcuaccacugaagucacccuugguguucaugugacucacccuucacccugucuucagacugugcuggcucacacagaugcacaguuaauaucccagggcuagcaucauguggccucaagguacagaacacagggccaucuccucccuccuagcuaccccuguugcuuggaacugcccaccccauaguuucccugcucugugugaacugauaucagcuuuggggacaaaggucccagagcagagcaguggcaggugugggguccuauagccccuagcuucugacaauacuggaggccucugccugccagugaagguuggggggaggggaccuaggcucagaauggggacuccacccuuuccaaaagaccagccaguucucaucagccucaaaggguccuguuugcagaggcagcucccugucagggugacuaggaagcugcugcucugucugcucauuucuccccccaugggcagauucuauagcagcugcucaggcuggacguucuucuagacaggcugaaaaaggacucuggaggcugagaggcccuguuugugcuggcgucaggcacaggccccaccggcauuggauucucuccugauggagucccggaagcuugagaacuccagacagaacauguuguaccagaggccagagccuuuggccaaacuaggugggcaauggugguagguagagaggggucacaugggguucaagcaguugaucagggcugcucaccugggccugcacuauaccccgugucccaagcaaacacaagccggucuguggcugcuguuaaaggggcuucagcuccuuuuuccuguuccagccucccuagaccugcagcuuguucugucugccccuuuguucacauccaccucugccagccgcucugggagcuaucugcugaugugaacacuggugagcuguucucagcccagcccuucacacguauacacauauccgaccagcuaaccuguucacaugacacacauuuucuccgaccccucaggagccaggugggggaaagaaauguucaacuucuuggcuuuugcuuucucucuccuuuggcgcccuugcuucuuggugaaaaaccuuacugggacucuucuuuuuuuuaaauuuaauuuaauuuuauuauuuuauuauuuuuuuuugaaacaggguuucucuguguagccauggcuguccuagaacucacucuauagaccaggcuggccucgaacucagaaaucugccugccucugccugccaagugcugggauuaaaggcaugcgccaccacugcccguuacugggacucuugacuauggccggcguccauucccacggccacacggacuggggccugcuuugccugggugcugcugggagcguacucucuguggauagucugacuuaguucauccuagaucuucccacaaagugcuucuuuguugaacauuuccaagugccaucuugucauagacagagccccaguuuuuugcuuccauccgagguuuucccugguaccuggugcaucucaagggccucucaggguacagggggucuagcccucuucuggucugaacacugucacuccauacccuuuuacuguaagagugcuucccuggcccaccaauaucggcuacaccuacauccuuguauuuccuuuauaccucccuuagcccaggacuacccuugaaauggaccuuugcaacagcugugcaugccccacugauacuugaguaucuguguauacaaggcuugacaguuaauggcuucuuuccuugcccuauccuagaaacaaccaggagcacugggagcuuggucccccaugucccuuaguguccccuggaugcuggauuucauggcugucagcuuucauuauggucucuacaagguuguguggaucuacaugcucucuauaguaaccuauucuguaaaauaaagacauucaaugcugccucccuuccucuccuuggggccuccuguaccaggugcuuggcuagcgacaggguguuuacccugccuagcuccggcaugagacacuguaucccuccguggcaguuuugacaucagcaguaauacgauccagguguggcgguccacuugcuuguuuuugcucaacucaggcuuugagggcgcugguuagaacaugccaagggcgcuugcuucucgggguggcuguacgugccgugggccucccugaaaggacccgcugggaucccaugcuggacaagaggacccaggggacaaccguagcccaugaacgcccuggaccuacagcaugccugaaguagacccuucuacugaaggaugacaugcuaguaucaagagcuguacccccagugaccccuucacuugccucuggcucccacugcccuuagcccuccauagcuccuaagcaucugccccugcuccagguuuucuaccuaugaccuggucucccugggauacgccuucugggcaaggcuuccugauucccaguuacuggcuccuuacagacuauucucuuuccagauuacuuccuggcuuccuuucccuuaucucccacuuugaaucuggggccuuuagaggaugccuucuguaucucauggcccacccaaucuacccagacuuuggccuucucuucaacauaagugaucuucaagacuuccaaccuggguguuccuuugcccuccugccugauacaaaucacugugccuuauucucuauugccacucuauagagauggcuguagcuauuuuaucuuaggugcucucacccuucccugacuguuggccuucaugcuccuuauaacucuuaaccuagagugacuucugacugaccccagucagcuggcuccuggucuucugggacccuccaggcccucuacaccugcugaacuuuaaggaguucccuucaccccucccucaaggacucagcgccacuuucaguaagcucucaacacaggaugagauacaagacccacaggacgagauacaagaaucauaggcuagaaugaucuagaacuuugcugguagggggacuaacugaagagccuggccuauccguguguacuguguaugcacacaccuguggcugugggcauggcacugggcacaggcucuauggagcugaguguggcuaugugcuagaagccaggaaacugggaguugcuucuggaaggcagauaaccuguuggcagcagaguuuugagcagcuaggcagcaaguuuugagguaaaggugagcaauauccagcugaugucccaagcccuuuaagcugugccugcccuccuggggccugaacauccugccucacggcuguucagacucugucccagucuggagauugaaggggccccaugacucagccagucagucauccaagcugcagcuguggcugacccaggugggcaggcagcccccagcccagccugcagaaacgggauggggcccgcucccuccccuacuuccugcuucuacucugagacaggauuuucugaagucaggaccccugaggccagagugaggcuggaagcuaggcccagggcugcagaugggggcuggguagcuaggccuagaaacuagaaucuugugucucuccuggcacgggaaauucguggggucacagaguuagaauguuucuaacuacucaauauauugacuccugccuggcagcuagguuaggccuaguauucugcuuggaguagaggccuggcuggagcauagggguacuuacuuacuuagggacaggacaaggcuucccauacugcuuccucugguccucugugccucagaacucaguucucguccuuacuccuuucaacacaggguguccuaccuccacauacacagucuugggacagaaauuucaguaucucauagguaggcucagccuuuccucuguugacugggagaaccugauggagaagcaagguugggcuccaauggagcuggcagugaacaagguuuagagggugacauaugaauaaaggaagcugagauuccauguccuuuuucuggcccuccagugacugggaacaaaagggcugccagcucuccuggcuuucaucuuuccacauucagcaaugauguuucacuuuauacuagccacagcaccucaccacuggccacccuuccccuauuacucugucuucugugcucagcucuggugucugggcugccuccucauugugacacuggguauuccuucuccaugaccugucauauggacacaaggcucugaggucacccaucaggugcccugugcugguccucacauggcugaucagaguguguagggcuaagcucuggcugccucuggucucugauggccuguucaggaaguggguaagaagaguuggaccagcaggaaguuguuggggcuucaagcuaggccccagugcuccagcccauuuagacauauuuggcagguucucuucccuauguucccaggcucaucagaauggacacuaucuagccuauuaccugcuaccugcccacuuugugaugcucccaaugccucgggccacccugcuaugguuacaguggcauuacugauccccagcucagguucaggcccuugggauuguccaucuccaacuuccgugacaggcacugcagggcagacugaggugccaaagguauuggauguaaggggagugaaccugcucuuugacucugggcuacucacuggccuucuguaaccucaguggggacccuaguggguguaguuauggacccuagcccccuggcugguagaucaagucccuccaugaccagauugccguggaucugggugacccauguugcacuggucaucucugcuuaagucuuaacucaaccccugaguagcaggcaucacuggauuugauccuggcccugcuggcuuuucugagauuuagcuccuguaucagccuugacuauaguggcaaggcccaggcauugcccacccagcuaauccuccuagcuucucagggcccugaaggaggugccuccaacagauguccuaucucuggagguggugguaggcauugcugucauuuucuuucccuuucuggugacaguccuucccuaagcauccuguacuaagcagcgauaagagggauuugcacuggggguggaauggaggggggguugggggacucauguacaguguaggugacagguaccaccuuuccuugcaccaauaggaacucuuauuuucacuguaguccaggguccacaucacagucaugucccagcccccaacucuggcaauggccuucugccaccuuggagauugcucugaccuguaaccccccaagcucauccugcagccaaagacagacauuuaucuugcugcuaggagccuuuacucugauguugggcacugugggauguugagcagcucgggcuagugauccugaagaaggaccuuccugaaagcugcuguuacuguggcuuuacacauacuauccuguaguggcucuccuguguucuuggcagaagcuggugggcaggguugagcuguagagggggacaucacagauacucugugcagaaaaguaucugguagacuuugagauuuaccuuguaaauaaggccagagcccugacugccucauuccuacagagaacuggacaucucguauaccccacuaaauucuuguucugcucaugccaugccuagaauugcauguggggugcucucuggggcccaaggaugagggcaaacagguuguggggcccucaggaaggucuauaauucucagaagguaagccaaaagguagagaaacuuccaccuaggaaaaagguucugguuggcccugggcccgccugaccuggccugaccccuucagcugaugagggacucaggccuauccugcaguucccagcccgcccuuccugugcuuggggcugggaggaagaacucacccgggacaccagggaucggguaaggggcacauguugacaagcugggugugguucacaggccccaggaagccccagucacccuggucuucaaguucuuauuaugagcccgguuuuuggagccuuggaaaccauccaaaguaaccuucaggacugcuuccggaggaaccugggucccucuaucaccucugguuaaaggaugggacaccugucagcugacugucuucucuuaguacugaccuaucccgcaugaccacagaccuauuuauuccucccaaccagggucuaauugacccagacacugcaugcaggacagagcuucagacugguuugcccuucaucuccugccaucccagacccuaacaugcccucaucuuuuccuucugagucacagcucccuguuggacccucucuucuuucucaccaggccaccagcagaagugucuauuuucuggcacuaauauucccuucccugcaguuuagaaguuucuugucaauguuauauaagcaugccagaagcucuuccaucucugaauagcccuugcugggguuacaucuccaguccucaacaguucccagaggaaagucuucaacuaucuuagcuguuuuuccugccauauuucuugacacucuguuucuuguucuuguaguuuuaggcauugucuagugauggucauggaagacgagccaucaaaauuuugucccacagcuuccuccucagcaguccuucuguguaguuauaccacaguccuaggcuaaauguuuagcauuugcauuccaacgaaacauguagcuuuaaaagacugcuguguaaauacuauguucacaggguccuucugugauaacaguuuucuguuuucucuguaguuaaggcucuuuccuuccaucacauagguucuagagaucaaauuuagauugucaagcuugguagcaagugccuuuaccugcuaagacaccuugcuuauccuuuacuuuaaaaauauuuuaaaagaguuuauuuuuauuuauguauguguguguauaugccauguguguucucauggaggccuauggaggucagaagaagguguucgaucuccuggaccuggguuacaggugguugugaacugccugaugugggagcugagaauugaacucagguccucuacaagggcagugaguguacuuaauuucugagccauagcuucagccccagagaauucauauuuuaaaaucuuuguucagcuauuguuuuuuucauugcugggggucaaacccagguuuuguacauauuaggcaagcccuuuaccacugugacacaccccuaguccuuuucuacaucugccaccaauccauucuuuaacuuucugcaagaauuaugacauuuuucuauugauccuguugggaauacugauaaugaaucagcaccccucccuuucuuucuccuuccccuccucuuucuguuggaguccuugcagggcuuguuucuuuccaguuuuuaggugugauuguucucccuggcccucagcuucugcguucuugucuguuuuaccucucacuuugcaggagcacauucccaggucauuuucugagaaaagguauauggcagauauauauauauauauauauauauauauauauauacauacacauacauacauauauauauauuuuguguguguguguguguugugcaucuuggcaaauaucuuuauucuucaguuauacuugggauuuuagauuggaaaucaccccgcccucccacccccaaaguuugaaguuaguguacuagcaugcgcuugcucauuuccugauguuuugauucuccauuuucuguguaugaccuauauucuucucucaggagacuuaggaugucuguuuuauuucuguucugaaacaauaauggaacccagugggacauucuagaaguuggcuuuuucagcuucaaaguguucagcuccacccacagcuguuccuaguaucgucacguucagagccgaaaggaucagcuucuuuacaguguagugugguugggugggggucagcaaguaccucgggucaugggcuggggggagagugacggagugcuuuccacucaggcugagcuucuguagguguuuucuuuucauggcucugcccuuaggaugguauaaaguucuucuaggaucccagcuaguagcuacuucaucuuuaaugguagcucugccuggggaaggccgaucucuaguucucauuucuaugguugucucugcuaauagaucuauaucuacuuuuccaaacuuuuggggucucuuaugcucuucucaugucuuuacuugcuaacuuauacaaguaauuuccuccuuugguaauucuacugccauuuuucuuguggguuuugaggaaguagagaugaauuuuagcugaaucacaaggucuucugugaucucagcuuugugucuucccuggaguuaagacucgccuuuggguuuuucccuuuucauccucagacucuaaagaggcaaauuuccugggucuuuuaucuccagguuggcuaccaccaccuccuccuaggucuucugaguccugcccucauaccuuugcugauggcuucaccacgccaaacuuuaaugccucuauacaacagugaugccagucugcacccucaaggcucccugggucacaaaguugccggugucugaccucaccacuuaggaaucugagaggcucuuaacuuugaccuauccuaagcugagcucugcagauugccugucagucuugucuuuaucccagggaaucaggccugcugagccugucucuuaagacucagacugagcccccaagggucuaugaacuccuugcucucuuuccaacacccaguuccuaucagaauucuuucccucugaaacacauggguuugcucucagacaaagacaaagcacuuccuccuuuagcaaaagaaccuugaauuagccacuuaauucacuaggggguccguguagugguacacugcccucuggucauuggacagaagaaaagcuaacaggggccucucagguaaccaggcuguguggggagggagguuguucuucagguauuuuccuucuuccugcuacugaaaugcagaggugauggcaacccugggagaagccauaggggugccacuuuguagacagagaagcauccagagagcagaggcgauuccuggucugacugcugcucuaggccccuggaagcucuuaacugagacaccacagucaucaucucagccaaagcucaaccaaucugcacugcccuccucacagcauggccgaugcucugcuugcuccuugagaccuagcacauucuacuccuagcuugacauauccacauauaaguuaccucugagcuguguuuuaagccacaugacuagcucugagugaccacaaagcccagaauccuuaggaugcagcucccaugccacccacugcuuggugguacccacccugccucuuucucccuggccuuaaggcuugccacaagaacacugugcccuaccucagugggucuggcuguaaccauguggugccagugggcugagaauaccaguaggaagggguuguggguuccucuagagcaggcagagauccagcuaagcuggggggaggcugaggaccuagugaugccugcugccccaggccugguccuuuuugagccuuauugggccccaaacaagcacgguauuuccuaugacagcuguaggcuugcaggugagccuuguggaagcaggggcaggagcgggagaaagggcugagaugcuggcugggugaacugacagcccgcccaaguuuccacaacugucugcacagagcugcacggugguuuccacaggcucugccaaguggcggcugccggcucggccugggguucugacccccgacagggccugcucucugccaggcagcccugagaagcuagggcagacagggcccaaagaguuaagccacccuccaccccaucucauuccuacaguuuucuguccaaggcacagcugacgugaaaaacaauagcauucccuuggagagguucggcugcgggcugaggccccccuccccaauaauuacucaagacauuggcacgagccaggccugguuagguaacaggcugcucgcucgcuccggagacuuauaacucacagucaguuacacauaaucucuguagacaacaaaaucguuuccaggaugguggggagggugaggccuuguggagaggguacagggggcagaaggggcagagaccaggguaagguggggguaggguguuauuguggggacuaccaggagucucagggaugcagcuagggaacucgggguguugaugaagcaacuaugguaagggagggaguugcccugccuccucucuacaauacuccccacccuuguccuaguccuuggaaaugggaggccacccuagucuggucugcuauugagcagagcuccagaggcgcucauucauacuggagugugaaugacugcuuugggugcuuccuccuccucuccugacagccucacagaggacaauuuauugccuguuuacuguccauggcucacuguacaugacuuccucaagggcagggccacauacugcacccccugccucuccccacuccccguguucccagaguacauagcagacauucaggaaauaucugccaagaacaacggaggacaucuaacccgaagaaagcaagcguccgugggguggagucaggcacaugggaggggugccugacagggaggguagcggagcuguaggugcucugucacccuucagggcucauucuccuggcacugggacucuuccacaggaaacccgcccauuuuccuggaaggaugcugagcuaagcaggcaaggaucgggaagguuugugucuggaaggaccucccucagccucccucuggcaacugggcagcugagucaggccacugaaagcugggauaguaugagggaagagucuagcucaugucuaaucuaaaccuagccugggacugggcuuaguagggauuggggagggagcuucccuccuuccuucuguauaucucuggauuuuucaucccuucaugacugagucucugaguacaaagacacccgugggcacaugaguugagcacaccacugcuuucuuugcaaaccagccuuuggaggcagacuugaccugcugaccucagguucccugucuaguccuucagaccuuguucaucuguuguucuucacucagcucagaagacccagcggacaggcagcauggcucuugucaugucccaugugggccaaaugaaugugguaccaagagggaacccaguggguacucaguccuugcuuuccugccucuucuuugaagucccugagacuucugggaugcaagagcuccuggacuuuuucugccuacccucuagucuccuguaugagcucaguccucucaucgcccacgcacacuacucucuauagccucuugucaagugaccuugaccacaucccuuuguaggguccccuucauggcagcaguccucuagcacccacuuuuagcaucucugaaccucauagccuaacuucucaguucacagcugaguagacacauauccauguggguaccucaucuguuccagcucucagcucccagucacacggcaagcagaacagagccccuuucaaccuccauccuugccucccuucuccuauagaacccucuuacaagcacuaccccacugaccuucgauuuauuaguuuuccugucauauuucuuaacucucuguauccugcucuuggcaaucuuaggcacuaucuagugacagucaugggagacgagccaccaacauuuugucccacagcuuccuccucagcaguccuucuguguaguaacaccacaguccuaguccaaauguuuagcacuugcauuccaaagaaacauguagcucuaaaaguguaaauacuauguucacaggguccuucugugauaacaguuuucuguuuucucuguaguuaaggguugccuuuggguuugccuuagcuuuuuuuuuuuaaacacuuauuuaauuaauuaucuuuaaaagauuuuuauuauuauuuuaauuauguguccgugugucucugagcaugugagugaaugugcaugugaguguaugugcaugugaguguaugugaguguauaggcaugugaguguaugugcuuucagaggccaaagacauuagacaccucuugagcuaaaguuauauguguugugagucaucugacauaggugcugggaauugagcgcugucugaguaguagaugcucuuaaccuaugaagccaccuugccaaguccuuguuuaccuauuucccuguguauguguaugugcaugugugugaagguuggagguuaauuuguaugaguguaguuucuucuuuauauauauauauauauuuuuaauuagguauuuuccucauuuauauuuccaaugcuaucccaaaagucccccauacucuccccccacuccccuacccacccacucccacuuuuuggcccuggcauuccccuguacuggggcauauaaaguuugcauguccaaugggccucucuuuccagugaugaccgacuaggccaucuuuugauacauaugcagcuagaaucaagagcuccgggguacugguuaguucauaauguuguuccaccuauaggguugcagaucccaguuucuucuuauaccaucuagguucugaggaccaaauccagguuuucagacuugguggugagcgccuuuaccugccuggccaucuugccagcuggggaaucgacuucacugggaaagaaucauaugcacacaugaaggagccuguuuaugagaaagacuacauuugugugggucugcauucugcguauauaugugugugauugcuuauacaggcaugguucugugugccagguguguccaugugugcaacugcauguaccauccaagggauguauacuucucucaguaacaggcucuucuuucucucaguguucucuugggcagccccucugccucgggugugggcugcagccuugcccaaccuugcucuacagaggaucuguauuuucuagagaaacuuguaaggaaaggcaugaaaagcaaauccuaugaauuaguaagugucuucuugcccuucacagauacuuuggcugggcauagaauucucucuucagacuuuuguaaauauugagagauccauggacugguaccucacuugccaucucugagaugguccugugguauuaucuuugucccagucucucuggaaggacagacugccacgaggggugcucuuccuagauggggcuuuuaggaggcuuuuccuucuauuuccuuuuuuuuuuguauaugcauaugugccugagccuaugcauguauaguacauguguagugcuguacagaggggguauuggauccucuagaacuggaguuucuggcaucugagauccuccacaugggugcugggaauggaaccugucaucugcaagaauagcaagagcacuuagcuacugagcuaucucucuagccccgugucccaugcucuccccggaacuucuagcuaucaaguaaguaaggguagggguucagggagucauuuuggggagauuuacuucaaccuugcucugaguauuuaauaguguguguguauguguguguguguguauguauauguguguauguauguguguguauguguguguauauguguguguguguauguguguguguguguauuuguguguguuuuuaaugauugcauugaguccaaagggcccucuaccucugccucccugcuacugggauuauaaguauuugaaaccaugccuuguuuuuauuuuuauuuuuaacauugguucuaggauugaacucaaguccuuauauuuguguugcaagagccuuacugucuccugagccuuccuuguucauggauuuuuuugugaguauaacuuuuuguuuucucuggggcuaaaaguugccugugaguuuuucuuuucuuuuaaaaauauauuuauuuauugaguguuuaugcuucuugguuaauuuucuuaauuucucauuuuuaaucccauuuugggggaagauuuacuucaaacuugaucugaauauuuaacaguauguguguguuuaaugauugcauagccuuaaaacagaaggauccuauaugcacccuuaacaccuacauuucccugcuuucugguauccaugugcugagguuagccccugccuaguguuuugccuucccuaaccccauucagccuuugacuuccugucaguucaagcuaggccccuuccuuccugugccagggucuuuacguaugcuacacauucugccuagaggucuuguuucaucucuguacucggcuuagcccauuugccugcaucuuugguauauagcucauggcguucguuagguaccucuguuaacuuccucgcugguuuagcagcccaucugacauucccauagcucuuuauagugcacguacaugugcucacgcacucgcgcgcgcgcgcacacacauacacacacacacacacacacauauauguacauauaugauuccugcugcggugacuaguagcugcuugguacugcugagcucucuaguccucugcuguggcccaggcuccugucauugucucacucuuuuguuuccuuaacaagucacuaaagccuuaggggcauauaccuugauuuuccugucugggaggucugcaguuugauaauugcagggcugacugcuuccugagaggucuggggcaaguguuuucuggcccuuucagcauccagaauggccugacuccuuggcucauggcucuuccucuauuucuaagcuaguagcccacaguuccucccucuuuggacucugcucuagcacccaucucuuauaccuacugcccccucaaguagggaccccuuguaaugauagcuaugaccaucuaagccucagcaggcuuuccaucuucugauuagcuguguucacgcccuacacagguuugcauauacuguuccugcugcaccuaugacacagcuagggaaugaggagguaggauuuacauagaaagcccacccuguagccacaacagugccaaaggaaagaguucacucagucuugauccagaugcagagagguuacaaugucugugccacccagagugccaagagccccauccaggaagagaacucagaaggacuggcugagcaggaauuguucugauguccuuagagagaugcaaaggucaggcauaauuggagcccagagccuaaggaccuccccugcuucuaugauggcuaaaagaggccccagagauauccaggugcagaacggcuguaaacaugugaguacugauggacagggagccaagaagccucaggcaaugaagagaaguucaagggaguagagacugagugugcagaccucaugguggguggggaagggaaucuuccagaagcggagggggaggggggaaaaggacagggugucuggagcuugaaggggaagaagaaaaucaaagaaaccaauaaaucaaggaauccaccacacuccugagaauuuucacacccauaccugagaaaccaccacuacaggggaaggcaaacagguaaauaagcucagaaaggaagucaggcgcugggugacucaugacaaguugaacuccugacagaguccacugccucccguguacaucagaaggucacagaggcagcucugggcauccaaggaaaauuccauaaacuuaaaaaaaaaaaaggaaaaagaaagaaaauuugaacauugauauaaaauuggaaaguagccaccaacagacacacugggcauucaaaaguaacccccuaacaaucccaugcuuaaaaaaggaaaugaaaugggaggcacgucaguuuacagacaggcucacgaugacagcgugacguagcagcagaaugugcgugaugcagucaaagggacauuuagaggaaugcucacagccaugucagaggaacagagggacuaaaaaagagugugcccaggcuuuacucaggaaucuaaaagagaacaggcccagcaacaaaugccgagaaagaacaaagaaauaauugaccaagaugcaggagaauacuagcaaaauggagaaaaauucugauggcagaaucauugaggaaaguaaauccuagcuguuagaauggccaaugaaauaaacauuaagcaaguaagauaacaaauuaaaaacucaaaggcaguaacaacuacagauaccuauggaggugucuauuugcuacuguugugaaacacuguuuuugaguccaggucuuguuuggcagcccagucuagucuugagucccugaucuuccuucuucacuuucccagugcugagaucagagaugcaccaccaaaccuaguacugauagaaauuuuauagcaauacaauugaaaacuuaaaaugauagauaaauuucaggauaaaaaauugguaaacaugguuuucgaaguagaaaaucuuaauacacauaaggaugccgaagagaucaggguuauaccaucuacucaccucuagaauguucuuggaccagauuuuacaaugauuuuuaggauguuuuuaaaaagcagaucacaccuguacaaugugcuucagggcccaggcuaagccagaaagcauuuaacuuaaaaccagagcuggguacagaagcacaagaaaauucuaaauuuaaaugaugucuugugggggagccuaggacaugagggugcuugagcaauguuggccggacagaggucaaaggcuggaugaaugccagguaaagacaccccagacccuucagggccaaacuucucuggccaauguccaguuggucuuuaaaaggauaggucugacccaacccagcuggagcugaguaugacuggugugccguuucucuagaaccaauaacuuccguggagucugucagaucccucgggcuaccuccuuccacagugguaagugugacaucauucugcaggccugggucaguggaauagcugccuagcuaagcaacccccccagcaguuguggggacaccuguugggaaggauggagggcuuuacuggcagcugacagcaggccuagccagcucggagggguggucauccagcugugccuggguccaggagcucugggcagcuggugcuaaggacccggcaggugggagaguucagggcuuagcagcugaacugcuuaggggaaaacuggaggugggguggacugcauuccaaaggcaagagccucugagcugugugcacauguguggaguagauacacagcauuugugaagaagggacaaagggggcacucucuugggcccuugcuuggguagccaagccaaguggcccaggcacauggugacauaugucaaaguauccugcuucuguuuucuagucugaaaggucucuuucuuugucuuuucugagggcuuuugggcacucuacacugggcaaacuggguccacaggaucacaaaguacagucugacucugagcaaaugcuuugguugguauggcccccggugcccgaaauggacauguguguucacagauguccuuagggcacuguuccugauuuccacaugcuuugccaucugacuugaagggaagaacagacagauccugaggguggcaagggaggugggcaguuucauuucacacuaagccggagaugcugagguuuaauggugugaauguguggcugggaguuguuggauguuguuuuagacagucuugcuagucccugcgaggcagguggguuuuagauaucugcauauucugaaagaaaguccuggggggauggaagauguuuagacgcugcguagguccuuaggggucccuuuucaaggucuuuaaaaugcaaauggacacaauuucuacaaagcuggugagugcccaauggggagggagcgcuuuagagaagagugugugugccuauagauuugugugcaguguguagagaccaaaggucgacuuggaguaucucucuucaggcgccacccaccuuguuuguugaaacccagucucucacaggccuggaguucacugauuagucuagcaggcucugcagcaagcucaagggccugcuugucuuuguuuccugaugccuagaauacagacgugguguacuaccuccauuccuggcuguuuuguuuuuaaauguuuaacuuagauccuggggauugaacucagacuuucaugcaggcuugugcggagaagcacuuacugucugugccaucucccuaacuuauagagguuucugaguuauguuagauucugaguccagcaucccuccuugggaugccacuuguauccucaggauuggguguuucuuuaagucuaguguuuggccccugccagggaggaagggcugaaccccaggaggagcccggcaagggaaggggcccugguugggucuauaaccacaguucccuuggcucaggguggcuccaagcuuuuguggaguagggccggcccuguuaguacucaagauacugcaccgcagccauccguggaggcuucuuggcugaggacuaugucagaaucuuccaaagcggcaucccaggugccagucaacgaaauuaggccucgcuuucucagaugcagaguccuggcccagccuucuugccuaccaccacaggggucagcuucuuccuggguaccugggugccuggggguaacugcaucuguguaaagcugggggagcugggcacuaucacagcccucauccugggaugugacagggcuuuaagguaguguucagaaucuggcuaaaaccgcggaaagacccgucauggguuccauccaacgugguuagaaacaucugacugugaccacaaaaaugcuggcgcccuggccacugcugagaccguucaucuuagcaaacgugcggugcggagagcuuugccuuaacccuuggaagggugugugcaggagccugugcaggacuggagccauggacuucugcuaugaauuaggccagaccaggaugagcgagggacugauucuugaguauuucuggugccacugggcaugguugccucuaaggcugucuaauaacccuuaggcuucagugacuuccggggauaaaaacuaagguauuaggagggacuuccaggggcuggaaacuggcacuucccaaggucuacauguaguaggcagacauguaucuguucauucuuggaaaugagcaaacauuaccuggcugagguguugaggaaggcauauaaccuucaauaaagcacugaccucccccaggugaccauuaggguugugaggagaugagcaguaaccauguaccacauccacauaugucagacagugaaaagggaugcagaacccugaaaagggaagucuuaugagcaagcagcuucuggggucacaagcuggggggugucaguggagagcagcaccucagggcaagucaaaggaagagaagggaacaugcuggaauguuccagaaauagaugacagacaacauuuuuugcuucuuaguccaucauagcuaugccucaugucaaagacuugacuccauagugccccuauuagcuacuuuuuacuaugauggggcuucuuaucccuucaccaugacaggcagucuguggucaguuuuuaaccauuaugaagauccaugaagcugguuccuacuuggggacagauacacagagggcuggguguuuggaccaguggguaaaagcagccuucauuuugucaugaaccauggagacacucuccagacauggucugucuggagaccggagguugugucuccagcacuuaguguuccucuacuuuguaaccucugccuuugggaucucccuucccaccugagucgucaggcugccuacucuuugauuccaacuaugaaucuucgacacaagggcuuccuccugggagcuuucuauauucugugguuuugaaccucauaacccuaaccccagcuaguggagggccacauauuccugguucuuacuccuuucaugaggagcucaacuuccugcaaauucccacaccagauguucuucucugucucauggcccuauugcccagggcuguguauauguuaggguagaaccugccuaccaaagaaugcauccaguuggucugcuuuccagguugccuggccccuucacccuagcaaguauggugacucagaggcacaggcagcuguuggacauagccuggggacccuuguacaguuugucugggaugggauaggggauuaaagccagggacuuggggugugugaagggagggguggaagaguucuucuauccaguacuucauggguaaggucaguacagggaccuuuaccuuuggguuuucuguuugccagcugguaauugagucaccauggugcuucuaacauaggugucccaagcuuccaucaucuggguguuggcaacccuguucacacugcuagagacuccauaaggagaacaaggguaggagccugagguagguuuggggguauggucuacagaaagcaaggcuccugcugaagguccacugaauucagaaccgcccguaggacuucaggcugccuuacacaaauccagaggccgcuuauccuugaaccuaggggucuaguuguuccauguauaggccucuaaagagaaugcuaguggccgggcgugguggcgcacaccuuuaaucucagcacucgggagguagaggcaggcgguuuucugaguuugaggccagccuggucuacaaagugaguuccaggacagccagggcuauacagaaaaacccugucuugaaaaacaaaacaaacaaacaaaaaccacaaaaaacaaaacaacaacaacaacaaaaaagagaaugcuagcuggauucccaccuccugaguagccugugaccaggguccuggagauggcuggcuauccagguuuccuuaaagguacagccuguucauagcaagcuuugguccuucauugaucuuaguaugguuugggucugagauguccuccaaaggcucaucuguuaaagacgugagguuuggaggaagugauggacuugcagauagagaaacccauagguagauccugauuuuaguguacugacaggagguacugggcacugaugaggugggauccagcugaagggaguggguccuuggaggcuagaucuugccccuagccccuugccuuuguucucuguucucuagcuacuacaggggaauaaccuugccucuaccagaggcuccuaccaccaugauacugugccuuauugcagcccacagaccacagcaccaagucauugcccacugaagccucccaaaccacaagccaaagcaacuccuucuuccuuuugaguuauuuuuucccucaagaauucuguuauagaaacagaaaguugacuaaugugggauaagaaagaguugguacagauaacaccaacaagauuuucuccagugcugaaaagguguguggggaagaguugcuaugacaucagccuucccaaggucuaugaggcuaugaggaagaccuggguuuguagucagcuggcacuggauaggcccugcuggaguuuuacaugggcucuugcucaccaaaccccacacuaggcccaaggagcacugagccagggaaacagagggaggugguuggcuuuauuagcaucuucucauaugcaaggaggagcuuagaaggggaaugacuuaggccuuggcaguauaguaaaaugauaaccagaggcugauggaauaaagaaagggugccggcagugaggacuugggguccacauguuccaaagaguagaacccuugcuugaaguuuucacuacuccuccaaacuugcuucuucuguccuuucaauguagugacucccacuucuuuccugucuuacaaacucaucuaugcauuuguaauccauucacagauucaucuauccauucaccuauucccuucuacugccuaucuauccuuucauccaaccauuaccacccacuaauauaucuccagguacccauucauccuauuuucugucaagcacucauuuaucuauccaucuaucuaucauugcugucuaucuauccauuuaccaacucauuacccauucagguauccaccaucaucuauucaucuauacacauacucaucuacugacccauacauuaacauccauccauccauccauccauccauccauccauuauccaucuauauauaucuagccaucauccauccauucauucuuccauuacaugucacccauuuuuuauucaucuaucuauccauucacuuaauuaucuaucuaucuaucuauauaucuaucuaucuaucuaucauccaucaaaauaucuauucgcccacacuaucuugcuuuauucauccuuuuccucucauuuguucucucauccaucaguccucucaucuaguucuccccaucaggcuguaugccugccuccauucuuuccacugcuucuguuuccuguguaucuugcagcaaugacaagaucaaaugguguggaugaugcagucacuggucuuggagucacagcuugccacugucuaaaaauagaucaagaccaaucaagaagcaaguucucuuucugugcuuucucuugucucuugaucucauguuccuaucaaaagggcauacacucauguggugaugggucuagaucaaauggaacuauggagacagggauagguuaucuucaagacuaggugacuaggcaugggacuguggaaguggguaaguugggacauuucugagagagcuaguuuaacaaguggucagguuuguuggagaaggaagcauuacaaacaugagauccaguguuccuugaauggagauguguacagacacaugacuuaggccaccaagagucaaauugaccauuguuaccacuauguauuuggacaugacacagaccucuucuuugugucuacucuucccaagucacuguaggcaggagcugauucacaguuaggugcuguggcuuauugcccauucccagggcugguccucauccuaggcagaugacucugcuguaauagggggagacgagagcuuacaaaguuucucuggcuuguuuuaugugucagguucugugcaggcacaggacuguaacaggaauggcuucuguucuaguggggaagcagaacccgccuggccaagcacagggauggugaguuaaaagacuggugcugggaucaggaacccaaggcauuggagagacaacauaccaggaaggggucaaagugccuuuaugaagcuguugcagcuugacgucaggguugcuguucccacaggggcccagggaugagaggagcuccaggaaggugcugcuagggagacuggccagggguggggcugcauuggaauugccuuccagggaggagggaggccgacaggccaugagcgggagugccgugggucugguuuauguuuuagacauccuucuggcugcugcaugaagacaggaaugugggggggggggagaguggaagccggggugccccuugggauagggaagaacucugucucucuguacaugccguuccugacugccggaaaugcccuucuggcccuggcagaguccauggugggaagaacaggaagacugagcagaacagagguucgagcguaucuccccacaccuaugaucuaguugggugcacuguaaggggugguauugugaaaagagcccugucaccaggagggagggagggagagaggaagcugcaccuuggacuucaaaugcuuaucaugggagguagcuguccuucauuggcugccauguuuggguuuuauuauuauagcagucgagcugugccugucuagaacuacugcugcuaugugggauggugacaggacggucagcauccucuguaguacccaccauggccacugccacuccuucaguccucuagagcuagcagaaccucuucuuuugggugacccuuuuccuuagguugcccaagcuucaggcuagguacacgacucugaggcagguacagaguacagcugucugccaaucauaguagguacugggcuuguggcucaagcuggcuagugaaugucugcuggugguauuuuuuucugggaauauagggaaguuguaguugugagcuucaagguuguaaaucugggacuaagagucauuggccacaacacagagaccaccgaggccagagacaagucauggagcuauggugcuugcuucuggaucucacuacuccugaagcugucaccuuuguggcuuuucaacugugugagucaauacaugacauuaccauucagacacauuuuagagcagcguuuccagcucuggaaccagagcgugugugagagaacauaaagaucauuucuagaggcuggggucugguguaaaggguagaaugccugggugcuuucugaaggaggcaguggcuuagaggggcugugaugguccagcuaagggccagcaccaguauaauguaaagguggggcucucauaguguugaguggguguccugggcugggucugagccacugcugggcucugagcagccuggguuuuaaggucauccaacugguagagugguaacauccagggaucccaagucuagacucaugugauacaucuuauugucacuccacuuguccucagaauuguugcugggagggaacuuaggcaguauaucacaucuauuucagaugaggacacugaggcccagaaaacuuccccugauuaaagucugccacuugucaggaacacagcacagcuaagcucacacaagaaaccuaguuuaggaauaucuggagagagguuacaaaggccacuggggguuaacuugauaauguguuuuugcuucccuauuggacaaaggcaauaaagagacccagcccaacagcugcugaacagagucuggcauacccacagcaggcaguagacaccugaacaaauauaaacaauaggaaauccgguguuuguuacucagcaaaacugacuauugcuuaagacuggaccucaaauggcaacuuagcgaaccauagaacuuaugaccacuccucccacaauaaguuaaaagcagggaaacauccaaagcuauguauucucugugccagguucuugcuaaguuaggcagagauuucgacagugguugucucuccacuccacuaggguagggucuuacucuguauaaacacaccaaucucuauccuaacuuuucugccaaugagguagucuucugggaucagucuuacuggucugaugucgggaugccucaguguaaugacuggcauuuccaucacuguuguucccuaaaugauggauggcagggucugacuccauacaggccccaggaaaacacuuuguaacacuagaagagggcaaggacaggugggcuaagcagacacagaaggucuguugacauguaagccauauuuggaaucuccagaaaggccuaggagcugcuuggcccuguaggccauggugaauguuaaagggcagggcauguuauagggugucaagaauaggagauaagaccaaaguaaaggcuaagaagacagcuguagguaaagugcuuguauaaacagaauaccagaacauagaaaggaaauuaggaagggcaugaaagacucauuagaaaugucuuuaacacagucaaaaggcugucuagaaagacacaucagaaauaauugugugaaggaaaugaucauaaauaauaaaaggaauuuuuuagaacuugaggauucaccaaauauucagagaaaucugugguuaaaauuacucacagaauauuuuggcuaggaaauucagacacccaaaaugacaguauagcuacugaaaauguccaggaaaaaggaaagaagagacagguuaaaaggugugugaauaagacuucuaacugucaauacuggguguuacaagaccacaggaccagguguuuaaaguucugaaggaaaauccacuccuauuugaaauucuauacccagcuaagcuauuacuagggcauggcaauguaaugaagauguuuucuggacccagaguacagauaguguucuuucauauaauuauuagaaagguauuugaaauuucucaggaagacaagaguaggagguaagauccaagcagcuguacucccaaacuaaggguuguugauuaggaugucucuggagaaaauaaaugcuaauuaaagcaagaaagaagaggucugggagaauagggacaaagggaguuugagaaagagacaucagucuggacacccugacaauuaaaauaguaagcugaaagagugaagggaguggacagugggcagcaggcaagaacuaaggggucuuuuggaaggguaauugaggaagaacucugucccauuaggaguuaagucaaaaccaaaguaaaaauuguggagacaacgauauguaaagugcuugcugugaaaguaugaggcccugaguuuuagucccaguaccugugugaacacaauagggaaugauggcaugcagcuguuacuccaacacuggcuaggaggagacaggaggaucccuaugguuugcuggcuagcuaaccuagccuuuuuggugcauuccagaccaauaagagacccugucucaaaaacuaagcugccaagaaaugauauccaaguugucauauggccucccuaaacacaugcauauaugcauccauacccacaaacacacacgaaacacuccaugaacaugcacauacaugcacaaucagacagacacacacaugcacauaccaaaagucacaacccccuaaaacaaacaaacacccccaaacacaaagaaccgaagggaauacaucuguucaguggauugugaugaacuugagccugccuccagcuuugcauagaauugagagagauggcaaugagaaacagggccucagaacugaggauaggaggauagccuuuggccacaguagagcuggcaaucauggaaggcuaagaguguaaccccacagugagucccauuucccauaucuuacaguuuucccucauaaccugggagugacauuuuucuguugauaaagauauguuuaugugaacucaucauuucuuccacuucacuucuaauuuucuuuuuaaaaaauugauucaaaaguuaugaaaccaagccuaagauaguucuugaugguaugugucccuuuauccauaccucauauauccaucuguccaucuguccaccugcccuguccuuuauuccuucauccaucuuuguacuuauacauguaugcauucauucaucaacucauacacccacucauccaucuauccaucucuccucccaucuauccauccaucuccuuuaccauucauccuauauacccacucauuccuccaccaauccaucugcucacugauccauucauccauuuauccauccacccaucuauuuauccacccacccauccaucuauucauccuucagccugucuucucacucagucaaccacacccucacacauguacaugcucauucacccaccuuuucacauaccugucauguauccacccacucaccucucaauccuccagcucuuuacaaaugcaaauauccauccauucaccugucugacuaugcauuauuuucugugccauauguggagaauuaccagaaaugcuguuucuuucaugcugaagauggaucuuucuggaaaaacaaggaucaucuuuaggaaaaagagaggaucaugagaaucuucacuuuuuuuuuuuauuaagaucuugcucuacugcuagaauuugaaagaacaaaaucuccauauaucaucuaucaacuaucaauacucuauuuuuauuaucaucaucuaaguauucauuuaucuaucauucacguauguauguauguaugugucugucaaucacccaucccccucuacuuuugacaugaauaacagauaccugugaagaucuguguccucuuuugcuuucuucucuguuuggcuuugcacugaggccuauuaauagcaccucagcucacuauuuuuggacgccccucccucagaggucuucccugaccacccuggcuccucccggcacagugcccugcucugucucugcaugguaauuuucccagucuguaauuacgugguguauuuucgaccaggggccgcuucguagugccaggagcucuguccugucccugcggcaccuccaacacugucugcugucugggacauagcaggggcuucaguggggacugugggaaggaaggaguggaccgugggcagccugggauucucccucaaugcccaagcagccagccucuagccucagugugguacuuggcagugggcagggagaaccaagccugacagugcccguaguggugcccauaagaggaggcggaagcaggugcuuccacuugccacgugccgggcacugggccaggugcucagcagggaagguuccagguaauguagcccaugagccuggaggaaguguucuuaucuucuucuagaugagggaauugagaugccaagggacucaugggggcuccaaacuuggcccucuuuucuguaacucuguccuagccacuguuaggggcugcacugaggcaggggcaugggaugaggacagauggggccucaagauguggaacuagaucaggggcaggugaggggguggggagaaagggggaauccuagugggugguggcuaguaggagggccauggggaagggaugcuccugagauaagggcagagagccaggaggggguagggaagcuuggagagaugccaggccccggcaguaccuaagcucaagcuacccacauugccagcagaucucaccguauggagaagggaccaagugugacauuucagccagaaugguggcugaggcaagcuggcuagucugucaccuuagggucaccacccaggucccucugugcucuagccagcaguaccaacauucaucccuuaggccuccagacaagaaagucacacugaggaagaguaggcaaggggaggcagagagccucagagaugggagguaccacgguuugcuggcuucaggcuuugcuuuccaaaagagggucucagggggccaggaauggggugggcaggaguggugggcuguggagaaaguaugauagauggagagaggggagagagaguucuggagagagugggaggaagugagggggaggaggggcagcuggagguaaaagggggcuggggcauggccuggaguaggaggcucagcagcggguaagggaggggagggcagagcacucccuggccugugucaugccugccacugagccuguguguaugcacauguaugcgugcgucccugggguggaucuggggacacacauugagcgggaaggcuggcugcuaggcugaggagagcccugggccuguggggaauguuccaaggagagauuuauuagugaaacaaaagcauauuuuuuaggcaggacuguuuguacaguuauuucaugacaucgccuuggccucgggcccagagcagagcggccgaggaggccccgcacggcuggccgggugcacaggccuauucguuagcuggccguccucucccguccuuaucugguccuggacaucaaagcgggggcuuuucauaaaugaauuaaaauagcauacacacagcaccggggcggaagaccccaggccaauuagcucuaaguagggugagaggccuuucagagacgagccccuuucugaaggagucgcagcggcuugucaaacucgaugaaauauuuugcccaaagcucauuaaaauaaugaaccugcauuucuuuccucaagagaauaauuagcagacuuccaaauggguuaaagcagcaauuuagaaguggccccccuuaaucgucccauuuacuacauuuugugacaaggaaacucuggcgccuuggggaggagccgagagucucggcauuggcucuguguggugacggcagggcuguggagcugggugggagcuggggggccugcagagagggcugcguucaacuugggauccugccuaucucugccaccucccuugcuuugcaaccauaggcccccuccuccuuguacaucuaucuauaacagguugguuagagacuggaggccugaggguuagggccaucaccaugcugggagaauaucaacucuaagauacaagagaaugaggguaucagauguaggcucugcuucagaacagguacagacgaagagaacgccaacagguaggugaucugagccuuagcauaaucaagggcagagcccugguacaucagagacuccgaagaggaaacgagaagauaccacuuagggagauguugggggaauacaugaguugagggcugaauggauugagaagggugagcucagagugagccaggggcugugucccuagauguugauaacuuugauggccaaugggcagaguggcaaguucaucuggugcaacaagugugggacagacaagagggucauaggcaggcuggucuccugcugagagucauccacccuuccccaugcugcuaacagggagguucaacuuuugacaguagccugagguagcccuggacaauccagagagcagcaauaaauucaaauguggcugaaucuaaagguugagugguccucagcaggagccuccaagaccaccuugcuuugcuucuuccucuuuuucuuauuccgcauuuguuguuuacaaaguaagacacucaugauggagauuggguaaaacagaaguaauggcaugugcaguuggacgccauuuacaaagugccauaguaugcacacacaggccaaugugggacuugccuucccugcuauaguucuguacuuaaguauuucccauggucacugaaggauaccugcaagcauacuagguguaacacaaccaaccauuggccaucgaagacuuggagucucuuucuaaccccucucugugauaagcaagacugccauuaacuugcuugcauacaacucccugagcaacucugcuuggagacagaguccuggacaggggucacagaguuaggggagggaugaucuguaccuuggacauguuuuauccuugcaauaugggaaacaggcuaggcucauuguccccugcagccucagugucuucaucacaguguuuuuuuguuccuuugcagacagagcaaacaugugaagcucuguugugggccacaugaucgcugggcaagcccagcgcucuuacuuugauggugggauccagucugaaaagcauaaguaugcuggaaaugcaccgaguccgccagacccaugacaucauagcuuagcugcagcauauuuuagagggucugagguucacccuggaaggcaggggacugaagagaaacugcuccugaagcugccuggcaccuaaagagagaacugaauaacuagcucaggaagauccagcuucaaaaucuaaaguacaaugaccauguacacacacauuuacacauaugcacacacaauauacauaugcacauacacacauauauacauguacauacacacauaagugcacacauaaugcacagacacagaugugugcaugcucagacacauaggcacaaacacacagacaggcacaaacacacacacacacagaguacagcucuuacuaacguaucaugcucacauucucagacagccaagcuauaaguugagaauuaucaaaccuaucauugcaacaugucaacugcuaaagcuugcauaucugugagugaaugugacucuguucuaauaaaacuuuacuuacaaagacagguguuaggcuggaucaagcccgugaacuguguuuuccuggcccuuuuuucaguagauagaugagaugagauguauuucuucaaucuugggccuucucacuauagguuuccauagauuuggagucuuuacauacuaaggauggcccuucuccaucauggcuugcugucugguacagccuagucagcagagagggccucuuugcucugcuagccaggccgaggcuggagggaacucugugacagccccuagcaucugugaacucauucuccuuuagagacaaaggccugcuuccagcugucaguccaagcuaucaaucagacucagccugaccuucugagaccagugggcauguccaucugcuguuaauagcuugucaaagcaggggcugaucucaacucaggcugucugggcaaauaugcccaaauggugccagcaugccugcugcagucagccaaucugggaaauagucugggaaauggaacuucgugagaugaagguaggaagcugcaggccagagcagagccacauacuuaucauggccgcauccacauaaccacccguggccccuuggcuggcuccugagacaacagaguagcccagaaagaugaaagcaguuaggaggaauaauaaugagggggcuauucuaguuagugccaaagucccagcagcugucugugacccuaggagcccaaggucugugggaacuguucaccuugcaucagucaucuaccgucaccaaacuugccuacacuugcccacaaacuccuggggcagagaagcaauagcacaaacuagugugguccuaacaacacugauuguuuagggaaaaaguuaaagucccaguuccagcauaagcaggaucuacagaugacagggccacggguguaaaaugauuagugccucggcuucccuccuguaaaauaauacuacaggugauccaaacugcgagguucucggagauccgugccugccaauguguucagggcauuugcauagccaacagaaagcugccaauugucucugcugaguggugguuauucuugucccuguaaacauuuuugucccuuguaccuacuuaucagccagcagccaccacagagaaugaaugacagccauaguacuucuacuuaggaugcagauggauucagguucugucucuauucagggcacacuugucccugccuugagugguucaucauucuccuuggucuugaccucucaaagcccugucuuucccuugaggcugugggcagguuugagugggacagauggggguaggugauccgagguacugcagccaauggcugcaguagggcucugaauacgagagcugauucugagauucucacggguagcaggugggagauucugggacugaauaggagaugaguggggaggagagaggcugggagaggagcagggaauguugggaagaaagagggcccuaggaauuugugggcaagucugggcaagcaguagcuccgggcacgcagggggcaggcuuggaugggcaggcuggggcaggcagcaggaaggggguugguagagggguacaggccuaauccugugucccugaggccuggcgggcaucucuuaaguccuauguccccacagcuugccagaaccuguaggaacaaggugggguaccauggcuucauaugaacacccccuccacaaccuagagacauagauguguucucugaugucugcagaacucuguagcacagaggaaaccucauuuuauuuaucuauuuaucuauuuaucuauuuaucuaucuaucuaucuaucuaucuaucuaucuauuuauuuauuuauuuauaccauagacaucaucauaucuccuugccuaucuuuaagguuuccaguucuuuucucugcccaggauauucuguuugugcccacauugccuuggccccucaggaaauccucauuugagcacucugcuucuuuacuggggauaguuaugugacaguauucuggcuaaggcuagucugcuaguguguuccauaggggaacauagcugccuggcagagcugcuuuacacaggugacuuuucccaggcucuggucuuacaggaggucacacugaugggcagcuggcuaccccucaugcuacaauuugaccaggaacccuugugggucuacuuucugcuuaagguuccauuaugugagaacuugaggcuagggcuggggggucgggggggggucagccuugaggaauccaggggauaauguaucuauccucuuguuaugauaugcugugggauggauguggauccugggauacuagggugaugguugaaaguaggugguggcuacuccacuucucugugaccccaaacaauagccugagggguagccagggaauaugcauuuuaagguguuugucaccagccuacuuuguguuauauccaugucuugaagaaccuggggcauuguaaugguaucugagagccagggugguugugagggccaccaaccccaaagaguagaauucaaggaaaguguagcaagaccaaggggguucaugcuguggcagguuccuuguggguuuaacauauaugaggugguccauaaagguauuuuuuccacuuaaggaugccaucuucuagguccccuuugagaugaucuugacacuaacaggaucugggaagucccacuggcugaggacagggauagagacaaggauagcucugaagccagggccaggcucauccuccugcuggcuguauccuccaauaccuaguauacuaugaagcucagaugggucuaugagacucaggcagaagagaaugguccucagcugaacuuccuguguagcagugaugguagagagccccucuucaugccagagcaggguuacucuggaggcucgcuucucuucuauacauuucauagaugagaaaacagaagcuuccaggaugcugggcugccugugaucucauggagaguuaguagugagugacucucaggcagguaagggacuuaggagaugacaggaaacuaaggccaagggcuguaacugguuccuauuccuaggcaauccuuauacauccucgacugagacaguggguccugaacucccuugggugccggguggagggccacagauccugcucagggggcauugacuccugcugagguaagccacaugcucagguauuuagccuugaugauucuuuuuuuauuguugacauggcuauauuuggaccaccuaagagauauacuucaagccaugaccaggaggacauuccagagagguuuaaguuaacaaggaagaucaaccauaaaugugggcagcacuauccaugggcugggaucccagacugaauaaaaaagugagaggagucccagcauucauugcuucccgauuccugacuugagaugcaacguggccagcuaucucgggcaucuauacgucaucgccaccaccuccaucagaguggacuguacuccuccuuaaacauuagcuaaaaauaaaauauuucuaugagguucucuuucauaaagcauuuugucacaguggugugaaaaguagaccccacacugagagccccaucgcuuccccugauacccucucuucuccagaaaacaccagauucuuuuucaaagaaagagaaggaaccccagggcuugcuguggauagacagacaucccaaagacagaaggcuaguggagggucaguagaaagccugguaagucucaguauaacagagucugaggugaguggucagaugggcaguaucucuuggaaggacacccugaagaucccauuccuggaugggauggcucugcuggcccuagacuuaggccacucuuggauagcugaccuaaucuaccugggcuccagcucuucaccuucaaaauaggguuacacagaugaacacagaacuuaucaccagguguggaacucuugaaguucaggacaaagacccaggaaacauacuccucauguccgcugccccuggccugagcacugcucucaagcaggcacucacuucuacuuggcaaaaaugaaugaggcaucugacuguagcuuugauggucuauucuugagaagacugagguggagguuauacgguuaaaaccagagaaaaccuuacuuagaacaucaguauccagcacaucacaagcucauagugaguggguucucacccacaccacagguccuaaggacaaaccuucaccuacauacuuacaaacacaccacauaauacacagaaacacccaaccaaacauaccagacacacacuuacauauaugcaaauacccaccacccucacgaguguaagcacguuauaugcaacauccucauauuuacagacacgccacaccuucauauguauaaacacacaccauccuugcacaugcagaaacacacacaaugcuuucaaauguacagacguaccacauaucaugccacuuuagaguacgucgggacagccuccccuccccaggcagagcuccacugccaucauuaagagcagggucccuugcacagcucuucucucacuugaaugcagaggugcuggcuuucuuucugucccaccugucccagggccuuugcucuucugucucuguagauuuuagauguccucuguuggguacacguugcugaucaccuguacccaguuugccgcugcucauaccuucugcacaugguaccuucucucaacaccccucccuuuccugccuuguuucugccaucuucgaccccuucucuugucccaaauuaggcaaaggggcgcacacaaaucaacccugcccacagcauagaggcgagaguucaaacaacucgaccaauuuacaaacaauuuucucugcaacgauuaaguuacauuuuccccaauagcugcuucauuuucuugucaaaauuacacaguuuucacauuuaucucgcugcaaggguaauuaauuuccagaccauaaguaagaacuuaauuugauaccugcaaggauuacaaaccauuucaauccauuguuuacaugaaaucaagaaagauucguucuguuugcaauuauguuaaugaggagagugcccccccccuuuuuucagggaacucaagcauaauuuuguccuuagcaauaaauuggucuaaaaagguccauggccaccacaaaccucuguguggcuauuuuuagggugaaccuagugagggaacccaugcagacagccagguacccugaggaagacuuuggggagaaugacucucagacugguggugauuuccaggguguguucccagguuggguugugggccaugagcuggugacaagcaggaggauggaccgcccgcaaugcacucucucuauuauuaucuacaaagaagggaucuaagaagaucaggguagcagggaagccagguaugaugguccgccccucugcacacacugcauacuggccaaggcuggagacuguagguggggacauucagggggagaagagaucgcuuucaggcaggagauacauccuaacucugaccuaaugcugucccaugacuguggggcaagggggacugagaugcuuggcgagaguucuguuugcccacagggcacccuacaggucaucccuugaucuccaucagcccagaccaugcaaaaugacuggaaggugcauccacaggagaccagcugccugcuaagaacuggcccuauggcugggggcuggaggcuaggugaagcaggccugcugggaggaaagggcaguaugagcaagggugagaggcuguaagaaauuucuacaggcacacaggaagcugcacucagagaaaggaguugggccaggcuaccagugccaagggccauguguacccuucauaaagacagagaacagacauggagggaaggaugcuuauaggaaguccuacagacuccuaagucaggguggaccauggugggcagcuuagaagagguucugccuguguggacaugggugcuagggaaauccuugggggucuaggaggcugcuuggcccagaccucuguaaggcaggagcccugagaaggugggcugaagaaacuggcucagccuuuugcuucccagcccuccugggcacuguggggcuacgggagaaagaggacccauucauggaguggcccgcuguggucuguagacacguuauggccugucccuggcuggcugucacuagagggcugggggcugggcacuguccucuuccuuacugcaaccccccuaccccccagucagcccagagcagccggccugaggcugcggcugaaccucguaaauccugggaugcuggagacagcccaggugaggcugggaacaaugccccauuguggccccguggggacggucugccaccacuugccaccagccccuaugcuguaaaaucucuccccacggauccaauuucgccucuccggcccuugagggguuaggcccgggacaggcgcaguuccacuccacacagaaaccauuuacggcugggauaaaggcugccuucaucagcaccgaagggccaacguuucccggccccaucguuuugucaccgccacaucugucagguggcggcaugcacagcaaugggggcucaugugagggcaaggaaggaccucagcagccacuacagggaagaagggccuacagucuugcucuuccugugagugaaguccauggcaccucccuggcuucccagcuugugcuucagugggauaauacuauugcaggauccagcucugagguggagagcaugcauccugagggacuggcaaagaggacaccagaccaggcugagugaagacauugcccuuuguuaguauauacauuaaugagcaagccaggauggaggaggacuggcuuuggccuugccaggugcuaguucaaaagcccgagaagcagaggggcugggaacaccugggagaggaugggggggcaaucagugggcugugucccacaccaucuugcgcuuuuaguucagagccagagaugggucucuguuccaucaagcuuuugaggaagaacagggaucuaagagccaacauggacuuggccuggcuauuuaucaugagaaaagccucuuccaggcuguggccaccauggcuaugcuggucuucuguuuugaaagaauaauagcuuuaggugguacuugagccaucaccuguaucuuagcaucuacguuugcauuucagugcaagguacaaaagaccauccugaaccagaaagcuauggcuucaugagugucagucacuucuugggaugaggauuguagauccuuuguguuuauggaggcacucagaacagcacagaaggauuggaugcucuguuguagcucuaggaccugagacagcagaggcuuauugccccgggccucuaucuagccucccuucccuacccacccugucacuggggaaggaagcugggagagaggauaggacuagaggcucaugggcuucuucaccaacugacagaagaugggugcauugccacuauauagcagagggauauuuucuccugcucauggcugugagcacuggguaguuucugaggcuugagugguaaagucauuguaacaauugaauauuugaauccugcagaauuagggucaaauaguguguucuggggaucauuacaaaaccuuggugaacccugguggguggagaguaggaagauuauguuaguuuucuucuucuuucucaucaggcugggagccagguuaaauugggggaugggcgcuugcuggcaccugcaaguugcuauuacuucuggacuuguucuauaacugggugacaacuggugacaauugggugacauccugggucauagugcccaggggaugauucagguccaugauuccaauuugagggcaacaaguaugugauaguuaauucugacugucaauuugaugggauuuggaaacaccucugugugcaucugugacagugucuccagaauguuucaggggagacccauccugaauguggacaguccuagcccaugggcuggagucuuggacugaauaaaaaugaggcagcaagcugagcccccgcauucaccucucugcacccuaauuguggauguucugugacuagcugccucagacuccugcagccaugcuagacuccaucucuucaaaccgugagccaaaauaaacgauucccuuaagcugcuucugcuaagaacuuugucacaacaagaggagagauuaacaaagaggaaaacuaagauggauagcguggcccaccaggggccuugucagggacagaagaccacaggaggaccugaagcacaggaggggaacagggcccacucugugaacccagccauuaugcccuagcuguagguagcucacgucauccuuaucacacccaaguagcaaggaggaaagguagggaaagcaaggcccaggggagaagggcugccuaugcccucagcuauuaucaaggugggggauucugaauuggcacuggauuugggucacaucuuucucuccuacagccauugaaguaugcauauugacugugagugccuggggucuguggauguaugcaggguuauagguacaaaggagaaaguggaugcucuuuaccaagagggguccugggucccuugcccuucuccccacugaccuugcaucagaggccuuggggucaugccuuauauguauuccauacacuuuccugacucucuacccaccacaaagagugggauugaaaaagggggggauagaagagcuauggcggccacuggucaccuggccuuccuucuaugguccagucacuacugggagaugagccugcuuuguuccucauccugucagacuuugucuucuuccuaggaacagugagucccagagucauuugcucuggaaacuugaugccuggauucuguucccuuuagauucucacaaacaugguucgccuuuuccuuggaguaagccccgaguucagcucuggauuggacuugggagcaccagccugaggcagggccagccuccucuuccugccccucugaggagcagguaaagccuguuucuuaggccuuagcuauggcuuuguaaccuucuugccucucaaccuugcacugacucuucauuccuuuccaccuaagcuccagacaucggagguccagcugccuaccuccaaggcuuggggcucuugauacucucuauccucuaucugccuauccagucuuggaaggggccagcagucugcgggacugguccaccuaaccccauagcagccccucauaguucucuggggucuccccugaggacucuccugggacauagcuggccgguuuaucccuuguuggcuagguucuaucuugcuguuuucuuugacuuagaggagcacagccuuuacgccccagggccuuaauacaggcugcucacaagauacguuccuggccucucuggccuuccaccuggcccucuucuuuuuggcuucugguuccugacuuccugacuagggaaacccugcuucaauacuuucuccucuccaccaugggaaauauguaauuacaggucacuauggguguccccuccucugccaauggacuguguguuccaaggucaagagccagcccacucuacucuaagugguagcacuggcuauggggcugguaucaaugggugggaggugaccggccaacugaaugagcucaugcagugcgcagagguuuccugcaugcuuuccugggcccucugccccucugucuuggcuagaaaggcugcauuuuagaggguucugugggcucugaggaagaaacaccccacacgaucaggugguaccuguccaccuggguuguuggagguggcccguuguagccagagggguuuucauagacauguaaaccaagucugugggcuuguugggcauacccagacauguuuuacauggugcugguaggcugaccccuuuccucccacuguagcugugggccucucacuauucccacacaggcagccaagagugacccagugacauaggcuaccuaggcccuaggccaggaccucacaccuuucucagaagccccaccccuugagggugggugccgguggucugaugggacguccgcugggcuggauauaguaucucugugcgggcagccggcagcuggccaccucaaugccuacacagaugucucuuuaugcuccagaccugacuuguggcuccuggcugccugggaacagagggggcgcugugcacaguaaccaaccuguguccuuggcuauggggugaggugggagacagagguggggcagugaguagagaggauacacgugggccucacccucugcagcucauaggaacacaucaaaugggcuugcugaacaucgcauuggggugcugcgcaccuaagcccugucucucagacuccucagaggggaaccuucaauggcuccagggugcacagccacacucacuauuuguuccaguuucugcuccucuuaacccaucuuuugcuguggggcaacaugacaggcaugcacuguaccuuuuguccccagagcccuuugccccucuggcucccugacagaccugcccucccucagaaccccuuugcaaaagcccagaucuucuuggaagaagcuucggugcaggagaaagguguggcgcuccccacaucagccugggacuuuuguuuucuugggagcacaguagccagugugacagccucaucgugucccggugcuuucuggguacuagaccacaggcacacugccucaccuggcucaaauucagguugcuauuucacagauggagaucuggaggugaaggguaccuuuagcuuagggucccugcaaggagcugccguggagggccucggccuucccuguucugggccaguggaguuaucccucgaggccauaggagagggaagggauacagagcaguggaggagggagacccaggagcggaggcaugaauggauacgccgaggacgggaaacagcggaugaggagcgggcggggaggcagcaugcugccaacccaaacagcccagcgugccucagcccagcauuuaauccacaaaaauuuccaucugcuucuggagcccuuggaacccaggcaaggaaaggccguucccucagcaaagcaaacaggccuccgugugcgcagcgauucccugugcuugcggccccagcugaaaggcagagucagccauuuuguagaugaggcccugcaggccaggccaggucccaccugcaccgcaggccuuccgugggugagcguggagaaggugcuugcuacauuagcagguuucacuggcaaggaccuacuggauacaccugccauucaguagggguuaugugagcuacaugccacauugggacugagaaggcuuuccccaucaagagaggcccacugugacaccauucaugacauggcccuggcugucauuugcuauaccagguguucucaauggucucuguguacccugaggggugccccuaagugcgccucaugccugcuauccccgcucuguccacugccugcuuuaaccagcccaugguuuccggagcuaccagggacaaggccagggccaggcacggcuggcugccccuuucuaggcugguccuuuccuagggagggagggauggcucuagguuggaagaucuauuuuugguggugaccaaacugcugcuuaauaugcagagcuggggcaagcuagggugacaaguuuaaaaagaggcucauuuugaccaaaauacauguuuuucugagguuggccaaggaggccaggcagggccggccacacggacacagguucacaccacccucacgccccauccccuguggacgguacccacugccucccuuuacagaagcuacugauuacagaucacccaacagcccuguugaggccuggggccuucgucugcugcaggcugacacaugugccucugucugcugccugcccgucucccugccucucagaagcagucacacccacagaaguugacacgggcuugagcuaaauuuucaaaaaauguaaauuuccucuccagccaauauuugaggccuauaaauagagucacucaggagagcugguguagggcggggaagugucucccacacagacagggagagaaccaucccaggagaaaggaguauggagggaaaggaugacuuuggggugggggcugcugaggacuggucacugucacagugggggaaacugagacccagauuugggaggacugcucagggaugcagaagagguugggacggagccaguugcuccucacuuucucaugcucacauugugagcuugguggucaguuaucagcucaguggucacaccugggccgcuuggcucucgaauauucacacaguacugcccaugccacaaggcccuugcauauaaugggccucuggccugccuggggauccucuaucagcgcugagugucagcggcagcagagcuugcagccuagaggcuggcuccaaaggcauugaaggagguucagguuaugggaugcgugacacaggcaggcaacgauggugcaggguuugugguaugccugugugcacgguggacagaacacagaugcagcauucaaguaaaggaacuaggaugacccuuggcauggggcucaggggcugggugagccuaauacaggcuugagaugagcacugagauucugucuacagcaaaccagugugguucucccacaggggaaugacccccggaucaggccagacagaagacccuggaggacacaugcuuuuaauuucuccaaauuaaugguaacugauacaaaguauccucucugccuuggauagagaagaaaacuuaggcucaaugaggacaguggggguugcuaaagacagagagagccauccaggccccauaucuaucuguaguuuuugagguccagaugcuguucuugucauauggaugagagagaagaauccuauccccucaaaagacugucaugggcugaaaugggcucugagacuugcugucaagauaggcaggguauaaggccauuuucaugcugacuguuauuguugggaagagcgggggcagagagugccuagcaugcaaguugucaggcugggagaguccuggaaccauggcagacugcagucagaugguuagaggaccggggcaaggaaaccagcuggagauugcagcuaccuuguuucugaggcaacucuugggagucagacauagcuuuccuuccaaugccaguccagggagaagugcccagaggccacuaggcaugugcgucuccugcuugagcaaaaugagagccaucuacugcccugauagucugcuuaugguuugcuaugccacagucaucugggaagagaagggcuaugaggccucuagcuaugcaccccaggucugccugggguaccagcaacaucccuacagagccacauacuaugucgagcuggccauagugcugcagagagcugugucaggaagaguucagugugaccaguuccucuucucccauaguuucucaagguugcaaccuaacagucaacagugcccuuauacauccagcccucugcuggaccugguacuucuccucaagcuauaggcugaaaagguacauggguauccaguucucacagacuucccuaagcuuuucuacugagccuguggcugaaggcaaccugcuccacuaaaaaaagacaggaagcccgugacucacacuaugcuacccauuguggcuguggucauuuucugacauggugacuuccuucugggagagguuagcagcagacacuucccuauagcuuuacuggggucuuuugcaaggacccuucucaaacuccggggguagccugaaggcagaauggaguggcuaacaggacgcaggccuggcuccuuugguccagcacugggauuucagguucucuucaugaguggccucccucagaguguuagcugggcacagggacuccccagaagccaugcccacucccgcccgggacuggggugguggggcgcugugucaaauggugcuuucauuauagguuuaucuuugaaacccuagacaaaacagggcuugugugguuugacuaaaggaccagcaccucaggacuucaccauccacuaagacggcuccucaggaaagaaaaaauacacgaaccuuaaaauaaccaguucccagaauagcaaacgaaugccggcuucugaagggagcucuuugaucgucuggagccccaugccuuugccuguuuacggcccugucacucaagaguagcccagcagcaaggcaaagagggguguuggaguggggcuggggaacaaguaagaaggagaacucagugggggagguagggcugugcuguguccuaggccgccccacuuucuaauguaaccagcccgugcagguagcaaggcucuuaauggcggcuggcaaauuagccuggaguauggccuguggguuccagguuaugguucucugggacuuggagagggugggccauggacuggggaggaggcuuuggagagguagcccagggaagucuuauaaggaugcuuuccuggauagaugggaguuuagaggcugccucucgucccucuuccccuccaugccaucuccacuuggccuucccacucuccugcugguguucacagagcuucuggucuuccuguuaagucauaugaaacagcauguccaacagcuuagcccuuaccccauauuaucuucagaagcacuggguuuuaaugaccuaauuuuaauaaauuuaaauugaauuacacauagauccuuaacugaguuuuaaggaaaucuaaagaaucuacuuucuuagacugggugugguagcucagugcccauaauccaagcaucugggaaacugaagcaagggaaucacuguaguuuuaaagccagucuuagcuacacaguagguuacaggcuagcuugggcuacaacgugaguucuaggucagccuggauugcagagcaaaaucuagucuuaaaaacaaagacaaccgccccaaauguccuuuccaaguuguaaauuuuaugaagucuuaauacagucccagaagcucucaugaaaacccagcuuucaaauugagaugggccauguguacaaaauucaucuggcuucugaggacucggaauaagggaagagaagcaaccguuuuaauaguuucuguauuaauuauauugaagucauaguauuugggguuucuggaauuaaaugaaauaaaugacugugacuuuaauuuuaccauauuacuuuuuagggcagcuauuugaaaagaaaauauccauguuuagcagccaggagcugagcagacaguaggaacacuagagacugagguaagagcuucccaaaggcagcuaugcaccacgagcuuuagauucuacaaucuuccuagugacucuggccauuagaaccugggagucucaaggcagaaacugucagcaagcucagaccuucaaauagcucaaugggaaagucaacaaaauuagcccacucccugagaagacugucaagauggcuuuaacuguuaagaggaagggaacaguuuuugcccugggaaguuacauccucaagcuaguuacagcucugauuagagcucaaacucuuaucaucugaguggucuggaaaaucuccgagucuaggacugaaaggccaggcuggauguaugcccauauguguagcaacaggagagggaaugaaaucaggcaccucagacaaggcagcgggugugagaaagaaguagauaaaacugcugauuguauuuuuaaaacccacauaugcacaacacacacacacauacacagagagagagagagagagaaagagagagagagacagacagacagacagagacagacacagagagagagagagacagagacagacagacagacagacagacagacagauacacacacacauaaagaacacaaaguacaauauccuuuaugacuauagauacaagccaggcauggugguccuggaaucucaguauguggggggcaaaaucaggaggaucauagugaguuugagaucagcuuggguuacacaguaaguuccaggccagccugggauagacuauauaaggagacucuguauuaaccccuaguucccccucucauuguauguguguauuguauuguguguguguguauguauguguguguguauauauauaucuuuauauacauaaauaguaauguucuuaccacaguauaacaacccgagcccugcaaaauuaaaaaaaaaaaauccuucaucuaccaugaccaaaugggguguaucccaggaacgugagauuaauuuagcacccccaaaauuaguuacuauaucauacuguauuaauagaauaagggguuaaauaucacauggucaccuugauagacucagaaaggacagcuggggaaaaugcacauuuacuuuugcucagcucuuagugcacucagcauaggagaacauccugaacucacagggagcauugaugagaacuccaaagccauccucauccuuaaugacaggugacaggaggccuucucccaggagagucucuagucauuccuacauauuacugacguucaagcuagggcaaggguggugggaaggcggcgagagcaggaaggagggaaggaaggaaaugaaaggcauugggaccggaggggaagaaguaaguuugccuucauuaucuguagcaggaguggaaaaucuaacagaaucaacagcaagaacaaaacaugaagacuaagaauagcaaguuuggacuuucccagaccggccaaagauugaguuucuagcuccaguaacauacaaucccaaagugaaauuaagaaaaaaaaccaaaaaacaaaaaacaaaaaaaacuaaucccauuagcaguuguauggugaauaaaacagaagugaaguuaacaacaacaacaacaauacacaaaauguacacaaacuacaaaaaaauuaucaaaauuucuaaucccagacuuuggcugaggcagguggauuuuuaauuucacaguauagcuaacuaguuccaggcuagccugagcuacagaggaaaaaaaaaacaaaaacaaaccuugucauaaccucaccucccaagaacuggaggaaguaaaacagagauagcauauucauggucuaagaugucuguuuacccaaauggauccauagauucaacagaaaaucccagaagcccaccacccuaccugccugccuuuucuacccccaauuucucuuuuaaagaaaaaaaaaauacaaguucaucuaaaaauucagaugaaaauaucuagguaucagaccaggguaggagaaaaaaaaucagaauauuuucacuacucaauuucaaaacuuacuguaaagauccgauaaucaagagaccauggagcauauggaccaagagaacgggaaugaagguccacaaagaaacccauacauuuaugguaaauggauuuuuuuuuuuuuugagguagcccaggcugacuuuaaacuuuguauaugcuugagucugguuuugaacuccugacucuucugcauuaguuucccaaguacagggauuaaaagugugcaucaccaugcuuggcuuaguuaauuaguuccuaagaaagaugccuuugcuguuugaccaaauaaaagaucuuuuuuuuuuuugacuaauggugcugugcgagugaaugaaaaagcagcuguuugugugguacuugcggguaggcagauauugaagacuauuagauaccagucagaggucagccugggcuuggccuacaucuucuuuuguuugcuuuuauuuuuaguguuugagacaaggucucacuauggagcccugacugaccuagucaccacauagaccagguuggccuugaacucacagacauaggcuugccucugccucccaagugcugggauuaaaggcauguccaaccaugcuuagcccuugagcuauacaccuuuaagaggcuaggaagauagcucaguuguuaagguacuugcugugcaagccugaggaucagagcuuaguucccagaucucacauaaaaaagucaggcauugcuggcacauauuuauaacccaggaguuggggaagaagaaacuggugggucccuggaguucguucaccagccagccuagcauacuuggugagcugcagguuaaucugagaacuuuucucaaaaaauaaaugguucugaaaaacaacuguugaaauguuucuuuggucucuaaacacauauacacccccacacauguguaucugcacacauacaagcacacacacauacaaagccaaguaaacaaaaacuuagaucucaucucacugaauacucucaaauugccucaaaaaucuaggccuaaauacaaaagcucacucucuacaauuucuagaagaaaaaaauaaaaaugaaaauaaaaaaagaaaauguuuaugaccucagauaggggaaagagaucgaagaucgucaaaagcaggaaccauacaaaagacaaauuggacuucauuaaaauuaaaaacuucugagauuuaaaagacaauucagaaaaugaaaagacagccggagauuaggagaaaguauuugcaagucauacgucugauggaggacuuguacccagaacauauuaaaaacuccugccacucgacaauagagcggaguaccuaauuggaaaacgggcaagagaguugaauaaacauuucaccagagaagacuaugaauggcuaauaagcacaugaaaaguugcucaacaucauuagucauuagggaaaugcaaaucaaaaccacaaugagauaccauuacauacucacuaacagggcugaaauagaaaacccaagcauaccgccugguugcaaggcugagagaaagugggccguuuacacacugcugaugggaaaacaagggcaaaaacaaaacaaaacaaaaacaaaacuuuagaaaagagucucgccgccguuuuccuagaaagcuaaacagaaauucacccugugacuucgaggaaaugauagaucaaauagauaaagagauuccagcgaggauagagaagauuugaaugaaacaaugaacaagcuuguucuggugcuuguaaacacagcccugcauccagugacugccgaauaugcuucaaguacucgggggcgccuuacaaaggcucagcgcaugguuugcuguaaaacauccuucaaaacauuccaagggguugauaucccaggaccacuugcucugacagugaagcaauguuacuagaaaguucuaccgcaguaauaacaaugaugaaaaccacauaguuaugcugccguggcauaacucuuggaauaaacaagaggugauggagauuagaaaaauacaccauaagcagaugaaagcgaaaguaaagcucccuuguccggagugugggggagccuggugcagggcccugugccugucaccccugugacgaaggaggcuaaggcaggacaaccuugaggccaaacugagcuacugagugagauucuggcucaacgaaaguggcaugugccuuuccagugaugcuuacagacaaaaaaaaaaaaaaaaaaaaaaagcuucacgggcuucgaaaucuagaaaaucuggagauuaauaauuaucuagcuuaagaaguuagagggagggaaaacauauuaaggccaagugauuagaaagaaagagagauaaacagacuagaauaagcaagauaaaaacccacaggcgggaagauccacaaagccaaaaguuuggugaaaauagcaguaaaacuggagaaugcauggcaggcugggcugccgugggaaauggggccagcguugauaaaugacaauggggagcaggggcaaaagacagaagccgccgacaccaaguaaacagcaacaaauugaaaaccaagauaaaaaguacaaacuccucagcucugcugcuuaucaaaacugacacaagaagaaauaaagagcccuaguaguucaugaaccucagacccuguaauuaguaguuaaaaguauucucacggaggaaacugcagccuggauggcuuugccuugaaauucuaacaaaugagagagagagagagagagagagagagagagacucacagaaaguauuccaggauguaggaugggugggaacaccucacuacuuaaccugugagacaccaugacucagcaaagauggcagaguaggaucaccuggauuugggcagcauuugagacuuaugugggaugugagagaugaggucgggaagucugcagugauaucuauguaauaauuccccaggcagagaacaugaagaccugggcuuagcaaauacucagcuggagagcaaggauggagcagggcccagggaucggccugggaugacaaggucucauggugcagcuuguaagccucauggauagaagcggacccugaaaggcagguauuggaggcugggugguauccucuaacaggaaauaaguaugcauggccuggcuucuaggacagaacuaggcagaaaugcugggcacuggggccucucccuccaacccaugcucccugcccccagaugcccuguggacagggucuggaaaccagagugccccuguguccggcuucaagccacaaacauuuccugcagaaaacaagaaagucagucucuuggccccacugugcucugcauaucagcccgacagugugagcuuggcuuguaaaauaaacacugcagcagguccagguccaagaagaucuaagaacaccacggguaagaggugggugggaguucugcagagagacagggaaccauagggaagccgaggcaggccagggaacagaagaggggugccggaaccagaacuccgggguuccuauuacagggaugacaagguggcuuguaccaucuugaauugccacuaguccugacuacuauagccaguggacaaggccaccaccuccacccagccuuggcucucagaguugauucuagccuccuuaccaaaggacuaucacacuucugaaauguucuucucuuacucacaucugugacugccaucaggaccagcucuuuguauaacuaacugcgugacaggagacugccugauuucuagaacaaaacaauccauaaucuacgacaaaagcugagaguguauaauggcuacaggaagggagccuauggguaugcucucccugguaugaauuccuggcuggcaccuuagggaacucuggcugggcucagccagccuggcuggcaccuuagggaacuccuggucaggaaccagcuggccuccccuaagaaucccuuacaaguagacacacucaauaucuuugguccuuagcuugauccucuccuuccaugggguccagguguuuguaagugggguucagucccugugaugugggcagacuauggugggauacacuucacagcugagggacuaagcugagcuaggcaaguugcugggcacuaaagacuugacuuuggccagucuguagcuggccuggaggggugggagggaggggcugucagcagggaagcccaggggcucuggcugggcucagccaggcuggcuggcacuggcucugcucugggacugcugggcucccagggauuuccuguccccuacuucccaaggucagcaggauugcgcuuggguuguuucuggucccgaugguuacguugauaacugugauaacguggggcccggccaugccaucgugcccucugggcccaacaaagcucuuucccagggucuguccccacagggggcaguggucccggacaagggagggacugggcaggcugccaugggcuguuugggucagugcaucuugacagccucuugauguacaguggggguccaggcuagagcccugggaggagccuugguucagugugaccauggccuuggcagaggacccacuccuccaucuuaaccaucuugagguagggagugaaagugagaguggugcccauuagguguuugcugcaggauuccagcauucuugacaaccuggcucagagcccagacagggucaaggucaccaggaccucugaggaucggccuagcuuuguuccuaaacuuugcucccagaaaccauggacucuggaaaaccagcccuuuguuguccugaccugaugaaguacuggcauguacuucugccccugucccugcuccugcuccugggccaguacaagcuccaccuuagucauauaaagcugugaccugcucuuaaacccuagacugcugcuagucagucauauauugagucuggaaaggggacacugauuuuaggagcuauuaacaaucaucuucugucacuuagaagagauaacagguuucuggucuggguuugagggguagccuguacuauagguaaugagcagaaggagaaagcuggaacaguuagaaugggguagaaauuugugguggagaaauuaucuggcacuggagacaguaggcauuugugucaacaaagcguagggagucuucaaagccuuauccuaugugggccagacuaucuuuugccuaccuucccaguugcagcucauauugagagucagaggcaaauguugcuagagcaacccagcagcaaccacacucaccacucaacugaaauuccacuauuuuuagcuuccuaguuauguucagauaaaauccauguacacagacucaaguugucuggcaagauaacagcacaccucaaaccgcagagacuucgaagaccagcaguggauuguaccaugugcccaagaaaagucccccuaugauccagagcuuccaguggcucaugaaagguaggguggugggcacagaagguagggggcaauggaggagccuauuugccuagcuaauaccagcugugacauucugauagcauaagauugucggcagccagaguaugcggaacgguagcacucuacaggguaugcacucuacuguacaugggagccuacaguaguggauacuaaaaauagccuggccgggcagagacagaggagccuagcacacuaacucaagcuggaucuuccucaccagccagguccaggauaaguagaagcugacaccauccaggaauccaccccagccagguucugcaucuucugaagguuuggcuuacccaaagcaaggaccuuagacaauuggcuuauggggaggcccgugugaaucuggcugcagccaccuccuggcuaagacacagccaggaggcucuuagagcucuaaggguaaggaguggagggggaaagcuaggucauguuuaagacuucagugcaucuggcucugcaaucucacuccuaccuucccagggcagcggcagggccacaggccuugggacaccaggcagaagcagccaauaggcaggucucugacuuugcaggcacacaacugugaaguguuuuggcccagccacugugcacacuccuucucaagaacuucacggaggaggucagagggguguggagcuaagcgggggcacuugggauacugcacuggccgaggaugguggcaauuaaagcugacagagcugaagcaggaaccuaccuugucuuccacccuguucagacgggcaccgaugguguuacugccacggucuuugcucuuuucuaugggguaaagcacaaagucagggguaugggcugugggugugggcucaggagccuagggagcaggagauggggaagggguagcuggggaguggggugggaugaaugcuugaaaauacaagacuuccuuuaaaauucuuuguggcugggacaccagggguugggggaaggguagauacuauaaugacagaguguaucuaggcuccagacuugcuccuccuagcuugggguauguuccuucuagcuucuacacaggaggcccuagugaccugugguaaggaaguuaagagacagacaggggugggaaagagagccccuguggguugcucucuccagguaucaguguggacacccaccugagauggggaugaacaaagauggcuucccaauggacugauccagccuggagagaagagaggaacaugagcuuacacaaugccugaggcaccacagagauaggccauuguguccaggaggacagcaugacacccacuccaggggcaucugcuacuguuacuccaagaccagccaagaggcacccaagacccuaugugcucaugcuccugagagguccaggcaggaaguuuaaaaaugaggagcagaaucugggcuccuuaggcuuccucucuggauaagugggguccugaaccuuugaccuuguguauggaagggacagucacagucucccagcugcacuccaugauauacagagcuaggucugcaagcuagcucaugaaacuagccuccuagaccuauaccugugcuggacccaggggacuuugauggaaauaggauucaagaccauguuggcucugaauggucaggauccuuagcuccacccaguagcagaaagacccauggauggauggguaaccuagagggagaugucacuaagaaccuuuuccuucccugugaggcuggggcgaggucuccuuucugugcccaccuucucuguaguucuuuaaugcgcaccauaagguucagguggcccugggaguacugcucgaugacaucucgcacgucguagggcuuccgugcuugcugcaggccagaaagacacgugucauuuucuccugaaucguguaugcucaauucucaacacagugaugggguggggugcagugauagggaggaauggcuuagaacauacauaguagcaggcuugauccccaaaggcuuagccugucugggccuuucccuucugucaguucacugguaggacuagccagcuccuacuggcccuuuugguuccaggccuccucagaagaguuggccucaugggcuggagacaugguccugcauacccacaguucaucugggcccuagacuucucugaggggggagguggaacaacacagguuguagauggcucacaaugccacaaagacuuuccauaagacagcccagcucucgugaaggaaggaccugccaugcucagggccauucuaggcaccagggucaccacauauucuguggucuacacauccagggacuacugaguccaagcuugggauaauacuuaggcagauccuuggucuuguacauacaucacucugaacuucuacuaagaacuacacuugaugauaucuccaggucuuacucucuucuguaagauggagauauaagcccugauccucccuucuccaagaugcguuucugagccuugucgcugucuucuguaaaacaggacacugaaucuuguuccucuuuccuggauaauggguugcugaagucuacgcugcuacuucuaagagagacugagaauaaaauaggaccuagaugaggaaggucaaggaauccugaugcaguaccuugucagucauagguggucaugacugaguccagggucugaguccuuccugaaagggcacacugaaagugacccuaaguaauaggggagagacuugugggagaaaaugcuuucuaaggugugugacaccucuaggcaugccuggugacacaugaggugaaugagcaagggaggcagaaacuauguguuugagguggugcaggccuggauuagaagcaggacagauccuuauguuggucuguggauagccugagagucugagagccucugugcccaagugaacauggguaccucugcuagccucugcaaacauacaugugauuguugaauauguaguggggagaagugagucugccaggcugcaggagggcagggggcuguaagcaggaaacaguuaagaaggaucagagagcugaccagugguggugcaugcuuuuaaucccugcacccaggaggcagagucaaguggaucucugaaaucaaggccagccuggucuacagggucuguuccaggacagccagagcuacacagagaaacuuggucucaaaaaauccaaaaccacaaaacaaaacaaucaaacaaacccagaaggaucagagauacccuaucaaccaaccacccguggucagcagcacuccaggccugcugagacuugucuuggagccacuaagcuccccuuuagagucugguuggggauugaggagccuuugucaaauauuugccuaaggcucauguaagagacaaucuuagcuuucucccugggccaauguccccugguggcagcacgagccagagaugagccagauaacgcugccuguccagacugauuggcuguggacgugggugcucaaggcaaacuuucagagcuaagaggcccuggcaccucaggccagacacaagggcagcuggccaagcacuuuaucggccagcaaggcaggcaggcaggcaggccuaaagucaggucaguauagcgguuggagagcaggaggguggauggcugaggcaagaaagcugggucaccaggguggccuggaagccuguggagcccuccccacaggggaucccucuucaacuacuucacucuuuccuggaggccugccaccaccugcccauguguccccagcaauaaagccagcucacuguagcaccccuacuuuucucuguaccccauaaggccucucugccaccugggcuaaguguauaggugagaagcagcgagcuggaaggcaggagcaguuuggccuguucuggcaguuuccugagccacucuuaggacauuggcuaauguucugaggccugacacaaagugcuccgggucucuuuuucaucagccaccaacuaugucccuuguuugugacauagaaacugggucugcguaggccacuaagaugacucugacucaaagggaccauaagggucccuguguuccacuggguacccagagucuaaaagugaaccccagggagcccugagccuaccugcugcaaccccauucaacugagcaguuccuauacuguuucauguagaaccuuuuccaucacccacggagccuauuucucucagccuggggaccgccaucaacuagcaauuccucaugacucuuuaaacacuagcaacauaagcuacaccacuuccuaguaagagugucacacccuagccccacuuuuccccugagagauugucuugucaagauauaacuccccaugggguuccugugguuccucaccaaacugggaagagcugguucuacagguacucaacucccuaucucucucuuggugucucagcagugggacuguaggucacguggcuucuagguaggggggagaaacagcuuuaaguguaauuuuuguggggccuuuggacccuucuaauccauuuccaggugcuucuuggcucuggccccugcucagugugaccuuuacuccuuuugacaacaugaagucccuagguuuguggaagcuugggcauaacuuggucuauuuguguugugacaguuccagggggugcaggcuaacaauuuuauagcagagugccacuguguuaugugcuggaugggcauagggucccuccaggguggcagugaggagcuagggugagaagcuauaugcuacucucuuuagugucagaggcuuggcagggggaggggcuguggcuguucuuagggcuagaacagcugaggagcugaggacgacagugagacucaugucacccaaggcuccucucaguacaaugaugacaacuugggauggggacuauaccuuggccucuaccuccugcagagucuagagguuuuggcugccccagagcugggguggggguugugaugaggggguagggggagccaguguuaaucucauggccugguaugguaggcguggccuauaacaaggcacagggccaccacugagauuguccuugggcaggcuauauauacuaagguggguugccccagccuucucugcucagugacaagggcuuuccaguaagagaaugcucuccagcacuuacugcaucuacugacauguucucagagugaggaauaaggcuuuccuccccaugacuucugcucacaacugucccagaauagaggaggaacacaaccugcuacccucggggucucagcagaacagcugauacuaaauggaccccagcagcagcucugccaacgcaggagcccuggucacuaaucaggccccaguauugguaggguaggauacagaaagcuccaagcuagcugaggacauaagucacuuaggacagaugucacuuccaguccuggugacaaugccaggcugucaccaucacagccuugcauggaaggagaaguagucccauaaaguuacuucuaacaaucaacauagagcgauaaagggacccugggccagggcuggguacaguacccuuggaggagccugcugucuuggggaguggugauggucuaagggguacagucacagcaugauggcaucuaagggugagggcauacuacuacuguagucgucucggggucaacugcgcuggguauggucucaccuggaauuucuucuuggcuacaaaguacugcaugcgccugaugaccuugaugguggcccgauggugaucccgcagccuguggaggagguggggcagagugugagcagccuucacauuggugaccccacaacacauguuaaagguaccccugccaaacauggguagucucuccagaaacaagaacauucuauccaggacuuguucugucucuagagaagcuagacauaaggaguuucugcaggggacagggaaggaugcuacccacagauggggagaacaacuccuuuccugcuuuuaucucacaagugggguggcugucuguaccccuaguuugcaaggguuacaacuccaacagcauagucagggaaugcccuaggaggaggguguacuacagucuuauuaaugaagauccuguuuccugagacggcuuggauacuuuguugguuugcuucuaaaucuccuucuagaaauaaagucuuuuuauaaacaucacuggagaaggcaggccugugaucagacaucugugugcacagaaacagacuggaagacagggcaauggggagacugggaaaaucugcugucugcgaagcucaaauuugaccagccaggcuacaccgcauuggcaacagagagcugcugggagccuuugggaaagggagacuggaagcugcccccacccccuagaaaacaagaggcaagaggaagccagacuaaccuccaggcugggcuuccuucucagaggagugugggaaaugucuacaccagaugggauggugggacuuccugggcugugaagaaaacaguggagccuaggcuccagagcuaccaggagacaagugacaagauuccggagaacaaaggcuaucaggguaucuuuuuuucacacgauccccccuuggaaauagcugugguucucacagagcaauaguagcugcugggagggaguaaaaauagaagccagcaggcucuugccaccgaggacaggauucagacccuucuagcaugggaccccuggaaacauccagaggauuugguugagucuggcacagccucacauugucucaagcguaaacuagcccagcuuucuuuuuuguauuagaugaaaaucuguagcgagauauuuuggaauuucugggguuugcuuuguuuuguuuuuguccauacauaaaaguugaaaaauaagggaaaaauagacccuagauagagaucugcagguguggugcauuuugcaaucuuaacugcuagaggcccucccgcaaggagacagugugguuuucuagcugcuuggauuugagcugaccuugugaccuaauguggcuguagagcucuggggagcucuccauguguggaacccacagguguugagaggguggcuggaguggcugaagggggacgaguggaggugaccagccuucagucagcacugauuggagguaugugacucagccaucuuggaucaccuggcccuaggcaagcuacugaugacugcaucugucugagucagcccaagcacaaccacagaacuaccuuccagaggagcugaguccaaacuccugacccauggggcuguuagcaagacaaaugacuaguagaccacaacauuugguuauaguuugcuguucaguaauagauagcugauaaagaaauuagaagcuggaccuauacucccagauauuuagaaggcugaggcaggaggaucacaaguucaggcacugucuagugaacagagugauuucaagccagccugaacaaguuaauggcaucauaccugaagaggcaguucagcaguuaagaguacuugcugcuugaacucccaaagguacugacuggguccaguccccagcaccaacaaucucugacacaaguuucaggggauccaauacccuuuccugaacuccaaggacaucagauacacacaugcugcacacauauacauguaaacaaaacauccacauauauacaauagaauaaguaaaacuuuuaaaaagaagaagaagaagaagaagaagaagaagaagaagaagaagaagaagaagaagaagaagaagaagaagaagaagaagaaggagaaaggcagggagcuggguguguugguaugcaccuuuaaucccaguacucaggaauuugaggcaaguucacucugugaauuggaggccugucugaauuacaacagagaguuccaggccacagagugagacccugucucaaaaaaauggaauuggggcuggaaacagaucagugguagagugguugcuuagcaugaacuaggccguggcuucaaucucuagcaccgaggaaaagagagaaaugaaggaggggaagaagaaaggaaagaaaaagagaaagaaaaagaaaguuauuaauuagaaccccgagcugggacauugugaugucaacuuuguauaaaagauuugacguugauuuuaggacugggaaggggugggggagcagauggcagaagauugggauaugugaugguguuugcaguuguaagaccucgaagucuguuuggagggagaaagaacuuuguuucagggaggacugugaagcaauggcuuuuaaugauagcugaaaaucccuucuuguuccugccuuguuccgccaugguggaagcagaucaugugaucugagcuucggccucaagagaucugcagacuucacuuuuacccucucagaaaaaaaaaaaaaaaaaaaaaaaaaaagucugccuccuggacaagcccgagcuagccugcuggaaaagcugagugaaggaagaaaggugaaggguucggaugacagcugacagcuucaggcaugugaggcugacacugcucagccaccaagugaguguucugcccccagcagugcgcccagcagagcagcccaagucugaccuacagagucauugguagauaguuggcugugcugugcaucagacuuucuagaugagaacuuuaagauaacugugauaaauagagucaggaaaauagaugagaagaugagggauuucaccagaugauaaaaguuaucuccaaauacugaaaaagaaauucuauaaaagucaggcaugguggcacaugccuauaaucccaccucuugggagguggagucgggaggaucaggggguuccaggucacccuuggacacagagguucgaagccagccuauguuacuggagacgcugucucagccucauucaaagucucccucucaaaaauaaagaaguaaauaaaugaauuaaagaaggaaaagagagagagagagagagcgagcgagcgagcagcacacugguggaaauuaagacuacauacaguaggugguuugauaagaggccauguaguaaaacaagaaagaaaaauaguaaaaacagaauggauaagaauaagguggcagagaauguggguuuaagugaauugauaguucauuaaguagaucaugauugucagucaggauuaaaaaugaugauaugaauucacuaaaagcaaagaaaagagaaaggggcagagaaaaagguggucuagucuagcuuucuaaacagcagcugggaacuagcaccagguacaguagacuagacaaagaaaauuucggacuuucaaagucucagcucugggcuggcuguuaaagugcuugucuuacaagcaggaggaccuggguuccuuucuuagauccccccaaaaaucuaggcauaguagcauuguguuugcaauccuauggcuagagagugggacacgaagauuccuggggcaggccagugagagacccugucucaaaaagaaaaacaaaaaaaaguggucugcagcugaagaagggcacuaaagguuguccaggauucccauccaccuugcuucccuggcaauggauaccaaagcaccagcagagcccaauaugaacaaucuauaugucaguccacccagacagggacaaaagccacaccacggcuggccagcacacacaaguauuuacaaagauaccaagcgcuagguuuuaaaagcaaguuucaacaaauuucaaguaaauaaaaugauguuuaacauagucuuugaccacaauaaaauuaaacuacaaaucaaaaauauuacuaggaaauccccaagugcuuuggaaauuaaaugaucuaaguaacccaaggucaaggaaaaaaguuacaugaauuagaaaauaguuuuaauugaauaauaaaaaauguaucaaacauuacagcuaaaguguauaccuauaaucucagcaacucaggaggccaagucuugaagaucacaaguuugaggccaacccacgcuauuuagcaaacuggugauuuuuuuuguuuguuuguuuuuuguuuuucgagacaggguuucucuguguagccguggcuguccuggaacucacuuuguagaccaggcuggucucaaacucagaaauccgccugccucugccucccgagugcugggauuaaaggugugugccaccacgcccggcugcaaacuggugauuuaaaaaaugacaagauggcucaguggguaagggugcuugugcccuagccugaagaugugaguuugauucccagaacucgccugguagaaggagaaaaaccaacucucaaaaguuguccccugaccaccacauauggggcauggcacuugcaccccccccacauacacauauacacagauaaauaaacaauauaaauuuaaaaauuguaucuucaaaauuauaguuaaauaaacguuggaaauacauugagagaugaacauugaggagaagauaacacauggccuaaaaugugauagaggagaggcugagauccaacucaaguuaacacacacacacacacacacacacacacacacacacacacacacacacauuuaaacccaaaggaagucgaaggaaagagauaauaaagauaaggguguaaguugaugaaauaaaaaaugaauguugcauuaaagaaaaucaacaaagcuuacauuuggcuuuccaaagagacuaauaaaacugauaaaacguuagcaagauagaugggaugggguaaggcgaaucacaaaucaccaauguugggaguuuuaaaauaaugagcaccaccacuguggaauuagagacauuaaaaaaagucuauuuagagaauaaugugaacaaaaauaauucugauaauauagauaaaauagauaacucaucaaaacacguuuuaagaaaagaagaaauaaauacaaacugcccaauggaauugaacuuagaauuuuaacgaucuuucuacagagaaguuggcuuagaugacuucauaggcggugucuccccagcauguaaggaagaagcccccagcuauauacaaagcuucuuacagggcuuuucugagguggccuggccuugacucucaaaucugacaaggauauuccugaaagaaaacucaagggcaaugucuguccugcauguggaagcagcgucuaaaacccagcagccagugagauccggggcucaagucaagaugcaggaucagaguggcuuaauccaguuaugcaaggcuggcuuaacauuugaaaaucaaucaacagaacucaccacaucaacagagcaagaaaaaacauauaaucaacucaaaagaugcagaaaagcacuugauaaaguucaaggcccuaguccuaauuaaaaacacaacuccuagcaaaguagaaaacacaauuaaaaaaaaaaaagaacaaaaaugaaaauugaaacaaacaaaaaauccuaaacacugagcacacaucaagucauggagaaaucacuuuguuccugagauggugugucccauauuuucuaacagagauuguaaagucccagcuugugcauuaagaugagaaaaggagagagaagauggaaggauugggcugccaaaaggguucaauggcuaaaaaggcuugccuccaagccuggugaccucagaacccauauguugggagaagaaaccgauuccaacagguugucuucugacguccucauucauacugugguaggcacuuccuaccccugccccccacaaauauaauauaauuaaaaguuaaaguaaagcacuugggaggcagagcagguauaucucugcuaguucaaggacagccagggcuagagagaucuuaucugaaaaauaaaacaaaucaaaaauaaaaccaaaacgaaauaaaacccccaccaaacaaaccaacaaacuauuaagaaaugaauuuaggagaacccugaccuugcugggauuggacauaguagcucauguauguaaucccagaaaucugaaggccaaaaaaugaggauuggaagauggagcaagccugguuuuacuaaagguugaaagcuaauaauccauuaucguucuaucugcuagcaauaaguaauuagaccacaaaauaaagacacuaacuguaauagugucaaagcuaauagagcuauuuaaauuguuagcaggugagacuuauaggcagacaagcacuggauagugagaagcggaugcugacuugaacucauggagguuauaacacauucuuaucuuggggcuggagagacggcuccuugauaaagggcacugguuugcucuuccagaggaucuggguuugacucuucccuauuucucuguguagcacuggaacuuucccuguagagcaggcuggccuggaacuuacagagauccaccuaccucucucugccuucugagugcugggauuauaggcaugccccaccacugccuggccuggguuuaauucuuagcauccacauggcaguucacaaccaucuguaaauccagucccaggggcucugaagccuuccucugauuucaagggcacugcauguacauggugcacagacaugcaugcauauauauacucauacauauuuaaaaaaaauuuaaaaaccuguguggugguuugaauaugccugggacagggaguggcacuauuaggaggugugggaccuccuaacagugaagaacuggagaaaggcuaacagcaaaaaguuuaggugucuuaucaagguccuuccucaggggagcuucauucaagggguucugagucugcaaacuggcucaagucuggaaauugauucacuggccaagauugccuuuugccaugauccaauguagccuuucuuccauuuguuugagauuuguuuuuucuucauauacagaucaaacagaaauguaguaggcuuccuaucuauuucaugccuggaaacaccaugauugauuagucaguaccaaagguccguacaagucaugucauuauuaaaauucacaucuccugugcugaccauuacggguuaggucauugugaaccuuauuuugucuauacuuuccauuauaauaacuacgaucaacuugccucuggcgauauaaugcugccaucuggcccuugcuaccucagggcccaauuaaacccauugcauuuaauccauccaauugagcagcagcaucuccaacccuaaggucuggcacaaggaaaagggcaagaacaaaauucuucaaaugugcugcugccuucucaccaguuugcgucuuauaggauuugugaagggcauaucuucugagccuucccauuguggaggauuagguuuuauacaacguauccacucuagcauugcaauuucccugagccuuaaaaucccuugucaacacuaagccaagggauaucaggcaucuucaacuccuuuucaguaggccaucuuucgauaaacacuucaacaaaccauucaaacaaacuuuugacacauccacagcauaaagaaaaauacugguaaagccugugcauuaaggcuggcagggcaaugggguggagcaagaccuuaggcguuauaaacauauaugugaccauuggcuuuaucgucgaagcuguuuccaucgggaaccaauguucucaguaaaugugcuuagacaccauaagaagagacagacacugauuccucccucaccacagcugcaaagcuagccugucaggccuugaacaggaagcugccgagaucagggugugaaaggccauagagugucugcauagccuugggcuagguaaagguuuccuuauggacuccugggaacaugagccaucggagaaaaauuccaguaacgcuggacugacaaacuggaggcugccugaaacccuucauuccaggccuggcuugaggagauaugacucugaccuuuuuccaccacucuccaaaggccugaaagugggugaaaagugggauuccaugaguaucucacugggaaggguccuuccucaacugugauuguagauuguagucuugagaaccuccaguuuuggcugugguagccaccagccugaaucuuguauuuccaucccuugguuucuguuuucauacacacacacacacacacacacaaauauauuuuaaaucauauaucuuuuaaguuaggugauucaacaacaacaacaaaaaaaaaaagaguugggcacgguugcacauaccuauaauccuagcacucuggaagccaaggcagaagaguuguagugagugugaggccagagauuaagacucugucucaaacaaacaaguagauaaacuuaagcaaagguuacucagcccucgguauuacuccauugcugaaagccucuuauguagcugucugccauuaacacaguuacaugagcugucauaaaguucuccuuagcuugaacaucuauguuccccugacaaggguggggcuagugcuaggucucaggccuguggacagugcugggacacacauucccuuuucaaggucugaguaccagaguuuccugugggugcaaagccagacaggcccuugcauaccagucaugugacucccccaccucagagaugaugucacauuuuuaaagugauggcuauacacugaggaaccaaaugugcuuccucugcugugguggaagcaggcuggggcaggggguuccuuaaaaaugugaccccucauaaccacagcucuacauauguauucuaagaaacgaagacacaaauucauauaagaacacagaugugagggucauagcagugcaauucagaguagaucuaaaaaucugucagcaggcagacacacacaagcacgguuuguccgugcaacugaguaucauucagccacacaaacuaagaguggugacauuuugacacauaucacaaaacaaauaaaccuacagggcauugugcuagguaaaagaagccagccacgacugaccccaggcuggagagccccagcucuaugaaaugcucagaauagcacauuguggaaauuugagaucggugguccuuuaggcagggaggauacggggugacugcugaugggugaagguggcuuuugagggugaugaaacgcuccacgguuagcuaguggugauggcugcacagagugugaccaugcugacgugugcacagagcauuguagcaggaguggcugccuugcagaucucugcagagagcucagcuggagagauagggaagcucuggaggguggacagaaccccuuucucggguaucccaggaacccaggcaggcaaccagugggcccugaaguuggucucauuuccucucugugugcacaacaguccauccuugccccuucugcccaacccccagacaguggaucacaggggaugcuuccaagagacaaagcucagcuccugugauuccccccaccccacacugcaauccuugcuguagcucccugcuacacccaaugauacccacaucauucucaggguagcucucgguucauuaucaaaaaacaggacagugaacuuugacucucuuggcaggucuaagugaugucucaucacguagaguguucaauggaugguuuuuaugucuuugucaaauuauuuccauauuagccauccaugugagccacccuuugcugggcccccgcccaggccagccauagcagacauucuuguuuggcacuaacauucugcagggucucaggggcagguggcugcaaugcaaaggucacccauuucaacugucccagagcugaaagaggagggugauucuguuuccccagucaaggcucuugggucugagugucugcauacacuaaaaacuucaucuccaaggagacugugguggggccuuugggaggacauuaggucaugagaggggcacccacaugaauaggguuaaugaucuuauacaagaagccugaggggguuuaguuaucucuuuuugcccuucugccaucugccacaggacacacagaagacacuaucuaugaggcagacauaguccucacuagacacuaaaucucucagagccuagacucuggacuucuaucuuuagaauuuguacaguaaaucuucauuauuuguaaaucaucuagucuaaggcauuuugucacaguuagggcuaggacuguacuugacucugagaaaggguguugauaaaagauacgguggugguguuggaagggggaucagagaggggccugugaagcacagaaagagagauugaggagagcucaucagaccuucagagcuuuagggacagucucagucuuccuaggcaugggcaaaggacuacaguuaggaugcugguaggaauggaggcaggaauggauacacuggugagggcuucguagaaauauggaguaaugaaauagcaaagaacguaguggcauuguguuccaggaugcuagugcucuguacaggauggcacuugugagaagugaacaaggcgguuuagcagaagcuaucccucagcaaaguguugauggugccgauuggcuucucuuugcugauaguacaaggugaaaggagaaucacaagccggugauuguuguaaggagaagaaaauguaccugucuagguauacucagcucccaggaggaagaaaagaaugaaaugacuccaggcaugguggcacacuccucuaaccccggcacucagaaggcugaaacaggcugacugcuuagacagaguucauguuagccugggcuagugucaggccagguagggccacacagcaagaagcacaguaagacucucuuucaaaccaaccaggcagauagcaaugaaaagaggcauguucaugauaaagguuggagguuagaacucgguaugucagacgggggaguugaugcugcucgucaggugacacaaagaccaagaggcauuucaggaagcauagcccaccuuaucccuuacaucgcaagcuucugccucccgaguucaagugcagcagcucuaagaugccccagcuggggcuucagaagccaugugaaguguuagcacagugacuaccccuccagugaguggcaagucuugguggccuucauggagucuugucuaccaggcauaggagcuaaggacagauuugucuccacucagauucagaacugaguggagacaaagaacccaaauaacuuuuauacccaaagaacuacagggcugaggcagaacugcuguagggaagggcuaucaagagaaauuccuagucuggacauggugggagguuugucccaaaaauccagagagucagagccaguagcauugaacuccaaccuggaugacauaugggauacaucuaguuaaagcauaguguuacugauaugugggguuuuggcuuaguggauccauaaagugggacaaagaccaaugauucucagcccuuacauauucgugcuaugugaccuguugggguuugaauguacuugagaccugcuagucuuuccuucuuguucauuucuuccuuugaaaggggaugucuucuucagaucagcuccacuacaguaauuuggaagcucauggccuuugcaguuucacaggcuaauagaucuggagaacaaucugccacaggacaagucucaucuaagacucguucauuuuggacacuggagacucuuguauuaguacugaaauaagauaagaucuuugagggcucuggggauucagugaacuugagggagcuaagucugaaugcuaugaucugggugguuauacuauaauccaucuguaacucucaugcauggauggugcaguccuggugugguggcauugagaaguggagucucugggaagggguuagguccugauggccgagcucucaugaaugggaucaguauucuuauaaaagaagucugaggggcuggggauaugggucugacaagcucuugcuuagcaugccccaaaucccuggguuucaccccuaauauaacccagguuuauguucaucuauaauuuuacuacugaggagguagggaccggaagauuagaaguucaagguugccuucaacuacauagugaguucaaggccagucugugugcccuggggauaaagaaggcagaguauaccaggaccuacucuccauaauagcccuaagauaauuagaaaacccuaaguaaguuccaucccgugccaccagcauugucuuugggggacaccagaaaagaacugguaagagugagggaggcuuguguggaagagcuuccuaaggcagggaccugacugucagugggaacacccaggcucagaacaagcugccauuggcagauacgucaaggggguaaaaggcagaaucuggacaaaauaggacagccaggaguggcccaguuugugaaaaugcccccaauagcuucuccuagcuaagucuggggaggagagugggggccuggccacuaacauggggccccugucugacacacuaguggucuguccuaugagaugaacaugaaccaaacacuuguaugaauauaggaguucccuuuaacuagaaggaacaaguuccaagaugccaaucagaugcccaaagucaagggcaguucugagccauguagcuagaggagagacgacacaauuagcagugacuuccuuucccuucuuuacaauuuuacagauuuguucugccugugggucuuggcaaccuagcaugcaacuguuuccuuuccuugcagacacuucuucuuuuuuucauucaaaggacauacuuuguggccucuucagcauaccugcaucaugacugauguauuuuuuuuuuacuauuuuguaucauauuuuacuaauaaguaaaauuaaagguaagcauugugacacccagaaggcagaccuguugagacgguuaccaagugacuaagggguagguagcaaaacacucuggauuugguugacagggacuucacucauaucccaggugggauaggggguggauggcacgaaucucauaacaguauuacaaagacaaacaauuaaaaacucgugcauuguuuauuucuagaauuuuccaucucauauuuucugaccauaguuggaguaauuaagaaagcagaaagggaagccgaagacagagggaauuauuguagccauacaacgacugucuuaggggauaucucaaaggacuagauggagucgggaaacuguucauccaaggggacugacgccaucaggaugggagagcuaaguguaaggugguagaugaaagcuguaaguuggccugcagaaauaaggcuuggguagcaggcuggccugaggaggcucuguguaguuccacuagggccacauaaagcaauacacacacauaagucauccagagaccgaugccaggcagcacggccaugcuaagcaucaugccuugguuuuaugagcgugcccuacccucaugcugaccugagaguuuuccucagacacuccuuuugcagacagacugcauguucaggggcuucccccugugugguagccuccacagauguacaggcacauggcaucaccaauccugucccccacucauugcaugugaaagaauaagggugacacuuagggagugccuacccaggacaaacacauaucuuagaacagcagccugguuugggaggagauguguggccugugaaaggaggauucggucaggcaugguggcacacaccuguagucugaggcagggguacugcaacaaguuugaggccaaccugaucuacauggugaguuccagacaagccaaggccucauagaaagacuuuguuucauagagccaaaaugaacaaaggacagaaagggugguuggugggaagcugcugaccuggcugagaauuuggaccacgggguaugcaggugagucuguagucccaccccacggcucucagcacuaaugaggcguguguuucacaccaggggaagggguugcugggguaggauggaugucugcuuugagaaucagcucagcccuguccuuuuuuuuuugcuaguagagagacugccauuccaggucugggccuucucccaaagguggcaccuguugcuacuauaggcuagggugaagagggaaccuuccugacagaaaaguccuagguucauuucuucccugagccucagcugguuccagucaauucuuugauuuuugggagucuccggaucgaaagagcccagaaaaauaaaaaaaaaaagaaaaagaaagaauagauaaaguuuucauguugacaaaggagcauccugggaggaaggaaugccaaaaagaagacacacugguagcucugagaaucacauaguggcucuggacccauugagguaacaggggugccagugccccaaugucacugauggccugaaaguccagggaaaccuguggggaacugccggguagaaacagaagagagacacgucuuugucuggguuuguaccaguaggaucuggugcccagaguugagaagccaguaaaggcugggguaugggcaggcacugcagaggacccacuuuaauccuggggagaagccaggaagguugggguaugaacaagcacuggagaggacccuguuucaguccuggggagauuaugaggacguuugcugcagacugucagcccucauuaaguuaauggaacuggcgaguuggcuaguuuccagcacauuggagaaagaaaacaagaaaagcguuuucagcgaaagagccgagagaucccguuucgcucagcagcccccgggagauuaggggccguugguaauggccucgcugaaauggcuuauuggggacuuguugauuaaaacaagggagagaaacuccuaaugucuaagaagaauuacacaggcuaugucuagagaagugauuugugcauaguuccuugugaacuacacagcaaccugggcacagccagggccucugcagccacuuggguuacaaguaggacggggaaagacaggaguuaaacgaggggcauucaggagguagcagcucucuggggcuccuuagagagggccuuagcagcccagagcacucggaccccagaacauaaaaccccugaagcuguguacaacuggcaaaccuggcaccucuaacuagccuuccugagccuuucugggugggacaaaaagucccggguaaaucugccacaguguguccaugguggguuugucucuccgccacauuuugguuuguguccagauguuuuccccacagacuccauacauaaccugccagguaacccauaagcucaccuggcaacuaacuuccaagggcuuggccuugugcagaggucccugacauguuucaaucccaucuuccucuggacugaacucaaauccuagacccagcaggccucagguugggagccaacagauuccacucugccccaggcuuccagcaagauuuucuaggcgcuuagcaucuuuauuggcuucuuaccuagguucguuccccuuauccuaaccucuaucaauacauuuuuuuuuuaucccagacaucccuguucuugugcuuuaaagcacauuuaauaucucgaauugucucccuuguacaaaugaggccagagaggcuuagcaaaugggucacacaagcccagcagcccucagugcucacgcuuugccugcagagcagagcacucagucucaucccuagcugcuucucugccucacccacuggggucaggccucuugaacaacccucauuuuauaaguuccccacucuaaucccccaagccccuucccacagagcccguaaacuuuucuagacuuggcugguggguccuggcuccacauuggaaacugaaguaugugggaccuuccugugggugcugaaggaaugaaugggccuccaaaucagacgaaggaucuagaccaaggcuugccugagacagaaccucguuccuccuaaagcccugguauggacugaguguucaccaugaucucccauuagcuuuugcucuaagaaugguauggggguguggucuuaaccuggccugaaaccuccucucacuucagaguccuauaaucccuaaaugucuucugucacacaguucagugggccaagagcugccuacccuugagcuaagguuagaaucaaggacaaggugauaucugcaaagauggaagcucucccaagggugaaggcccaaaagcuaaacaagagguggggauguuggucuacugacuucuacuucccugccugauuauagcccccaggcucuugguaagguugagguuaaccuagacuguucguuuccaauagaauccccagaaaggaagggcuagagggcuagcccacuacugaacacugauggaaugaacuugggguuggggagggagggagggucuccacugugagcucugcuggcccccaagaccuuaugucucagacuuccuggagcucuuauaucuauagauggguccuccuugguuaggacccuugucugagagucugagugccuucucuccauguauaugccuggccagggcaugggcuuaaauggagggcaggcaaggagucuaucaggaugcugagaaggcucaucugugggaaccccugaggacauucugagggggcucaugaccacauaacacaugaagaccccucagcccuauucuaacuugucauguugcccagucaaauauagcugugucaaauauagcaucugggugaaauauacaccuucugggaucuacauguggccccccucacuagggugaaguggggggaggggcacaacaauccaaccugugcuuccaaaggugggaaaaacucuuuucuuugucuauccaagagcugggucaagaggagcugcugcccuacccccgccuagcucuuucccgccuaguccugggccuccuucgggccuaguccaugaaggaagagcuggccuccugcccagcaguaaucucugcccuuccuuauggguagauugugaaguucugcaaacucaacacuguucucagagccugggcuuagcugucuuccaggguguucugucaguguggauaagcaguuuuuccauguauuuucaagauagcuugcucaagccagagagauugcuuuggaacuaaauguuaucuagacccaucugggaagcacaaggaaacugguuccccagggcugacugccuuaccugcuuaaguuagccuugcccaucccccuaccccuaccccaggaccuucccuuuagccuuugaacacuguccaccaugaucccacaaccuggccuggcuauucauuuccucucccuauguacuugauccugcccuaccugacucuucuguaggaauccugcccuauaggucuauuuccccagagguagaccuuucugcucagauaccugugauagccaugagcugucagccuuaggaacaguguaucuuuuuuuuuuuuuuuuuuuuuuuuuuuuuuuugagggcucuguuuccucaaagcuguguccccaaaacuuggugugcaguggggguguugauacugcuucagucaaaaccagcagggacagagugcugacugcuccagggugcaaagcugaccugcugggcagaggcaacacagugggcagggcccucccggggccaccacccgguccccccagccccucccuccuucccuaaagggaaggagagguuaauaaaccaauuacuuugggcaacgaagcaaaauaagucccauuaaaguaauuaauguccuuugcacaguccccauuggagaagacuaauaaauuggggcuuugucaccauccgguaauuucucucuaaggcguuucuucacccccauccgacagcacaguuuaaggcucuguuaaugcuuuuaagacgggcucaaugccagacuaauuagauuugcauuuccaccaugggccaggcugggcgcggaugugcccaaugagagaggcuccaggacccugccggggcccagggacagcacccgccuuugagaaggggccauguguggauucccacgccugccuggggcgauggccugcuacccugucugccugcucagcuucccgguccccggggaacagggccuauggcuuugauccaggaagaggccagacuucauucucagggggucccgccaugaaugguccccacuagggccuacagaggucaacaguaugguccaugucuuggggucucuccagagcucuguaaggccaggcccuguuggcuuuuaggaggacaguauagaaaaaggggacagaacaauauaaacauugaggagcuggacagacacagcccagccaagauagccaacccuggcauugggauaaguuguguaaacaguuggcacccuuaguggaugauagagagaggcuuaacuucuuuuccuaaccuauagucucaccuaauacuaagaaaaaugugacagaacucagcuuagacaccccagaaccuuuggagaacccauggucauaucaaagauagaaagaaauaguuccggucuagaggagcuucaggagguaggaccuguaguuguauggaauccuggauggauccuggaccaggaaggggauaugaggggaugcugaagauucaaauagagugaacugugugaggcacgguggguacugguggguacugcugcucaucgguaaugaauagacacugagauauuauguuccugacagacacuggagaggacauguagggacucuguacugacucugcaaugaucuuauaauuauaaaacuguccuacaauaugcuucacuucaaaugaaucaaauacaauaauagggagagauaagaggcugguggaaggagaggggucuucguaucauuccuucuugccuguggcacagguagauaggugucugucacugaauuggacauaaucaauacaucaucuaggagauggagauaagccaaaguagaucaucaacaacccauuaggugcugaagucuccacaguaccccugcaacccaguaccugaaggaaagaagagccucacugggcaagagaugcuaaggccugaagcuagcuauacucacuccucauggaaagauguucccugggcauuucaaccaugcaacucuuggccugaaaucaugcugaaugaaaauauggagaguaaguccuggguugaauucagccugcucuaacacuugaacucugaggguuccuccccucccuagacccuguuauccuauuuugugugauggacgccauugccaagaagaucaccaugagcucaaguagcuccauggauaggcaaggucagucagguaggaauacguuucugcagucugugaacuuauaaguccauccuuccuuccuuucuuccuuccuuccuuccuuccuuccuuccuuccuuccuuccucccuuccuucuuuccuuuuccucuccuccucuuccucuucuuccuccuccucuuccuucucuucuucuccuuugaaacagucucaguuuauagcucuggcuuuccuggaacucucuacguagaccaggcuggccuugaacacagagauacacuugccuuugcccuucaaguguuggaaccaaaggugugugccaccaugcgugacucugcaagucauuuucuuauuacugaguuuuauccuggggcauggaauuuggugagcauaaucuacagaguggguagcagagggccuggagaaaaacaggguugggccuggaccaaguuggcuagaagccugauacauauggcacagcccaagauggggaugacagggaagggacagcugagaaguuagguggggugagaaacaccaacaaugcuggauugacugagucuuggaugacaggauauguggaaugugaacagcagugcaguuccaucugccgggcagacaccugcuuggcuuugcacugcagcaugggaacagcugugaacaaugaaugccacggcugccacagcuguguauccguacaguuuaccauguggaugaguguguucacaguuuuauacuuucccaguguccuuuuccuauucgucuuuuuuugcuuguuuguuuuaguuuuucaauuauuuuaaaauguaaagaacuauuagcucaugggccguacaaaaauaaguggcacuuuucaguuugcaacccauggcaaagauuaaugaacgaaagccgcaaaacaaugaaaauuaggucugauggacaccuguguuugcguaagcucaaaaacaccaaugaacauggaugaacacugagaacuauagcaaaaucagaacuagaagguaagcauuuaagaaauuuaguauagagcuggguggacagcccagugaggaagaaauuuccuagcaagcaugaggcccuguggucaaucgucggggacuccuccccugacacacacacacaaaaaggaaauacaaauguuacuaaagcaugucuaguuuuguaguugaacucuuccaaaacuucauaaaauaucuacauggcuccagaaaacagaacaagaguuacgcugcccaguuaauaggugugguuucaaauccaugcaaggaaaauguaagaaaaaggagauucagugcaaugccacuuacaaagaggcaaaaguccuauggaaacagcuaaucaaacccaagaauguauauuaaaccagcgaggaagaauagaaaacugaaugaggaugugagccaggaaugcaaagacgguucaauaucagagucucucagugugauucucagaucaaggggauaaguacacaauucuuccagcuaguagaaaaaacaucugauaagcaugccccccccccuuccuuuuugucucuguguagcccugcguguccuggaacucacucuguaggaccaggcuggccuuaauucagagaucccccugccucugucuccugaaugcugggauuaaaggcgugcacugccacacccagcucauccuuuauuucuuauaguuaaaaaggcaaucauuagagaacagaaauagaaaaggaacuuucuuaacucagcaaagguuguaaacaaacaauucaucaaaaagacaucacagggauuuucacuaugagcugaaggagcaaggguacccauggucucuacuguuaaggaugguccuggagauauucaggcucaggaagcagaaagaagauacugugaugaauuggggaaagagggggaaacuguacauuuuugcugcccucugaaaaaacuggcagcucaucuguuagagcuggcuaaagcaaucggcacugcuuacuguacaaugcugcuuuaugccagcaaucaauacauuccaauggagcaugagaaaggacacauucuccuggagucgcagaagugaacuuuccggggggaggccuucugacugcaguggggcaccaagcaugugguucaauaucgugcggagagacuccuugcccuuggguagguggguagaauaguauagauuccaggauucucacauggaaugcuaaaccaacuuaaucuggagaaaauucuguuucacaagcaaacugaacuccaaagcugacagggaggaacgauggguccaaaccuuuacaccacacuaaagggaugaaacacuauaggaaucagugcucuucuagacucaagaacuuuguucccuaccacagcaguaugucuugagauaggggugguuagcugaccaccagacaaagaaaguacccccaccauucuccuuguacccuugaggaugaagcugaacacaaacauggcuccaucuaccaccauggagagagggggggcgggacaugacauaaagucuauccauaagggaaaagaugucugauuauacugaaacacaaguguaccugagaaugauagcagaauauucuaguuucauuucuguggcugugacaaguacccuggccaauaaaacaaccuagggguggugggggaaggggucaauguagcuaacaauuccaaggguggggugguuuaauguggcuaacaauuucagcacaguucauuauuucagggacgucaagacaggaacucaaauggcaagucacaugugcacagucaggaguagagagaaaaauacaaccuugcuugcuugcuucucaguuaggguuguacugguuuaucuaguucagggccccaagccuagggaaugguggcacucaucauggcccuugauaauuccuuaagugagacuuucuucuaagaggauucuaggaugugacacgcuggcacuuaaaacuaacuggcacaccuaccgaggguccugauaugagagaaaauaccaagaaauaccuccaaguggcacacacaagaaggcccaucagaguuaggaauacuauauacagcaugcugaggguggguuggcucaucuuugaggccucaucuucaugacuguggcaugcugggcagaaucuucucucuuuagacaggcuuugcuucucuucaagacccugaauuaaacagaugaggaucuuguaucucucucuuuuuuuuucaucucuaggaccuaauaugguaccuggaauguuggguguggaucaggaugaaugagugagggaaucaaaaagagaaaccccuaaacccuugcacgacggcucugccucuggagcacggguagguuguuugcucuuagauucuucuuuuuacaguaggcacaccgaguagcugugcaaguguccuacacucaccaaagcugugguaaauggcgcauccuucacuccuaugggccuaaaagaaucuaagggcucauguccugugggagaugcugggcugcuuggucuauucaguguuugccucgcuggagcauccuucccucugcauucugugcugucuucccaacacccaccuagccuccugcuugugacaagauggagaagacauggaguguccuaagugggugagccgcaagcuaacacucucggccaacucccccaugccuggaaaggcuccuguuuuguuccacgguaaugcaacaccaucugaguguuggguuuagggacagucacuucuuuuucuuccagucuucuggcaaaaaugcucuuugauguccagaaaauugaaguggguaaggggaggguagauggacauguaguggcacuagggaagaggguuuuuccuugaggcucugaguaguacuggcaagaccuaguuaggcuccuugaguccugcugucucuagaguuuaguuucuuccagccuagccccagggcucuugcucugggcuuggaccagguauguguuacagggcaggguaaguuaaggauucagaauauagccacauauggaagagccagugacagggugacugguacucucugagcucagaguucaggcuaggcuaggccugucccaaaccagguguauaugcaagccucaucuguauccuccugaacugugcuuaaugguaauuguaugagaccacaaauucuccaggaaucucuugcuauacugcccuuucauguuuagccaccuugcugguaucuuccugaauuucccacuaagcuuucagugaagucugacucccacugccaugcagucaccuaagcaaaaacccagggaguacacgugcucgcagacacacgucuaggggcauauaaggagccgggggaggacugggucuuaaaagcaguuacaguaagauacuacuccucacuacacuauucuguguuacagucugaggaugguggacugauggucaauauuuuaauuugugauuuuuaagcuuugcugugguacgaaauacguguguauucagcagaaaguacaucuuguguacugaauuucaaucuagucuugguguuacacuuauggucaucuuucaugaugauggauggagucaaaguacaaccuacagccaggcccuaggagcaagugguuccacagggugccaggaagcuguacugauauauccacuaagagaaguagauacugaacacucuuuccucccuccgucucuccugugugugcgugugcguguauguguguguguacaugcaccuacauguguuuggggaggguauaaggcagaggacaaccuucaaguauauccaagguggauguuuuuugaaaaagggucucugaucugggaguuugugcuaagcaggcuaggcucagcuggauggccaaaagagcccagggaucugccuguuucugccuccccagugcugggaucacaagcauguugucacgccuaggguuguuuguuuguuuguuuuuuaacauggguucuuaggcuagaacucaggugcuuguguuuguaaggugaacacauuacagaguuuuaacuccccagcuacuacaauacauuuuugacuuaaaauauuucaacuuaugacugaucaggauaugacaccaugguaaggaaagaaacaugugugaugguuauuaaaauaauaaugaagguugccuuuaaaagaauaagcugaaugaaaauaggaaauaucauaguauguuauaugguggguuugcauauguguggccuagagggaaucugaaucucauagcuggccagugaacaucaguguuccaggagagaacugagugggaauuuggagagauuguucagguggauauggaggaaagaaagauaaugguuaggaaagcauccauuccaccucccuugggcaccacuggcagacauagagcaucaugguccaucuguacagacucaggaaguucagcaaaaggggagucaggcaggguugaucuccuggugggggauggggcugggagagccaacagaacauaggcuccagagugaaggguaguucggguagggaguaggcacagugacagcaaguccaggucucaaauauaucucaggcuuugagucugaguaaaagccguggcuccuuauaacccugaagcugaauaguaagaagggggugggaacucuuccuugaggccugagcuggguccagaugaacgaaggcucugaagcagcagagagcagaccaacccccacagacuuccugcacuggagcagcacagggucccuggcuugcaagacccuuacagauaaaaauagucccuacaucacuggaggcccaugaaucacuucaauugcccauaauugcuaagacacugcucucugcugcagcauaauagccgugacccuggcuuagguaucccaaaugagaccugccuugguuuggacccacacuaagggacauccaggccagccuucuccacaaagaacucagagaauguaaaaaguucagggggaagggcagcaaaagacuaacuuuccuggauccuaggaaugagaaaaaucaaguaccucaacuccuggcagccaccuggggaaggcaaaugucuacauugcccuucccaguaauuguggacuacagcaaagggcucacgcagagcuuucugagucugccuacucacgggggucucuagggcacauuugcuuuguuugaccuacguuuauuuagugcuauagaagagccccagcuggcuguuugcaccgagguccggugugcuggacucagcacucuggggaggugagggccccuuguacuccaaggcucuuguuugccaagcucaggaggacccagugggacggagccuagacaaacauugagcauccuuggcuucagaaacucuaccgguaaacacuccccugccaugcauuucugccuugcauugauucagcugcagagugcaaacggcccugagaaagggccaaggggagccugggcucaacugcauucagaaagaucuguauggaaguggcauagcugaauggucagucuccauggucccuaacacagugcugggguguagggggcuagauagcugugagugucuaggcaaacagagaaugugcacauuggacuagcucaagucaaaggcuaucugccacuaccuccugcuucccugauguguuggucaugccugagcuaagguacaggauagccuaagucaggaacaagucuccuaggaacaguaguucuaggaauguccuccaagacacuuuugcugaucaagagaagagggauggcuauuuuggaugaaaacgcucuaucucaagggcagaacagacagggcaaagcuuauuucuuucagaauuuauuuucuuuccuucuaacuuuuaaaguggaaaaaucuggcauugucacagcaagugccuuaaacagguuaaacaaucaacacucacucucaacuccggugccaagaguuccaggagguaacuaagaggccaggaguggcagcuccagggcaggggcauaggggguaagaagggugcugcuaggaacucagcagcucugugguugaugaucacccugauuuugcuuggcaagccugggugaaggggccggacccucucaagagggguauccagaaaaauuacaggccaagggggcacugggcucuuaucccccaacuauuaauauacccauggcuauaaugaaaagagcccagcuucucugguggcugggcauggcuccucuaaaguaggcacuucuccacucccagagaugggguauguaaguagcaacagaaccuucuagaauguucccuuaguaacagaugggacuuguggcuaaagagcugaggcacaaagggaucucaggccugggcuagaaacugaaaaagccugcagagcuagaauggggcaggggauugacagaaggcuuggugcaggaucacauggggccaagcccaccccccacuuaugugcaucccugugaggacauauggaacccuagcaagaguauauacagagagacagagaugaggaagaaguuauguccaggaccaccuguguccugcucaucaccauucaggugagacaucuccaucagcagauccaccagguccccuaguuccucaaagaccaaaugaguuaaaguccagcuuugcauccuucuuggccuacugucuccacucuccccagguacagagauuucccacccccauccugaagcuccuuauauaggccuucaaccacugugguguccuucaagccucauaagaggcaugguaggccccauugguccacgagcccaagcuguggguauaggggauacagggaacuggguucugugguggguaguaucuuauuggucccugaaaauguccaugucuuaacacuuggaacuugugucuugugucaacgaagaauaaauuuuguugaucagcugauuuuggggaggcaaaaucagcauggauggacuaugggcugccuuaugugaucauaaaggccuuccuuauacagaaauugguggagcaaagauguggccacagaggggguaggagauaaggaaggcaaguuggggacguguucacugacaucucuauccuuacagagcccauaauccaaggaugugggaugucugcaguaggaaucagcccuccccacacuugaucuccaggacuggaggaugguaagucuaagaguuuaaagcuaccaccuaguugggccuuugggucuucugucaccgacacaggucuuguaucuacugacacaggaaaugugaagguagcguugaaugaucuuccaucaaagucagggcccccagagguacuaugucuguucaccaaaucuagggacuucuagggaggacuuccaaguccacaugucccucccccuuccauugcugggucccuugccauaucuacuacucauuugauaucuuugaacaccuguaccacuguuuguuuagcacuguuccuuaaacagacucuauuuccuuaucugacuauguuuuaaaagccagaaaaugucacuuugugucgaagguaguuaugaaacauacauaauuaaaaguuacuuugacugaaucuacgcagguuuccuugaauugggcugagagaugaaaguauacucuucacaucuuccaacccuacucuuggcacuguccccagaggagcacccugaggaagucugucucacaaaggaaagagagaacagcuggugccuuuucaugguuuaggagcaaagcaggagucaaagucggcaacuaugggcucuauuccuaccgagcugugggcacagggcgguagcuauggaaccauaggcuuguagguuccgguggcuucacacugaauuuguuuugucuacuacccuuguuccaugucuuugguugcugggauacaagaaggggauuccacacaagaagacuauggucgcugcccucagcuucuaccucaaaaucucauuccuaagagggcuucagagaacuuguuccuccuuugucccccuauucucuggauuagauuuggucaauccaauacugacugaacaaggacagcacacugacaggaccaggugugcuuagaguggcaggguggcccagaggcucugguagaugucaucucguacccacaagggagccuaaugucuggaccagugucagcuccucucaagaucugugggacucacugucuuaaagucaagggguggggcugauggugggccuggcugaauaugaacaaguuccuaagccaccagcuccccaagucugagaggagggcuuaaaccccuuuagaagggaaauggccacgugugaccagagcaaaguugccuugucauuggucuuccuuuguauaacagaaacacuggccaccuuauacaugucccaucaugcuauaucuuuggccaggauuagcuuaucauaugguaucaucagucaacagugaucuugaacccacugcuguccuuaaaucacuucaacugguccaucugugccuuauuuggaggcuggaaaucuguuaccugcaggcacuaagggagccaagcuaccaugggauggguuccugcguugacuauggaugccugauacaguaggaauauggggugguaguggggagguacagggugagguagacccucaaggccacuucaaaagauccagcuaaugucaucuauaucccuugccccccauagagauggaccuggcaggaaagccaguacuuguucaaaguaacauggaaauggaguuugggagucaggcugucaucuaugaauucccagccuccacucauaccaggggucccugggggcccaucuggugagugacaggcugugcugugccucccaccuggccucuggcacccacacugcaccuguaacaacagggcaucggagcuggcguccgauuacggcccccucgcggccugcucugaauuccugcggagagccggcacaucgaggucccgggccgggcaggaggacaauccccacagugucugugcagcuggcacuguagcauguggccugcugagagggcagcccggcccagcccagggcuuggguccaaccggcaucucccagcccccaacaaggcuccacaagccccuugccuggcuaagugacacucuuagacccuggagggcccaccaagccuggcuuugccuccuuguauccuccucacccacccccaagcacauucugcuacuggcaggugggggugaggcacaccaaggcggcugcagugauuuaucugcccaucucagaggugcccaucacccugugguacacuuaccaacuugccagaggcugguggccuuuccaucuuccugcauaguuaaggcaaaggucaccuccucagacagcccucccagacuauguuggcuuccugacaacacagccauccaccucacuaccaaggaacauauuggaaagguccccaaagacccagccuccaguuggcaggggcccacuucagccuccccuuccauccccucccccucccuaccagaggaaguauuucuuuuuccuuugguuuauauuuuuaauuucuugccuuggccacagcuugggcuuuuggagagcuuggucaagucaggguaggguguggauucccccuggaacuccugagccccaguccagggcaggagauggauauaguauugguuccaugccagagaugccccuccucuggguggcaugggugccaagcccuuugugucuccugcuuaugccuccugcacauucugaauguauaggccaugucaagacggugacagccccucccauggccauuugaaccguggcuccauacucacugacacccaggagucccgugugccgcgguguuacuagggacuuugccacgaccucagaucccugcugggcuuggacccaccagccgguguuuuacagccuguuagggccgaggccgcaugaagccuucccggcaguuuacacaaagguucuucgccgugagcggcgucaaguagauucacguugggaucauaaagauaauuaggagacuuuuauuuucaaguagcacuucugaaaucuauaaaauuaagcuaauauacugauuuuuuaaaacacaggaauuuuauugcucugugagucagaguuugccagcccaugaggucgggaguuaacuccuucccguucucaggcagccagugguauggcugaguggcugggccuccucauucugcugagggcacaugcuccaggaaagaagguucccgggauaggguagugacuagacaggaacugacccuccaucccccaaauacugcuacuuucccccacuccaacuccccuuucuuuguccuuccugacaaguugagcccuagcuuuugccccuccuggaaucuacucccucuuaguguucuucuugguccuccuuaguccgacuuaguacccagaacgcaucuguggcuacccuuuccucugagauccucucuagaccuugcuaacaggaugagccaccacagcucuguguccugggaaaucaggccagcauauucagcauagccuucggaagggguaagcagagagccuguagcauugccaugaaugggcaccuuaagggcagccugaagaugaccuggaacuuucugggcuccccacuuguggcugagucccuggaugucucaucuugaccaaguucucacuccauggccuugccugacaugaccaaggcacacaaccaugucauaguccuagauuggagacagcuguggaggucacuuucuacagcuucuuacuucacaggcuccaggcaucuccucccuucggggacuagguccuuucuuuaggaccacagagugagugucuuaucuucaccgagagacauggaggugaccauguuagggacagcaauuuagcacaccauaucuuguggguuuuuguuagguuuguuuuguuuuugagacagggucucacuauguagccuuggcuagccuggaacucccuauguagaccagguuggcaucaaacucauagagaucuaccugccucuacauuccauaugcugggauuaaaguucuuggccaccaugcccugcuaaagcugagucaugcauuggcuggaaauggaaccaagcaaggccuucuguauggcaggcaagaaucuuaccauagaaccaccaauuccuugcucugcuuccugcacucuuacauucaguccuguugugcccuucugggugcauugucagauuuaacacauuuucuugagaaguacaauucaagccagauguguacagacagccacagcuuacaugaugacaaguggaggcuuccauggcacaugugacauguguuagcaugccauucaaggcacucacuuccacugggcccagggcaggcaugucacgggcuuggccacauggcuguucuuagccacacagagaugucaaccuagacaucugcauuggccaucauucuuggugucucaguccuggggcuuagguuaccacugccaggcccaaguagaggucauaauucuuauuucacagcagaggaacgugagacaggaaacuuauuccaagaugcaaagaaacaguacaccuucaugcuugcuccuaaccacauggucacuucuggaaucauuacccaguggauaccagacuagaggauccaggauacuguuccuagauguuuuucucaacucugaaaguccuagagagguaccccacucuccagccacccaguaucccacaaaaguagcacaacucaggcugauccugcucacugagauccugccaaugcugucuccauuaagggcacagucacugaagacccagccuccauuuacccagccuaaucccuauauguagcaguuauuggacuuggacugguggcuucccugcuucucagccaucuagacucacuuugaggccugguacgacuaucuguucauucucugcaguauucacucucucuuucucucuccaaaugcuuaccagccccucccuccuauuccugaagcccuugaagcagagcagaacccuuccccagaccuuagucuuccaguuccuggagacagagcuaugguagacaauuuacuggcaucuauaaccaccaggaaugccaggccugcuagaaggucugggcagucuugauuuaugacacaggacuccucuuuggagaaccucagaaauagcugcuccagggaccugaagacaaaacaggacucaaccagaggaaagaggugugugugugugugugcgugcgcgcgcgccccugggggcggggugugugugugugugcgcgugcacaugcauguacgcacuugugcaugggcacacaaaggcccugagguaggaaaugagagcaaacaauagguccggauguccccguccuguccugcagaaacuuugcacuucuguuuucugcuggcuggggguucagcuucaggugggagagugagauaaaugaaugugcaccuacuucccuacaggggugcuugggucuggcuuggcuccuccuauagugccucuccuggcaagauggccuucucuccucuuagaaacugcugguuggaaguuugggguacccccauuauccuuuggagucuacccuagcuuccauacuuuuauaaccagaguuugauccucacgggaaauuucaugcucaguugggucuuccauguugugcuguggggaggaggcuggcaugauagagagaaaugaggguugggagucacaucagagggaaaaguauaggauuccuuggucugaggucaguugagggaccugagguuggugagcccugccugugggaacucuuucacuuuggacaugggaggaaaggcugagacggagagcaagccugagaaaagacagcuguagcugccccuuuugaguuccuggaugcuggggcuggggcuggggcuggggcuugagagaugugugaggcuggaucaugccucccauuuuauggaagaggaaacugaggcuuccagaggugaaguucuugccccaugugaagagaucucaggugucuuuguguuugugcuccaccagggaaacuggccggccugcugccuguggguggucacaagcuccuagcaggaucccuaagcucuggagccugcugugacgagagccaccccugccuuagcaaaguggggccagggcccaaagggaagagggucuggccaauggaccgccagggcagggguccccucccugggcccccgugggugggacagaggcccccaggcuccggcugcaaggcgaggccuucaguggcggccacaauaaauauguuuguucaagggaagccaggcugggagcugugugcgccggccugcugaggaagaaaaggcugcuugugccuugcacacuggggugauuguuccugcucacgcaacugcugccccauggccggaaaggucagacggcccucaggccccgucggaagcacccggugccucgggccccuuugcuugcacccugccaugaugcccuguaacgcccgcaugcagccugccuucuggccuuggcaugggcagagaagcaaugaggcgaggggagaaaggaggcugggaguccaccuguugagcucaagggacaaaggugugagaagaacaggcccuauagggcucauugcucaggggcagccaggagccaguugaggggcugaacuaauuugcucaguugacuauaggccuagacauuaggaaugacauaguaaucauuacagaugacauagggagaggcccagaagcacacaaaggucagcaggccacucuuaggggccagaacagccaucacuccacucugcuagaugagauggcugaaguagguccccgcgucugcuugaugcuauagagaaucacuccugaucuuugggauaagaguacagcuuaauugguagaacgccuaucaugcuugaagcccugaguuccauucucaguauugaauaaacuagguguguuauugcacuugggagauggaagaggcagaaaaauaagggguucaaggccauucuuagcuauacaguaguucaagccugggcuaaaugcuaucuugguucauucguguguguguguguguguguguguguguguguguguguguguguguguguguguguacaugaucucagaaugaucauccagcuccugagaugggaaagagaaacaggaccuuaagauuugcuggguuugguaacagacccugagugaugcucuuucuccaggaagcuauuuagggacauccccagaaccaugccagcauuuucacuaagaccauaggaauaagauggcuaugaaauucugagggaugcugccccuucccaaggcccaaggcccaguugaacaguccuggggggagguauugauaauacaaguggcuuuugcagucagcuuuggcccagugaacccccuaaacuugcagccauaauggcuagagcuuuuggugaucacgguuuaugggagggaguccaguagcugccagggccaaagcaugggagggcuggcuagguaaagggagguggcucugagaaugaauguggcacacagggcucucaccgguauuccacuuucuuccacuagaccuacgcagccugcuucuuacauguaccuguugucacagggccccuggagugcuggacuuguucagagggacucuucuguugcugagagggaaaccacccucaggaauguuaauggagucccaccaucacagccagaagacagccacccuugccuggucacuguguuuugcauacaagagggugugaugaugguugaccugugacaguggcuucuauucucaagacucuacuauggacauacuaccagaacaugccaccuucaguuaccuggggaccuaguauucugucacugggauaagagcaugcuauauuguccucuggauaagaaucauaggggucuuggagggugaaauccuuagaauccauuuguaccucuuguccuagggaagaggcaaggggugggcucagaagaaggcaaguucaacaucccucaagugggggaagccugaccuaugccuacagggagcuggugagggacucuuggggagucuacuuuccucugccaggccauaggccaggcaguguccugugaccuccaucucaggcucugugguuagcuuucaggccccagauucaugauugcucaucgcccaagaagaugggucuccuuauuucuuucagggaaaccaaguuaccagugagccauggcugcuaggagacagaguuagggcuugauugcacguagccuuaggccuggccuuguugguagauacagccaccaaaaccaacacuuccacugucuggcuggaaucuucgucgucuguccaacucggccccuugaaaccaugaucacuaccagcuagugucuuucauggcaaucccuaucagacacccaaccauucccuaucuggccgccaaaaacccuacuuuucucuugggucuugacauaacuggccccacagacaagcugccauguuacuacccugacucuacuucagugaaccucugugagccuuguaagcaaggaggaaggcaauggggacugcugaguagaaguguuuggggaguggagagagagcuuggaggaggagcaggcagcaggagucagaaagcugaggagaggauuuaaucugccacccccuugcagagacccaacuacacauugacuugaauuccuaacucccagagcccuuugcuguguacuuuaaaaagcuguuguguuggugggaguauguuacaguugccauugaaaacuagaaucuuuuuuuuuaauaaaauaaauaccagcuucacuacuuccuuguguaugaccugguucucucuugcuuggguuaguauaguagcuccuguucuggccucccagucuggcccuuguccuuccuaaaacauggcuauaugaauagguguuugagucuccuagaagaugccaucuggaagcuggugggugccaaauauuaagacacugaagacucaauccuaguaauaaggguaacuuuucagggugcuccuguaggaaagauagcuggcauaugggcaugucccacaguuucccacaggacaacacacuucuauccugcacaguacacacucuagagggaggccaggaagaaacugaagaggcuacaaucauacccaggguggaaggaagaggucagaagccucccaaagaugcucuuggaagaagggacaggauugcaugagggcaguccuaagcagaagaaacacccaaagguccugggacacaaagaagauggaagaaggcaagggauagaguuccuaggcagagcaagaagaggacgaggugacaacgaggcuggggaugacaugugggccuuuggcaugugagcuuugcauuuguuacuguacgcaaggucagugggcuagugggauugaugcaauguuccuggagucaggcaucccuccugccugcaacauccauagaagauuacucaaacaucccugcuccucacugaccacacaaagcccaugucucagagauuuuacacaaauggucuugaacucuggaugcuaccgcugucccuuccugguccuauggcuuucugcugcuacucaugcuugaagaagacugacuugauuugguuguaggcccaggcuucuucccuuuggcuucccacguggguucagcuaaugagauaccuagaaggauggugaaggaggccauugaggcccaagauuccccaccaugaagccacuggcugcaacuuagaucuuggguccuuauuccucucaaggugaccaggacucaugacucucaguuuacagagcuucagauucucuuuucuuuucuuucuuuuucuuuuuguuuuguuuuguuuuuuucaagacaggguuucucuguguagcccuggcuauccuggaacucacucuguagaccagguuggccucaaacucagaaaucugccugccucuaccucccaagugcugggauuaaaggcgugcaccaccacugcccggcauagacucucuuuucuugaucuguaagucuggggcaggaucugauacugcuuaggguucuggaggguuuauaguucccaauacccugcccagcucuagaagggccuaguguguuuuauguaggccucuaugcccauuguaaggauggcuggccacugagcagggaaguaacagucaccauggcaagcuaagcacagguccucaguggcuuuaaauuccccauaucucucauauucaagucagcuucuacuugagacaauacagaaauaacaugauuugggagggaaaaaaucaaacuuauauucuucccugcugggaaauggccuuaccgcucucucuggcccugcuccauuggcuugucaccacagucccacccaaagccccucuggacuccaagacaccucccucucauaucagcagaaggggugggaugggagcugccagagccuggagugggucacuucccuguccuuagugucuucugccuugccagagaagcucucaucucccuagcugcuucugggcuucuuugaaaaucugucacuagcucuaggcuugccuccaggaagggugugcccuucacucaaacacaucugggacauaguucagugguaggaugcuugcccaguacauauaagaccccuaguucaauuccuagcaacacacguacacauacaucaccccaaaauaaacaacauaccacuccuuaucugaggugccagcagguuaccuaaucuauccagggaucuaggggucuuuaagucaggagccuggguggacauuucucuauucacuucugccuaagcuugccacgucagcacauauccugagagccaucucagcuucuccaagccaccgcccuaacccacccuuggccuuguccuugcuggggccagcuggaagcaaucuccccagaguggcaggugguccuccuuagcaggcuccugcgaggccaucucaagcccagcacccacacagagguggcucuguacgcacggcugccuugggccccuuccccgcuggaaugaaccaagcacuuuggaauuugcagagaaaucuggggucuuuagcugcuguuuuucuuggcgcggccuuaucacaaauuaguggggaagcccgaagguuaggguuucagugagcucagcagaaucugagaagugaggagcuggccuccugccuuucuaagucagaaauaauacuugaccugcugggccccagaggcucucagaguccaggauaacuccugggcagguuacccuggcucugaguguggggaagccuggggaggcaguguucauacaaguuggugauuuccccccucaagcccaaauggccucccuggugccuuccuggggucacccugaacugugugaguuuagagccuucaggcugggguucuuggcacugcuagcagcucaggcuugggaaauggcacaccugggaagaggguguaagcaauucugaauaaaagggcacacucugagaccuagggaucuccagacacauuuaggcuuuacuucaaaguucagagagaagaugggggccugagcagacaaaugcugggggacuccacugugguaugagccucuucugauguagaaggcaggaauugcugugccauaguuaggaagccagagcaucaaggaaccauugaguauuccugaugagggcuaccuacucuuuuagauguuuaagguccaucuguuuauguggggaccaacucagagcuucucuaaagcuguaucuauacauaccucuaggaguccuuaucuacaucccaaugacuuauccccacccugcccaagucagagccaagucuaguucuggcauguacuuggggggcaccucuuagcacaccaagaacuuguuggacugcggccuagugcaggguccccaugggccaacauuauccuugguaccugguacagcuugcugcaucacucaucauuacccugcgacagaguccacuacacuuccacuguacagcucagaauauggaggccuuggagagucuuguuucaugucacacacgaccaaggaggauaugccagggugugaagcaagcucuaugcuguuguuaggaagacagaugaugcuagagcagagugcauguugugcaagcauggggacuugaguucagagcuucagaaugcacauaacaaaaagagcuugacauuguggcacauguuugcaauccuggagcugggguuggggguaagcuggguagugacaagaauauuucugggguuccucagcccauuaaacacuucuuauuagcaagcuuuagacuagagagacccuaucucaaaaaccaaggaagaugccucuugaggaaugaccugugguugaccuguggcuuccacacacaugugcacauauauacaugaauacaacccucccaaaacuccaagaugauaaucucaaugaccaucauaaacagguauaggugagucuuuccccuaaauagaagacuuugguacacaccacuucucucuguauuccuaggcaaguccuagggcuaugucaaaaaacuagccaguagguacaaagcuuaacagcauuugacuggcauuuguaugagaucguauguagcccugagugucuuuccuucagcagggggcaguuuuugacaugugccuccuuaggggauguggcugcugaccagggugcagauaagccccaagacagccugaccucccccuuucccaccuccccuuuacccucuuacuggcccuuccucaaaugguauuaucuucacagggaaggccuggcuccagagccagcaaugggacccuggccaccagcccugcuccauuguaaggaaacccaauccaggcaggaggacggcugucgcuccucacgauuuagggcugucaccuggcagaguagagggcucucuacucugacagaauaagugguuccauucugaaaggugacaccauaaagcaauucugagccggcaggaggacuguauaucaugugggccuggauguguguguguuuuucuuucuggcucuccuuccuggucuccuugcuguggcccccacccccuggugaucuuaucagagcauccggggccagaugugauuuucuaucaagaggauggggcccuaggcagacccaagggggucaugcgaagagggggaagggagacuuauaggaggugggcucugugucagacacaagagucagauacacacuuccuaccagccagagaacggaggucuucacaccuguaauuggugaggaaggugucagcuacccacccacccccaacuugcuuugaccacuaggucacaaguaaauggccuaagaggcuagccguaccucauguggaaugacugaacaccauuauugggcacaagguuguccuuugccauccauuccagcccaggccugucagccuguucuauaaaucgaugagaacuugaacgacagacagaagucccuuugaacacucgggcugggaacagcaucaccucuuugagccccaguguuugcuucaaaugcuauuauuuucugguccccugaucauuccagagucguggaccagcuaugggagugucaccauggggucuaugacugaccaacugaccucaccuagcaagucuucuguuaggaggguauucucauauucuuuauagacaaggguaccaaggaucacucaaggaggaagguucuuucuauaagaggucuguaggcacccccuaagcagaccaauguuccuugggagcccuggagucuccaugucccuuucucgucccaauagucaacaggaaugcugucgucucuguugucaucagguaguauguggagauccagagauagccagaagaggagaaaaggaaagauggaagccuguccacucauuucucuuggcuaccaccucucuucucucauagugccccuucccucaacgggcucuuccaaagcagaagccucccugucuguagaaccuccuauuuauucucuugcguucucgcaauacacaagcuggacaguggacacacucuggguaaacccuccccacagcaaccauuuucccaggaugccucuggcugugagagccugugaagucaaguuaacccauguguggggucagggaaguacuacuguguauuuucuguagcuggggagacacuaguccucaaguugacaccuccauuggaagcuuuucaaagaaaggcgcuguggcuccaggcucuaggcaugcagagauuaacaacauguagguucuguccaaccuggcccauuccuuuugcagagacagccuugugaccuucgggggcugccuuugcuuugggaguuuucucaaggccaauggccuccucuuggccuucaucuguccccacacaaggccagugugggcuuagcuuaaaggaggcuugaccucaacgugguccuauaaggcaguugagcuagggagauuguaccugcauaugcaaauuggucugacgugagaacugccagcacacacauaccuugaagacaucacugauucuaaagauaauccaugcaagggaaauguggcuuguucugcaucuuuaaauuguuuucuuuuuuccccauccuugucaaagaccccuguacuaucuaauguacuagagcuuuuccugguaacucucuagcaaguugggaaucauacccucuauuucuuguaaaacccaagcacuaagggacacaggcaguuggggacuaguuguggaggucugaggcuuggcauauugugcauaccacagaauuguccuaccuucaaccaggugcacaaagggccagacccuggggucccaccagcaguguggucuagucauacaccugauaugguuggguuguauccauuucugucuuuccauaauggaaaacuauggaacaaugagaugacuccaagagaucacagcaauguuggagauuguuaauccugaauuuaagauacauucaaccucaaagcucuuugccaagacacauggcucuuauagaugcuaaugggcugccugaaggcucacccaucagcaaacauauuuggcucuggaaugaccaaaaggagaaagguuuuuuauuuuguuuguuauuguuguuguuuauuuauuuuuuguuuuuuguuuuuuuguuuugaauagaagauucugacuuccuggcuuaaacuugugauaaccaaacucaguaucugugagcguaacaugagaauggcuuccacuuuaaagauucagagacucaguguguguguguguguguguguguguguguguguguguguguguguguguauaaggcucaggaaccuguauuucucagauucucugggaauucagguguauguaugggaauugaaccuaggcucccauggaaugccuaccuggcccacuguucagcuacucaugggaaaauagggaccuggagacugggugggugcucuguguaacuuggcucaggguucacucaauacccagguggacacaaaucccauagguuuccucaacauaguguuucccauaguuuucucaacuguucuuuuauuacagaugugcaugucccuggggcugguugccagguguggaggcaaauggguaggcaucgugccuauggaaagccaugcaguagguucccagguggcccaggcugaacaguccuccuugaagccacaaggagaccauuauucucauuccucauuaccauuauggcccccagggccaauuucuguaaucuaaagauuugagccccuuccucugcucacuuguauccugagagcugaacccuggagggauggcacagaagaaugggaagaacagugaauuugguacuggauccugagggacccagguccagucauggguggaaagucaagaaaaauaucacagaaacaaacaggaugaaggggcguagucagagccagggcuauauaaggcucucugaguauggggcccaucaggucucaggcagcgccagagaggucagagcaugcaagguuaauacggagggggcuacaggggggugggggugggaggaggguacagaggaaguuggaggaaggaaggcaagaugaagacauguuuggcuggagcagagcucccagcuccuccccgaggacagggagaguccucgaaggguuuaagccacaauggggcaugucagcccugucaucugggaguucaucugagaagggagaccaggauggggcauguuccaugucagccuagugcucaacuccuggagggagcagucccacagaccuugaaccaugggaccucgaggcgaugcccugucaucagaauaaaacuugacuuacuuucucagcagaugagcccuucucagccucagaaucaagacaacacagccaaguugaguucuuuuuccaugauccuuaaagagcugggaugucagggcuggugagagugcucagacgggaaagguacuuaaccaaccaaccugaugacccgagccugauuuccagagcccacaugguagaaagaaagaaucaacuacaaguuguccucugaccuccacacacaugcugugguguacacacacacacacacacagagggugcugagcucuguuuuuuaagggagcagacccuggggacuugggacaaagugagcauuuaaggguguuuuucccugagauccagauagguucacaggucucagccccuggaggguggcuuuuuuacuuucugccuccauuuccuggcucuccuuuguucccacagcuguucauuguacuccuggcugcccaugccucuucucuucuacucuuacaagauuguguguuuaaacaaaguuagagagccaacaauacaggcuuaaaaauguuccugaaagcagggccaggcuaggaaauaauaguccugggggaagcaaugacuuccugggucuguccucucuuaccuguccuaaugcuggcccuggugugaaaagagucacuuaguugucuugauagaaaaaggcuuggaggcagggauggagaauucugucuggcuaccugcaagucacuguguuuucuuugcuuuguggcuucccauagcuggacaaagauuugaagagagacugcauguacagcaaaugcagggugggcugcgauuaaacacauggggagaugucuauccauguaaucacuguggggccaucuuauuucccauccccuaaucaacacuagucacugcuggucauaaucuacaaugccuuguagaaacccauguaaccuuucugcugggagugaaaagggaacacaagauucuuuauaacaguaaccaggguccuuaaagccccacccuugccacacugaacaagcagagagagaaggaaggacagcuggggaggcuucauauuugguguaaaucuucaguuugucacuugguaguuggccagcuaaucaggggcccgccaaauaguuccacaccugacaucaggauuccuggacuugcucaguggggauuuguugagcuuggacugugugucuggcccauagccaggggccacgcccucgguugcccaauaugcaggacgcacguagugcuugcuccagacugcucguggcucccucaaaacacggaaauagugguuguucuacacuagaaauaccaggacccauggcccggugugagccaccaaguuccacaccacucagcagagggaacuggcuuccagagguccccuuccacaggggaccuuccaguguuccccuaccccaaccaggaguuuggaauccuggagcugcagggcugggcgacuagggagccuuugagauaaggcacacugggagacaggcuguagaauuucaccagccugcaguacugaaguuguuugucugccuagccauuacucaagagcccuagauaccugaagcugagcccuggggcacaaacuggaccggugaugggggagggacacauucuguccugaagagccaggagaccucagugucugaccagaggucagcuucccugauguggcucugcaaacuagccacagauuccaccugaagcugccucccagguuuguuagauggaccugggacgaagagacugaggcucuuuagaauuucuuauuuuaagugcuugugaaauagagucuugauuuguaggccuuguuagccugaaacucaguaugcagaucaggagagccacagccuuauagcaaucuuucugccauguguccccaaucuaccuccaccauguuuuugcuuagcccuugagcuuugugccucguuccuaauuucuuuuccuagugucagagccacugagucuggcacagagugggucacauuauuuaggagauagucauggucaaaaguaaaaagcaaacuuacacaacauaaauagcuauacaaaaguauaauacaaaugacuacuaauguaguccuggguccuaagauagaugagguggccugggacuagacucuagucucuguggccuggucagugcucuggggacagggaugccccuguaacugugggaacaauuaauguaggagaggucagaggcagggugcucagugguguggcugaaaugugcuuuuguggggcacagggaugaauccugaagcuauagccuugagguugucaaggaaaccuuguuuuaucucagguaucugagcuguaucacauggguggagagugaccgccccuugguccucauccuucacugagcaggucagcuagagaggccuggcugaggcauggggcgagauaguuuuuugguuuuguuuuuugguuuuucaggacaggguuucucuguauggcccuggcuguccuggaacucacuuuguagaccaggcuggccucaaacucagaaaucugccugccucugccucccgagugcugggauuaaaggcaugugccaccaugcccagcugggggggcgguaguuuuaugguuuguauuggcaugguucuugcccaggcugucccugcccacucaggcauuggagcuauggcucauguggcugcucccugauccaggaagcuuggaggcacucaagcuaaggcacggucucugggggagaugggcuacucuggcuaguugaucuugaaggaaagggccagguggaagaugauccacaggacaggaaaugagauguagguaucucaagaaucucccaugugggcugagcuggugacccuaacccucuagagagauucucuuuaguuugaccauggugugucauagguccagacgaccuauacacauggcugcaaaaugcugggauuguaggaauucccucugagccugcccuacuacccaacuagcugcuacagguauuagucuucaaagccuaugcccacuacccugcucauccucaaccugccucuuuuuuucuccuuccugccucuuucugccccucugccugauccucuccugccuagcauccaugccagggcccacagaucucuccagcuuggacuccccugagcuuaguggacaggaaggacccugagagaggcuucagagcauacucuggcuugcuauuuccuggcuaugugucugucagucuuggggauccugggcugggucauaaagugcccauauagagaacuuguaggaagagggaggaggggugugugugugugugugugugugugauaugcugggaccaaaucugcucaaggguauucuugcucagugucucucaacaguguuacugcuaguucccaacugugauacuuuauacuggugccaacaccagaguaugcaagacugcuggcacuugcgagcugugugcaugauaccugcuaucuccuccagggccccacgccuaagcuuuccaccuuaguggggugaugcugauaaaauggaaggaagcgcgugcuguagaggaccuaaaaaugagucuuaaggucuugcaagaaaaguuacccuguccaaaccauguccuugcauaagaaaggaauuggucaucugcaagacagugacccacuuggcagcuccucuugccccccccacccccgccugcuacuugcucuuggccucaaagccaugugcuaccaguuucucugaagcuggugauagcugacuacucgcucugugcuuuugugggcacuguucccucugccagggauuugcccuuuuuugugaagcgugggugccaaaaacggacauguagaccaccccucuacaagguggaggccuggaaugcuucuacggaacucagauccugauaaguggacaaaaaaggugucuccaguuccuuuacuucacguaugcaggccucuacccugcucagaacagaccauuccaagagugcagaaaagagccuuggccuuguaugcagaggcugcuugagggguggggccacaaacuugggugcccugagguaucucacacuuuucugagugacagacaaucuggagguuccugagugagcugguagggagugggcagcaggcaaacacagaacaaaggcuuggugcugagccccugaucuggccaucauguaucucagggcugggcugcaagcuaguguuugcucaucuggaagcaauauuguaguaacguuagacggcucgaauacggcauauucucugaauccgugaacucuacagugaggaauauggauuuaauggauaaucucaccagcagccaaaagaacccagauuccuccccggccuucacccgggccuuggcuucucuuggagccccaacucagccaggggcccacagagccugcagcacagcuuccaggagaggcaugugaucuuugagaucggggcuggguuuuuuuuuuuuuuuuccuuuuucuuuuucuucuuucuuuuuucccucuccuuucucugggugggaguggaggagcuggggaccuguucugggcaacagagugacugaucuccagaccagccuguagccagagaaguugaacuggagaaaguaggaaaccagggugauuuaucacuaucuccaauggccaaggcuugcuuuggagugggguaaggguaggcagaaauaauuccugcagcucuucccaacuuaauauaguuggaauaauaaaaugaaacaauaaaaccacagcggaaaagaugauggagagguuuuacagugagcagaagaggaagagcccagaaggcggacagagcucagugaacaaugugacucgggaacucauccagaaggcagccagggggaggggaggaguggaaugcaggucuggcuggcccuggccaccaagugaagugggggcugcaagccacucagccuauggaggcugcaacucagguagauuccuggcuacucucuggggucucauuucaaaugcucauuaauucuuaauuuaaauauugucaauacauaaugcuucacaaaggugcuaauuucacugagagccaucagcugccacugcagcugcauaggugggccucucauucuugccaagauuccaauccacucuccugacuauccagaugaacuucagggauccaacagcucucugaugaagagggaggggugaaagauaaggguaagaaagaagaaagauggguccuuccaucuuuccaauucuucagauguccaguucagaggccacgcaggaaauaaagcagcuaacaugaacacuccacuccaggaggcccugagagucaugugcccugacgucucagccuuuggguguagcuguuccaaggacgaggcuaggguauccagaggaggcucccacugcagacugaguggagacaggaugggggagugggaaguggggaggcuggggggugggaggugggguuaagggagguaggggccucucaguuggcuuuaucuuuacauuccaggaucaguagaagccuccaaggguucccaaaccacgucaucugaugagcuggagaucaaagcugaggcagaagaguuuaugggccuccaguccauccuggagcacaggguggcuagggacagaggcagggagggggcucccgucugcacucuccaauauuguucauuguuuucuacaguuccguucugagucucccacagucuuccaggggcuacagugaacacaauauccuguaguugggacucuugcucuagccucaucuagucucagagggggguauaaugcucucucugaggccacaaugcccugugggacaaugccuucccggggcagaggucaugagugucagcucauuccauagcaacaguuccacaccuugaagagagcuagaaacacagaaaauauucaaugaaggaagaaagcaaauguucagggcuuaaaugaaaugcaagcacagggcaggguccacaacucagcagcagugauuuuguagacugcacaaggcccuggguucaauucccaguaccauuaaaaaaaaaaaaaaaaaggcaagcacaaagcucucucccaaacucccaagggacaccaaagcugucaccucuuugggucuugauccccuuucuguuucucugggggcaggaaacacaggcaguauguccucuguguacagauggagaaggagacccagugagacagggccauaucagauggccaugauucaauuugguccaaaugacaugacccugcucugcccauggggauggcuucagggagcagcccucagcaccugccaccugccauggcuccaggcaacuaugcaccaugagcuacuuccaccucacucucaaagguacccuccucagaagcagggccagaauccugccuacaccagaagucuguagacuggauuugagacccuugaguugaaaggaaauuugaaaaucaaauuccuuuuguaagcugccaaaguccugcuucucuagcaccgaggcccuaagaugccuggcuugguacuaaagaacuguucaucuaucauggagauaugugauacaacgauuaucuaggagucaguuaaauucuaauuuagauuucugggcucugagcuggccuguagcuuacugagguggacuccacuaucucuaguggacucaccccagguuuaaagaucuucagucuagggguaacacacuuggcaaaggacaccaaggaacaggaagaaacacuuggacaggggggugcuggugcgacuugaagaagcucauggagaagggaggaaagagugucuucuugccaggucuacaaggaugugaaaaaccuggucagggcagcaaacuuaacagugagacuuaauaguaggaggcuguguagaaguauggcagaugugauagggcuagaaacauggccuuuaguagcuagcaugggagacugacuuggagaacugacagggccagguuguacagaggaaggaaagcuacuggucaccagccugaagccucaccagaccaacaaaagaauuacccaagagauacucugaagauagccagguauucuuggaagaaaccugaaaagauagccacaugaccauuaaagugguaacgcuaucaaacauaaccucagguucaaauaagacucagagucccaacagccuccucuguuaaauauugacaagugcugggaauucuacagacccaagcaacaggggagaacaaaacuggacaauucacacuuucugauuucaagcucuggacacagcuacaaaaauaaagucagaucaauagcaaugaaccuucacauuggccuucauuucccugagagcccacaaggcuggcaagaucaagcaauggggaaagaagacacccuuucaacaaaugguguuggaaccacuggguagucacauaaaaaaauaaaauaaaguugaucccuucauaccacauacaaaaaugaauuaccccccccuuuuuuuuaaauguaaaaacuuuaaacucuuagaagaaaguagaggaguaaaucuuucugaccuuggcuauauacauugucagauaaaauagcaaacacaagcaacauggugaugggguggagauaaauuggacuucaucacagcuaaaaguuucaucagucauugcuugcccaaaauacuugcauguaauuaaaaugguauaaaaaguggguuggaaaauaaaaauuugccuucagacucagaauugacuggggucacacuaaaaacaaaaaaacaagcaaacaaaaaacaaaacaaaaccacuauaaaggaacuaaaaaagagccaaugagaaagcucagcugguagugggguggggcuugugccaccaaaccugacagccugaauaucuaucuacacagcaggagagaacugaaugucccaaguuguccucugacuuccauaggcgcuguagccucacacaugcacaaauaaacccucaaucaaugaauaaauaaauauaaauuuaaaacauuuuaaaaggaagcagggguggggggaccccagauauaugcuuguaauuuuagcauucaggaguuggaggcaggagggucagaaguucaaguuagucaaauuggaggccagccugagacccacucaaaaacaaaaaaauaaaaaaacaaaacaagaaagugaagaggcaacccacaaaaugggaggaaauaaagcugauaagggacuuuugucuagaauauaaaaucuaguauauagguuaggaagaacaauuacuuuauaacaacaacaacaacaaagugaacgaucaaucagaauuggcauuucuccaaaguugguacacaaaugucuuucuguaaaagaugcucacugucauuaacccucuaggaagugccuguccaacuucauacccacuagcaaaguaaaaacagaaagcaaauguuagugaggguacaggaaccucagggacuguugguagaauuugagagaugaaacuggcgguuucucaaaaaguucaucagaacuauccuaggacccagcaauucuaccccucaguggauaugcaaauaaaaacauaguucacaaaaugcccagauguugaugguaguauuauuuagaacaacuaaaugguggaaacagaccagaccuucaugaagggauaaaugugcucuccccauacaaugaaauauuaugugaccauaaaaaggaacgaagcaucaccacuuacaguaacacaaauggaccucacaaacacgaugcugggugaaagaagccagacucaagagagcacagaacauaugauuaucguuacagagaguauccagagcaugccaaacuauagaaauguaaaguugagcuguauguaucuuggacuagggaguaggcuggggaauaggaaaugauagauaaggaacagagagaauguucuagaauuagacaaagggagaguugcacaacccucaauaaauuucaagugcuucaaguaggugaauuguaugguaugugauucuuuuuaaauaagucaauucaaaaaaaaaaaaaaaaaaaaaggaaagccaagaaacacacacacacacacacacacacacacacacaaacaaacaaaaaacccaaaccagucccacaguacuggagccccugacuggacaggcccugacugugagugguucccaguuccaggugcuccuggauucaggaguccaagaggccccuugggcucuggggcugagccuccacccacaucuugcuccucagcucucagguuugcuguuucucagggcaaaggcacaggagccuggagccagcagugcucugcagcuggggcugggcuggggugggggcgggaagcugugcagcagggauguaggcucccacgcuccagggccaagcugacgugacuaaagcuaaacagaccccaugccacaaugggguuacagcuaauucugcgcagcacacugagccuucgccagcgauggcagccucggggaggggcgguggggcaggcagccccaaagguaauuugcacacggcguuuauaaggccccucagcucuuuuaaacauaugcuucucugauuauaaacagcugauggcucacaagauucagauuuuccagcagggcuuccaaaaaaagauugcacuaggguagggaaaggugaccggguucuuugcugaggacguaaauccagccauguucucgagcagcccagccgucaccaggcuccgaaccugucacgucuuuaaaauauuggcugcuauugaugugucccaagaaaggcucuggcuuggggaggggacagagugauggggccuuccauaagaauuggguucccugcugccuuggugugaaggauaaguuuuccuccaucuccugcccugaggcuuuuaguccuggaucaaaagccagaauucaaggcccccaggucuaggcuucuggacucaaacagucacacagugcccacaauagaggucucuaaaaaugauugcugggcuucuccugggguccugggaaccuagcaggaguucaaaagagaaugaagagcagguagaugagcagggcaccagcagcaugagacuccagggaugccagcucacuauuuugccaagucccccuuagucaugacccaggcuacacaugaacaccaggcuggcagggaaccguacagggaugggucagaauccugucuaccaucuaguucuggcaucuagagcuuaaauuaaaucaggaggcauccucucucuacugaggaauggcuuucaaaggccucuagccugaaguuagagaauagaaugucauuugacccagcagaguauccuggggccccucaucuuggcugucugcagaagacaucuugggagcagaggccuagccccagagauuuagcacuauggaagguuagaaguuaucccuuugaccuucaguagccaauacacaguccucuggucccaaaucagauucuggggagugacauaagaggucucaguggccaggaggccacaugugggcaccuucauagcagaaguugcuaauaaacauggucugugucucugauaugaaacugcaugccagagaggggagaacggagaugguuccugguucuguauacacaaauuuccagggccuucugccugucugauuuacuuggagugggccuguuuauuugcucuucuggauacuagauggucugaaagucuugcagggccucaaaguuggaccugcaagcuaacuuucagggauuggcugagguagcaaggguuuccuugugaggaagggugugugugugugugugugugugugugugugugugucacagucauggugggguugaagaguaaugcagaaaauggcaguagcucuauuccuggcuggacugauggacagcucuacaucauuccauuauuuacccaugggcucuaaaggaauuuaacccaacacacauaacucuagcaauguucaaagacagacaaagccuguuuauugagcaggcccaggaaaagaggggcuuggggaggggacuuuaguagcauucucuaccaaucuauacacccuugugucuacuuuuagguuguuuauuuuuuccugcucccuuuauucuauggcuaacucaauuuuccugggcacgauaaacaaaugaggggcagggcugacuagugaggagcccuuucucggugcuuacgggcauuguccuuagucuuaacguaucuuaagaacuaaacuuggagauuuucugugaguggcagucaccuuuuauauugucacaggccaacuucucccuaccauaagccuacugucccuacaucacuccucucugaaagcacagccuacacuucagaccuguagugucuggaucucuugaguuuccaggcugggaccugugcugggucuugagcaggggacacuacuauucuagaggacaguuaacccucaucaaagaaaaggcaugaugugugaggucagggaggugugccgccuggguccaggacacuuacuggugcccagauaccaccuuccugggagauguugaccauuagagaaggccgagggacagccaacaguugagcugagacaagcagagauggcuggaucagcuauuacuggcucacaagucaccccacagagucacagucugaugcacacagggaugagggucagcggaucaugguucuuugguagccuggcugggcagggcuggcucgugacguugcagugaagaagugggcacugguuggagcuucuggaauuaccugaagaccugaaucagagcaccaccccugccucugguucuuuguggugcauacauacauacuuccucacugguaucuggccacaaguuugcuuggguguucuuacaacauggaagcuggcuucuguaagugucagcuaccccagugagggagaaugaggagaaaguuauaagaccuuuuaugagguggccuuggcacucaugcuguccccugauacacauuccacuugucagaauugaaucaccgagucuacccuaacuagaguggaagaagaugcucucucucucucucucucuguguguguguguguguguguguauguguguuacauguuugcaugggugugcacauauguguaugcacaugucaagauauggcaugacuuccacaauugcucuccauuuauuuucuaagacaaagucucucauggaacaugggccucauuaauucugcuagcugggcuccucugcgagugaacuccugggaugcgucuguccccaccuccucagcgcugagacuauagaugugcugcuauguuuggcuuucaugugggcguuggagaucuuaacuuagguccccacgccugaaugacaagcacuuuauggacugagccaucuucccagcuccuaacucuugaaggaugugaguguaugggggagggggaggugucaaaggccccacagacacauuguaaaagcaccauggccauugucaggccucccuuucgucccauucuuaucuuuuuuuuuguccaaaugacauccgcacuuugagccugccuggccgagggaaacauguucaucaggcucuuccuggcccucugcacuugaugcuucccagaggccuagucacuucagcagccuugccuuccaagagcacacagugggggcugggggcuaacugagagaaugagcaucuacgcuugcuguaaaaacaauggaaagcccuuuaacccugagagaccagcucaauagagcagagggguaguacuucugguucacauccuucuggggacuucagagagagcauugggguaaccccagcauugguaacagucagaggacaggauaggggccuuucccugaugaaugggcucugaacuugacaggccugagcaggauagaaaugcucugagccugagaugcauccugggagaccacugcuucuggaagaugguggcagaaaagacucuuuugguggugggccugguagggcccagcucccuucguuuucccauucccagugccuggcacguaaccaggcccuaggcaggugccagggagacagcugcggcauuaacccgugucgcagcaggggcgcagggagagcuggguuugccuaaucaaggcuuggcuguacaauguccaaacauauacaggacagcugcccucccccaugagaagugcccacaccccaugcugccacucacagagauugccugaaugccaggccucccacgaaccaccaccuggccuccaguuauugaugaccccaaaugaagugauugagucuuccugugcguggaggucagcaucagcccuaauguagcauagucaccuaagggcauguccccuagccgucuaccccagaguuccucaagguccuaagacuaacuuggacccugagcuacccuaaguggcaggauacaggucuggcaagcuaagcuugugccuuaucucuggcccaguguagcaaagacagggauggagacacugacaagcuauauccaggggggacccuaguacuaugaagugucaccacaguaguagguauuguguaugagguuaacucuuugcuuuuuaaaaaaaaguuuauuuuauuaucuuuaguuauguguaugugugucuauuuguguguggguaggugcauaggcccacagaggccagaggggucugauuccccuggggcugguggugagcugccugauaggggugcugggauucgaacucagguccucuagaggagcaguacaugcucuuaaccacugaguuauccauccagucccccuccauggaucuuuaauuuuuuuuuauuauauuuuauguguuuugguacuuuacaugcaugcaugucuaugcaugccugauacaugaaggcaaagagggugucagacacuccagaacuggaguuacaaauaguuacgaaguaccauguagauacuaggaauucaacccaccucagaaagaguagccagugcucuuaauugcugagcuaucucuccagccccaggccaugacuuucuuaagacauagcauugacauugacccuuacuuuccugcaugcuugcccgcuugcccacugccacaacauuaccacuuggcuaaaggucuaaccuuagcuacaaagucuaaucaaggucaccucuucaugaagauaccccuaguccaguccuucucacuuucauggauacuaccuuccucuaaaaucaccuccuuucccacugcagaaagucaaaucucccacagaacccacugagcacacccuucagucuuucuauccagcagccagagaaaucuuucuaggaaaguucccucuaaggagucccuaaagauugcucauugucccuuaccuccaaccucggccuacagggcaaugcccagaaccugcucauuguaggagggaugcagacagaacaaggggacaagggccacagggacauuggccagcaucugcaggagaaaaguagaucugugaaccucaaggauggauggggaguuaucagcagguccacaaagacacauugguggggagauccagauggaguguaggcucaagagacagagagguugugggaagaggaaggcucugcagcaaacacauugacuaugcggaaaauuacagggagcucaccuaggucugcagagagagagagagaaaaagagagaaagacagagacagagacagacagugacagacagagacugugugugugugugugugugugugugcaagcgugagauguccacaugcacauguuugagcauuaacagggaaaugaggaggggcuguggagucuguggauaaugucugcaagggugaaccuuaagaauggcuuuccuagcuuugcaaauggccacucagagauaacaugggguccccguugagugcagacuacagcauacagcaacgccuguucccagaagauggccuaaccaggcagccacguggcccugggccucucugcuuuggagaaaagcaguaacuugguaaccuggcugaagcuaguucuauccuuagacucuagggauggggguggggagaagugaggcccacagaaccccuuggccagggccugcugaguugcugcuuggaugaggggcucccacugcagcccuuucuccuuccuugccuguguggaagagaucugguguuucccuugggaccccauggggcucugggccccaucugcacuucugugcuggcaaaugccgaagaauuagcucagcaacuuccucccccucaucccccacccccacucuaaauaccuuggaaucaagagaaaagccgaguggccguuugcagccuaauucucuucagcugugugugcgugcauguaugugugcguguucucggaugcagaggccugcgagggaaccuuuugaaccccaaauguuggaguuggagggaacacaaggaacguuaaguccagcccccacuauguucagaugacauaaaccagauacaggaggaggacaagaccugccucugucacauggaagcccaaguacagagcaccaggugcugggcucucugcuucugccucagcauccucauccccacagcccuuagccucuggaagggaaggaaauguaggcacuauacccaaagacaacccugaucacagaucagcuaggcuggccccggccugggaagggacuaguacaacccucagagccaugacugcugccuuucccccaaauucuuugauuccucagaccagcucuauucucccuccaaucagucuggaaucgacccaggucucccauuucucuccagaaacaccuauacgucuuguuucucaaugagacaucaaauacauucagaucaagcucuauccucucuggucucccugaaaagaguagagaggcaggguuuggggguggcauauagcagcuauacugagcuugacaggcagagcuaguuguuugacagcaccccaugauccggaagaggguggugucaauugagccuaugacccaaaggaaaaggacagguuuuuuggccuaaccgacuucaaagauugaccuauggagaccucuugaaagcacagugagguauauaccagaugucaucaaaaggaaauugauuagggacagaacugagggcccagaaucuacaaacugacaacagacacucuugaaucuacuuguuggguaugucaugacuaaagacacaauuagaacucagacuuuaaguauaccauuaaauaaacuaaauuuucauaauuaaaacaacaaaccaaaacaaaacuauucucagccugguggggagguugugauauacaaccuuuaauuccagcacucaggaggaagaggcaggcagauuucugugagugugaguccagcguggucuaccgagcuaguuccaggaaagccaaggcuacucgaagaaacacugucuuagaaaacaaaacagaacagaacaaguacaacaacaaacccaaaacaaauaaacaaacaacccauuaucaagauagaaucccuaucaagcucccaggaaggugucacuccucuaagugaccuugcuucaguuagcuuccgagcuuacucacauauuugaauaaaacagaccuuugggaaacccacaggugaggccuggagggucagcaaggcacuuuguaagacacagcuucccuaggcagcagagaucuacccauuugguuuggauuaagaacauccauaacaggcgguugguaacacacacuuuuaauuucaguaguuagaagacagaggcaggaggaucuccaagaguuagaguccagccuggucuacagagcaaguuccaggacagccaaggcuacauagagaaacccugccuagaaaaaacaaaaccaaucaaucaaccaaacaaaaagaacauccauaacauuuugaaaaggugccuacauuucuuacugggaguuguguuuugguaaaacauguggauagucucuaaagaacuggggguuccacuccccuuaccuucccugcaagaaacaggccugcaggaacaggauccaaggaaaaugccuggccuucuaggccagaggaggcaaacaaaggcuuaggccucagagcuaagcugggacagugcuuagaguaaggaagagcaggguuucaaaucagagccccauggccccuucacauucucuuggugccuggcuuagcagcuucaugggguucagcagcagcaucucuaguagacagaugggaaacaagacagagaggguucccugaucucagccaaggggagcagauaaccacguuuaccauguggcccugaugccccucuuagaggucaauuggaaggcuggcaauggcaggaagcaggugccuagucacuuaugcuggggaaguggaaggggccauuuguggcaaaagaucccaggcuucacuuccaagaugcaagcucaaagcuaauaugaugaauuuaaagauggugacagguucuugagggaccccauuaacugcacaucugcucugggauaggcagaaaagaaaaccacccaucagguaggaggguaggacuggcccuuugaaucaaaugcagcauguuccagacgggcccaaaaggaauuggcaaagcagauguguggccugguaggaggugggguaccaagcuaggaguagcuucugaggguaaaaaggaacugucuguugcuagaggaugacaccaguuucucuuuucuccagcuaaauaacaacaggagaaaaaaagagaaaaagaacagaaaagaaaaagaaaaagaaaaaaaacccaaaccuaaaaaccgugccuuccccuccuucccccacauauacucagucaucuuuggcaagagagcuuccuggcuguuuuuguagacauauauuuucagcaaaagcaguuaagauguauggcuuccuugcgugcuuuagaugaccacacccuggccuguucacaggacuggcucucccuccccuuccccuaaauccuguuugaagucaauucuggguaggggugguuuggagaauauacccagaguuccacaugcuaaaacuauaguuugcacagaaaucugcauuccccccccucgccccaggcuugcuuaugaauccugggcaaguggauugucccccaaaucuggcauuuugucaaguuucuccaggcuuuaggucaaugcuagauacaggguggugcguagacaguguuagucaaauaaaugcauggauaaguaaguggacagaguggaaacgauccugaacacuccagugacagggccaggaaccaagagaaucuggaggaugggucgaguggcuggggucuaaccucaggacuaucauuaccuaguuuuauaacaugggcagacccagggcccccuccuuuucauaaguaagauagccccaagacuuuccuuacuuggugauuaaaaaaaaaaaaacaagcaggguggccuccuugugugcuuuagaugaccacacccuggccugcacaguaggauuccaugggacagcugagaggguggauugcuuuuuugcaucccaaggucaggccagagccaggggcauacucaucuuuggccaugaaaccguuuagguacauuggcugccucagguaucugcccuguacugcauugagguuggucucacacuuauucagaguuaagaaccccagguucagcuaggaagggaugaggaagguaggccuuaaggggugguggacccagcaggcuaggucguacaauccuguacaagcucacccaauccaaaugcuggagacaucaggcuguuuccucuuggccaauaaaaauagucagcacagagcuaucuguauccagccuaucaugaggaagagcucccuagucauuauucagcaucuguccaaucaacagugucguggcugccacgucaccaaggucuugguagguggccuagccguugucgcuaggaggaacaguugccucagcacgucugcgcagcuuuccuugcggcgccccuccgcguggucuaugauggugcauuuugguccagucaggcccgguguggucggccucauuuuggauuacuucggugggcuucuccucggcgugguuacggucuaguacaccuuagugugcuuuucucugcaugguccuucccagcguggcucgucucagcagcgugguuuucauccgugugaucguccucugcaugguuuuucacggugaggucauaucagccagccaccagccucagcauauuuguccacaguucuuuuggagcugccucugcucggaucacuugagcacuacaccucagucccgacuagccauccucagugugcuuugcucaacgcgauccuccucaguguuuguccugagccuagaccuccauggugaggucuuaucuuguuucgucaugguggucggcgauaugguccgaucugccucagcaauugggucacuuccguguggaucguuucagcacggaucacuccagcgcggucggcugccuuggcgcgauccacuuggcuucucagcauuuuuuuuuagccugcuggguucucucaguuuuucuucaacacgcuucuuuucccucugugugauucuacuuggagagcuuuucuguucagcuugguucccagcgcuucuuuuucucggcaugguucuccuagguaugguuuuuuucucagcgcggguuucuucucugagucagcacggcacaagucgcaaguccgcguggccgcgcucaucauagccucccccuccucgcggcaagcacucacggccagaagcagaggugauucgugccgcgcuuucgcggcugggcuccaucuucguuuugccgcaguggcuccguauucguuuugcaguuacggcucgguccucguuucacggccgguccucguuucacggccguggcucaguucucguauuuugcguccacguccccaucuuuguggcccaggcuuacagaagcagggguggucuugaggcccuuugagccccgaggucggucgagucccaaggugaguggccuaggacaccggcucaggccuucggauucuaaaccccgggccgagucagaacgcacuggagcugaaaccgaaucgggucuggagaccccugagcuuuguagcccgguguggccagcaccaagguagugaguggaguacguguuguuaugugguagcuguuuuaaugcugagagugaggggcuccguucggaauguucgcgcauggugggggaaggguaucguggaacugaggcuggggaaggcugcuuauucggaguuuugaaccgaguugugaucuagcucuuggauccgaguuggguguguguaugugugggucuacagugguuccgagucuagaguggagucacgauuggaaucggguagagauucgggucuggagccgacucggaauucaggugugggggauugggaacuugggguggaggccgcagugguugcaguggguucuuaaccuuccuugugcuuugacccuuuaauacaguuacucauguuguggugaccuccaaccauaaaauuaauuucauugcuaccucauaacugcaauguugcuacuguuaugagucauuauguaaauaccuguguuuuccgauggucuuaggcgaucccuaugaaaggguuguucaagccuaaaggggucacgacccacacguugagaccugcagagucagaaucaggucugaauugggggaauagcagaacugggaguuaccuccagauuuucaguugggauuugauucuuuucugugguuuuaaauugagaucccagaggcucaggucucuguuggggaccagacugaggguuucuaguuauauucaggaccugacugggcaguacaguaagaauuaaaguugguuuugagugugagcauaauggucugagguagggaucaggacugaaguauaaagagucugguuuuuaacaagugggaaucacauuuugagacauggggucccaugugggucagaguugauuuaaaggaccaaggccagggcccaaaccuuaguccuccauuuuguuguucuuguuggucacauucccuuuucuguaaaauggggaggagugcuuuccgcuguaaccuuucugggcauaaaagggaguaaguaauucauagagguaaaaauagucuuaucuuaaaugauuaaaaaguguaaaauauuucucaauaguaauaaggacaaauaauaugcauuuaacaaucuuuucucauaccgugugcccuuuguuaggcacuaccaaaaaggaaccuuuucuguucuguucccuagagcuugccccacccagccaugggccuaauacacagccauccucaggcaauacuugcugaaggaaagcaggcaggcaggauuaaccagauuucuauggugucuuaaaugauccauuucugcaccuguuuuccagauacuaggagaaaaauuuaaaggauuggauugcuugauuauaguucuauuuuaauguguuaccaaacacacugaagaaaaaaaguggaucuguuuugggauuugugcuccagcuagaaggaucuuuuaaaauuucgaaucagagcauguccaaauucaaauaaggagagcacaaauaaagaaaauuaugaggcacuucccuggugaacauagaugaagguccacuuacaguauuaacuaacugaauccaagagaauuuugaacaacaguucuuagacaaguaggauuucuccuugggauauaaagaugauccaauaucagaaacucuauccguguaagucacaguauuaagagacugcaggagaaaaaacauaugguuuucucaauagaggcagaaaauuuacaugaugagguuugacgccuauguaugcauuugagggggcuggaaggacauuacuuaggaagccaaaaacuagaagagaauuucccuaacuugauacaguguauauccaaauuuaacuuuuaaguaaacuuaaaaacuauuauuccugguaagauaaggagcaggccaaggguauuuuccuagccaccuccuaauauaaggaaaagaaauggagauguaagacuuccguggcaggaagagcgaaacuaaugacuuagagagaauaguuguauuugcauugggguuugcaaacauuuugauguuacaaucuuuguguacuuaaaaaauuauuaacucccccuccccacauuuauuuaagauggacuauauuuauugguaguuacagucuuagacauuaaaauuaugugcuuaaacauagagcuguauaauuguauauuccagggaggucauaucucuggaaaacucugacuuugugagaaucaaaauagagacugcagaugaguuaugggcguauuuauuccucagaccaucugugaccuuuccugggagggucugagaaggcuucucagaaguuucuuuggacuuuucuuugaaaacugcugaacuaccugaaagauaagguuuugcagcaaaagaauuauuuggguauauacaguauacccaaacaaacaaauuuuuaaaaccccacauuucuuuauaacaauagugauguaaaagauguaagaagugcacucagauacaaauuagaauagcaacgagauugucuggucuuuuuuuaagacaguguuuuugggaaaacuguaaauucccauuggagauaaaggaagguauuuggaugugcagagacauuuguuuucuuggaaaauuuagcguuagaauccucaguauuuugcaaaucuguaaauuuaguuagauugcagucagacuucuagcuggaggauuuaacaucucuuccucaaaaauguaugugaaagagaaagauguacaaaugccaagugaacuuugaaaaacauuccauggcuuagcagccagaaggguggagugacagagacccagaacagagcucagugagcucagccccgagucuggggaaggugacaugugaucaaaguggcaccacauaucaguggaaccuccuuggaagauguuaaaaaacaaguaaaagagaaacauccugugaacucagaguccuuagaaagggggagcuccaaacuguaaguaaaagguaguugcuauuuauuaagaaaaacuacagagaauauuuucuaggguaggguggaagucuuaaguaggauaaaucucaagacucaaauuuaugaacuugaauaggugcaaaaauuaaggauuucuaugaaccaaauccaucauggccagugccacuaguuccauaauugaaagacaugauuugccuuuuuaucccuucucaugcaaaguucugcccaugacaaauuacaagauaaccagaacacuaaaaccagggagcagcagcugagacgacgagaaagcaaaucagaggaaaagguaagacaagaaacucgcaggaggguuaccagugaagauaugcucaaacugaagucaccagagaaaugcaaaucaaagugacauuuauuuuucuucugagaacccuuagaaaguaggauaaugccaaguguuggcagaagguagggagcgagacuccccgccugccgcaggugagaggggagaccgacacagacauucuggaaagcuggccagcauuuuuuuuccucaaauaaaauauuuuauaccugcggcgcaacaguuucccuccugaguaaacaugcuggagcaguucucccccagaacaaggagaggcugugugugccugcucagcacagcauggccuggggguggugggguggugggcauuuggcucugguugcugugguuagaagcaggggacuagauguacacuucacaagauggagacacauggaaacggugcugagugacacagacagcaaacagaaggaggguuucagucccugccuugguguuuaaauucaaauuacaccccucccagaccugcgcuaacugggcauacuguccauacguacaaugauauuaauaagcuacuccagagcagcugucugaguggaagggaguggggguuacaggauggagauaggaugcaaaagcauggaaggagcagagugguccuuuuaaacagacccuuucacaguaacaauuuuaugggcagaaggcugugauuuacucuguguguuaugcaccaggacccaagagccaaguaugaagaagugaaugugcacccaucacucaccugccagauacccucuguagacuccuauuucuaggaacaucagcuuuuuacaagguuggcuugcccugagcucugaccauuucuucuucucuugcugagcuugggccucagcagcauucuuugugcacacguguucuaggugcaugcaugggugggguccagaggucaaugcuagguaucuuccucuaucacucuccacuuucuuuuuuauagacaggagcucucacugaaccuggagcccaccauuuuguuuugacuggcuggccagugaguccccugggaucuuacuuagugucuauaaccuagaaccccagucaugugcugccagaccuggauuuuaugugugugcuugggaucugagcucagguucucaugauuuccagcaaucacgauucccaguaaguacuguagcuacugaaccaucuccccagcccaauaucaacauuuuuuuuuuuauuauuauuauaucagcaaaguauuccucccgcuucagggucuuaagguuagccacucugccugacuuuuauuuuccuguaauucucauaucucacugcaagugccuuuucuaaccugccauaucaauuagucuccucagcuaauugcuaccucagucucagaagcaugggcuacacugugguauucuuguuccuugggcguguccacuuaaguuagcugccugucuccuccacuagaagggagguccugggugagcgugugugucuucucuguaggguuagcacucuguaggcaucucacacauuucuggucaguggcuucauugauuuguuaaaugaaaggaaagagcaggccaggaaaguguucuuccacuuucagaauucagugagaaaguaaguggugaagauuucuuaacugccaccuugguguuauuuggugaaggauggggguugaggggagaggggugcucuguguuguaguauguuucacagccuaaauggcauuuaccuaguccaaguaguccccucacaguugugauaacaaaaccugccucccaagguuaccacauagcucuuggggugggggugggggggcacucccugccaggucugccuuagacuaguugcaaggagcuagaaagccuuucagcuuuaaacacaggguccuuuaaacacagcggacccuggccuuuauccugcaaugcacuaaauccaugcccuuauggucccuaugaagacgacccuggccuaugccuguauaauagaagcaccuccaucucugcucauugguguaaauauauuuugacagguaauccuguccucacaaugcaugggguuccauuaaaaucuuuacaacauucuuaaaacaaaucaacaaacaaacagaacccuacuuauuguuauguugaugaaugucuugucugcaugcauguauguauaccaugcaugugccuggcauccccgaggacagaaggaaggaucaauccccuggaaacuggaguuucagaggguuguaagccgccacaugggugcugagagacaaauguagguucuuucuacaagagcagugaguauucuuagccaccgagauaucccuaaccccgguuacaaccauccuuuagcugcagugccucaguugugaggcauuggcaccugcagcuuuaccaguuuggagccggccuggaaagaggcuggguugggucuucucacagcugccaguuaguacagacuaguaaguggcucuugugaacaauagauccagaaguuuacaguacacuuaggaggagaagaggguuugccucagagaaggcugcuugggagaguaaguggguggccucuaauacuggguuuccuuucccugugcuugccucugauaucagccuuugccaugguccucuaugcugccuggccccagaaagucugggucaguggccagaguccagacucccaggguccugaucagagucuucaggaaggccugagagauuagagcacagaacucuccuagccucucccacugggaacugaaagcuucccugagccuuuccuagggacugagacccuuguuugcaauuuaaaugugcccuccuuuauggaagaaucccagcuccuugaagagccuugagcucacccucccuagcaguuguagccuuagccaggggaagaaacugaucuaaugggccuuucuccuaauaaugcuaauuguggcaauuaggcucugcaauagagaaggggcagggccaggcccacuaguuugcccuuagcucaaauccaggccuucuuacucaggcugcuguccagguuaacuaagccuggugaagguacuaaauaagcagagguucagcagagggugguugaagccugcuggcuuccaggggcaaucacaguggauauggaucugagucuaauguucagucuaguauucauacaggugacucugggccuugccaugugauccucccagaagagggucuaacuggagcauaaagaugguuugaauuaaucaauagaccaauaucuacccuuuccuuucucucucucucucucucucucucucuuucucucucucucucucucucucucucucucucugugugugugugcacgcgcgcgcgcggcgcgcgugagagagaaagagagagagggggagagagagggagagggugagggugagggcgagggcaaaggugagcaggggagggggaaagaaagaagagugagcaggggaccauggauaagggcuuaucuggucuggcaggaaguuagguuuugaagcauauggcucuauggauuaagaaaccauuccucaguauggccaauuaguagaucuaauccccucaaccuccuaacauauacuaaaggaucaauguuucuucacucugcagggucuugcuuacaaagcacucuggguccuguucucucugggagcugggaaucuggucuaaugaaaggaaacacagcacaggcauaggcagccugaaugcuuaguuauucaaagguuacaccguagcugacuuugaaucaguauauagcgucugcacgguacggagacuuuccaggaagugaauuauguguaggaggcagggaagugauuauugcuccauuuuauagacucagccauuccacacauacuuguugaaaguccaccaugcaucgcacagcugucucgaggagggauuuuacaggagucaggucacgccuguccuauggugcuuguguguuguuauacacugaagggaauauucuuugaggucuggagauauagagaaaggacuauuaggaaccagccagaacccaucugggauccuaguuaggcacuaagaccaagaggacacuguggaggagggaacacgagagaaagaagcuagcuuucuaaaccuggguacagaucuucaguccuugcuuccugugaggaucuuggguuuguucugagaccacugagagcugcuaaggcucuaaguucccauuccauuuagaucccauuccacucagggaacuaaguggaauccacauuuuaaaaggcucuuccuccugaguggaggggaauggagguuaucagaagguguuguggccucccagaggagugacaauacaaaaggagggaauggguagaggggguaagcagccuggcuugguaguggacuaguugggucucagcuaggaaagaaggcguuggaagugauugcaggguuucagguuuacacuacuggaagaauuuuuguuugggguggagcaugaguuggaggaguggaguaugaggugacagauaugguggguccagcuauuggaaagcuaguuuuugucaguccaggagcuccugaugcugagggaagggaccagcguagggaaagaagggcagcacuacuuagugggugugaaacugggugcagagcuagcauggugaccggggauagauggacaggaaagaggaacccauucuugcagaggucauguggagucaauguucuagucuuaugaggguuggcaguggacagcaaccagccuagaaugugccuccugccaguaugacuaugacacuugccuuccucugugacuagagagaaggccuuauuucucagugguucuguuuucucucugcauuccuagaaucaagaguagcaaaagaacauuucuccauagaaugugcagggagggucaccucccucaggaggccucguccuugcuaaaguauuucauaaucuuggaacgauggaaaauccuucuacccauuuuaaugcaaagccgggcaagcuuuaaaaaaaaaaaaaacaaaaaacaaacaaauggccuugaauaggcugagaugaaaagcaaagagguugccaacgcuagagacugggggaggggugugcagugggcagggagauuuugggaggcuccaaaguuagcaguuucugagcuuuacugcucaaaccuagaggcccaaaccaaacagagcagguccaggguucaaggugcaagggggcaacagcccuguguggaagaugucucuuucuugucauuguuccugauuagcuguucaaacagccuucacagguucugcaaaaaaaaugguuaacuguggguccucuauaucuucuacuugguaauuuuuaaacacagcugagccccgggugccccucccagaggcucagaggccagaggccagaggucagcacaaacucuacaccacgucugccuagccuuuaccucaugugucuaggaaugauguacauuagaguagaggcucugauaccucccucgcucaggugccagaucaaggcuucauccucugcccuuugcccaggguuuagugggguuugcuaauauuacuuaauuccugaaugaaccuuucaggucagcauaaaagagcugggauuguauggcaaaacccggauggggaagauggcucagacuguuaaaaacaagcucccagcagugggagggaagcacccccuccuugaggccugaggucaguguucccauuaauccuucugccaagggauauguaccuaaagguucuagggucacacccuaucgggacuagccauucgggacuucugagaaauggcauuugauagcuacauguacugccacaacuguacacaaccaagucacacacauucauccuguucccagccagggcccaagacugagucucauucccguuuuaccuccucuuagccugggugccucuaccuuguaauagaugcugaggccuacuuagaccccaugacugugccugacaaccaaagaagcccaccuucuggugucacccaccucacccuagcucucugugauuccagcuuuucuaaggaaggcagguagccucucaaccagucauaugccccaugccagacagucaugccagccgcuccagugcucguuaacuaccuuuaggccuuguggacuucauguucuauggaugcgauuuaguacucccaagagcaccacaagaaaggggauagcaagcaagaagaaacucagccacauagaaggacuuguuugaggccacugggugccugacaagaguccugccucuggggaaaccagugcuccaugccuguaaccuugacagagugcucuuggauuuauguuuucauagaagcagucuguggagggcuagagaggcagccccuguuuuccugggucccugcuugggaagucacagcuaucacuguugagaaaggcagcccagguuuggagcaguuggaggcuaucccaagaguagguuggauguagaggugugggugcguauaaaugccauccuggguaaauggaaaggccacaggccaccgugauaagguaccacuuccucuuccugccuggugggcugcuucaguaccaaaauguccggccacuaacuugguauaaacaaaugggugugauccaaaugcaaagaacagaugcccuuagcccccacuccuccugcccugauuuuccucagugggcuguaugucuccucuccauucuguuucuaagaccaccuaaacaucaagaaucuggaaaauagccgcuacagcaaauguuuauauucuucuugguuugucauucauucuguuccucccagagaggccuaaaugcugagauacugggcagagggcaaggaacaguacugcccucuccagaggcugccaagagacaaggcuguaguuguagucuuuagggccaucagcccuacaugaugcuguccuccucauucccuuuuuccuaugggugggcuucuucccaugggccacuucuacccaaagccaugugaaaggccuuaaguucuagagggauaaccugaggguggcacugaguugcagggugcaaugagagauuauugcaaggcugguagaacccuccaucugcagggcugacuucaaagcugcugcugggcuuagccugcugcaucaaagucagccaguuaaacaguuuucacauaaaagggagaguggaggguuuaaaagccuucccgugaagacaggcaggcauuccacccucuucucaggcacaagagccacuagaggagaaaguaacugccccuuaaagacacagaaaucaccuuacacccugguuuaggguuugaagacuacagccuuagguacaagcguagugaggcaccuguguggagggauccuccauuugcauucagcucccugcuuuauaucuggccuuguauuuugcuucccuaccuccagcaccuauguuuuuggggugggggugggggcaggcuaucuggcugucgggaauaaggagauguaugguaugacagcccugagggaacucagagucaggcugcucagguuggauucuagcuuuuagucuaaacaauggcuuuauacagugccuuucuuccaguccuagcagccuugugugaauacauuuagaggagacccucguucagccuccccaagaacucucugggaagauccaggagacucuaccuugcucucugucuccccacuucugccuuccucuuugcccccccuccccccaccguugggucccuugccugacuccaguauacugugauggcagaagugccaaugucuccucucaagcagagccuaacccagcuugugccuugcagagugcagaggggugcucacccugcccuccuucagggagacaucaaagggaaacuggaagcauucccugcugacccccagugagugggagaaaagcagcagcuuggcucagcuggcugggcuggggauuuuccauccuaccaacaauauccacaggauagauaccccacucuggcuuuugaggaaccaggaacccucaggaaccaguguuugauuugcagccugauggugccaugaagggcucauuggcauuggggcauggcuagccacuugaggaguucccuauccucaugacgugcugacgacugguuugaaaucuuagcauuucucacccuagcagaauacuaccucgagguccccugagaucuagcuagccaggggagaucacaauuuguguggggacccaagaaagguagagagaagacugccugccuuuucucuaucagcugcuuaucccccaggccuuuuguggagugcacacuccagccuccguagcagcucagcacagcccaggcuauccuagacugucccaaguccucaaggguuucagcaccucccaagcuaagggaacaggaaguccagaaauagaagucaacauuuaugcuaaaccaggguacccuccccccuuugacuaacaugggcuuuuggcagcuucuggcucucagaucuccaugcacaauuuguaggcuaaauacucuacacuacucaggauaucuaauccugucccucaagaguuagacugucagguuuuucugagucacagcaaccuuaggccugguaagucauagugagcauguuucccucuucagccuagaacucacaggaugggccaaagagaaugcaguaugguuucaaggauguccagggccagcagcacuaccugaugagaugagacgagaugcuugccugcuccauccugucagggucuggucacacaacuaggcuggagcaggcuuagagggcaggauuagacauagugagauccaacaaaggcauagaaaauaucagaagugagauagcaagccaggccuuaggcuugugcuuccuguguuccugucaacgcugcccuacucuaugauuauggaaaaaguaggaaaaaaaucuuuagagaaaccuaaguaccaauguggcuuuuguagcagacugaauugugggaggcccuggugaagacauauugagcuuugacaugugauugugccuuagcugaggucuucucucagccaaagcaaggacucaguugggucccgacucccacaaggcuaucuucaaguacuguuuguucuacagauggagguggggggcuguuucucauuucugccaaagucacuuaagggacacagagaagguagaccuguugcuuuucuaguaccuagaaguggaaagguggagguuggucagaaagccacauuuugcuucucauucccacaugaaaaaagauggcgcugggggguuuacccaucuguuccucuauaucuugucuuuggcuggccuaggcccuuaucucaccacaugccacuccgaagagagacggaaaugacaagagugggcuaaacuauuuggacuggguaaagucaauaauagacagugcccgauuaagaacugggaggaccaugucuuccuaagucucaugguaugcuccauucuucaaggggagccauucccguaagagcuggugugacagauuugaaguggcugugccagcuagugagucuuuuccucugaaccauguagugauaggcaaggcaaguugacaaggaaguucuuuccaauucgaagaagccaaggcagucaucaagcuuugucuuaccaggaaaacgucaguguauaucguuggcugucuggcuuagaagaggcaacugugaaugauggccagagagaaucaccuaacacaaucugguuaugaacacauuugggccauggagcgagaggcuagcccuggaggccuaguggauccacaagaacccagagagagaacaaagaggcucagggucuuagaggcuucugauccacacagagagagucaggaaaguuauuagagguguuccuucagcuaugggaacaacaucugagaugcugguacuccagggcagugugugugcugcuggauagcaggaagguuucuacugaugccugaggcuugcucuagcucauaaaucuccacuucuccuuagcacugugaaauguuuacucugaacuaagccucugcuuuaacaagucauguuucaauaggaaaaccuucguugauggaaucgaaugcaauuccuccuccuccuccacgacaguuacccauuccuaagaaaagcacagcauuuuagcaagcacccagggccucaggaacuagcauuugcagacaguaguguggcagauaugauggccucaugugcaucaaggagaaucuggccucuaugugccuggucuugccaguccuucagacugacaguucuggagugcuccauccuucacuuccagccccauuauccauagaagccuucagugggaacucucagacuuggugcugguucauuccuaagacuggccuguugcugugcuuuggaguuagccuagcuaguccuacccagugcugaggguauacauacacacacacauguggcaugaucuaccagcccuaaggcaacaguguguuuucuuuaaacaguagaguagguuuccuguauguaccuagcugccagagguugcugcugugaccuagaaauagcugcugccccaagccuugauccacagguuuuuuuuuuuuaaagauuuauuuuuauuuuauguguauuaguguuugcccacauguaugucuguguauaacaugcauacauggaacccacagaggccaggaaagggcaccagagccccuggaacuggaguuacauauucacaaaaccaagaugguuccuuccaugugaaacccuucuaagagaaucaucaaaaauuacuguauuucauuggugccuacauuucuagaacagcaggcagaaaggggugcauuguagagaauggugauaagauagcuucuggagaacucuggggccccaggccccauggauagaacccugccagggagcuuugaagcuguaccgucccuucaagauguuccuggcaggcggauuucugaguuugaggccagccuggucuauagagugaguuccaggacagccagagcuacacagagaaacccugucucaaaaaaaaaaaaaaaaaaaaaagauguuccuggcauuaacaggguccaaagcagccuucccagccccaggcuggguccuaggagaaccuaacugauugcaugggaaaccucagucauuuacauauucauuuauuuauuucuucaucaaacauucacugaagguuccugaugugcucugaguagauuaagcacagaauauaaaacacugaauggaaguggucaguaucugcccucauggaccuugaauggaauugacagagaaagucaguaaacuuguuaccacaaacaugcgguuauacauuaaaaaugagggaugggggugcaguucuccaugguucagucugaagcugagaaauagccuaggcacguuucagccuaaaaucagcccuagcuugugaaggugaaagucagaggagagcuuagcacguuuaaagaugacgccaagagaauguuacaggagcugggcaccuucggcagaucgacuauucccuggcuuugugaccugggccccagacuugaucacucuaguuucaguuuaucucuaaaucagaaaugguagauaguauucauaugucagaagcugccgugaggauuagugaaguuauauguauaaagcccucagcauaaugccugagaacucuuaaguaguauuagcucaggauuauucuuuagacugacauugugcucggagugagcauguuuucuccuuaaacacuagaguggugguucuuuugaaauacccaguugguaaaaucgggacucuccuguuacuccugccccuaggacuccuucuggaugcaugggcaagcucuagugaggccuaguacucagaagaaaagagaaggcuuuccucuacccaugcucaggauguuguagaguuuucuggcuucuuucggcuccaggagccugugucugucauagaacagcuuggcucagccuagaaccggcacucagagcuaccuuuuggagaugaguacauuguauauguaugcauguccaucauuuguguacacauuuauuuguagggcacagcuaaaaaucuccagaaauauccuggggaagauaaaauucuuucuaggcuucaugguauccuaguggggaccaccaaagccuaacuuccuacccagagucugaggaugguaaggucaacugguuccauuguuuccagagcgcucacagaaaucgccaaucuuuaucugaguuagcuuagccccacgagccuucacaugggggugaagaaugaguuauacaacuaggggucccaggguuggagagacagacaaaacagaggagaaugguuuguccuggaacucacagaagagagcauccugcuucugccuccuaagugcuaggucugcaucuagucuaccuucugucaaagcuagugggcuucuuucuagccucccaccuucccuuaacauaauauaaaagcacauuccuuggaauccuuggaauccacccgucccccagcauugagaauagaauuauagaauuuucucuuucucucucucucucucuuuguauguguauguauauguguauguguauguauacacacacguucuuaaugacauuuucuaaaauacuguuguaaagucuugaaguaaaaauuccacugguaguggggccacagcgagaagaaaaaaaauuccauugguguguuaaucugacagugcuacauaauaaaagaacacacaucuaacaaaccuaugauggcuaauauaaaacucuuacauauuagccaagaaggucuggcaguuuaaaaaaauguauagaccugaauuaagaucauagcaggaugcaaaaacauauacaaccugggugagccucagaggugggcagacggagggcuucauuuucuuuuaaagauggcaugcugcuuggcucaauucauguaacauugcuauaaugccauguguggcaguauaugccuuuaaucccagcauucaggggcaggggcaggggcaggggcaggugaaucucugaguuucagucaggguauauaaugaaaccuugacucaaaggaacaaacaaauuucagugacguacaggcuaguaauugccaggggaucaggaaaguagggcuggaaagccugagguaccauaaaguggcuguacauaggggcccuugaggccacagaaacauucugcauugguacuguacccuaagcuugauacguuucuauaguucuaaguauguugcuggaggaaacuggucaaagaguauagggaaucucuuugcuauuguuuacaggcauaugucaaucugugguuaccuuagaauggagugcuuaaaaaguuacaucucgcuuaagucaguaguacacuuaaagauaccaagaggugaauuaaaaaauguaagaggaagauagguggguggguaaagaguuaaacaauauagagacuuucuaguucacuugagcauugggaacagcgacuucuccuuaugaauggacguuuucuauuuaccaaggugauucuucuuucaucuaaaauaucagcacaauaaggaagguuacacacaggugaguuaugcuaagucuuguggaaaauguggcaugucccauguuucugaagcaccuggagccaccccuguaccucuguagucugaccucaccccuacccccucaucaugguagggcgauucuucugucaaggugagaaaggcaaugauuucuaagauuaugcucccauucugaauaaccauaaggggcugcaucugccuugcuucugacacugaugcuauucaaccagacuucccucuccacggccuugccaagcauggagaauguggguuguaggugaugaaagguaagcugaugccuugugauggaaaaugcauuuaaggagcacagcagacaacccaugucgaacaccuuucuacaugguuccauauuaauacauuucaccucugaacaacucaggaagaauguucuuuuaguaugauuuuauagaccgaaggucuagaaugaaggaagaaguggugaagccuggauuaaaauuugguuuauagcuucaggaccugcuuuuugaccauguaacauuuuaguugcacauccugaaauagaagcaccaaucaaguaguggguguggcauuccucccagccauggacaagguuggaaaaacauaauugucccugguggcccagcugagaaagggacugaguccuugcuuuacagaucaugcuguggagccauuuuuaccuguauagauuauaauagcacugucuggugcacccccuccuuuuggugacagaauuuaggggagagacugggcuauauguuaagauuaugguacuuuuaaaaguuuuuuuggggggggcgggaagggcaauuucuagggacugaacccagggccucccacaugcuagcuaagugugcugaacucuacuuguacucaaaacccaaaagacaaaaccucuaacccuuugccuugaauuacacauuguucuccuguuuucuccgaaugugauaaauugucuuacgauggcccuaaagcaugauuagauauguacccagauggcuccugugucuggccauaacauacucuuuggauguugccuuaugagggagccucuaagauaaguucucauggucccugaacaugguuagcuauugaggacuaagucaggaguuaaggaugugugucacucauagccauagccaugcuuagcucacaggccagucugggagccacucacuaguugauacauugugaaugaacacuucaugccaccuggguuuugauaauguacgaagaagccaugacacacagaaggacaucucauaaaguuauauaauaacaccagcaggaccaguauaguucuaaguagagccuggaaacagacacaaaaucaggaaauacaaucaagauagcuguuaaaaccagcagagcaaagauguaaguuuaguguugaaacaaccauauaacuguggaaaauaagucggcuuuuuaacuauuccaaauccagauaaacaaauaauauaaacauaaagcaugaaauaaaagaugauagaaaacacgggagacuucauuaagacagucacacagugagcuuauuuccagaucugauacaaaccccucaaauaaccagacugaaagaacugacuuuguaaaaaaaaaaaaaaaaaaaaaagcaauauccaagaaacagugggaaaaaguguuuuuaaugacccaaaccaaauguuuuagguauuuauaaaggauaaaacccucaugguggagagauggcucagugaguaagagggcuuggcaugcaaacaugaggaccugaguuaggaucucagcucccaugucaaaagguggguguaacugcauucccgccuguaacaguaccuguugauagauagcuaggaggauuguugggccuuacuggcugccagcucagguccagguucagggagagacucuaucucagaggagucagguagugauaggucaggacaccugauguccuccucuggccacuccaugugcaugggcuccugcacagcacacguguucuccccacaugccccccccccauccauggacaccgcccccccccccccagauaaaagaaaaccaaagcuguagcauacgaugcuuuaagucuuuccaauuaacaggcccauccauauguacucuuguugucgggaucuagggaaacaggcauauuugggcagcauuuacaauaguauagggucugugaggcauuaucuaccuaaaucccauuuaaaauaggccgaagagacaucuuaaagugaauccauuugaaauaaaaaucaauacauugugauaagcagaugauuggaagguuaucuugaaaaaguguuaaguuauaaaaagauuugcucauauauaauaacacuaaugucugcagacacacacuuuuagaaaaauagcaaauugaaaaccuuuauuuuguaaagcacuaugcaguaccaucuugcagagaaaggauguuguugcagaaguauggcaaggccuggcugauuuugagaggggcugcccugaaucuuccaugaccucaccaacucucccuuaaaaugcuuaucuagaauuagccuggcucuucuuuucaauagauaacuggucuaacugucugauuuuuccauggagaaauucaucagcaaaucucuuuccaacuugaugaauucuucuauaagauuuauaguuucucuucauaagugauuugcuuugugugugcuuaauguuguuugguggacaagagcagccuagaaggagcucagucaacagagaugccagcagggauaacauggauggggauggggaggcacagccauguucaauggggagagcaauuucagagggaacuaauuucauaaguggucgguucauaagugaauacacuugaauggauaaucacuauuuuuagcugcucuauacauucaucaauaggggacuuguuccauaaaucauggcauaaucagaggcucugcagcuguuaguagaaaggaugcuugcugcuugucugaguaaagcucuaucuucgaauucauguccauuggugcagagcgcccaugcuaaacgugcaaaguuucauuuggcauggccucugggacauaugucucagucccuggccacugugugcugucggacuccugauuucugcauuguauaguagcauccuugggaauguucacuuucuucauagacuauccuuuggaagagagucuggguccaccaauuuauuaaagguaccuuuaggaaggugguuuuuuaacaccuaguuuagcauuccuaauccugcacuaccaucuacaugacuuugccagauacuguugaguuuacguguugacuagaaaugcgccugguuccaggaauacagcuaacaaccugaggagaauagugagcacguucugucuggaaaaagccuggcccagagcaaaggccacaucccccuuacaacauccuggaaucccagccacgagaaaaacagcacugucaccugcucacuugaaugugcauauauaaguaaaacugcuacucagaguugcaacauaucguaacaagccaguccugugcagacaucugcaagacuacggcaccuaccuguacauaagacacacguacaaguauacaagaaugugugccacccauguccaaaggaggcacagagacauguaucuuugcuuauauaaagucucugggaagaccuagcagaacuaaaaacauuuaggagaagaaacuugggaauuaggguugggguaggagacccuuaguuuuguguuuuuguuuuucuuugccauauuccuuucuguacccuaauuuucacuguuugauuugugcauguauacacaaggauguguggugcauuugugguauuuuuuuuaacauaauacuaguauaaaagguuugcucugaugugcagugcauuuuacugugauguuugcuuuuuuagcacaacauuaauacuuuacaaaagucuuguuuggacauagcagguguaguuccagaucgggauuggcuguaggcagccacaguaugcaugcuggguggacagcaugccuuggagcugggagucucugguucaugucacucuggagcaggggcugcucuagcacaaagaagguuuugaaaggcaaaggcagagccagagucagggcaggcucugggcaggcuccaagagagccagcaacccucugcugaaggguacccugaaccccauugcacaggcgggcaccuccugugaagugagacugcuacacaagucucgucauuauagacuuuugaguggagugauucugaaagaagagaaugaguacggcguguccuacugugccucauuaaauauggaaguuuuuauguaacuuuccuccauuucagguaaucucaaauuugauaaaugaagaaugacagcaguucaucuuucaguucauuugugccucuauugaucuaauugaauguuuucuauacaaauuuauuuuuaaaucuaucuuagaucuuagucuacaaccacauuucauauugccaaaacugcauuagggagggccaaguuaucuucaccauugaaacaggucugcuaguuuggcucugucuguccuguggaaaugacacaauguugaccuaagagggggguccucacuucucccuacugaguccccaugguuggggaagaagaagcugugagcccacccccagaccugcccacucaggacaugcccauguugggcuugucuguggacucugcccuuggcaucccuguugcccaccugggcucuggcagagaaguugggcgggaagaggccagccgaguacccgccaguauaagaggaaacggagagaaacagcuccagucagccccagaagggaggccuggaaaaacucugcagcuggagcaaacacaaaggacuuuucagauccugcagucaaggugcccagugcuuuuuuuuuuuuuuuuuuuaauacagcuauuagggugacaagccuuuccaaaggccagcaguuggcgagaguuuccaggaagcuggucuggcauggggcugggaucauagcaacuuuuaacgagugaaguucagaaggaaagagucaucaggaaagguuuaagguucaacaaacuuuuugaauuauuuugcaaaaaaaguucuggcuuuccaauucaaaggcauguuucccugugaugguuuuaagccagagcuuauuucaaaggcaacacagacugcacguuucuaauucauucccuggagauauuugccuaauccuagagacaagcuuugcaagugccauccagugccuggagacacuagagccauccuacuaucuuuucaaacagccauccacccacgugucucuccccucuaccaguuucugugguugggaguacacauaugcacacaccuucucuaagcaggaagcugcucuuugccaaaagugaauggaauucagauuuccagaggguauccuuggucucaagcuccaacagccaucugacgaagaaagaugcuagugugcgcgcuggggcugugaagagaggggcuuccguguccauucaaaucuuucugggccccaagaaaaaccaacaacuggcugugcucucccuagccccacccagccucagucacauuccuucccuuccugagcccacccuggguggccccacaaaccagcuuccacuccucccuucccacuaguggggagaccuaacucauguacucaucgaacagccaacagugaaaaugaaggucacacugcaagcccagaacagcuuaaaagcagagaaggguccuccccaaugucuguucucaccccagucagaggcuauucccuuuuucucugucuagcagccccuaggacuaagcguucauaccuuccugugcuugcuuccaggaaauccuagccuacuucugccuguaacauucuugguccgggaaaugaagaggcugcuguuugggcugcuguagccuucgcuacuagaauguuccaacauauuagggaucucuaucccuaccuaagccuuccaagccccaggauccagcaucccugggacuuguacauuuauacaugcugacaugguuuugauaaugagucacaguagggaucagcagugacaagguagacuggcugguccuaagccuaaguuucugggauuuguacuuguccagccagggagggaacauguggagaaccuucugcagcugucagaaggaaugagugacuaugguggacauuuugguucugugcucagcaagauaccuagggcagagacuuggcucaaaggcugcaaaucaaauccuuugauuucaaaugagacuauuuucaaugccauagucuccuggaagcaggauuauuucuccugagaucaguucuggaggcgauugaggcuuugccauaugggcauugcucucucaccugguucugguugcuaccaggugcucagcuugucuaauuacaguugacugucucuacugucuauggcucuaaggcccagucugauccucuugcuuggucaaaaguaguguuguccuaguggauuuucuggguguucuguaaaguguuauuaugguuuuacuggccagccuuacuuucuuuccuuggccagucucaggucucaucuguaaguaucugcaucauaaccucaggucuaccaacuucuuccuggcagagucuguagugggcuuguccucaucaccuuggaaggaucuuccuguuccaguccuagguuuugugcuacuuaagaaaaugccccagguaacuagcaguaaugcagccauuugaucuagcccugcuggaggugacugacagaaccccauacagaggagauagguuccaucaguaaacagaacauagggguaagaauugggcccgcuuucuggcucuggucaugccauuagguggccguauacucucuuaucucugauugacuuccauucucuugucuuuacauuauaugacaccuccaaggauguugugacccaaacccagaccgcauggucuccugagauccugugauggggccauugcccauuguugagacagucugguaaagaaaagccugguagcauggaguaugcaaagccuuagggaagaauaacuguuuguuugagacaggucucauuuagcucaguuuguucucaaacucauugucacugaggaugacuuugaacuucugaucuucuugccugaagcuccugagugcugggauuacagauauguacaacuagaccuaguuuaugccguguugggggucaaacccagggcuucauaaaugauaagccagcagcucucuaacugcuaaaccauauccccagagggaagaauaucuucagugaggcccugagccucugggcuggacuacuuuaccccucccccugugcacauagcaugcuaaguucagucaagccuggagccuuuugucaagcauugcuccacugaagguugaccaugcuacccucccccccccccacaccccaggcaccugcaucuggagcccacacuccuagcugguagaguucauaggguagguuuuuguuuucugaaaaagacuauuucaguguuuugaauuagcagaguuucaauuuaauuuaacaauuucaagcucggcggugguggcacaugccuuuaauucuagccuuuuaaacugccaagaggcagaggcaggcagguuucugaggccagucugcucuacaaagugaguauucuaggacagccaaggcuauaaagagaaaccuugccucuaaaaacaaacaaacaaauaaacaaacaaacuccauauccaaaccugagggaaauaaaagucuggcuaccuccaaaggagguagacuuaggcaagagaaaaagaucuuggaguagagggcaggguguuggcucacacauauggccuaaguguagucaaggccagggcaaggggacaggcccagaacaaaugagcacuuuaagucccaguaugaccuucgcccuaccaucuucaccucagguacagagaccagcugccuaggaaauuaaugguggggcccagaggacagcugcuuagugcuaccuacuucaaugaaccuaguucuguuggggcagcaaguuuaggcccuaaagcaggauagguaagaacccugccugagaguauguguuuguagagagcucuauguucucuaagccucaucuuucacccuucuuaccugccuacaaccccacaacauaaauaccuccuaacuaccuugcaaaugcagccucauuucugccucaguucuccaguagggcaccauaagccacuguuaggacagaguaauacuuagaguuugauuuuauaugagggcuuacagccagaguccucagagagaagccagguagaauaaaagugaucccugaaaacaucuugaauuacacccuuccccaguaaucucucucagagcccucugaucucuugcuucuaaguuguucucauguccccaaagaagaaaaagcucucaggggaccugccaauugucucuggacuucuggggcagcagcuccaugugugacgagauuacguaggcagaauaucuaagcagauggugaagccaggauuauggagcuagaaaugcuuggcugaguagagacuuagacuagaccccuaucucuugcacgcgccggacucgccagcaguaacaaugcugcaacaggauccuucugcacacauuuauugggagagcuugauugcagaggcgaagagaccccgagcccagaacuggugcugcuuauauaggccuaggagaggcgugucucacaccuggauugguuaugcacuaagccucauuugcauguuccucaucugauuggcuacucucucucuguaccucacagagccucauuaucauaccucauuugcaugucucacaucugauugguuauacucucaaagccucauuaucaugcccgggccaggcagugucuuugcaaaaaauuuuacugcauguguacacauugguuguuuguccaaacuuaugcgugguggccagcaguagugagcgccacucugcaacagcacauguggcuucccacaccuaucuacuuccccccauucucuuccauguuuccaagaugucacccagaucacccauagauccagccaugggcuuaucgucagaccucugcuaaccagucauugccaaggagaugcgucucagguauggcuuuugccaaggacaccugaacucuccuaaaaggaauacaaauauaggcauaaauacugaguuggaggcuucggggcaccaugagaagcuuaagaggaaaggacauccuaguuccuagucucugagaucuagagaugcuggcauggccuggaagccagugaaggcuccuggcuuccuuauguggcaaugucaaucacgguauacuuaacaggcugaauucacagaauucucauggcagaaggugaucagaugaccagugcccaaacccaccauggacuguucaaaucuaccaauggucauaaacucucacguauuacugagagugccagcuuacuacuuacucucaggacuucaaccugaccuucaccaaaggagacguaggcccccagugacaguguguccuagaaugagccuggcucuuccaguauuucuugugugauaguagcaaguuucugcccuuccugaaccuuuauuguccccuuuugugaagcugaacacugacccacuaaguucuccagcuuacacagauauacauuauguauaucagcuaacuauaccaucaccaacucuagcaccagaagugcagcacaggcuagcacugaaaaacuaguuuguaaauacuguggcuacauuuggguuuaucuuuucaacagagagccugcuuccuaucacuugcagggccaaaggaaagcaggauauaaaacuuaccccucuccuuagucugucugaagguaggugcuuuugaguaagcaagucagcccaaugaugaugggaccaaauauugaagcacacagaggaaccuuuaacugccaaaggcacaguccuuggaucccauguccgacuuccucaucagaguuaugggugcuagucuccugcuuguaucucuaauuauaggagucaaaacagcucacaagccccuuccccagcuacuucaggcuuuagucaggacuuguagccuuccccugcugcuacauauuccagaucaucccagagcucaguccucuuaagucuaauuuuauccuguuuaggacagcacuugggaugcagccugacccauuuguagcccauggaaaaucauuaccuggcaguuuuuaaagcugucaggucaaauaagcaaaaccuuauggggucuccagucacaaagggauacuuuauacuuucucaaguaguuccccaagucagguauaugacuggauaccuguccacauuugcuaaaauguauauaccaacagaggaagauacauucuaaauguguuaauacacaaagagaacuguagcucauagacauuaagaaaacugcuuuaggguccugugagcaggauuggaugacccaagccugccaggguuuccugaaagaugguccguagccacugugagcccacagcaaaugcaagcuucccagggcuuccuggaagacacuguucuuagcuauugcgagcccacaucagaccauaagcauaugcagaaaacuacaguaagaggacaggaaggugaccgaaauggcuggagaaccaaucaggccauuguuccgcagagcccucauagggccauuacaaaggacauuuuccuagaaacugaugcauauauauugaagcaaaggccuuacagagccagccaagccagccaugaggaagaacugagggagccugcauaccccagcccucagguccuacugguaaacagcaaugauaaugaaaggguaacacuggccaaagagaacaaccugaaagcugaccaguugaacagaggacaguccagagaauaaccauaugccaacagcgagcugauuuauagugacacugauaugacagggcagugggagaaggauggugcuguaucagacuggauguccaaguggaggaaaaagcuuaucuugaccuugacuucacacaggacacaaaaaucgauuccagauggacugcagaucuacaugugaaaggugagcuuuuaaagcuuuagaacaaaccagaauaucuuuaugaccuuggaguagucaaaguuucuuaaguaggacauaaacagcacuauccagagaggaaauguuugauuaacuggaccauguuaaaauuaagaccuucuguucaucaaaagacaccaagagggggcaggacaguccgcaagcagggcaguauuuacaauacauguaucuguguaucugacaaaugacucacacuuaagaacacccaggacagagagagauaaacuugugccugaagaagaacagcucucaguauaggauauagaugucuuacagagaucuauaaagaaaugagaauauagaauggggcuuagcucacugcaaauuacagauaccacucugauguuaugagaagccaggauggcuaaaaaggaaauagugaaaaauuccaagugugugugaggauguggaaaaaaguggaauauucacaugcugccaagcagggguaaaaguuggggugacugccaugggaaacagcugaucccgcaaugacccagcacuucucggcauacaauuagcagagauagccauaacuuuuaccagacacauauauguagaauauucuuaguaacucacuacccagaucugcccaguggucauggguaguagaaugaaagagcaaaucacaggccacucagaacagagugucaacgaucaaaaggcucccgagaccacuguuuucuucagccucacugggaggggugggugguucucagacaucagagugaaugaaagugccagauacaugugugugccgugugcgaucuagccauguagauuucaaacucgggcaaagaaggcuguugugcugggaagugagcuuaugguuuguucuugguguguccaugauaggaaaugggaucuaggggacucccuggggauucuacugcuuucuuuggaugcuuggcucucagguagggagaaugcaguagguuuguacuggaaaucuguauacguuacucuuuugauguguucccuuucuacuauaaguaaguuuguaacccagugcucuauagaagacaguauuuucugagcuuuaguagagacacaacacgguacaagcccagagggacuggccuugccgccugacuaccaccuuguuuagaaggauauauuacuccaguaccccugaccagaccaccagcagucccuauuguucaguuuccacuuccagcucuaggcaaagcaaacagaagauguauuugaggggcucucucuguuuuucagaguaccuuucuuuuaugguaucgguguaguauguacugucacacuacucucccuggcuucucugucucccucagaacaauucuaggagguugcugcaucccuuuucaugugcuuagaugaaggaagugaaacuagggaagguuaggggcacugggggcugccuauagcugggccagugcaggcugggagccagauugagggcauucgauucccagucccucucuuucccacugagccacugagccacuccgccucgcuuuuaauuuaauuaggagaacauuuaaucccccgugcauuucagagacggguuugagccuggccggggccuuguggggcucugacagggauccugugacucauacagccuugcacagcccucccgggagggcucucauggggcuucuuuggcaccuuaugcagacagagguggucuggauauucacagaagacaggacacuagucuggaaagacaaacuggucucaucuguucuugacaaguccccuucccuauccuccuggacacugcccccaacauggccccuccaucuucucccaucaucauuugcagguugagaagccaaguaagagaaaugggugcucacugagguaccacagcaggcccugauugucuccaggcccugaauaucccaggcaaagcagucccaucagaagagcuagcccccuaguccacuaaugcuccccuuccagaaggcauaggcuggccccagccucgcugacaaacgcagaauucaggagacauuaguagugauguggaugaaagccaggccacagcgggccucccuggaaaagagaaacucgaacgucuuggcgugagauucugcaggguccaggagaaaguugaagacauggaaauucuaauuaacgcacgaggggcugguuuugcucaaagauuuuugaagcugucaugucaaaagaggcccggcaagcacaugcucgcccgggaggugcuugugggcaccuggugggauucuugcaauguccuagccuguauucuuacuuucccucuguccucuagacuuuucuccacccaucuugguaaacugguggccccugaaugucaucccagagugggauggcaggcugguuaguaaauaaauguugaggcuuccaguugaaaaugucacaucaaaaaagucugagggcucaggaaccaaccucuuggaagaaaccuuuagggaaacuacauggcagagccaggcugagcuauaggcugcugugcuugugguaggcuuggcauuuggggauguucaucuuagauauccuugugcaacggauggggcaaugguuccagacaaguucugauugauucaucggcuggaggguggggugaaguggcuguaggagaagcucacugaggucaaacccagacaugcuucuuuagcguugagcuauaggugcucauguccugggcccuguguaugucucggcaucuaugggacguaccuggagaccuugcuucauuucaggcaaggcuaaugaugugcuuucugugucagaguaggacuggcaaucuuaggguucuuucauccuggaguuuuggggagugcuggaaaaagaguggccaugagcagccacaacacucugcugcuugccugacccaggcuagaaucagggagcuuugaugauagccucaagaugaugugagaggcauuccuggggaaagggaggacugaguagacacuggaaagaugugcaauucugauggcuacaggaccgacaaggacauuccagcuggugggaugcaaaugagcccuugccaguuaaucccaguaagcagaauccuggagacuugcccuauuaguuguaaagauacuccccaucucucguggcagugggucucuauuuccuacguggcccuuagaagucuggagcaaggcuuuagauagaggauucauguugagggagauugaggaguacagggcucccuuccagugauguuagaaccaggaagacagcaucugacugaaauauguaugcaacaccgaggcccagauauccagaucuggacgaugccuggggcuuacuugaggagcugcugguacgugccuguugagcuggggucagagaagcaauauugucuucucagcauccuucccuauuuaccucucugguuuucaauaggccugcaccuuggccucucuguccccaaacuaucaguggccaaccggcucugaaaagaggagcuucacccagccccagggaccuucccauaaucaaggcuacagugaccucaccucccuagggccccugggcggggagagcuugagauggaaacaaaaugugucuuuauuuaugcuuuuaauuugaauucuggaacuggcccagcaugguaauacauuuaacaucaguaaaaugcugaagaaaaauggaucuguuuuucugcaacugcuucccacccacucugcucccugcaagacccuaguacacaucucugucccugguagacacguacgagggugugugccucuuuuuucaguguagguucauagggccagcugcccacaggagccaugcugcaucagugagcugcuggagccuagcuuaauuacagacaucaaucaacaggcugacuaugcaagaggcaaaggaaugcagcccuggugugggcacgugggccccuuacacaguacccaugauggccuaucugcuccccuagaauggggaggggucuugguaaggccaguaguccugggagcacaucagguucuaggacccagacacacaccaggccuauggucaugcucucugcuaggacuuccaccaaggauggcacuagacuucuacagaugugggugucuaaauucuuagaugccucaacccugacuccaacucugcuuugaccagauuauauuuuuugcuuaagccuaugaucucucuaucucuaccuuaggucuuuuaacucagccccaccgugggcuccuccuuuccuccuuucccaccuuccuagauuggcuuguucccagcugcugcauuuggaauaaguuggccuagaaagagucuugguguguucuuggguagagacuugacuggauaaagacuguccaccuacucagguuccaggagugcuggccugagaagagcugugguaccuggaaagauggugacacacuaggccuauagagaccaagaaagcaucauucaugucucugagguucuguuacagaucuguuaucagauuuggccuaguacucugagcagagucgucuaaguggcuuagggcugcuucuagaacagauagacaguaaaugucuggcuccaggagcuuugaguauacuaauaccagcacagguggccuuuugcccccaaaggugugguuauagggcaucuauggacugaacuauggucauguaucaccaguuuccacccucccuugggaccucguuggugcucacaguagcuaggagaugugagacacaucuaucaagguagaugguuuguugagagcgcuacucucauuguagcugcuucugugucuggagguugcuccauggccagaagaauaaaauggaauggauaccaaugagaggugagugaucagggggauaagaaggcugacuggucuuucuaggcguaggcaauucccugaggccugcuaugguugccauggugcuacuuacuauccuuacuccuaagcaggcacuggcauauccaacaccagccacaagacaccaguguuuacacuuugaguugucucaugccguggacuugauggagagacuuaaccauaguguaagcuauuuuucuacccucugacgccagccuauaccugccuagccugucuggacuccuguucccacaccucuguucccgcuugcuaaugcagccagccuguaaggcuaucuuaggagggagagugaccccugcuucucaauaacauucucgcucucucuaaacccaugaacccucucuacaucuuacaaaccacgaggcacugcuaaccucguuuaaguuuggguggucugggaagauagugggcaugccuuguuugaucauaaucauuccucugacaagccugccuucccccaggguggccucaacuuggcuaucugguuacuuaagaaacccccagcacugugaguccaaguuucuucagucauuguaaagucaagccugaaaucuaggcauaggccagaagcguuaugacuacacaagguuaaggacaugaauuuuaguagaaagaguggaagagucucagaaugcgaaucucaggaaaacuaagagcauggcauuaacauccuggcacagaaacacuuuucuagaggagugccccguggggcaguggucagaagcagucugagugaccugccuccaccacaucgcugccucuccugaguuuugguaggaacauuugagucacauguugcagagaaaucauggcauggcuggguacuaggguuuguccuggugaugccuugaugggggcccaaauggggggagaggaugggcaugugucccaggccagcugugccugggggaaggccaacuggaaggcguagaaaaucagccauuuccuccaccugaaggagccccugaggacaguaguggcaacuagcaucugccccauggcuuuggccaaaaucccacagggaaaugcuaaaaaauaauguuaacucucuugaaggagugguggagggguagaggggaggaaaacaacaacaacaacaacaacaacaaaaccaacccaaguuucucagacgcucaaagcaugcaaacaaguggaaaaugaucagucugguuuuccauaagucaaaacaagaggaucauguuuccagauucagugggaaagccccugcccuucucuccugccugagcccugaggccagccccagcagccaguguccccagguucauaaggauaggcagugaguuguggguacuggguaaauagacugcaucccagcaagaggauaagcuuugcccuaugcuagggcaguucccuugagccccagccuuugagggcaaauggacacucacugugacacaugggugaugggggucagcagugucuccccuuccagguccagguccucugcaaagcuguuuguucucaagaaauggggugugcuuacuuccagcaguguagggcucuuccuuacugugaagaagguauggggacagcucauuaggcuucaauagaaacuugaucaugaaggggauccagaacuggacagaacuagacucaaauguccaccccaaccugcuauugcuaugggauaaaccuguaagcucucaagaucaggugaagagugaggacagagcuuggaaguuuuagccuuacccaucagguugguuuacacugaguggaauaagugagugggcauucacuuauuccauucacuuaugcccauucacuuauugauugguccccagguaccuggggacuuagccucccaggguaaaccauagaggcugguacauucuccccaguguuguagcugcccuggggcugaguuccaggacugaguaagguucugcccuauguauguuaaguucuaggccucucaccagcuucacauaaaacauuugugccaagaacaaaugaaagcacugaucuccacuacugugcuauucacacacauacacugacagaucaguggaccaugcaacaaaaggugcuaguaccucugcuuaucaggaaucacaagcugaauuccuuguucuggucaugaugccuuauuaaccggguucucucugagggaggccuccagacugucccaauagcugacuuccauagcucagggcacugauccagauuagucuucacagcauuuccagcuuacuaguguuugcucucaacucacuucuccuuuaaaguaucuaauauaguauuaaguacuucugaugaguggaauauugaaaaauucacagugguccucaauuauaggaaucaucugcugcccgggacccuggcuuuucugguagcacaaaugugaggucauaaacuugggcagacuucuguucuugucaguuuuucuuacucugcgacauucuuuucuuuagguaugcagcuaugcaucuaaugaucauuuuagcagcacaugagcccauagcuuaggucuaccacaauuaacuuuacucaucccauauuuuauggauguucagucuuguaguuuuaugacaaccagacagugauguaauauccaucuucguuguuaaaaguuguugauauacugggcaggugagauagcaugacuuugguaauauuaauaaguguuuuuggauuguucuucuguuaaguuguagccaacuauuccuccccuucaauuuugcuuggccuuuuaagcauggauaaacacugaggcuuucucauuuucaaaauuguuauuaguucuuugagacuaugaucaacgaacuuugauccucaaccaccuucuaacuucucaauuuuguauccucuuguuuuaaaauucaauaauucaucaacuucaguuugugcucuccauguaauucugggugugggggcuguaauacugcaguaugaaugacccaccaggaguuagaauguuaaggaaaaacucuccuuucccaggagccauuaauuguccauagcuuuucaagaaccucuugggguucgugaaauucuuguacucaaugauacaguguugacuggcuugaucuuguguaggcaaucaugcaacuguccugucaugcccagaaguuaguuuguuccagucgucgccuaucucuggcucuuacaguccucccauccccuuuuauaaugguccugggccugugagagggggaugguuuucucauuuucauauucacugacugcuucuggcuuguuugggauucuucuuucagaauugcccguuaauaaccuuugcuuggcauuucaaaggaacuuuuaauucauuagagauaauaaccuuguguuacaugaagcauaaauaacuuucuuggucuauguuugucuuuuuaacacuccguuguuuuaucauaaagacugucuuguuuuuuuuacagugaugcauuuacuuuauggaauggguuucccacaacuacuacagcagucuuuuacauuuauuuccaauauaaacauacaaaugugggcauacaucuguauguguauauaaauuuuaacacauuuagcauuuauguguaaugcaaaggauguuuagaagucauacaauggaaauacaagaacacuauauauagucuuuuaaaaaucugaaauagaacauaaaacuaaaaaaaaaguuaagaaaacuucaaaaucucuaggacuuuagauuugaaagagaauugagaugcaacaccgaaaacuuaauccaagugggggaggggacucaauuuuauuauaauuagaaacaaaugaguuauuccugcaacaagugcauuuuucuaaguagcaacagaagcaaggaggaacaggcucacugacuguuaaaaugcugugcuuugugaaggcaaugagacaagucacagauuuacugcauaucacuuaauggaaucaagggccuuguacccagaguauauaaagaagaaugaucauaauuugacaacagugaagcaaacaacccaucuuaaaaaguggauuacaaauaagcaugggaaauugugcucagccacagucuauggucuuuauggaaauacaauauuaaagcuucagugagauaacccugaaaauuaucaugaagauggauaaagcauuaaauuaaaaccuuguaacagccagcacuucaaggaggcagaaugacugcaacccucaugugcccgaggugggaaugcaaaguggcccaacugcucugaagaacaaacuucauagccuuauaaacacacauaugauuuaugacucaguguaugggauauuuaaguucacauaaaucugcacacaaaaauauacagcaauuuuaccucuaguugcaccaaacaaguuauaaccaagauggcaacagugaaaugaauaaagaaaucguggugugucuaucugucccaccuaugcaguggaauaauguccagcaaucaacuagaauauuggaggauccugggacagauaauagacuauggugaguagacuguguguugugaauacaugauagagcacugaagagagaagguggggucugggggaggaggaacuugcuaacguugcuuuaaaaaauaauguuuggacuaaagaaaaccuagagaaaaaauacugacauaaacacaauauucuuguagauaauuuuguuucacacagggguacuguauaucaaggauuauacaaaccaguaucuauacuagaaaaugggagcugaggacaaaguaaggauaaucagaaacaguauaaacucgagguaagcugcauaaagauacaaacccugaaacauggauguauauagacuuucauuauagacauacauauuuccuaguucuaccugcagaaaggauauguuaucagugacccuuuuguggcaaagaacacacucugugcccaggucauauauaacacuguuagucugccaauaaaagcgaauauggcuccuuggaagaauggccgcuucuggggcuagcacagggaaacuacacgaugaaccuaaaaggaacuaaauggaaagcaugucuaaagggcuccuguacaaguggcuaaaguagaaaaagguuagccacaaaacaauaauccucagcuauaccccagaaacacaguugccaaguccgucuguauuucuaaauaacugaaagugagaugaaaaaagugaucucuguaaguguagaaggaacgaguuaaccagaagugcaccguagaaaugcuugaaagauccguggaugaaggcuagaauagaauuaguaggugaaaucuuuuuuuuuuguaauuauuccuucauucucuuuauugauccauguugaacauauacaauaaacuaaaaagccacuuuguucauuuaauuaucauauaugauuguauuguccauuuuacaguuauguuguuuuccagugacauugauugaaucccgggcuuuguucaugcuagacaagcauucugccacuacacuacauccuuagucccaaaauaaauuuuaauugcuuuagugauuuuaacacauucacagagucucuaauacucuuugcaagagauagaaugaaauuccucauucuccgaauguuggccagaccuggugacuugcuuuuaauaacuaggucuaauaaaggugaaauagugggucaauuacagugagcuauuuaaucauguaaaguugacaccauggugauggaagaaaaugagaaaagcaccuugccuuaaugacauuuacgacaccuguaacccuauucuaauuuugagagaauguuauacagacccagaguagcacugacauuugauaaguauuuaaaagcaucaacuccagugacaguacugacaggacaccaagguccugcugaaugagcgugaugguagauauuggacaggcucuuggagcaucaaacugggagaaagacuaaaguguagcucuacagcauuguauuaaauuaaacuuguuuuaguuuuuaaucaaaguaacaugguuaugugagguacuucgugaaagguacauugcaagacuauuuuuucuuuuacaagaauauguaauauaugcaaauaaaacacacaaauuaaaagggaaaagaagcagaauaguagaaaagaaucucuaguguauaaagauagauuaaaaacuauuaagaaaagcacaaaacuuuaaacagagacaccgacaaacagaaaacugccuuuauugcauugacaaaacacucaaaaaauucugaaaaauccuaaauuuuaauuaaaauccuaauguuuguggugaauacucugacaaguggauucugagauguauuuggaaguguaaaagaccagggaaaaguaauauucuuuaagaacaggguggcuaauaggcuuaucaaaaacaaguacuucaacauaguagucauuaauacaauguagaacugauucaaggagagacuuaacuggcuagugggauagaaauggaugucagaaaauagccuacccauggacacuugcaauguauuaaaggcuuacuuaucaugagauggccuuuuaaaugacacauucaaggacaaggaaauucacauggggaaaacacugaacugggcccuuaauuuucucacagcguacauugaaaacacauucuugguguuucagggcuuaugacaaguagaacuagaaggaccauaggccuggauauagaagaauaucuacauugcuuugggguagaauaacuaagaagcaauaaucaaaaagaaaaauagcaauuuagccacauucagagucaaaaccuagauaucuaaauacauuuuaaauaguaaaaagggauucaaaaaugauaaaacauauaaaaaguuagguaaaucaguaagaacaaauagauaagucugguggcgcaggucuguaaucguagcuaccuaggaagcugaggaagaagaaauauuauguucaggaccuugcugggacaacagugagucaagauaacucucaaagagcaaaaugagggcuagagauggcucagugguagugucuucccacuagguauaagaccuuagguuuaauucucuaguacugaaaaaaaugaccuaaccgaaaaauaagcaagacacccuacacccacccccuucaaaaugagacaagaauucaaaagcgugaugagcuuauggaaagguguugugccugacuagcaaucagggaaauauaaauaaacucaggagcucauggcccaaggggccagcagcagacuuccagcaggaaacuauacagacauuacuuagucauagcuggaagaagggcucaaguaaagggcucugugccugugacauccucagagagaccagggaaagaccuguaaaccuugaggaaugugugcacaugaagaggcccacaggucugggacguggugggaguauguuacuguucccauucuagagacucagggcugagauucaaguguacuggguuauauuauacacuugucaagucacagcuacaacuucauccaggauucaaauguucuuuuggaaaaaaaaagaaaaagaacacaaauacauauuucaguacuugcaucacuuguauacacaagaaaggagaagcaaagaggugacuggaagagggggcuguguucuacacacccagaaugacaagugccaucuccaagccugagggcccagggugagccccucaacuccugagaaaggcucuguccugguauuaggaaauuaaaaugugcacaucaguuggcuguccacagcgggcggggccugcaccugccagagaggaauguggacucuuugguuuaauccugggaaggguucauggggccccugcagugagggucagagaggggcucagcacaguuguuuuuccaagucaaaaggagagacuguugucugcuaggcauguuucagagacuuuaggggugcuucucuuucaugggagaaacacuauucaggacugccacccacuuuauauuuggaucuguacucacagccaggucagacaucucaaagauucugaaagggaguugagagggcaggguuucaacuuaaacacacugguggugcuccucuuaggcaagagcuuggggcaaguauuguguucuaagaagccccauugggcacuucaucucugaagagcccagaguuugucuuucauaaagauauaaaaagauagcccaacugcagaacaaacugagaccauggugaaugugacaagggucauaugaccacuuagacccuguguagaggauacuagagcaaugucagguguucucuucugaaccaaccaaugucaguguaccugguccuggaggaaaaguacuguuuccuagugacagugaagucacauuuuccuaaaacgauucuaguuuuugaugcuuucauuccuuggcugcuucugucuugucagagccagaaucuggaccuaagugugcagggcagaacaaaacaauuuuguuuucuaggaaaaugggaggucuggaauggcgaauguagccucaggcguggcaacugccccagcugggacuacccacugccaaguuucacccucucucaagagaaccaaaaccagacuguacgcagcaucuuccuucucagccaaagggccuacucguuagggugauuugcauuguacuuaagcauugaaaaaaaaaaaagacuggaaggaaauagaucaaaaugugguauguuugccuguggauuaaaggacuucaaaugauuuucauuuccuuccuuauaguauauguauuuucuauuugaaugaaugauacauuuagaagucagaaaaacaguucauacaagccuccuguauuugccuugcccuccucauccugggguuagcacaaugcaucuaaguguccuuacucagccaccuccuccagucuguccuuaagaugcccaagagacccaaugacacagagcuccuacuucccaagcucuccaagaccuucccuuuccuagcuccauuacuccugcauugagcucccagacuuucccucugcauacccgaucaucugagcauuccaaguccaacucucugcaaggccccaggccacccuguugcccacugcccucugcugagacuugcuggugucaguaacuucacccagcugcucaccccugcccuccuccuccuccuaacugauuauaauccugccugaucucccagauguaaccuaaaccaccuuccuauguaagcuccccaaggcucuagagauugccccuucaauugcuauggggcuuaugugugccuggcccucagcacaggaaccuugcuuucuuccucucccaugucaccuccggugccuggcacaggcaaguccccugagccagcucacuccgauggaauaaacaagcugccuauguccuccccuagcagaggcccuuucccuguccccccucaaucaauuuccccgucuugguggauuugccaaagcccuguggauccugcaccaugaaggaaaaaaaacccucccuagggcaucuggacagcugcagccagguccugcgugacauugcugagcugcagccccacagccugugccagcugcccaugcccuguucacagacccugagccagaccagacccaacaccaccugugucuucacucagaggggagaaguaagagacaaggacagaaaguguaaaagcuauucccacaacagcugccaggaacaaggcgagagugcaguguaaauguauauucacagcugguacccaguuccgcuuaggaaaauaccuugcuugaguggacaccuguuguuuuugcgaacucugcaaccaggccuggcuucuggaaauaguucaccgaaucuuccuuaaagggguccucauuuccuacuccccaguguguaagauuuaggaauucauuggcuauuuccaaagggggcuuuguggcuggaucacaacuucagaaacauaguugcacuuauaaagauggcuuguacuuugguugggagcauugagagccuagccugagccuguggcagaaaucauuuggaaaaagucuggcaucuuucuucugguacauguaaaauaguggacaucuuacauuuauuggaaagugaguguuuaaggacacagaugaauauagcuaugcauguaucuauaggcagagagagggaaagagcacaaaaaggacaggguagaaggaggagagaaagcaucaccagacuagcucuagcugugucuggaacagccagguucagauucauaaacuagaaaaaugucucauuguccuuaucuagauugaaaugggcucugcagucuguuaccaagagcacuuaggaauauaaaaagcuagggguaagauaugaaccugaggagauaggucuggggguaagucuagguugcaaaacacagcaaacaaaacaacaacaaacacccuaagacagucuuguuaagcuuugcagaguagaagacaggaaagaagaagguuagcuagauaaaucuggcccgaggccccagcuucagcucuacaugggccaggaaacucugggaaaggugcuucguacagcuguccacugacuuucuacuguuauaaugcaaacuucucuuuagagagcuucucucucuacccuguguuugcagcacuuuauggaacaugcuguauuuuguguucaagcaaagacugaggauacauuuaacuugagauggacagugacaugacaguugaagaugaccuauggaaucccaagaaauccuaggaacaaugcuaggcuuugugcaacuacagaguucauagugcuggagacuuuucacugaaugccuuuucucauaauggagauaacaggccuaacacauaaaucucagaguaaauggaaaugauucugugggcccaaggguggggucugaaugguaaggugcuaaagaggacaggcaaugacagagcuagcccuaagcaagcccaggaagcagagcaugaguagcacagcugccugcagaacaaaacuagucuacccagcuuuccaugcugcaagaagucacuguccaggucucccaagacacauuuggaagggaagguuccaggcagcaagagcggccccaggaaacuuuaauauacaauggaaucuggguuaagcacuaucuucuccaaaaguugagcucacaggacauuccccagaaaccucuggagagguggggaggaaaguuucuggaggucuuuggacgaagaaaacaaaaaaguggccuugauuuuucaaggagaaauuacacaggaagaaaaaaauguuuuuaaucuaauuaagagcgaucuuuucaccuucaucacaacaucacggaaaugugccaguucuuaacuucacacaauaaucaaagcaauuaaggagaagccuuggaaacuggugcagauguucucagaauguuuaauggggaaaugaguugcaggccucauucucagcauccggcuccaggcccuggcuaccaaauccagacaucugcuggggccccacucccaggccuggagggugugugcuugagaaacacaggucucuucccaggcugccucuagcgaggccagaucuggggccccagaggcuccccaugguuccucaagccagagccuggacauagucagaaucaccccagagcuagggagaagcuuaaugucaaaauuauguuaacaacugaugucaaaaguaaucaacucaaacuggcucccucaccccugcuggcugcaggaggacuaugaguagaggaagggggggcaaagagccccuggcaggggcugggagagacucucuucuuugaccuccucagcaugaagaucacauaaagguguggcagcauuggugcagucugacucugugugcuuugguucaauguugccaagcuagacccgagaagcaaauuaguccauccuugaguaauuuucaaaaaucagaaaccauguagaaaggagggugcugcucacuuaguaacuagccuguuuuagagagcagaagggcauaugacuaaaguuaaauggcuugaaagugaagaccuugauguaugguucaggcagcucauuaaaccacacuggaagcccugcuguaugguacacacaaagaacauggaagaaaagaaaacaucccugguuuugaggacacauaggcaguauggguccucacacauguacgacauuuaccauucauacugucuucauaccaaaggcuucuuaauaaaagaaauaccagauaugacuccagggcuuuguuuaaugcaggguaggccaaaggcaauggaaagaaaucucucaaaguaagccuucaguggagucaauacuccagguccacauuacugguagaucuuuaaggaguguuguaagcugaauuccagcuguucacuaaauagaccacuuucuugggaaguagcuggcacaaguuuccuguuauucucuguccauaaaucuagccccaaaaaagugauaggaagggguuaaagccuuuaagaaugaaaguagcaugaugcacuuuuuaucgaaagaauuuuugggauugcuauguauaggauguagcaaaggaaagccagggagacuugggaggccagugaagagugaaagggacauccaaacaaacagacaaacagacaaaccccuaaacaaacaugguggcauuagcaggggaagaagcuauagaaaccaagagugggaaaagucuauaugugaaaaagcauaauuuuaaagauuugcaggaauguuuggagaauaacaacauucuacucccccaccccaaccccuggacuucaaaucuucucacuuacucaaaaaaucagaacaagcaauucaacaacaguaagagcaaaauaaaaccauauaugaucuauuccuucaacaguaggccaaauacauagaaauuacccaugagaggagagucugcccaccauuguauaccugugagugcaaaagaagaggccuacgaugcucugucaaaagagugaggaugcuaaguagugucaacaaaaauaagguuccccucuccacagaaauauuuuuauaggaacucagaauuaaugucagugauuaauucugggaagcagucaguaauucacagcaaccaagugaauaucacaaaaagaaaugggcaauuaaaaaguguuaggggcccagcaagaugauucaguggauaaagauucuuguugccaagacuaacaacuuuaguucaaccacugggaaaaaaacccauuuaguagaggaaagaacaaguuugugcaaaaauuacagaaacuugggacauuuucacuuguccuuaaauacucaucuucccucuacuaagccugguuugguggcacuguugcagaugauagguaguauggacccugguccuuguuucugaagugugcaguacagaccuugucuaaaauaauuauuuauguuuuacaauaauuuuuuuuguuuuauauuguuuguggguagccugaaagacugacuuaagguguuuucauuuuccccccaaauaguaauugcgaauuuucucagugugaaaaauaguggacaguacuugcaaacgcuguaagaccuucagagcaguuauaaugacuugagcaaagaucagugguugaagcacacagcggcccacugaaaagccucagaaggcaaucuagagagagcuuccuuggaauuuuagagcauuuaaaauaauaguaugugcuaauaacuuacaaaacaugcacagagcuagaugcuaagaagagcccugacaauacuacaaaccaguaucuaugagagauuucuauacguaaguuaccucaagcuacaagugaaagcaaagacaggauuguuaauagucuguccaaauauugaaggaaaauuccaguuuaguuaauuuacaaaagcuggacgaauccugcccuccuuuuauaccucgcugucauaaugaacugaacauaaaugaaaggaacagaacuucaaagaccacacauaacuucacaaaagaaaaauagcuugggaauaaauaaaaaaaaagcuuaaaaccacuuaaguagcauuaaaaaaucuggaggcagaaaagaaucuaauguccacaguuauaauauaaauaauugaaaauauagagcuuuaaacaaagaaaauauggacuauacagagaaacaauaacaaaguuccuucccacagaaagccgaaagaaguauagacacacuguacuuaacuugacaaaaaaauaauuuuuaauuaggcuaggaauguuucagcuggaaaagggucuugauacuuaagcccugugaccuaaguuugagcuccgaucccauauaaagguauaaggaaagaacuacauaaaaucagccccuaaccuagaaaugggcaccauggcauguacaguaaucucauugauaauaaaauaaaauuagucuaaguuaugcugaaagauaaaaagaaaaugauaaagaacuaaagaaaacaaagaauaugaagaaugagauaaaauuagaaaauggaauuaaacaaauucuagaacugaaaaguauuaacaaaugaaaaaauccauuagaggguuucaucagcagaucugaaugauauaagaaucaguggacuuaaggaucaagucugagcaccagggggggaaaaugagcauuucaagaauucuaugguaaacuaccaaguaugcuaauaucuuuguuggaaaucccaaaaaguaggugaaagaaggagcaggaagaagaauugaccuaguggcuaugccuccccaaauuugauuaaagacaaaaauuacuauguacaggaacauaagcaaaaggacccagaaaugauaacugagucacagaaaaauacacuaucaauuauugaaaggcagaacagacguuaaaaagaaaaaaaaagacuuugcuugucauguagugauucucaauacaauuaauguguuuguuaucagcaaguauagagucgacugagaauggaauagcauuuuuaaguacugagaggaaaaaagucugucaaccaacaauuuuauauacagcaaaauuauucaaacauggagaaauaaugagcuuaagagcuucucaaaugaauaaaagcugggaagcucauacuauauuggcucuacaaaaacuauuagagaaaguaauacaguuucaaauaagaaaggacuagaaaguaacuggaaaccacauagagaugcccagaccuugaggaccagguagcuauguaaaacauaaaagccaguauuauauauaauaucuaaguuuuuaauguuuauuauuuuugugauaaaagaacaugauauauacaucuggcauauauaucauaugucuuuggauauauucaugcaauagauauaaaauuugaaaccauguagaauugaaggagauagagcuguauaggaucuugaauuaauuuguaaaaguuggaagaauccugcccuccuuuuuaccugcuauaaugaacuaaaccuuaaugaaccaaaucuaaaugaaaggaacaauauugaaacuauguuggcauaaacucaaucuagaauuuuguaaaguuaaguguaauuaauucucauaaaaauuauucagaaaacaucuggaaaaguauaaaucucaacauguaaacagcuuagaaauuacaguaucucaacaaguaaaauggugaguugacugaaaagucgauuccauuucuguaucagaaaugaaaagaguaaaacaaugccuucaaaaugaggggggggggagaggugaugggagauugaaggagagagacagguagacauggagaaucagaacauauuacaguagacauugcuggaaucagcuuggcuagaaaaaccuaauuugugauuuaacugcuggaguuuagauguagauagauguaagaacuaaaaagucaaaggcacuaaguuuugggaagagccuuaacguuuucaugaaguacuucauccaggaguuugaucagauucucaaugcgaguaguagagaaaaauucccuugaaacuuucaauauugggagggaggaaagccauucugaaaacaaacaauaguguuuuucgucaaggguuuaccuucagggaaaguuaguuuacuaggucuuagccagcuaggauuuaucacaagcuaacugaacugaccuaaagcaauucaaauuaacucuagauuucuuguggaguagaaauaaccaaacaccagaccaguucacuuuagccauccuauaccacccaagaaaaaauauugaagaaugguugugacauucagucaagaggcucaguaaaagugagaccuaaacacagaacuauagaauguuucuuauauacgaaaccuuucuguauuguuaauaaugcccauucaauagaaguuccuuuugucugauacaucauaucugcuguccaccuauugaaaaaaaauacaaggauucuaaaagacauuaacuuuuuaaaacauagcagacauuucagauauguugaaauuaucggagauauuugaacuauaaaacuaaggacaacauccaaggacaauagcaaggaaggaaccaaacucauagggaaaacacaaaaagggcugggaaccagcaauagcaauguaugaaaaauacccucuguagacucauuugauugcacacagaugagaaaaaaaaucagaguaucuuuuuguacaaacaacaaaaacuaaaagacaaaaaugaacaaaacagugagaauuuggcugaguugguuaaguguuugucuuauauacguaggaccugaguuuggcucccaaguaaaaaaguuaucuaguuaucuccauuccuggggcagcauuagaagacaugucaaucccuaagaauacuagaaauagucauauagaagccaaaaacaaaacaaaaauaaaaaacaaauagaaaccauuugaaacaacaggaacuaaaaauuuccccuaaauuauuaucauacauuaaacaguucaggaagcugaaagaauaccaaacaggauuaauaacaaaacuugcaucuaaacauaucauuaucuacagaaaaucaaauauuuaaaaagcccuacaggaacaccuacuauaaaauagcaauaguacaaaccacauccaaucuguccucagaagcaagaagagcgaaauaacagaacaaaacaaaucgcuauauaucauucugcacucugcaauugucuuaagauuggccaguuagguaagauuuuguucaaaacaucuaaaaauguguuuaauuauguuuauguauacuuaauugaaaugaaugguaccagugauuuauagaggaguuaaugguuacuuuaggucauacaauguaugaauugguaugguaugauuugaaagagggcuuagcuuaguugaaaauguauacaagauccagagaaaucaccccaaaauaaugcuaguaaacaaacuuuuccaaaaacaguauugcaaauauauagcaaaacaaguuuguaguuacagguuguaucuuagcagccuccuggguccauuguaccagaaucccacauauaaaucucauguuuacaguagauuucagauugggaaaucuguuuugcauagucauuguuauuuaauaaguaucuucaccccauuuuguggcaaugcuaguagaggaaagugaauugcuacugagcuauaucucaagacacuaccauaccuuucuaauugcacaagcucuaaugccaucacaccuaaaagaagcucugaauuaaauacaauauaguucuuaacucguagguauuaccuaagagacuuaaagugauuuuugagcaggcuaaaaccaaccagccaccacuaccacaacaaaagauaucugcuaacaagccaucagauaggauauaucuaguaguauuccuguuguugccauugauagaaaaacauaucucucccagaacaugagaaauaugagaaacaaauuaggguaggauaaggaagggagaguugcuauauuuucuucuuguuugggagagauagcuauuugucaaaagaaaccaacauaauacuagauagaaacauaccucuccggaauuauaaucuugguaaagagaaaauuggaauaggaagguguguugacuuucugcagcacaacucuguuuaggggaaaugucuguuugucuuaccuggcuucuuguaaaaguaugguagauaauauggcccaugauaaucucauuucaaaguuccuaucaaaguaagaucugcuuauucucuauaacccuguggaugaagccauuucagauaaagaugagcaaaggguuacuaugcuuugaagagaaauuacaguauucaaagagaucuuuaagcccagacauuggauuuacuagacacauacuuaaagcaauuauuuuaaagaguuaaauauauugguaaucauaauaaaaauauaagcuacagacuaggacaaaacauuuaaaaaauauauaaggagcuucccaaaacuuaaaagggcugggaauguagccucacgacaauaggguacuugucuaacaugaacaaaacuuaaaauucuauccucauaaauugaaaaaaauauguguaugacugaauuuugcuuucugauuugaaaaacacccaaacaauaugaaguuaaugaauggcaacuuuaccaauaugcaucaguuuugcaggagaaacaccuccauuuagcauagauguuaaagacccacaucuuaaauccaaucucuagaagcacaauguugaugaaagaaagccaggcuuccaaagaacaucaucccaugccugagucaguuuaguaaaaucuacaaaacuggccaaugcaaaaugagcucuauugugaaggauaaaaagacaaugaagaacaagcaaugguaagauuauguuagaucaucaauuugaguacauugaugagaacuucaaaacuaucuaagaaugugcagugagggggguagguaucuuuuugccauauucucaaaugaaaaagcuuuaaaaaugaaacauuuuaguuuaaacaucuuauuucuugagggucuaaaagauucuaaaguugucaauguucacugaaacaaaaaagaugguaaucacauggaaaugucuuuuguaagagguuaauauacagggaccucuuaguuuucacaaagguaggauuuaugggcaggaugauaaacuuguuuuccugauagacuuucuuuuccagacuuaacaggcauaugaggaaaaaugguacacugaggcuauguauaagaagauaauaggcaaccuaaacagaaagcaccaugcuuggauggauuuacugauaaauucugacaaaucucaacuauuuaauggaagaauguauacuaaagguucuacagugucuuuuagaagguaggaaauauugcuuaacucauuuguugagaccaauguugcccuuauuucuguagcaaacaacacauuccaaacaagcuaaauaccaguaacucaugcuguauguguaaaacaauacacuacgcaacauuaauaugccaaauccaaaaauaccacaacugcucagugcuaugggacauuaaaaacuaagguaaguuaucacaagcauaaaauaagucacaggauuaugucaccagacagaaauauacauccgacaaaaaucuugaccaacccaugguaaaaacaacaacuuuggaacauuuagccucagguacguaaucauaagaaguaaaaagaacuuuuaugauuauaucacuggauacauaugaaucugacaaaauucuuuacuaacacaugauuaaaaaaaggacccuuggaacauuaccaaaucagguaaguaaucacaagaagaaaaaaaauguuacaugacaugauuauauuucuggauacaauaauucaucuagcaaaauucuuuacuaacucaugauguuuaaaaagccguuuggaacauuaaaaagucagguaaguaaucacaagaagcaaaaagaaguuacaugauuauauuauugaaaugcaucuggaaaaauuuuauaucaauuuuaaaaaagcccucuagauuauuaaaaccucagguaaguaaacacaagaagcaaaaagauguuacaugauuauauaacuagacaaaaaauuugacaacauucuuuaccaacucaugaucaaaacaaagagcauuaaaaucucagguaaguaauaagccaaaagaaguuacauacuuauucacuggauacaauuaccaacucauaauaaaaguaacaacaaccaacaacaacucuacacauuaaaaacucaggauaggguucacaagacccaaggggaaaaaaaaaaaggucugacaacauuauuuacuaacucaugauuaaaacaaaacaaacaggaaaacuucuggaacauuaaauacucaaguaagugaucacaagaaguaaaaauaucacuggacacaaaagugcaucugagaaaauucuuuauuaacuugugauuuaaaauaaagaaaaagaaaagaaaaccaaacaacuggggaucauuaaaaacucagguaagugaucauaagaaacaagaagcaagaaauaaguuacagaaaucugacaacauucuuuaccaauaauaccaaacaaaaaauaagcacacacaaaacccucuagaauauuaaaaacuuagguagcugaucacaagacacaugaagcaaaaaagauauuacaugaauauuucacuacacacaaaaaccugacaacauucuuuaccaacucauaauacaaaacagaaaaaaaaagcauacauaagacaucuggagcaucaaaagcucagguaaagaugacaagaagcaaaaagaaguuacaagauuauaucacuggacacaaaaaugcaucuacaaaauucccuaucaacucaagauaaaggaaagaaaagaaaaaccuaacaacucuggaccauuaaaaacucagguacaugaucacaagacacaagcaaaaaagaaauuacaugauuucacugacacaaaaaugcaucugacaaaauuccucaucaacucaagauggaagacaagaaaaacccaacaacucagaaacauuaaaaacuuagguaagugaucacaagacgcacacacacacacacacacacacacacacacacacacacacaccccacaggaaguuacaugauuauuucaguagacacagaaaccucacauuccuuaucaacucaacauaaaaaacagaaacaaagcaaacacaaaaacccucugaaacauuaaaaaccaugguaaguaaucaaaagacacacacacaaaacaacaagaaguuacaugauuauuucacuagacacagaaacaugacaacauuguuuaccaucucauaauacaaaacaaacacaaauccuuuggaauauuaaaaaaucucauguaagugaccacaagaagcuuaaagaaguuacaugauuauaucuuuggacacaugcaugcaucugaugauuuuuuaccaacucauggauuuaaaaaggggggaaaauaaaacccaacaacucuggaacauaaaaaacaaaaaguuacaugauuauuucacuagacacagaaaucugacauuuaccaacucauaauacaaaacagaagcaagggcuagaaagaugguucagugguuaagagcacugacugcucuucuagagguccugaguucaauuuccagcaaccacauaguaguuauauauccaucuauaaucugacucucuccugacgugucugaagagaacaacaguaugcugauauacauaaaauaaaucuuuuuaaaaacaagcaaaacacagaaacccucuggaaacuuaaaaaggugaucacaagacacagauaggcaaaaugaaguuacacgauuauuucacuagacacagaaaccugacauuauaaacucacaauauaggaacaaaacaaacacaaaacucuggaacauuaaaaaacucagguaaguaaucacaagaagaaaaaaaaaguuacauaauuauuacuggacacaagcaugcauccaacaaaaauuuuuaucaacucaucucaaaaaccccaagaacauuggaauauuaaaagcuuauauaagugaucacaagacccaagaagaaauaacgaaguuacaugauuacuucacuagacacagaaaucugacaacauucuuuaucaucccauaauacaaaacagaaacaaaaagaccacacaaaccccuggaacauuaaaaacugguaagugaucagaagagacaagaaccagaaaagaaauuacauguauguaauuucacuacauacagaaaccugacaacauucuuuaugaacucauaauacaaagcaaaaaaggcacacacacaaaacaucuggaauauuaaaaacucaggugagugaucacaagaagcaaaaggaaguuacaugauuauaucacuagacacaaaagugcaucugacaaaauucccuauccaaaagaaaaaaaaaucaguaaacacuauaaggacgucauuaacuuuguaaauaccauuuaccaaaaguauauaccaaacauaauugacaggaaaaaaaggggagguaaggauggugcccacucauuuuucaaaaucuuguggaaaacuccuaaguaauggaccaaaauaaagggaauauauauuuuguuuaaaaggagcaaaguuuuguuuuaaguggcauuaucuauguagauaauaugaaaggacacauauacaaauucugcaacuauuaagggaccacagcaagguuacaugacucaaaauauacaauaaucaguuacuuuccuauaugccccaaguuaacgaguggaauuugaaacaaaguacauuauugcuuuggcaucaccaaaauaaacagauaaaaauauguacaauauauuuucaauauuuaacauauugaaaaauucaauauugccagauguccaauaacccaugcugauccccacauuaaaugcaaccuuaagcaaacacaaauguuuuaucaguauuggaaaauggacucuaaggcuacuguggaggaaaaggauagaauaugaaacauaauauuaaaggauaauuuaaaauuaaccuauuuuaaugcauugcuguaaagcuuuggggauccagaaacuauauuacuuguaaaagaauagguaaguaaagaugaaaggaaaagaaaauagcauguuaaaauacaaucuaaguucacucaacuaaucuguaguaaaggaacaaaaauaagaauggagaaaaauguucuuuuuuuuuucaacaaauggugauaaaauaaugauagccacauggaaaauguaagaaucuagauacagacuuuauacccaauaaauaaaaaauaaguugagaauggaucgcagacaucaauguaaaaguagaaaauagaaaauaucuucacauaauacagaccuaaaaaaauuccaaaccuugcacuaaagaacuaagucauuuugcauuuguaguuugauauuaagaaaaaaaaaacauguuaaacuguugccaccucuauucaacauaauggugaaugguuuaacuggaucaaauggauuagcuggacacauguaacacauguaaauuggaaaggaaguaauaaacaagauuccucauaagauuguauaugguaaauucaguagugcaaaagaauaucaguacacaaguuucauuucuauacaucaaaauugauauuuaagaguaccauugacauaauuucauuugaggcagcaguauguuauccacagcuuugauggccaggcuaccucguaauuauucuugauuucauagaugauaaaucugaaaaacuauauuguuuugcccuuacuacaauaggaaccacugcauccaaccaauucuugauucuugcacuuaaauaggucuuagcucauucauaccagauuguaaauacaauggauguauaccaaaauuaaggaacacugucccaauauaaugagaaauacuaaaaacccaaagagagccgggaagauauccauuugguaaagcauuuggcaaaaugcuuuuaaagcaugaggaucugagggugagcccuggaacucaugugaaaaugucauguauauuggauguuugcagucacagugauggaauggaaggaagagaauccaaagaguuuaguaauuuggcagucuggccuauuuggucaagucgagacuaucucaauggagguggauagcauuucuaguuaagaaaguggaggcuguccucugacuuagaacacaugaauaugcacaaacaugcaccuacauauauaucuuuguauauaaaagaacaaggccauuaucaaagaaauacaagucauguuccaguaaccgacuccaaaaaaccaggcacauuaacuuagugacaauuuaaaaugaguuaagaauagccaacuaaaagagaacugggagaguacaaucugaaaaacaauacaugaacaaaugaguuucaauaaagcuauagaaagcaaagccaaauucuggaggugaagaguacagugaaaggaaaauuguaagacuggcucaaaacaagauuuuucaauuaaaacuggaaaccuugaccuugaaaagaacacuuggaccaaauggauuuaacagaucuauagaacauuuuaucucaaaacaaaagaauauauccucucagcaccucaugaaccuucuccaaaauuggccaaauaaucacacacaaaaagccuuaaagaauccaagaacacugaagugauuccaugcauucuaucagaucaccacagacuaaggcuggacugaaauaacaacaaaaacaaugaaaaucccacauacucauggaaacuggaugcucuagucaaugauaacuugguccaggaaaaaauuuaaaacuuucuagaauucaaugaaaaugaaagcauagcauacccagacuuaaugggacacaaugaaagcaguguugaggacaauagcacuaagcgccuucauaaagaaacugauccuauacuagcaacuuauagcacacuugaaagcucuaaaaugaaaagaaguaaacacauccaaagggaguaaauggcaauaaauagccaaacucaagauugaaaucaaccuauuagaaacaaacaaaauacaaaaacucaacaaaaccaagagcugguucuuugaaaaacaccaacaagguagauaaacccuuagccaaacuaucuaaagggaacagagccaguauucaguuuaacaaaaucaaaaauguaaagcgagacauugaggaaauugaaaaaaacauuagaucuuacuacaagagacuuaacaaaacuggaaaaucuagaugaaaugguuggcuuuccagacagauaccauguacuaaaguuaaaucaagaucaggcaaacuaaaacaagaacaaacaaacaaaaaccaaccaaacaaacuacaaaaaaaacagcccagcgccagaugguuuuagugcagaauucuaccaacauuaaaaaaugagcuaauacuaauacucaaacuaucccacacaauagaaacagaaggaacacuaccuaauucauucugcgaaggcacaguuacucugacaccuaaaucacacaaagacucaacaaaacuucagaccaguuuugcuuuugaauauugacacaaaaauacacaauaaaauucuugcaaauucaauccauaaacauaucaaagccaucauuuaccaggaucaaguaggcuucaucccagggcuucaggaaugguucaauauaugaaaauccauaaacaucauccaccauauacacaaacagaaaaaaaacaugauuaucucauuagaugcugaaaaggccuuugauauuaaaauucuuggagagagcaggaauucauggcacauaucuaaacauaauaagagcaauaaauagcaaacugacaaccaacaucaaauuaaauggagagaaacuugaaacaaucccacuaaaaucaggaacaagucuucccacucucucccugucuuuaauauaguacucaaaaguucuagcuagaguaguuagacaacaaaagaaucaaggggauauaaauuggaaaggaagaagucaaguuauuacuauuugcagagaacuccuacagcggauaaacaacuucagcaaaguggcuggauaugaaauuaacggaaacaaaucaguaaccuuccuuuauauaaaugauagaugggcugagaaagaaauuagggaaacaaaacccuucacaauagccacacauaauauaucuugguguaacuuuaaccaagugaaagaucugaaugacaagaaggggaacggggagugggagagaggaaccugaucuuguauugggugagggaaaaggacugaagccccaagggccagcagaaagaauguaaacaggcauccucaggaaauaggagguugggggacccccccccagaacguaccauugaccugggaggugaaagacuuccaggacucaaagugagggaccuuagaugaaaugccugacaguagauagagggaacuuauaaacuccagcaggaagacaggacaucaagugagggaugggauuuccaucccacagucacacaucugacccaaaaucguuccugucugaaagaauuacaaggauggaaauggagaggagccugaggaaaagaagguccauugacaggcccaaagagggauccagcucacggggagaucccaaggccugacacuacuacuaaggcuauagagugcucacaacaagggaucuauuaugaaugcucucugaaagacccaaaaaaacagcugaaagaagcagaugcagauaguugcacccaaccaauggaaagaagcaguugaccccuguuguugaauuagggaaggcugacagaagcugaggagaagggugauccuguaggaggaccagcagucucaaucuggaccccugagauaacccaaacauuggaccaccaaacaggacauaccaacugauaugagguccccaacacacauacaggagaauuccggaucuguguucauucagagaugaugaacuuaaaccuuaagagaguggaagccucaggaaauuggggauggauggggggggggugacaaauagaauauggaguguaaaaauuaauuaaaaauaauuuuaaaaagaacuucaagucccuaaagaacaaagaugaaaagaucuccucccaugcacauggaccuguggauuaacauaaacaucuuaccaaaaguaagcuacuguucaaugcaaugcccaucaaaguucuaauacaguucuucacagacauggaaagaguaacucucaacagaguuacucaacaucauauggaaaaacaaagacccaggauaacaaaaacaguucuuaacaguaaaagaucuuccggggaaaauaauaauuccuggccucaagcuguacaaucaagcaauugugaugaagaucacgugguauugguacagagacagaaguugcccaguggaauagaaucgaagacccagaaauaaacccacacaccuauggacacuugaucuuugauaaagagggcaucugaaaucaagaaaauagaaaagugaaaagaucuccuugaggguucguggaaugaaaucaugaucauuaaauuucccaauuguagaguuuaaauagaagagacagagaaagaaaauucauuugaguacauaaacuauugagaaccaggccaauccaaagcauucucagaggcccuaaugaaggagaaaaguaaucucuuuauuccaaacuuuaaucuauccccuauuuuuugaaaaccugauccucucucucaagguucuguuacugaagguuugccagcuaguccaugccaguaaauaaucauugaaaauucagauauaugaacaaaauggacauucagguauaugauagguucaauacaacaauguagacaacacacauuaaagauugaaagauuaauucuaucagugcauuucuuagcauauaucaaaguaugaaauucacugguuaaguauagagguaaaacaaaacaaccagccaaacaaaagacagucacaaaccucauuuuagauuuaagagcauauagacugaaaaacaaaauagaaacuagcaauacauuacacauggaaaacaggagugacaaaauuaugaagauauagucacuauauaauaauagaauccauuaauggugaggucuaacauuuguaacaauaucugucuuaaaacuuaaaacauaaaccugaaaagauuauccuuuagcauucuccacuuauaguaguggauaacucaucuguacaaagaaucacuagagaaccauuugagauauauaucaauaaauaauaaauaaucuaaguuuacaucucauggaacuauaaaggaaaaaacccuauccuacaugucaaagggauaaaaagacaggcuagugcagguauaaauuaaagacaaaaaauuaauucaccuucaaacucuuuaauaauugaagauagaauaguucuaaaccaauuaaucauucagaaaaggccaaagucaucaacaguguuccaguaaaacaaaguuucauggacuaaugucacaucuaccccuauuuuacaagagucuuuuagcuguacuacagagcaauugugauaauuaguaauuaucuuaagagauaaagaaauuuuaugauaaaaaugucauauuuagagcugaaauguuuuaauggagcacaugugugcaacgcuuacaguaaauauugaguaacugaauuauuuucuugaacuaaaguaagaaaaugauaccuauggaacggguaauauggcuaguagauaaaaggcaauugcugccaagccugaugaccuaaacugaauccuugggacugcuaugguagaaaugacuuuuuuaaguugucccuuuaugaucacaugaguguaaaggcauuugcacaugcaaaugcaugaacacaaacacaauaaauaaauaaauaauuuuuuuuaaguaaguuauucccuuuuuuaccaauuggauucaagauaauguugaaaguucuagcuagaggaauugaggauggggagugagauauauaaauaagaaaggaaaaaauaaaauguauauuugcaaaugauauaauuguacagaaaaauguuauugccuaaagaauuauuacagucuucaaaucaaaguucaauauauaaaacacacaagaaauaucuacauuucuuuauauuaacaguaaacuacccaaaaggguaauuaagaaagcucuuaagaaaauaguaccucaaaucagaaauaaacauugaauauaucaguuaguuuggacaagaguaucauaaccauuuaucaacaaaggucuguuauuugaacaaauaguuuuggggaaaauggguauuaagauuuaggaaaaugaauguagcaccuuuaaauuacaguauauaaaauuaacuuaaaagggaucaaaaauauaaauguaaguauaaauuuugaagaaaaauuacauuauauggggcauuaauuucaugaauauaacaccaaagguauagacaacaaaagacugaacuucaugauauguaggcauaaguuuaaccacagcagcaaaauuuuuguuuacuaaaaauaaauacuuaugaaaaaauugaagaugacaguaauagauguauauuuguuaccucuuuguggauccaaagacuuucagcacauucaugcagcccaaaguaaugcgcagauugaaaaugauuuuauucuaguuuuaugcuuucuuuagauaaguaaaauucuauaaacauaugaaaucacaagaaaaguugaauagcugagcauuuaugacauuaaaaauagcuggaacuaucacccaccuugauuaaccuacucacagggaaagaccaauuguaagcaaugcagauccuuauauugacacauagauggacaauuuaccuuucacacaggaauuaugaauaaacgaugagaacagaauacucaucaaaagaugguauguaaauccuggauaugaaaaugaaaaaaauugaaauugguucuauuccauaaucauauuaacccaaaguauguuaaagauuuaauucuagaugagaacuccuagaauaaacuaauuuuaacagugaucuuaacaauuacuuuuuaagauacaacaucaaaugccuagaaauaaauacaaaguugcugccuaucacagguuugguaguaugaaggggaaacaaaaauaaaaaagauaacauacauaauggaauaaaauauuuccaaacuacaucuaauguguuaacauauaaacuauaaaaauaacaaauauuucaauagcaaaugauaacaaaaauuaucuaaauaugacucagacaaaagacagaguuaaccauuuuccaacauacccauacaaaguauuaagaagaauacaagaagugcucaguaucacuaucuggggaauguaacucagaacaaucaugauaauaccucaaauauuuuaugaauuauuuuuaaaaguccaaaaaauagugaagauauggaaaaaugaaaaaucugauucuauguuugaggugaauguaaauugacauaacaagauauaaauguaauauaaaauugaauguaaauuggcauuugaaaaaaauugaagcaccuaauacugugucuuugugcucgaguagaaugacaaguuguuauggucaccagcauuugucucauacaaggaacacgcuaauguuacaguuaacuguaaaguucacuggcuuuaaaauacaccuaaauuuaacaacaaaagauugaagauauaagcugagugagacaucucauagaaagaauguaccuuaaaaucuaccaaucauaguucaaucuuuagaacacacagaaaaagagaggaacaaaucccaaaauuugucaaaugaccucuacauaugagcuauggcacacaugcacccauaguccaauauacacacaauaauaaugacaaugauaauaauaaacaaaauaaaacaauuucaauuuuaaaaugaaaaauaagucauggaugguuuaaucaauguuuagauaacuuguaauuuuuaucauaacauuauucauauuaaucaagauauaauacugugucaaaauggauacaauggauaaaauuaacagaauguuuaaucucaaaaaagaagucauuuacuuugugacaguauggaugaacuaagguuaaacugugaauuagaaagaacaaauacuucauguucucacuauauguguaaucuaaaaauguuaaacucuaaaagcugaauauaagauugguuaguaauuuagacuugggucuuaaagaaaacauugguugaaggaauuauaguuauaagaugaacaaauucagcauuguaaaccucauucucuacaaucuauauuuagaacuugaugaauauaucuuaaauacuugcagaacaccaauguaaaaucuauguggacugauacaguaguuucauuguauuaguauauuuauaaucauaaaguuucagagcgugugaauagauauugcaaauugugucucaauacaacuauuaaaaccucaaagcaucaaggggugaaaaauauucagcaauuaaauuaauuaagauggaggaggguuauauacuuaaaacuacaaauuauugcuaaagauaaauaaaaauagucaccauucauaaaguugaagguaauauauaaauacuacacaaagcauuuuaugcccucagggcauccauaaugaauauccaaaugucuacagaaauuagaaaaauccaucauaauauucacaaccuuuagauaauuacacaaaacuguuacaugaucauggucuucaaauuaagcacaaacagugcugagggacuccauuuucuaacaucaaauggucuuaccauguuaccauugagaaaagugaaugauaguaauuuaaauaauuuaaagauagacuuacagaucaauggaacauauuaaaagagagaacucagaaaugauccuugguguacaugacauuuuacaguguuggccagacuaauuuaaaaagaaaaagucaucuugacaauauauagugcugguaaaacuagacauccuuauguaaaaggguaaauguuggaucuuuacuaaaagcauauauaaaaauuaauucaaggucugucaaagaccuaaacaugaccugagaaguauagaauucauggaacuggcagugacuucuuagaugugaaacuuggggggaagaauauagaaaacucuaugaguauuuuaaauguuugaacaucaaaacacuauuucucuauaaaaacccaaccacaaagaguaaagcauuugcaaguuacauaucugauaagugauuaauaucuguuauuuacagaaaaaugcauuacuuauauaagaucaauucaaaguagguaaaagaccuugagaaguaucauaagaacaauuauaaaugacauguauacacauauacuaaugugaauaucaauuauuaaugaaauguacaucaaaacucuaaaaacaggaucacugagaucgcucaucagguaaaagugcuugcugucaauugaugcaagacugacgaucuaauuguccuugaaaccuguaugaagguggaugaagagaacugacuccauaguauuaucaucugaucugcauauauaccauaugcaaugugaaccgcccccacaucuaacuauaauuaaauauaccucacaaucacauaucauuucaugagagagagagagaaagagagcagagaagagcuucaucaagacauauuacaauaaaaaagucuaaaaagaaaagugauaagucauuuauacuauuauggacuacaguagauuucaaagaugaaauucuacaggcuaugaggugaugaaguaagauauuccaaguucagaagcaaagcaaauuccaaccauuaaguucaagggcauuguuagaaaugaaggagaaauaaugcccauuuaaaacaagcaaaaucugagggaaucccuaagcaauagaccagcaagcauuauaaaaccacaaaaaugagagacaagaaaaguacucaacuaaaagacagcaaaaucaugaagacaucaguuauccauaauaaccuuugauauauauaagauacuucaaauucuguagccaugguagcacacaccuuuaaccguagcacucagcaggcagaagcagauagaucucuaugaauuugaguucagucucgucuacauaacaaguuuuaggacagcaaggacuacuuggagcaaccuugccuacaaugugugauaucuacaaaaaauaugagaugguacuauagacaaauggucaagaugauuauuucaaaacuauauuugcucauuauuggagcauauaguuuuauaaaacaacaucagacagaagcauaugugagaguugucaucaucauacugugucaaugcguuauccagacucucccuuucaaaaaaggcaaaaaucaaugaaaucagacucccuuaaagaaauacagaagaacaaagguaaacaucuagaagcccugaaagagguaacacaaaacaauccaggaucuaaaaauggaaguagaaacaaagaagaaaucacaaagggagacaacccuggagauucaaaaccuaggaaagugaucagauggugaaaggcaaauacaagaaucuuaccaacagaaaccaagacuacuuggcaucaucagaaccuaguacucccacaucagugaguccuggauaccccaacacacccaaaaagcaagauuuggauuuaaaaucauaucucaugaugcugguagaggauuuuuagaaaggacauuaauaacucccuuaaagaaauacaggagaacacagcuagacagguaaaaguccuuaagaggaaacacaaaaaucccuuaaagauuacaagaaaacacaaccaaacaggugaauugaacagaaccacccaggaucuaaaaauggaaguagaaacaauaaggaaucacaaagggagacaacacaguagauagaaauccuaggaaaaaucaggagucauaaaugcaagcauaacuaacagaauacaagagaugaaagaaaaucucagauacagaagauuccauagaaaacaugggcacaacaaucaaaaugaaaaauggaaaaagauccuaacucaaaacauccaggaaauccaggucacaaugagaagaccaaaccaaaagauaauagguauaggugagaaugaagauuauugacuuaaagggccagcaaauaucuucaacaaaauuauagaagaaaacuucccaaaccuaaagaaagugaugcccaugaacauacaagaagcuuacagaacuccaaauagcuuggaccagaaaagaaauucugccugacacauaauaaucaaaacaccuaaugcacaaaacaaagaauauuaaaagcauucagggaaaaagaucaaguaacauauaaagggagcccuauuagaauuacaccagauuucucaccauagacuaugaaaggcagaagauauuggacagauguuauagagauacuaagagaacacaaaugccagcccaggcuacuauacccagcaaaacucucaauuaccaucgaugaagaaacaaaguauuccauggaaaaaccaaauucacacaauaucuuuacauaaauauagcacuuuaaagaauaauaaagggaaaacuccaacucaaggagggaaacuauacccuagaaaaagcaagaaaguaauccuucaacaaaccuaaaagaagauagccauacgaacagaaucccaacucuaacaacaaaaauaacaggaagaaacaauuacuuuucuuuaauaucuuuuaguaucaauggauucaauuaccccaauaaaaagacauugacuaacagacugacuacauaaacuggacccaacauuuugcugcuuacaggaaacccaccucagggacaaugaaacuaccucaaaguaaaaggcuggaaaacaauuuuccaagcaaauggucccaacaaacaagcugaaguagcgauucuaauauugaaucgauuuucaaccuaaagcuauaaaaaagacaaggaggggcacuucauauucaucacaggaaaaaaaucucaauucugaacaucuaugcuccaaaugcaagggcaucuacauuaauuaaagaaauuuuaguaaagcucaaagcacauauuacaccucaaauaaguaauagucugugacuugaacacccuacccucaucaaugaacagaucauggaaacacaaacuaaacagagacagagugaaacuaacagaaguuaugaaacaaauggauuuaacagauauauagaacauuucaucauaaaacaaaaggauauaccuucuuauuagcacuucauggcaccuucucuaaaacugaccauaucaucagacacaaaaauauugaaauaauuccaugcauccuaucagauaaccauggauuaaggcugcucuucaauaacaacauaaauaauagaaagccaacauacauguggaaucugaacaacacucuacucaaugauaacuuggucaaggaugaaauaaagaaagaaauuaaagacuuuuaaugaaaaugaagccacaacauacccaaacuuaugggacacaaugaaagcaguccuaagaggagaagucauagcucugcucugcgugccuccaaaaagauacuggagagagcauacacuagcagcuugacagcacaccuaaaaucucuagaacacaaaagggcgcaaauucacccaagaaaaguaaauggcaggaaauaaugaaacucagggcuaaaauaaacuaaguggaaacgcaaauaacuauacagagaaucaaccaaaccaggagcuguuccuuucagaaaaucaacaagauagauaaaccagacuaacuaggggacacagggacaguauccaaaugaacaaauucagaaaugaaaagggagacauaacagaaucugaggaaauaaaaaagaucaccagauccuacuaaaaaagccuauacgcaacaaaacuggaaaaccuggaguugggcaugguggcacaugccuuuaaucccagcauuugggaggcagaggcauguggauuucugauuucaaggccagccucuucuacacagugaguuccaggacagccagggcuauacagaaaaacccuguccaaaaaaaaaaaaaaaaaccuggaaaaccugaaauggacaauuuucuagaaagauuacagguaccaaacuugaaucaggaucagauuaaugaucuaaacagucccauauccccuaaagaaauacagacagucauuuauagucucccaaccaaaaaaaaaaaaaaaaaaaaaaaaaaaaaaaaaaaaaaaaagcccaggaucagaugaguuuaguucagagugcuauaagaccuucaaagaagaccuaauuccaauucuccucaagcuuuuccacaaaauagaaacagaagguacucuacccaauuuguucuaugaagcuacaauugcucugauaccuaaaucacacaaagaaccaacaaagaaagagaacuucagaccaacuucccuuauauauuuugauguaaaaauacucaauaagauucucacaaacagaauccaagaacacaucaaaaugaucauccaucacaaucaaguaggcuucaucccagggaugcagggaugguuuaauauacagaaaucuauccauguaaugcacuauauaaacaaacucaaagacaaaaaccacaugaucaccucauuagaugcugagaaagcauuugacaaaauccaacaccccuucaugauaagauucuuggaaagaucaagaauucaaggcccauaccuaaacauaauaaaagcaauauacagcaaaccagaagucaacaucaaacuaacuggagaaaaacacaaagcaauuccacuaaaaucaaggaguagagaaggcugccccacugucucccuaccuuuucaauauaguacuugaaguccuagacagagcaauuagacaacaaaaggagaucaaggggauacaaauuggaagguagaagucaaaauaucacuauuugcagaugauaugaaaguauuuaugugugugugugugaguauauauauaaaaaaaauuuuuaccagagaacuaaaccugauuaacaacuucagugaaguagcuggauauaaaauuaacucaaacaaaucuuucucuacacaaaggauaaaugggcugagaaagaaauuagggaagcaacacccuucacaauagucacaaauaauauaaaauaccuuggugugacuuuaaggaagugaaaguuuugcaugacaagaacuucaggacacagcuucugggacaggcccugauuugagcugcagacaucgggcaccuucccugccagaggagaggugaccacccaagaggccucugaccaccagagcaggugagggagccauccuguguccgggucccucugagaccagucugcgcagaucuucucacggaaugcauagggugagcaacaggauuguagaagcgacacagcuucugggacaggcagaagugacauggcuucugggacagaccccguuucaggcuccagacaucugggcaccuuccccaccagaagagaggugaccaccugggagggcucugacugcuggagcaggugagggagccaucuuguguccugggucccuuggagaccagucugugcaggugaguacacagacuacagaagcaacacaucuucugggacaggcccuuuugggggccuucaucuucagacagaagguaguucugaaugccagaccucugugcaccuucucugcaagaggagagcuugccugcagagaguacucugaccacugauacucaggagagagcuggacugcugacagaggcuaacagaauuacaagaggaacaggcuccagccagagacaacuauaacaacaccagagauuaccagauguugaaaggcaaacguaagaaucuuaccaacagaaaccaugaccauucaccaucaucagaacccagcacucccaccucagccaguccuggauaucccaacacacaugaacagaaagcaagauucagauuaaaagucauaucucaugaugcuaguagaggaccuuaagaagggcauuaauaacucaaagaaauacaggagaacccugcuaaacagguagaaguccuuaaagaauuacaggaaaacacugcuaaacagguagaaguccuuaaagaggaaaccaaaaaaaucccuuaaagaauuacaggaaaacacaaccaaacaggugauagaauugaacaaaaccauccaagaccuaaaaacggaaguagaaacaauaaagaaaacccaaagugggacgacucuggagguagaaacccuaggaaagaaaucaggaaccaaacaugugagcaucagcaacagaauacaagagauggaagagagaaucucaggugcagaagauuccauagagaacaugggcacaacaaucaaagaaaaugcgaaaagauucuaacucaaaacauccaggaauuccaggauacaaugaguagacaaaaccuagggauaauaggaguagaggagaaugaagauuuucaacuuaaagggucagcaaauaucuucaacaaaauuauagaagaaaacuucccaaaccuaaaguaagagaugcccaugaacauacaagaacccuacaaaacuccaaauagacuggaccagaaaagaaauuccucccaacacauaauaaucagaacaacaaaugcacuaaauauagaauauuaaaaguaguaagggaaaaaggucaagugacauauaaaggcaggccuauuagaauuacaucagacuucucaccagagacuaugaaagccagaaauccuggacagauguuauacagauccuaagaaaacacaaaugccagcccaggcugcuauacccagcaaaauucucaauuaccauagauggaaaaaccaaaauauuccaugauaagaccaaauucacacaaugucuuuccucauauccagcccuucaaaggauaauaaagggaaaacaacaacacaaguacagaaaccacacccuagaaaaagcaagaaaguaauccuucaacaaaccuaauagaagauagccacaagaacagaaucccaaguuuaacaacaaaaauaacaagaagcaacaauuacuuuucuuuaauuucucuuaacaucaauagacucaauuccccaauaaaaagacauagacuaauagacuggcuacacaaacaggacacaacauuuugcugcugacaggaaacccaccucagggacaaagacagacacuaccucagagugaaaggcuggaaaacaauuuuccaagcaaauggucagaagaaacaagcuggaguagucauuuuaauaucgaacaaaacuacuuuccaacccaaaguuaucaaaaaagacaaggaggggcacaucauacucaucaaaggcaaaaaucuaccaagaugaacucucaauucugaauaugcuccaaauacaaggacauccacauuaauuaaagaaacuuuaguaaagcccuaagcacauauugcaccucacacaauaauagugggagacguuaacaccccacuugcaccaauggacagauucugguaacagaaacuaaauagagacacauggacacuaacagaauuuaugaaacaaauggauuuaauagauaucuacagaacauuuuauccuaaaauaaaaggauauaccuucuucucagcaccacaugguaccuccuccaaaauugaucauauaaucugucacaaaacaggccuccacagguacaaaaauauuaaaauuaucccaugcauccuaucugaucaccacggacuaaggcugaucuucaauaacagcauaaauaauagaaagccaacauucacaucaaaacugaacaacauucuacucgaugauuccuugggcaaggaugaaauaaagaaauuaaagacuuuuuagaguuuaaugaaaaugaagccacaacauacccaaacuuaugggacacaaugaaaggaguccuaagagaaaacucauagcccuuggugccuccaaaaugaaacaagagagaacauacacuagcagccugacagcacaccuagaagcucuagaaauaaaggaagcaaauucacccaagaggaguagauggcaggaaauaaucaaacucagggcugaaaucaaccaaguggaaacaaaaagaacuguucaaagaaucaaccaaaccaggagcugguucuuugagaaaaucaacaagauagaaaaacccuuagcccgacuaacuagaggacacagggacaguauccaauuaacaaaaucagaaaggaaaaaggagacauaacaacagaacccgaggaaauccaaaacaucagauccuacuacaaaaagcuauacucaacaaaacuggaaaaccuggaugaaauggacaacuucguaccaaaguuaaaucaggaucagauuaacaaucuaaacagucccauuucgcuuaaagaaauagaagcagucaucaauagucucccaaccaaaaaaaaaaaaaaaaaaaaaaagcccaggaccagauggguuuagugcagaguucuaucagaccuucaaagaagacuuaauuccaacucuucucaaacuauuccacaaaauagaaacagaagguauccuaaccaauucauuccaugacgccaaaauuacucugauaccuaaaccacacaaagauccaacaaagaaagagaacuucagaccaauuucccuuaugaauaucgaugcaaaaauacucaauaaaaucuuugcaaacugaauccaagaacacaucaaaacaaucauccaucaugaucaaacaggcuucaucccagggaugcagggaugguuuaauauauagaaauccaucaacauaauccacuauauaaacaaacucaaagacacaaaccacaugaugaucuuguuaggugcugagaaaacauuugacaaaguccaacaccccuucaugauaaaagucuuggaaagaucagaaauucaaggcccauaccuaaacauaauaaaagcaauauacagcaaaccaguaaccaacaucaaacuaaauggagagaaacucgaagcaaucccacuaaaaucagggaguagacaaggcugcccacuuucucccuacccauuuaauauaguacuugaaguccuagccagagcaauuagacaacaaaaggagaucaaagggauacaaauuggaaaggaagaagucaaaauaucacuauuugcagaugauaugauaguauauauaaguuacccugaaacauccaccagagaacucuuaaaccugauaaauagcuucagugcaguagcuggauauaaaauuaacucaaacaaaucaauggccuuucucuacaaaaaggauaaacgggcugagaaagaaauuagggaaacaacacccaucacaauagucacaaauaaaauaaaauaccuuggugugacucuaacuaagggagugaaagaucuguaugauaagaacuucaaaucucugaagaaggaaauugaagaagaucucagaagauggaaagaucucucaugcucauggauuugcaggauuuauauagucaaaauggcuauccugcugaaagcaaucuacagauucaauguaauccccaucaaaauuccaacucaauucuucacugagguagaaagggcaauuugaaaauucaucuggaauaauaaaaaaccuaggauagcaaaaacuauucucaacaauaaaagaaccucugguggacucaccaugccugaccuuaagcuguacuacagagcaauugugauaaaaacugcaugguacagguacagcgacaaacagguagcucuauggaauagaauugaagacccagaaaugaauccacacaccuauggucacuugaucuuugaaaagggagcuaaaaccauccaguggaaaaaagacagcauuuucaacuaauggugcuggcacaacagaugguuaucacgucgaagaaugcgaauugauccauucuuaucuccuuguacaaagcucaagucuaaguggaucaaagaccuccacauaaaaccagagacacugaaauuuauagaggagaaaguggggaaaagccucaaagauaugggcacagggggaaaauuccuaaacagaacagcaauggcuugugcuguaagaucaagaauugacaaaugggaccucauaaaauugcaaagcuucuguaaggcaauaggcacugucaauaagacaaaaaggccaccaacagauugggaaaggauuuuuaccaauccuaaaucugauaggggacuaauauccaauauauacaaagaggucaagaagcucaacuucagaaaaacaaauaaccccauuauaaaugggguauaaagcuaaacaaagaauucucaaguaaggaauaccgaagggcugagaagcaccugaaaaaauguucaacauccuuaaucauuagucaaaugcaaaucaaaacaaccuugagauuccaccucauaccagucagaaugucuaagaucaaaaacucaggugacaguagauacuggcaaaaauguggagaaagaggaacacuccuccauugcuggugggauugcaagcuuguacaaccacucuggaagucagucuagcgguuccucagaaaauuggacauaguacuacauaaagauccagcaauaccaguccugggcauauacccagaagaugcuccaacugcuaauaaagacacauguuccauuauguucauagaagccuucuuuauaauaggcagaagcugaaaagaacccacaugucccucaacagaggaauugauacagaaaaugugguacauuuacacaguggaguacuaggcagcaauuaaaaacaaugaauuuaugaaauucuuaggcaaguggauggaucuggaggauaucauccugagugagguaacccagucacaaaaguacacacaugauaugcgcucacugauaagugguuauuugcccagaaacucaguauacccaagauacaauuugcaaagcacaugaaagucaagaagaaggaagaccaaaguguggauacuucgauccuucuuagaagggggaacaaaauaccucuggaaggaguuacagagacaaaguucugagcagagacugaaggaaggaccauccagagacugccccaccuggggauccaucccauaaacaccuaccaaauccagacacuauuguggaugucaacaagauuuugcugacaggagccugauauaucugucuucugugaggcucugccagugccuggcaaauacagaagagaaugcucacagucauccauuggacagaacaccggguccccaaugacggaacuagagaaagcacccaaggagcugaaggggucugcaacccuaaagauggaacaacaauaugaacuaaccaguacacccagagcucccugggacuaaaccaccaaucaaagaaaacacauggugggacuccugucucuagcugcauauguagcagaggauggacuaguugaccaucaaugagaggagaggcccuugguguugugaagguucuaugccacaguauaggggaaugccagggccaggaaggaggaguggguggguuggggagcagggagaguggggggauagggaauuuucagagaggaaacuaggaaaggggauacauuugaaauguaaauaaagacaauaucuaauaaaaagaaugauaucauagaaaagaaauaaauuaaauuaaucaaaaucuuaaaaaaaaagagagugaugauucccaacuuaaagggccaauauauaucuucaacaaaauuauagaagaaaacuuuccuaauguaaagaacgagauguucauaaacauaaaagaagccuacagaacuccaaauagcuugggccagaaaagaaauuccuucugacacauaauagucaaaacaccaaaugcacaaaacaaagaaagaauauuaaaagcagucagggaaaauguucaaguaacauauaaaggcagaccuaucagaauuacaccagacuucucaucagagacuaugaaagcuagaagauccugggcagauguuauacagacccuaaaagaucacaaaugccagccugggcuacuauacccaacaaaacucucaauuaccauauauggagaaaacaagauauuccacuacaaaaccaaauuuacaaaauuuauuuccacaaauccaggucuacaaaguauaauagauggaaaacuccaacacaaggagggaaacuacacccuagaaaagcaaguaaguaauccucuuucaacaaacccaauagaagauauccacacaaacauaaaaauaauaucaaaagcaacagcaagcaacaaucacuauucuuuaauaucuuuuaacaucaauggacucaauuccccaauaaaaagacauagauuaacagacugguuacauaaacaggacacagcauuuugaugcauacaagaaaugcaccucaaugucaaagacagucauuaccucagaguaaagggcuggaaagugauuuuccaugcaaauggucccaagaaacaagcuggaguagccauccuaauauagaauaaagucaacuuucaaccaaaaguuaucaaaaaggauaaggaaggauacuucauacucaucaaagaaaaaucuaccaagaagaacuuuaaauucugaacaucuaugcuccaaaugcaagaacacccacauucaaaaagaaacuuuacuaaagcucaaagcacacauuguaccucacacaauaauagugggauauuucaacacccuacucucaucaauggauagaucauggaaacacaaacuaaaaagggacagagugaaacuaacagaagcuaugaaacagauguauuuaacagauaucuauugaacauuucaucauaaaacaagaggauauaccuuuuucucagcaccacauggcaccuucuccaaaacugaccauauaauuggucacaaaaaaaggccucaacagauacaaaaauauugaaauaaucccaugcuuccuaucagaucaccacagacuaaggcuggucuucaauagcaacaaaaacagaaagcccacauacacguggaagcugaccaacacccuacucaaugauaacuuggccaaggaagaaauaaagaaauuaaagaauuuuuagaacuuaaugaaaaugaagccacaacauacccagacuuuugggacacaaugaaggcaguccuaagaggaaaacucauagcucugggugccuccaaaaagaaaccagagaaagcauacacuagcagcuuaacaacacaccugaaagcucuagaacaaaaagaagcaaauacacccaagagaaguagauagcaggaaauaaugaaacucaaccaaauaaaaacaaaaagaucuauacaaauaaugaacaaaccaugagcgguucuuugcgaaaaucaagauaaacccuuagccagacuaaccagaggauacggagauaguauccaaauuaacaaaaucagaaaugaaaagggagacauaaccacagaaaccgaggaaauucaaaaaaucaucagauccuaccacaaauccuauacucaacaaaacuggaaaaccuugaugaaauggacaauuuucuagacagauaccagguaccaauguuaacucaggaucagauaaaccgucuauacagucuaauuguaauuggugguaauguugcauaacuaaagaucacaaaauaauggguaaagauuccaucuagaaaucacauacacauaaauuagacauuaauugaaaggaauacuauacaaugaauaguguaccaacgaaggagaacuaucugugaaugggugauauauuucuuuuuaaauaaauaacuugaaaugauaagaugauuacauguauuuggaagagccacacauaaacucuaaaccagaaaacuuacauuuuguuacuuacaagaguuggggcuuaugaauauagaagggauaugggaggaaaaggcuucucucaguagauuauuuugugucuuuuuuuguuuguuuguuuuuuguuuuuuguuuuuuguuuuuuuguuuuuuuuuuuuuugagacaggguuccucuguggcucuggcuguucuggaacucacuuuguagaccaggcuggccccaaacucagaaaucugccugccucugccucccgagugcugggauuaaaggcguauaccaccacaccuggcaugugucauuuuugacuuuuggaaauauauugauauuuucaauauuuuaauaacaaacaugugggcaguuucaaaaaaacagugggauaagaaacacaggcuaaagucucaguaggguagccauaguucuagguacuggggaaaagauuuguaagaaugauaccuuaggaguucaagagcagucuggauaauggcaaaccuccaucucucuaaaccacuggcucucaaauuugaugucauguccccuuucacaaaggucacauaucagauacccugcauaucagauauuuacauuaugauucauaauaguaacaaaauuacaguuaugaaguagcaacaaaaauaauuuuuaugacuggggagcaccacaacaugaacaucuauauuaaaggggcacagcauuaggaaugcugagaaucaccacucuauaugaacaacuagcaaauucucauuuuucuaaagaaacaagcaaauacaguguuuaaauuuuuuaccauuguaaaucugaacaagacugucaaaaacagugauuucagaaauauaaauuaaagucacauaacaaacugaagaaaaacauuaggguuguggagcagaaacagaguacuuauuucaguugugaggacccuauuuaaucacaauuauuuuuaaaaaaaacuacaaaaguaaaaucugauaaaucuccauagaaauugcaaggucuguggaaauuuaaccuaagguugccuuucccauacccagaugaguacaauagccuugaagacuagcaucuuuucuuccaaugaagaagccuaaccugauuugaacucuauugccagucucauucuuuaugucaaaaaauaguguccucaaggcauuuacugguuaaagccacuguuauagcaaucugaugcucuagcacugguuguugcacauaaauacacacacacaaaaagauaguaaauucuuagagauaagauggucuguacucucaaaaaaagaccagaaguacucuccuuaucuacacugcugauugugagacacuauacagacaagaugguaaaacaaaggacaguuguaaagaguccaaauguugaauggaaauccuaaggcaaagcccuuucaggaaaauuuaccagcuugagauacuuaaaacaaggccucugacuaaugguggcuuaagcugaucaauuaaagcaugcuuuaaaaacaaagacagucauuuucuaaagagcaaacuugaagauaaaucagauacacacauugccgggaaaugcaaacacuauagaagcaaaauuggcacaggcauggcagaaacaagcaauugcccacguagaugggaaaaaauucaaauguaguguuccuaaaaaucaacacaucauccuaaguggagaggggggcuagagagauuaaagauuuguaaauaguaaugaucacugagagaaccuaaauacuaguuuuaguaggucaagauuucaaaguauaaauauucucacacuaaaauaagccuuguuuuaaagaauaaaaguaaaacauugugacaauaacucaucagaugaaauguuaauaaagagauauauuauaaaguugucaguacaaauuacaauaacuuaaaugaaaaccuuacuuguagagccagauugcaagauaagcugggagcagagaaaaagaaucagugaauuuaaauauagauauauaaagauuauucaguuuaaaggacagaaaaaaaagaguaaggaagaacaaugaacagaaccucagagaucuguuagcuaccacaagaguagguguuaccacgaauuuauauguaaauugcaccaugcaauccucugcuccauugaaacagauauggugguagaugcugauaaccucaguauucaagugguggaaauaagaagguuuagaagcucaaggucauuuucagcugcacagugaguaguuuagaccacccugggcuacaggagacccugucuauaaacaaacaaaacaaauaccagugccugacauuguacuuaaugguggaagaugaaaugcuuucccuucaaaucaagaauaaguuaacucaguauaauggcauacaaauauaauuccaucuccccagaggagggagaagaagaagaaagauaaguuagaugucaucuugggcuauauaguugucucaaaaaauaaacccagccacccacaauugagucaaggggaccuguuuuaucacuuuuauuaaauauuguguagaaguucugaucaguuauacaaggaaaagaaacaagucuggaaaaaaguaaaauuaaauuucuauauuuaaccaaaaucccaagauuguaaaauauaaagcucaaucauauuucuauguaccaugagggacuaaugaaaugaagaaaacaauucauuuuauaauguaaaaaugaauaaaucacagguaugaauguacuuaaugccacaaaaauacauuuaaaauuauuaacuuauaaauuauguucuuuuuuuuuuuacaaaacuaaaaggaacaaaauuaaucgaucuauuuuuuaaaguauacaaacuauacucuaugaaugacaggauaccacugaaagucuagaucuaaauaaauugauauauagcuuguguuuaugaacuggaaaacuugaaguuaagauacauauguucuucaagaugauguagagaccugauccuuaccaaaauaucaggugucuuuucuagaaaauaacaagcaauguuuaaaauuauguaagacccaaaugaccuacaauaguuaaagcaaucucccaaaucagucaaguuaaaggguucauacuuuucaauauauagauuuacuauaaaauaacaaggcacuauguaagcaucacaucaaacagacauacauaagaggggauagaauuaauagucuauuaaauaguuuauuaaauacagaaccagauagcuaugguaaauggacuuuuaauaaaggugccacagaaauaaaugagggaaugaacaguguuuuggauggauuuuucuucaacagcauguuauauauguaagggaaauaaaguugaaugguucccugccacuauauguaaaagcuuaaaaucaaucaaagacuuaaaaauagcaauuaaaucuugcagaauucuuacaaaaaaacauagagucaaaucuuuguaaccaaauguuugacgaaagguguuuuguuuugcuauuuuuuuuauauaaaccgaaaguaaaauaaagagcugauucacuggacuuuauuaaaaauuuuuaaaaauuuaugcuuggggguauacuacaaagaaaguggaagcuguagagauggcucagcgguuaagaauauuggcugcucuuccagaggaccaugguugaauuacuaacaccuauauggcagcuaaaauaacuucaguuccaggggacccaauaaccuuacaaagauauauaugcaagcaaaacauuaauacacauaaaaaggaauuaucaaaaaauuuaaagaaaguaagauggcaauacauaggugugagaaaauacucaaaaauuguuuguugauagaauauuuguagcaggauaaauaugauauauaucaauauacacacauauauacacacauaauucaauauauacaacacucagaacucguugcaauucacacacacacacacacacacacacacacacaaucccaauuuaaaaaaugaagaaucuauggccugugaaccuuuaaucuuagcacuucagaggcagacaagaagaucucuaugaauuaaaaaauagcuccaguaaagaccaugucaauagaaugagauagauagcuauagagggggcaaaaaacugagaaaucauauacuugacuuaggcucuguauucagaacacaagaagaacuucuuaaaacuuaacauaaaaggaaguucaguugaaaaauuaguaaacaauuuaaauaaacaguucacugaauggaagaauguggaaaaaaugauucauuauuauuauccauuggcaaaauacaaauuuaaaccacaauaaaacauuacugugccaggcaugguagcauaugccuuuaaucccagcacucuccuacacaaagaaacccucucucaaaaaaccaaaaaagaaaauuuacugcauguuuaccagaauugguaaaaugaaaaauacugucaauauuaaaugaucuauaguaauuccaaauuaggaauaacuuagaugucuguggaugagugagugguuaaaaaugugguuuauacauaccaugaaauucuacccagcaacaagucugaauuaacuacugauauauaaaacaacuuggaugaacaucuagagaauuaugguaaauucuaaaaauggucaaauuucaaaagauguguuugauucuauuuauauagcaaucucaaaaaagcagaucuauagaaucaagaacagauuagugauuacugggaauuaagggaugguaggagggaagacgguguggcuauaaaaggacaaacagggaucuuugugguaacaaauaauauucuguaucauugaaccaguguuuccauccuccuuaaauugcacuacaguuuuguuacuacugggaaaacuauauaugaguuuuucaaacuauagaugaucucuuugcauuauuuauuacaaaugaaugugaauuucuaaaauuagauuaaaagcuugaauuuuagaaguaugcaaaaggaaaccaguaagaaagugggcaaaggggcuuucugcugagcuuaaugacuugaguuugauccccaagacucauauuguagagggagaaaagaaacucccacaaguuuuccuccauucuccaugcauguauugugguaugagugugccaucuccuucccauaucugugaaaaaauacaacugugcaaaggaucuaaauacauauaccaguaaagaagacauguaacugaccaauaaacacauacaaaaauauucaauaccauuuauaaagcacaucaggacugaaaucagauaacaaaauacuagguagacuuuuuuuucucagcacuuuuuggauggaguauuauagauggaaaaucauuuuugcagcuaccauaauaaagacuaguuccagaaagcaucuuaaucaggacagaccaagguauuuuaaaaugcuuauaguauacccacagcaaguucaucugccucaagguaaauaauagugacuacacaguggaaaaacagacagugccuuaauggagugaucaaaccaucaccaucauugaauauauauauauauacacacacacauacacacacaucaugggaaaugguauccuaagaaggacauuauauuguuucuggaauauuccagaugggaauccacaaucuguaucuaauuauaaagaaauaucaaagaaaucccucaaaaagugacuuugauguaaaaagaaaaaagacuaagagauacuagaaauacccagguucacaguaacuaaauaugcacaaccaagggcaacauagaacauggacugggccuugcacuuggggacagcugcaccaaaggacuuuguuguguucacugacaagaguagaauauaggcuuuggguuauuucagugacuguauggauguuuaauugccaaaguugaugucuguuauaucacuuucaaagggaggaaaugugauguugucauccuccuuaaacuguaguacaguuaggaaauaaauuguuaggaaauacacagcaaaaugucuaggggugaggggcuguaaagugugcaauucccuuucaaguuuugcaaaggaacacaguguacaaauacacauauaaaaauauugaaaugaaaaagcaagugaggcuggaaugguaauaaguguaccucaaaucuuaaugaaggauaugaagaugucuuauauaucguucaugcaguuuuucuguaguucauuauuacuuccaaauaaaacaguuuuguuauguuuuaaagaaacaucuaugagauagcacaauauuccagugauuuuugacucaggcuaauuuugcccuaacucggggaggggguagauuugauaauauguagagaguugugguuacuuuauuuuauuuuugguugucacaacugaaggaaugcuguguuagcauccuggcagaagccaggggcucugcuaaacauccuaaaguacauggggcacucuucguugacaaagaauuaucuccugccaaaugucaaugguuccgcaguagaguaucccugccccacuuggcuaacaagauggaaaauuucucugccaauaauggcuggcagggaugucaggaaaggggaacccugccuguggaaaugcgaggucagacagcacuugaggaaagcaaccuggcaacauacaugcaauuuaacaaugcauccaucccuguguaaggggcugaacuccguccccaucaauuuucuaaguugaggcccucauuuccaauauuucagaauuuuaacaggagaucagaccuuuaaacagacaguuaaauugaguccaauuuuacuggugugccuauaaagaaggggaaauugggauacagaaagagucccaaaguguggcuauauagacagaagacacagggauauauuggccaucugggaguuaaggagagagguuuuaagagagaagcaaccugcuggcacuccaaucugagucuugugggcuccugcuuuuugagaagccucucaauucagcauuuguuuuugacaacccuggcaaaugaaguuugugaauucacugcauagaaauaaaagccuuuauacugggaagugauuuuaagaaaaacuuuuagaaaacuagcuuaaaccuaaagcaaaauauauuucaagcaacgaagaauaucacgguauaggcauacaagggagaaugaaggagagacucuaagauuuaaauagaagugagagaugaacagaauuguuccugaagcucagaggaagcuguaguaguaugauuguaagaaaagcaaggggcagaaaagcaugcaugcugugccuuccauguguuucaaagacaacaauaaggccucuucaugagagguaugguuuauuucacuguguauuauauggacaucaggaaaacauuagagaauaaaaucauuguuaaucaauguaggcaacagagaagaaacaugcagaaaaagauuguauauauacaauauagucagcuguaaaucuaagagcauaaguaagugauauaauuuuuaagaaaaaauaccccucuccccccucccccccccaagauuuguggcaugaggaauaaaauagaagguuauggagcacagaguugucugauaggagagauuaaggcuggcauuguugcagcuugggguuaaaucugaggagacagacaccagcguuuucacuguaugcaggguagaaaccgacauccucauauuuguucacugcaguaauucuugccguagacagauagacuuuucuuaccauuguuuuaaaauuuuauuuuacuuacuuuauuuuuuguguguacaugugugugcacacaugcauauguguauggacagugugugugugugugugugugugugugugugugugugugugugcguguauguguguguguaugccagagaacaacuuccaguaaccauuuuucuccucauagcauauggaugcagggaauugguuucaggucaucagucuuggcagaaaguaccuuuacuuagugagcuggccccacaguuggaagcuugauuucauugauguguaauagaggcauaaaaaguagauggaucagggucacauaauaauaaauagugggaaagggucguggucucaagaagcauagcuauaaguagugcccugaacacuacgaauuugccuacauuuuuaaaaagcagagcuguaaaggaaggauuuaauuucacuauuucaguuggaaaauugcuauuucaguugggguaaaguaaauagagggaaaaagaaauccaaccaauuaaauaaauaaguaaauauauauggauggauguauaauccaucgucauguauuuuaucuguuuauacaaacaaaucugagccccucaaauagagaagguauguuuuuaacuuagguggguggaauaggucacaucccaagcuaaaaauuacaaaagcacuggucuuauuuucagacuuugaugcugcaaaggagcucuuuuaagaaaacuggagcuuucacagacugcaugcuuucacugggagccuauuaaaugggaaauaaauaacggugauaaaaauguauugcuuaaaaauuaagcaaacauuuaaaaagagcucuagauuaaagagaaaaaacaaaacacgaaaaauuaucaaaaagggaaugaaauuggucauauuucauaccaagcccuacauaucacagcuaaagcugugaucagaggaaaaauuauaacucuuaaaaugucucuugguaaagggacuuuaaauaagugaacuaaauauuacccuuaauuaaguuuuaaaagaaaauacauaaauuaaagauaauuaggaagauggaauuaauagauauuauaguccaagaugacuaagaagaaaacaaauauagacaaagguaauuuucugauaagauaauaaacauaauauuuuaauaauuaacagaauaacuaaauuucucaugaacuugacuaagaaaaaagcaagacuauaaaagcacaggcaagaaaaauuuauagaaaagagcauaaacuacugaaagaaaauuaguugcuaccaagugucaacacaguugaaaugcuucaggaaauuacauagcaaugaauaaauuaucccuuaaaacaugcacuaaacuaauuuagaauacauuaccgcagaaaagacuaaaagcaauuacgauuucguauuagguccagaugguuauacaauuuuguucuguguaaauuuaaaagauuuuacacuuauuguaugugcauguggucacaugugcaugcaggguggugguagugugugcaaaucacagcauguguguggaagccaaaagagaacuuguaggaauuggcucucuuuuuccaacauguagguaccaguuaucaaacucagguaucuugagcaggcuuggcagcagguaucuuuacucacugagccauauuuccagccacugcuuaaccuuuaaagagaccaucauucuaauguuuucaaacuguuuuggaacacaagcagacagaucuucaacugcauggcacugcauucacaaagacaugguggaaccuuuuacacacugcugagccaagagauucuguaacuuacaggaucagauaucagggcuguccuucauacugcagaaagaaagaaaaagcccauucucacaguuuuaaugacugauagauccccagcaaauaagcagaucuucauagauggauauauuagcaauuugcauuguuuugcuacuuagcaaucauagcaucaguaucuccagacaaaaacagcuuucaaauguauagaaucaauuuauagaagaguugaagauugcauacaguuuuacuuuagauagugagauugcaucacucuuuucuuccaacaucaaugacuaaggccaaguuucccuauauacucaccaacggaguauuauuggugucuuacuuaauaaucaaagaaacaaccguugcuuauauuugcacucuaucauaagugaaacagucuggcauuuuccccccuggaaucaguagcauuuccuuuuuaaaaaaucauccucucaauauaaagagcuuugaaaaauugaaugaaaauaauucacucugugucuacaauauggguggcaacuguuuccccagguuaacacuuaaauuuuauuuuugguggguuuuuuuuuugcugugcaaauuuuauauauucuauuaccagcuuugcugagguacagcuggcauauaauaaaaggcacguguuuaaauuguaggauuugguaacuuuugacauguguugaaaucgcugccacaauuaagguaaugagcauauccagugcucccaggagcuuccucuugcccuuuuggacuuccccuaccacugcuccaccccucgguaauuauugaccuuucugucacucuagguuagacuucauuuucuagagugcugugguaacagaagacgacaguaugaacucuuugucuggcuucuuucacucacuguaauuacuuggugauucauccauguuagguguaucaauaguucauuccuuuguacuucugaguaguauuccauuguauggacacagaacaacuuugccaaaaaaacucucuacucaaauguugacugcuuuuggaauguuuccaaauggagagagagagagagagagagagagagagagagagagagagagagagagagagagggaaaccauuaaacuguuuuucaguguuccugaaucauugugaccacgacauggcauacaacugguugaguucuuucauguccucaccaguaccuggugaaucuccuuaauuuuaggcaauuaguaguuaugaaguagagucuaccuuugugcacuucuccaauaacuaaugaugcugggcauugucuuacaugcuuuccuauaugucuuccuugcuaugaaguguugauuuaaacaauuuacccauuuuuguaaugugugaguuuucaguuuaaaguguccaucacauauucugaauauaaauucuuuuuuagguaucagguuguaaaauauuuucagguuugggauagugagcaauaauguuugaugugcaaacauggaaacugguguucaaauccucagcauccacgcuuaaaaaaaaaaaacuggcaugaaugcacauaacuguaauccuagaacuguggguagggugggcagagacaggcagauccugggagcuuagugaccugccagucuggcuggaacacugaacuuccaguucagugagagacugcuugaggaaaagaagguagagagccguaaaaaaaugaggcuaugccagugccuggcaaacacagaaguggaugcccacagucagcuauuggauggaacacagggcccccaauggaggagcuagagaaaguacccaaggagcuaaaggggucugcaacccuauagguggaacaacaauaugaacuaaccaguaccuucccagagcucaugucucuagcugcauauguagcagaagauggccuaguuggccaucauugggaagagaggcuccuuggucuugcaaacuuuauaugccccaguacaggggaacaccagggccaagaaaugugaguggguggguaggggagcgggggaguggguaugggggacuuucaggauagcauuugaaauguaaaugaagaaaauaccuaauaaaaauugggggaaaaaagacagcaaucauuuguccucugcaugugaguucaugggcaugcacaauuccacgugcacaugcaaugcacgcaaaaccagaaugcuuucuuucaauaucugucuuuuucauugugucuuucaaaaagcaugcuugagaagccuggcuaaccaauuuguuccuaauacucacaugcuuuugaugcugugucaaagauauccuuaacuauauuguuguuguccuauaagguuuagccuuugaauucaguucuaugaccauuuuaacaugguuuuggggaaaugauaaaaguucaugguugaacugaauauccaguuuuuccaucuugucuccuccccacagaacaaaacaaaaccuagcauaaccuuuacauguggauuagaaagcaccugucaauaaauuugaauguccaccugauccccaguuucccccacuaucuguuugguuuuuaugcugacauuauacaucugguguucauccucaaaccuuguucauguucaaaguugcuuugguauucuagguuaucugcaugcuagucuuugacuggcuuuauacugaauuuagaaaucaauauugaaccuuguaauuugugaaccuaauuauauaucuauauuuauuuuuuugaaguuucaucagcauaguuauauaggcuccaaaggagagcucuuuugucaaauagauuucuauguuucacauguuuagugcuacucagaauaguauuuaaaaguuuccaauucugccuuacuuguagcuagaauuuagaaguagaauugcuuuuugcagagcuacuuuguauaugcaacugaauccauauauucugguggccaaucugacacaucagauuuucuauacagacaaccaggaaaucuacaaauaaugccaguuucauuucuuuuccaacuugcuguuucuuaccuuauuccaaaggcaagcaucuccaacuuaauguugaauagaaaucauaacaccagauauuuguacuccugacuuaugggcaaaacggauauuuguucauugaauauguuaacugcaugcaggccuuuuuuuuuucaauaaccuauuucaauuggaggaagcuucuauuuuuuacuucauaauuuuuuuugcuagauuucuuucaaguacuuucucugcaucuucugagauaaauauggcuuuauuuugucauuuauuaauauguuucauuuucuuuauaugccccaguacaggggaacgacagggccaagaagugagaguggguggguaggggagcaggggagggggaggguauagggaacuuucggaauagcauuugaaauguaaauaaagaaaauaucuaauaaaauaaaaaaauaauguuucauuuuacuaauuaaauucaaacuaacuuuguauuccugaacccuaauugauucuuuugcuuaaaauuuuuggauuuguguucacaagugauauuaccuacaguuuucuuauaauguuuuuauaauguuuauaauguuucuuuauaauggcuggguuuccuaucaggguaaugcuggucccagaauuuaaaaagaauucccuucauuaaaagaaaccagaguuugcuucuuaaacauauggcaggauucaucaggaagcaacauggucccagaguaugcuuaucgugugugugugugugugugugugugugugugugugugcauuauccaugauagauaauuggguuacaucugucugcacuuuaccuuuccuaagaaauuuuccauuuccucuaaguuguagaauauaguaacaaagagcuguacaggauaguuuuguaguuuuaaguccugucauuuauauagagcuggguaucucacuucugacacugacaaguugcgacaucacgcuugcucuuuggucuaucugguuagucacuuauugauuuuccuggccuuaaaaaaaaucaacaaugguuugauuauuuuuuuuccuguuuuuaguuucuuacgccccucgcaaauucuuauuuuccuuuagucuacuuauuuugguuuauuuagcuguuuuauaguucccagucugaggccuucaccgcuugcguggugcuauaugguccucuaagaacuguuuuagcaguguccuauaaacuagagcuuguuguguuuucacuuucauuugauuuaaaacacucauuuuucucuuagguuucuucucugacccugugcuauuuggagacauguucuuuauuuuccauauaguucagaauuugccaucuucuuaauugauuuuuaauuuaauucuacugugguaaaagaacauaugacuugaguaacuuuaaguuuauaaaguuuuuucacagcucagaauauggucuguccuggcauguggucucuguguaguuggcagccauaucuauccugcuguucucuaccagcauuaagucaacuugguucaaaguauugcucagauccacauuucuguugauuuuugugucuaacgguaccaucucuaauaauaaagacauuaaaauccacaaaacuacuuauagauuuuuuucuucuccuuuuauacauauuauuuuccuguuuuuaguuguaaguuguuuuaagaaacaucaacucauggagcuggaaagauggcuuagcgguuaggagagcauacuacucaugcagaggacucuaguuugguucuuagcaccuacaguggauagcuuacaacuccuguaacuccugcuccagggaauccgauaccucuaguccuaugcaggcaccugcaauuauguacauaugccccuccuauaauuaaaacagaauaauuagucaccaauaauuuacgugcuuuacauaugugucauagggucugauguugauuauuuucaucauuauuuuucuaaauagucacuaauugggacuuuauuucuucuucaaaggaauaaguuuaaaugccagaagcagcauuguucagaagaguaaaguacuaaauagauuucuaacaacaacaacaaaaaaguaaagcugguaggucacuuuucccaucagauucaaacuaguuuguagagucuauguagcaggugaacaccacaaaauuauuggcauaaauauuugccuagaaacaacacaaaccaguuucaaaagaauuuaaaaugacaggcauuaaugcucaugucacaguaaguagauaaaagcaggauuaaaacugagcagucaauguggacccaacccagggaugacagucaucaaagugggggugcacccacuuugucaucaggacacuggggauaggagugagaggccagguguggugcuaauaagaagguucugauucaggcucagaacacacccaagagaggacaguuguccaaaacccaacagccguaagacagcagaugguuauucuuuauccucuucuccucuguauuugugcuccauggugaauauaaucuacuuuucuaaucagaaauauauauauauauauauguauguauauauauauauauacauauauauauauaaacuuaaaaguggacaaaucuuccacuuaaagauauacaauauaguguguagacuauugggcagcugugucagaugggaaaguccagccaugggucaagacagaaaugguugaguagaacacugcuggaaaaaugagaagagacugggcucucagaagucacaugacacuucuagguguagaagggccauuaacugcccacacauuggucagucuacucacuggucaugcagacuagacuugaugcaauaaaccggaggugaaaaggcaggaucauagagucauguucucaaggacagccucagagagaaggggagucaucaggacacuggggauaaaagccagaggccaggugugaugcugauaagaaccugauucagaacuuacccaagaagcucugaccaaccuuccuauuggucucaccauagccuacauaacuaucagugagggagguuuucuaacccaaaagguuuucuaacugaccaacuuccucaggucucugaggccaccgagugauuugugacaacugggaagauuaguagaaguuucuauuaagucuugggccagacacaccugaggcccagaacagaagugcagugguacaaagagcaguaggccucccauuauccuauagucaggccuggcccuuccacccugguagcucugaugcagcauggugagaagucacagaagagcuacucuuaccccugcagcuggcacuggccucgcacuuggaguuccccagggcuaaucuauaagccaccugccucagaguaacaugagugccucauacagauuccaggaccuaagcacagucaacacagcccacaguacggagacaugagaugcuaagucugcugcaggugaggucugguccccuguguaaagagaacuuucucugacacagagaggaaaccucugugucuccacucccugcaaguaccugggcaaguuuguggaaagagaacaccugccuugcaugucccucugggaucacucgauaaauguggcucuggaaucaguccugagagcugguaagagagcaggugcagcugggcagagcacauccagccugaaacagcucaccugugacucagccugugacucagccugcccaaguagucaccuguggaaucugaugaucccuaaagaaagaaggugagucuggaaucuuuaugaggcaagaagugguaacugagaacugcauccucuacuucccaauguagaacuaggcccuauagaggcugcaaacgaguagacucaagggaaacauaaacaaagcaaaugaaaaagcccacacuggugggaagggaaaugaaggaaauucauuugucuuggucuauucuugcuggugaauaaaaccaaaguuccuugcuugaccugugugacagaggccagcuuucuaagacauaagucuccacccccagugcaugagcucucuacaaaauccuguguaaaucugaguccccaaagacccugauuguguucccuggguuauccuguuugggaguaauguggucucccccaggaaccuuagagacaaaagcuacuaugaaaaagagcacaugguauuagacuacaagcacugcagagguuguaauuaucaauagauguugcaaaaauaaacacauuaccaugaauucaaaauuaaaacuugugauguaaacuaugagagagguacaagcugauuuaaagcuccacacaaggaugcacagaacugggaaaaucuaagguaacuaaaggacugccucaguggccggguaaggccgugcaugagacauaccugcaguuagcaacaguagcaguaugguuagccugagaaggacaugagauaggcaaggccaagcugagaugguccaacagaaaauucuaggacagaggcuugaaagauaguucagucuguaaacugcuugcuuuacaaggaccuuaguuuuaucuccagaaccgauauaaaaaugcauggugugguggcauguguuugcaaucccagcaauguggaagcagagauagcgagauuccuggaguucccuggccuaauuaaugaacacuaggccaauaagagacuccaucuccaaugaggagacaguguucugagaaugauacccaaaguuguccucuggccuccacacauaagcauauguacacacacaguuuccgguagauauaguagucacuuugcuugcuugauggaagacauaagcccucagauucagucaguaccacaacccgugauuuaaaaaaaaaaaauccaccauguugacacaucacaguuuagguaacaccaaacucaaaggagaauuuucagucaccaggaaugaaaaggucaugcacaaagagguauuccuauguaucuuucuccccaacuaaaucaucaccuaggagugagcacacaauuaaaagaugcaacccagcugcagcugaaugcucaccaagaccagcccuagaagaagccuauacuuaaggacaaaggagguccaguuaaaccugcaagcaagccucagagguucacacuguuagcaaugugagcaacuaaugagaagaagaaucuaaaaaagauaaaaucaaaacacugggcaacacauuccaggaaggguguguguguguguguguguguguguguguguguguguacgugaguauacauguauacguguguuugcauauguguauguaaguguaugugaguacguguguacaugugugcuuaugugucuguguuuguguguuuguguauuugugugugucagugggggauuaacaguauaccuagaacacaaccagaagucacggggcucaagagauggguccacaugagacaacagucagcaauauauuuaaaauauaauccuauggggaccauagaaauucacagccugccuggauuggaguggagugcauccagcaagcaccucugucacuaacagcuuugugaacuggaagucagaggugcuguuugacacacaucagcagaccuacugugugugugagaauacucaagccuuacccacaguggcuacuaguguggagaugcccacuaauccuacauugaguccuuaagaucccuauggacagcagcagucaaguuaccagggucagguucucuggaccugaacuuggacaauggcuucuccaucaaccagggccuugggucuugcuuugcacuucuuccuugagccuggauaucaaucccucugggaugcuaguaaguugaauggcauguggcuugaguccuccaagagugagagacaauacuucucaggccuauaugguccccugaacccucucuguuagcauucuguccccuguaaagguacaagauccuggcaagaguggugggccuuugggggaguuguagacuucuuucugcuuuccacaguguuucuuuacaggaggcacagacccauuuuuacugcaggguagccugagcccuaaugcuaccauaaaaagaccccuuacuuuaccugcuuccaccaguccaauuccaccacaccugcacacaucucuuaggugagcuuaguagaguguccuuacaggggagguccccgcaugauucugggucucugcuagucaucuuuaguugggaccagcacugcagcucacuucuacccacuguauaguaaaagaacacuauacagguagauuuuugcacaccaugaacagguaaguguccucugcaaggacaagaugauggcuuccuaguucucauacacaaaugagguccaagucccgguuuagccuggcacuagaagucagugugucugcuugggaucugccucgugggagcaggcacucuggggcuuucccagugauggcaacccucccuccccgccugggauuagcaccucgucucuaugccagagugcucaagauucccaagagucucuugggugagaagauugggguguaucagguaaccugugaaguaaggguugccccagauccuuagaggggcaagaccaguggcucggucucuaaaaucugguggcucuggacuaggcugacuuaucacauuaacagaaagagacgacacggugugggagcauuccacaagcagugcugcuuucucugcucgugcaccucauuaacaugccgcagacaucacugcggacuucauaacacuaagcaggcugaauggacggcagggacacugcugccccguauucagaaaacaucgagugaugcuucuccugggcaggcacagggcugcaucccugccgccucugcucacgcccaaccugcccauuagcauuagcagaaagccccuauuugcauugagacaaugguccuaccccugaagcagagcugcaggggcacugggcauuuguuggcacaauugcccuuugugcccgcuccagugggcaggcggggaguaugucccaggggcucauggagauguggccagccccgagccaaauccccaugccaucugaugaggacgcagcagcuuggcgcucaguaaaguggggcccaggcuggguccugacagacgggaugccuaagauagccuucgagagcauagaacagccauggccccuuucuugaacacuucccacccuccugccaagaugugguggugggaacaaugacacgggacacagaucagcugcccuuagagaagcuggacuugguaggcuggggcccagacacuuguuagaagaaagaugaagaauaauacuguuggucacccucugcuguaccugaaacuguccuuacaacugccaaugagcuggaaguuucuggaggauccuggagcauucuacuuagucacaaaacauucuggcaggucccaggcacugggaggaagucugagaagggagagacacaccuacaugacagcagaguggagggauagagugucaacucaggagacacugcuacacacacacaguuggucucaacccuuaguucccacucuaccaagcauccaacaucagugccuccuucuugccaggcacaagaccuggccauuguggcacaugagacuggacacucagucucuaacaggacacucaaaugaagccuucccauggagccugggauucuugaagguaagcagaacaauucugaaugagaggcaagauucugaugggagaaaccaggaccuuaggagccagcucuagguaguggguugccuaucauugcuguagcaaacaaguauucagguaggauggggagagaggaugaggugagcauuggugccuuuggcucaagcuuccaccucuccaucuggaaaagggcucucuccugaccucaaguacugagguccaacuaucacuuauugugcuuuuagucaggugcccccuccacccaggacugcaucuugggcaaagucucuccucccugccuuugggagagugguuccugggcugccccaauucauggguacucugaucccuuagauaaaauggcauagcauuugcggagaaccugcuuguacgucuucaugacaccucccgauucuuuagaagaggaacuuccacguaauagucuguaaacagauugagucagaggaugaagaaccuguggaugcuggaugucuggacuauuugccuuagcauacagucuugggaggaaacagccagcaggacaguguaaggggcuucccaggagaugcugagcaaaagguauacggugacaugggccacaucccaggccuagcucacaaucuagcuuacuaucucgauacccauacuuuucaggggaaggaaaagaccagaacaguucaaacuugaguuauagacagcugcuagagucauuuacccugaggugggcacugaaguuuuuagagauauaugagaacuacaggggaagucccuuccacagccaccuaugcugucucccagggguuaugcuguaaacucaggagacacugcugcacacacacuguuggucucaacccuuaguucacacucuaccaagcauccaacaucauugccuccuuccugccaggcacaagaccuggccauguggcacaugaggcugggcaugacucuuaguggcccagauacugaaaggaguguccagucuccaacaggagacuguacauccacaucugagaccagaaaugugaaaaccccagacccacagagcccugucuccugggacaaugcuugaccguaugucuucauaauggaaacagcacccguaccuccugagaaaucucucugguaaggagaccuuuuacuccugcugugguccccuuccaguccagaggaaggauaugaagagugcccuugccuaucugcuuuguaacuggugacccagaggcacuucuaggagcaugccauauucucacugcauggucuggaaaauaugcuuaaccucucugaguucccuuaucacagagccucacuaugaccuuacagaggaaaagcuaacuagggcccaagcaugcaaaccuuucacaggccugcggucuuaucacuaugucccaugggcuuggccucacccaagccauggaaggaaagauacagggauauaggauggugaugcuagauagaaacccagggcuguauaagaaauguauccaucaagacauugaccccuacaaaaugcccucaugguuucaccagcuagccacugauccccccagggccugcagagacuucaucuuuaccacccucacuucugggcuuccccaucagugggcaaaccuccaagaggucaccacagccaucuuucaaacaaagaccuugggugcuaaaaggagaagcccagugaauagaacacacaugucaccuucccucuuauggccaggucaggccaugcugacccucaacauucuaaaccaguaguagguaucccuucaacagacugcauagugauuaccaccugaaacagacuaggagagcacggcuucaaagccgccagaagcuucuaagucuaguccaguagcagagaccucaagacaugcaucguuuccaagguaggcaagugacuguguaugugcucugcggccuuauggacagagugccaggggaggacuagggacagguggcauggaagcuccccacagccagguugacccugcuguagggucagcacugaauguccugccccugcacacaugguagcuugcuuaccugagcugucauagccaucaauggagaaauggucuggccuccuauccucugggggaucauaagugaugugaggaacauugaacaucuucucuccaggacucaucccauuauccuuauccagcuugaacuucuucuucuuuaccuaaaaaguccacaugaggaguagcaguuccugagcacugucugccagaucuuuaaccaaccccagagcacccguggagucccgaauccaggcuugaaauguauacccuugagggaacuuggguaaaggggcugagcuccaguuccugcagauauugaugaaauggggcuucaguguguuaguguugcuggaggguuuucggggguugcuuggcccaguguggcccucuaugagccacagccuaagaaaggcaagcaaacaaaaauccaauagacuguaaauaugcaggcuugcaccagggcaguagggcugaaggccaaggcagcaaagaggcacuggggccucuuuaaagaggucucucagagaaaguggggaagcagguugugugaaaccauggagagggaagugcaaguucaaggguccagugacaguuggaugcugagaagguuguuuuuucaaggaggggggagcaaggaaauggaagagccccaaccuuuuccucacuauuccaggccaauggcaggacucuuguccauagcuacuggaacuugacucugugggcuagaguuccaacaccuuccuguucugucugcuuuacccaguaaggaaagcccagcaccaggguccucucaagagcuuccuuacagcagcugauggagcugcccucuccuauuccagaaguacucucuuuaggccuaucauauccuggucuuggcaguccaaucuggcuccaaggguggaggaaaugaagucaacauggaucaggcauggaguagacauccucugacuucagaaugaugugggcacccuaaugagcaguacacggaguggcagugccagagucucacacaccgccucuccagcuuccuguccugcuaacauguaguucccuuccugauggccagugaggcugcuuaccaugacagacuuuuuagguuuggggcugggggacagaagcgugugacuccgagcaggcuuccggacauagaucuuccaaguggcugagucaggguucucagcggcauagcaccuccaugcagucugaaaucaggcagaggggaaaggaaagaaggcucauugguccagccacucagcaguaccucucaaaaaaucuucauguccuccccgagccccaagcccagcuuguuccaaggccccuucccugacaucaaggcuuagcccucuagagggcuaggaaggagaaggccucauucauuaacuaucuguuaccugagccacuccuaaagagagccuugagcaagucccagacauacagagaugcucaacuaaggcagaguuagauaaccagacuugacucagaggacaguagaaaaggacugccugagccuuugugagcaccagcagguuguggagggguagagccccagggaccagugggcgaugaggccuccugggacuucaagggcuagacuguggcuacgaggagucucuggucacuacagaugaaacucuuggccaacauucuagagggaaaugcccuccccauagucaucacaucaagaugaccuggggaagacacuggaggggccuaaaggagccaagggagcaagaagggggaaggaacagauaccaaagccucuuauggggacauaccauggugacucugucauuauaggcccuaugggcaugagaaaguaaaaccaguugaaaguucucuaugcuggccaggcuucugagugacagccccaugcuaugacagcaaccuagcauagacacaaaauccaggcagggauacuuaugaccugggacaguuggagccccuucgaaggguuuuaugucccauguauaugcccuaucugggcagcuccauaccucaugcagccugcagcuccucccagcacacuccauguugccuguguuuccaacucccaccaguaagaucccuggcacaucuuccacuguggguauagcuucugaaggagucuuguccacagaccaugcaguuccugagcaguggccucugugcucagccgaggaacuacauaacugccugacuauguuaauguggccaaggcagguuagugggucugauuuaagguuuuccaagaaugagaagcuguggggucaagccaggccugggaaagcccacaacugcaacugcuggccucguggcuguugcugucaguggccagguaaauggcucuggaagggcaucagaggaacaagcuggggcccagaacugugcuagaagcuuagauaagaccaugagagcuacgagcuuugagaagggcugccaugccccucauccaggguucuguccagaucagagaagucaggaaacugaggcugaccagcagaguacagacuggcuaaguagccauggucaggccuugcccuagucugcaaguauggcccucagugggaacagcaugaggagcagugguccugcaucccuuugcccacccuaucauccuaauagugaguacuuucccagagagccaccucaccaugggaagagccgaagcaaagggauccaugccucucaaguagugggcauggcugggagugguuccaacacccaaauggauguaaguacacagcacugauagccugccgggcgcaccgcauaccuggaugagugaggcugcagcugggaucugccgguugaagugcuucugccucugcuucugcuggaccuucagcgcgaacccagagccaaguauccccugguaagggacagaaggugcccacuguuacauaagccaugcuagccagugcccagcagaggaugagggucccaaugaagagcaagaagcaaaagcaucuggauaccagguuugcacagugcccagggcuguggccaggcaggcacuaucagaagguggguuugagacagcagaugucacaugcgggcagucuccaggcucagccugccuggccuugccagcuggggaggcagaauccauuucucagagucgacucaacaugaagcuuggcucuagaagagaccugagacucuacacauuucuuggcaccaccugugggaauccagguaauuuagccaucaccccuugccccuggggcagaggauuccuaacccuaggagagggggaguuugaggcuguccucagcaagaagccuacagcuacuguagccagcaguggcagagauggaauacugacucugcagcuggggacacacacugugugucaugacccauauauaugugucacacaugcacauauaacagacacuugaacacauaucaucucccauguguuacagaaacucaugaaacauaaauaauauauggauacggaacaugugugcaaauauagguauauacaugacauacauggaaucacaaauacacacacauacauauguauauauguacacauaaacaguacauaugguaaacaugcuauucaaauguaauacagacacuuguacauguaacacauguauacaguauaugcacacaacauguauaagacacaccuacaaugacagauauauacaaguaaccaguauuucucccaccuagcacacauguguagacauagguuugugauuuuuggaaaagucacaagacagagccacuccuggcuauagagcagaccugcagguucugcccagucugcuccccuguaccuugccgcuucugugaaguaccacaacaaggccuccuuacucuacuucaaggaaugccuagaaguuggggcaagggugagugggaaacaagggaaagggcucuuaauagguacccaccgcugggagugcaaagaaggauauggcgaagacagagaaacaggaggcgauggucuucccaacccacgucugagguaccuuauccccguagccaaugguagugacugugaccugcaaggaagaaggacugcagucaguggugggcuggcugagagccucagaaaagacaccugccagccccaacacagcggcuugaugacaaaagagaccaacuuaaaacccugccuaccaggauagugaggcgcgguucugagaaaguaccaggaacagcaauauggugaguugguucaagcuucugagucuccuaaguccuucaacucugauuaccacagauggcacagcccuaggcuuacagauagauuggggugugcaggacaggcaaagagcucagagcccacccacagggaccaggcuuccugccccaucgaaaagaucccucuccuggccaccaaaguugcagugcacuggcccccaggaggccggaagcucccacugaggccagcgguccacaaagccccaggauggggcugacaugcugcuuccugccaccagcccagggauccagauguuuuauuuuuccuuuucagagagaauaaggcaaggcucuagccuucuucuuagugggggagcagcguccagggugugcagugggacaauaggagugaggggcugccccccccaggcaguccccugcugacaucugagguuugcuccuggggccucugaugagggacuugggggcccacccuggcugugccuaacugcuaggucacaccaugaggcugccuugggccugcugggagaacaggguggucacauucacuaacacgaagcccuuggggucacaacacacuguccagaucaggccaucagugaaggcaggucagugugaugggauacccugcccacucaaggucuuuaaagucugaucacucuagacaccucagcugucaccccuuggggccaggugacaaccacccagccaagaccuauaugagaaccucuaagugaaccucugcccaacaaagauggggccuggggaacaccaucgaauagacuccaaccaaagugaggcccagagaggaagccucaagauccccacacuauccaagcccauggccaucacuacccacuccauuuccagauggacuucuguggaccacaacuguuccccaguggccacugaagaggaagggaaggcaagagaggcaugggggucagaaguuaauauguacauaucgugagcauagagauaagugcucagagccuaggcaagcacucugaccaacuucagcaggggagcagaggacaaggacagcaagagugaccccacagugccaagucuguugcuuuggccaguauguuaacaggucaugaagcaacaggucaauuuuuccuggauggcaaacaacagagcaggcuacagcugggcccaggccaucacugggccacccuucagugcuguaccauuaaauaagaggcugcaugcauacugguguuuucucccaauugcccacaugaaaucuuccccacaaugucauuauccuuaaaaaaauccacacccuacaugaacagaggacauagcaaaccaucaugugaaaucuuccccacaaugucauuauccuuaaaaaaauccacacccuacaugaacagaggacauagcaaaccaucaugauggcugggcccuuuaaagggaccaaccuggucuacauaugugggcauacaguuguaaacaugcuucacauggagacaaggacacccauucacacucauaugcacacgagggaacauggggccacugagugagcugaggcaccaugagggugcacauacacacugcguaaguucacaaaggggucuagagguuauacucaggacugacagccagggcacgugcuguccagacaucuuauacacacaccugaaaccacucacaugauguaaguugaagacaagccauuccagggacggaggacauggcugccugcaggcugugggaugagagggcucaggagagcugaagcuccucacaagugacgucuucccagagggugugcaccccacaugugagagcuaacccacagcugccuucucuagggagacaggcacaugacaggagcuacuugugaaagcagaccugggcuggagccagcaagaguucaagaucaccugggauauauggcuuauuugaggcuagccuuggcuauaugaaaccccauccaaaaaugggggauggggaggaaaacaucuacaaagguggagggagaauggccuagagggcaagcugggaagaagcaugggugaauugagaggaaacuccuuauguagguaaaaauaccugaggccaugccuuuucccuauaggcuuagcugucccuccacuccuuggaucaguaggagaaagggcccagugcagugguccugagugcuggucaguugucuguuggaaggcaccuaaccacuaggacccucuuucuccugggccaccacagagcuccgaaucuaguuuaugaguccucucucccaaguagccugucccuaucaaguuguuuuuccccaagucacagacucagcaacucaggaauggaucauuuuauagagcuguuuggaacuuguccccaauggcuagaucugcaagucucuugggccaaugaacagaggggaccuuucaagggcccaacuaacaauaggucaccugagucauacacacuugaguucauagauugcugucccagugacagaaccugucgggcaggcucuguauaguucauggcucuccucgucccccugaacaggccccugggaaggauuuucagaacuaguaguaccuagucuccuccuuuugagucuagagguagccuggcugagaaucuccaaccacaaccauuccugaagcucaccuucugcaugcucacugacuuaacuugucuauaucuauuaacuagcugugcccaaagaggcuaguuggcaugcccauggcuucacagcugaugccugguggacaugggaggugaguacagauuggucucuguguugaccucacagcgugucaaccuuguaccuuaugcuucacuacuuccugaugcugucugcuuccucguggugaaaggguuucugggaagcucuauuccugagauuuacacaggcaacuccucaauaacaugauuucaacccauguuuagcaccaccuaaccugcugagucuguauaauaacucuaggcacugcuuacugaauagcagcuacaaaaagauggacaugcuuuguagagacuccucaucauucuauaaggcccaacuauaaagauuccuccuccuugggaagagcuuacuagcaaggagucuggcaggccuucagccuuugcugcauaauucucauagaaccaacacagaagaggagagggcuuagugcuaccagcccugaccccugcucuggccuucacuucuccauagucagaucaauccugaagaauaacgucucucguggauaguuccacgaggcuugcaugugacuaucuaagagacuuccucaacuccaaggcccuucuguccuagcugugcaggaugcagcccagccugggaggugggaacuuuccagagccuccaggugaggaaugaagagccgucagacuggguuuuuuaagggacugaaauacagggugggguuucagccugcucacuugaaguucuguauuuagccacucaagguaaacagagcccagcagccgccuguuuucagagacccccaggcauuaaacagaggagcccauguuugcagaaaugccauuuuccugcacucaaacuguaauacaaacaaaugcauucuguuucaaggguaaaggaaagcuugaggggcuccccaaauacuucccagcccacacuuggacauuauuuuaggggguucuggguuccagggaccucacacccauguggguauucccacuggagaaaggggaugcaguccaugaaguuugcuuuccagcuguaggaacucacaaucuaugaagacagggccaccucacaaaaugcugccuggauaccuacauucuggacuuaucugugucccccacauggcucacccagccucaccccagauuauggccuuccuucugggucuccuggguggacccuaauccaaugcugcauguccaugggaaacacauaggagcgacacaggauccuagggcuaccagaaacuuaacuuaauacuaaaagucccuucccagagucuaccaagugaguguggccugcccaugccucggcuucagacucugguguucggagcagaacaggacauacugaauccaccuauuggcagugaacaggcuuuccugccccuucucacaaucugguuuacuuacucagugaauaagcacuagucagagaggacccucaguuucaucauaggcucugcaggcuaacagggugagaaacauuccucccuaugcaggcaugccucuaugcccaaugccuaccucaguguaccuuaggggaagcuaguccaacucucagggacaacauucucugggguaggggacagggcuugaggccuaguccaggacagggacaucagacagagaggggccugguguuuagaaaaugcucuugccugaggguaugcacaucacccccacauuaaacagaugaggaacccagggacaaggucgggaggggccauacuucccuuauggaaugagggagacaaaggagaugccuguucauuggcucagggcuacagaacucugagccuggcuguccuguccuacagggcucaaguucugauuacccuagaggugccaggaacccagucuugggcugcucccacuagacagcugcagagacagccacugaaugaaugaggguacuggggggcccuugggcagccaagggcacagggccucacaggaacaauggccaggccagggugcgcuguggucgaggccugggcugcagcugacggaguaggccagacagagcaccggugccaagcugggcacaaaggggccguguucccggcuggcgggcggauguuugcacaggugccggagugggggcaccuuucugccgagggcuggggggccaggggcuggggggcugggaaauaguuccugcaggaggcugggaacauaggcagggcagcaucaaggcuggguacugcuaaggcugggcaucacuuaucagccacacuguagguagucacccauuuacuuccugcuguaccucagcuaacacugcccaucucccaccagagaauucugguuuggaguugccuggcccccaugcaggcccugcuacaucccugggauguguccucuuuccacaggcaagcuuucuaacuuuccuacugauuuuuccuaccaacccuguuugguucuaucaugcuaggguaucgggggacauuggccccaagaaggguaggcagcauuuugaccuggggccugucccaaccuggaagcuucucaggguacccuuaccuccugaggcuguuuaggaugcuagaaacuucuagaaaacggacugauucggccaaugucaagaggucuugcuaugugcccugcuuccugcaggcacuugggcauugugagaacauguguuuauucagcucccauucucaaccccagucuagaagcucugagaguaagcaggccucggagacugcucaguccuggucggggugggggcaguauucaggccagggccugaugcaaucaucaucaccauggauggcugcuuguucugaaucagguucccagagucugugcuggcccuuucuauaggaugccacagcccacccaaccuucucaccagccuagugaaccccaaagucaacagacugagaaugccauuuaggaucguauugaaauccucgugccuacccaggggugccagcccuggcagcuccucccgguaugauggcauaaagcaucuggacagucuauugcucuugaaacugaggggaggagauagaguuuuaaucgagggcagaccauacaugcucugaacugcuugcuccuguuagguccuuguguuuccugcagcuuagagggccccaaagcucaguggcuggauaaagccugccuccagaggaggucacgaaggccauguagcagcuaucccauaggcuuuuaggccaugagcaaugguugcuaggucauggaguacaccuggauuucuucagcaucacucucaccagaaccucucccuccucuaccuguuaucugacacccaaggagccacauaccucuacacacacacacacacacacacacacacacacacacaccacauucacaccaaacacuggccugcacacaguaucaucauacuuugggacauucagcccuagcacgagaggucacugucacacaccagacuccacacagacuggcagcucagugaguuuggaguugcccuaacccgagcgguuuauggccaucuuuaugaccuuagggccugacuggcacucauacuacugcugccuggggcagcggaagccuuugcagaccucauauccaaaagccccugugucuuucucuuagcucacaagguuuuaaugguaguauggcauugugugccuugaucucuggcacaggugugcucccugggucaacauagacaccacaaacaugcaaaguauguuuuugaccccuuccugcacccuaaacccaggaucccucaggguaaggaucaccacaaggcugagauaugaaguuccagguugcaaucccuugucccaucagccuucccuuccaaaacagaaguugaaagauaacaaugcucaaauuucaagacagggacuggagaacgcuuacuguaguauacauuuguaagcuguaaguacacauuuggugguucaaaaguuuuuaaaacugggguuaguaaccucaguggagaagguaaaaacauugagcaaguagaguucaauauccuaaccccacugcccagauccauguaucucccaccugagacccccaguaaagaccccaacuuaccaccccccaccacagagcaucugcguagcugccaaacucgaugcggccggacucguucaccgcaucuuucucagccaaguagacaaaguaggaggagaagauaaggcccagaaagccaauguacaggguggugaucagcuccuagggacagacaacacagaggccauggucacauacccuggugguccacaugaguauggugagaggaggaaaguuccagaauuugcuguuagauuguacuguguugacuguagcauguuauacacacagaaucaccuuccagaguaaccuagcuuuugcaauucacaaaaguggcaaugaagaagucucagcuauuacccuaagucagccauuuggguccaugcagucucccuuguacccaugacaagauaguacuuagagccagcuguccccagcagccucucagacagaguguccucuggaaagugucugaggcaccacccuugauuuccuagguuugauuucagagcuucauaaaucuguuguucaucuuacauuuucuacaagaugcaauggucuuuugucccaagcccaagugaagguggcggcagcucugcacuguuaagaagccaaguauuuugccaucaugaaugugggguaggcucaggcugggaaggcucugggguccuggacccuguccucagacucacaugucuugguaucugccuagaccugguccacucagcugggguccagguacuaagauaucaccaucacugcauccugaccucauaagucuccagaccuccuguuuauaggcuggccagcuucuguucugcccacaccaggcuuacucaccuggcggugaaugaagacuacagagcccaggagccuccagguaccccccuggcgaucgacaugcagcauccgcaggaucugaaggaagcggauaccccuaagaagcaagaagggagaggucaagagggcugugguggacacaagcauuugcuuccuauguuccugucuccaccaagcuuccaauggguagagaagacauguacaugacacuuuguacuggagccaucuugcuuccuauaggugccugagaacccucucuccaggagcccuuuuauauggccuuuuugggggagaccagaaacccagggucacccauauggcaaccacacagucaggcuaucaucuaagucuuagaagcuaggaaguacuggggucaaaccuugaacucaggguugcauacuguuucaauaugaugaacuauggccacccuuccccugugccacucaccaugaaagagacagguagagggagggagagacuacagcuuaggaggaaagggcuuuguagugggucuucucucacaggaagaaauggaagagccaacauaccugauagcugauguggcgaacacuuguccuuuggaacccacgcagaggacaaccauagaggcuacaaccacgaugaggucugugggaggggcagggggucaugacuucugguaaccaggaaucuggggaggguaggcuaccacccacaccugaggguuaugccacuaaagcaagaugggacccaauaaccaagggcacaggaauaaucuaggggucuccauccauggagauucucuggggaugacuguaaugggaauguccuucuggacccaugaauguguggaauggaaugucugcaggauguguaggcaggacucaccaaugauggaaaugggcuuccgggcaaaacguagccggccccagaugcccacguacuugcugcggcagccugcagaccagaggcggaccacauauucugucccaaagaacaccacaaggacaaucuccugagaaagaaagcaauaagccuguguuagaggcuaugaccacucaggcuagagcaccuacaccaagcuaccaugccaggagccucugcugagacacaaccgugacuagcaggcucagguauccaucugugguaacucauaguaccuauaacaacuguccagagagguuaacacacugagcccagggaugcuaagaguagacagugucagcuguuauuugcuggggaagacuccacaccaggguugggguuuaaugaucuggucugguaacauagugcugacauuuguguugucuagcuucauggaaucaacagagcucaaguucuauaucugaaaaugaggguucaaggacaugugucuuuugaggacugucucccuuagagcauagcucacagcucugccucacacuggagacaccguacccaccauccauagccucuauugagguuuggguacaaaaguccccccaauccauccagaggcaguagaggaaucaagcaagggcacgggcagcaacggaugugaaauaacucuccuaggucaauucacacagaccagaccucucccaauguauccacauacacucugaagucagagugcacugaaagggaggcuuuacaagcuagagaaacccaggcugucauccagguuacuuacugcaguggauggacagaucaacacaaagguggauggauagaagaggagaugggugaguggacaaauggauaggcaugugaguggauggauagauggaugaauggaagaauggauggauagguagauggauggaugaaugagaaggugggaggaugggaaaguggagagauggacagauggauagauggacagauggauggauggauggauggauggauggauggauggacggauggauagauggaugggugugucgaugguugguugaguagaugaauaggaagguaaauaaauaauugcaggugacuggugugagaaccaaguuaaaaaaaaaaaaaacaaaguggauccauuagcucucucaauaaaaacagacucagccucugaccaugauuuauaauucagcuagcagcaaucuuggggccuucccagucugugacagcacugggugagagcaacuguacugcuuuguguucacacagccuugacacaaacugaagggacggucgcuggcggccuggcaaucaccaugagagaagucaagguaagccuggggccuugccuuugauuggugaauagccucuccuucccuagccuucacuaucugccucuucaaugaaacacccaaagaccugucacaugcacaguaucuggagggugaggcauuggcuggcuugcuauggcauagugaugucagaaggucuggucugggauacccauacucugcugccaguuuccguucucucccagcucuugccacagggucauugucagggacuggcugcccugagugagaauccccuuccugcuuguuccaccccugggcagcucaggucugauccucaguccugcuauggcgugaaaaugugaguagccgcaccacaagugggugaugggaggauuugaaauaaguauacauuccaugcgaacuacagccuaugguggccuccaggucuccagcccugucccagaccuguuccccagcucccagccagccuucuuugguaugaggcccuuggggaaggccuggggugaggaggugaaaccacucccacauauguuaggggacugugcaaagccacaaacccgagaagccacaaagcauugugcugcucaggccugcuuccagcuggcucccugccuggccucccucaggagccuggcccuggagggaacuuccucuuugaagggugacacaugcuggcccugcccccaccugucggcugcuggagaguccaccaugagugagggcugaauacugcacaucauauauaaaugcuuuuaauuaagacaaaauaguacaccaccuggcuuguguuuugggcaugagcagugacugauggaaggagugagcuugggagaucauagcuccuuccuugugagaaaagcauuuggcccaugaagugaacucauugggaaugggggggggguggcuaugugugggagagcgagagagugcuggcaaugaugggcccaguuuggcugagcauaccagggaggagccauagucucguucacuccagucagagcucaauauuggccuguugaaugaaugaaugaugagugaaugaaugaacgggcaaaugaacaaucucugagcagcuggcuugcagggauauugauucaucuuuguuucuugagaaucugggucuguagggcuguugcccaaaguacuguguguaucuuuggccaacaugaaaaacauacucccaauccccagcacaggauaugacuucaugggagacagcaugccugaccaugagaagucccaauauuuaguuacagugcuagcccaggcagaaggccucuguuccaauuucauggccauacaucacccagcuggcugaucaucuagugaguuucucucauuugcagauguuugucauuauucaaauaucuccuuagcaauggcuucugauggcuacaggugcccccugaccuaguacuuggagggaaacccauuuuggaauuggcuaugugaaacagcaagauccccuuacacagaucuccaauucagcaugugaacacagugugaagccuggauucagcggacuugagccccuucauccccugaaaaugucuggcuaguuauguccagggcaggccaggcugaguuaaucaguaaggcucaggggcuucuaggaaagagacauaggaaaacaacccuguccuagguagaauguagccauaucuaguguuuagacagagauaaaaugguuuucaccagcuuugcacauauacuggaccuaggaggaguagcccucagaccaaaggucacacuggaacuccagugaagaauuagcauuuagcaguagugugagucuguaggagacacacugugggggacaguuuaauucagguaacaacacccuaguccauagcaggguuaguggggcgagcuuagcccuuguauaacagaccacaggguugauaccagcuguuguuccagcauagucaccccugcucagucagggccaggccugaagcucaccugucuuauagacauaauccaaaugcaaccccaguguugaaugauaggccucaaauuucucaacagaacacauaaauaccuguuaccccucccucacccccaugccugcuccugcuguccacuugaggucaaagguuaugggcuaucacccaaagggucucauggcccagugcacccaaaagccucccuagaccccagacacauugcauccucuggguucuccauguccucagaggcuuagugugugggguguacucucacccccaccuuccaaccccuugccuauuuagaccaucccagcaucccccagaccuuguaacagccaccuaaaaagcuagcaugcuccccccaccaauaaaaguaccagccuaaugcaccaguauuguccagcucccuaaagggccucccugagaaauccacaugcugcugccagaaccaaggacucaaggccaggggacauugauggaguguggcccugagcucugucccagagauauaaaagaaagggcuguccuugggccaaugagcuugggcugagacaaaaggcaagagaacacaguggccccucccaccaugaccauuguucccuguacuagaguuaggcuaaauccuggcugcagagggcuuuguggcugagacuccugcgucagggauaaacagcgagcacagagccugcagcuuuuccuguauccaccaaggcaggaacccugugccucuuucuauacacagggaggaaagcccaugagaauaggagaauaccugcccaaggauucaugggaggaauagacugacaugggcacaaggcagaggaucacacaggcucucagguuugggaguggacucuggcaagugaggcuaguugccucuuggagggcugacuacugauacguggguacaucugggaacaugaggacagaagagguuuggggaauggcugugaguagggguuguauagaugagacagggucuugagugaucagggacagaaaccaagguguaaaaggaaauggccuaggauggagggugaccuagaggcauaagagccauuuaccaggccagcugugacacgaaguguccaggguaaggacaaaagaugagccuggaccaugugcagguccugguaccccauccuggugaacuucugugcauggcaggagagcuagcauuuaugcaggugagucugggauuauagugggugugaagagcccuggggagauacaauaauccuggcucuaacauacgugugcuugucuccucuagguccuugaagagcuggaggagagcagaggggccagagucugagugcuggccacuccuccugaagcugucagagaaaaaaagaggggcuugucuaauggcauacgagugccagagccaugaacaagagguucggacaggcucugaaagcaacaaucucuagaguguaccccuugcagcauccuguagccugucacuuugcccaugugcuggucccaacccacaugauauacucucugacacacucugcuuauuuccuaugcaguaaauguugagaguuguaucucaauggagugagagucccauaauugaaaacaauuuuaagggcuggcgagguggcucaguggguaagagcacugaccacucuuccgaagguccuguguucgaauccaagcaaccacaugguggcucacaaccauucauaaugagaucugccacccucuucuggugcaucugaagccagcuacaguguacuuauguauaauaagaaauaaaucuuugggcuggagcaagcagggacuaaaugagcagaguugaccggagugagcgggguuggcuggaacaagcagggguccuaaaaaauucaauucccaacaaccacaugaaggcucacaaccaucuguacagcuacaauauacucacauacauaaaauaaauaaauaagucuuuuuuaaaaacuauuuuaaaaagcaaagcugcuggcacugaggcucaguugauaaugugcuugccuagcaugcaugaagcccuggguuauauucucagaacuguauaaaccaggugugguacuagauaccuggacucccagcacuaggaggauagagacaggaagaucagaaguucagggucaucccuggcuauguagaaaauuugaauccagccuagauuaaugagacccuguuuuaaaauaaaaauaccgaagaaggaggaagaggaggagaggaggaggaagaggaggggaggaggagaggaagaggaggaggaggacaaauguuuuagaaagguagagaaccugaauaggcagcaauuuggagaagacauacaacugagaaaagaugcccacagaaacaguuauucuaugccacuaacuguggaaauacaaaucaaaacagaggcugcuguaucccucuagcaaaacacaggcaaugacuacaguggccaaggaggcagagaggcagggcuauuauacauggcugccugagggagacaccagacccaugauccuggaagcaugguucaaugguucccuaagucaugaagaauggaguuaccauccacucaauucugcucuaaacaaggaucuaucuuuaaaaaaaaaaaaguacaguugugggacuggggauauaaaguauauaaaguauauccccagucccacaacuguagagcacuugucuggugugccugaggcccuguuuaacccccagcauuacacagaaauacaucaauaaaaacagaaagaucauuuauuuuucuaaaaacaaaaagaacuuccacagagcccagcaauucuacuacauccugaaagagaggcaggguuuugagaagcuaucuguccaccguguuuacuuuggcaaaguacacaauagcuaaaggcaauguccaucaagaggacagagaaaacaggcuccagauacuagagggcacauaauauuccuucagaaggauguaugcuccaacacaacacagcauggacagaccuugggaaccuucuguugagacaaaaguccugaaagaucccccucauaguauaacugcagggccccaaguuaccaaagccacagggacacaaagcaagaugagguggcagggcauggggguggcggggugggggugaguguuuaacaagaccagagucaucugugaagauggaaaguucucaagguacgugguaaggacuacuacagugugaaugagcuucaugccacucagcugagcacucagacauagccaaggugagacaccuuaccucauacauauuucaggaaggggaguggggacaagauggcucagcaaggaaaggcaccugcuauugucaagccuauuggcucaaguuugauccccaaccccacacgauggaagaacaaaacugaccaaugcaaauuguuuucugacuaccacgugcacacacagacacacacacacacacacacacacacacguaccugagaaauaagggaauacuuguaauaaaagaagaaagagacaggagggggaagaugacauggagucacaaggcucacaggaucuacggccugcaaaggaccaaguggacccucacuguggcucccauuguaaagauaagaaagacggugguagagcaaagacaggaagcauccaaggucuaauuagguccuuugucaucucaucucacuauggcaaugcuggaacucacugaggcacaggcucgguggcauccugggcucuggauccuggcagggacaucugggaagagacacgcugccucugaaaacuucacagugggaacugaaaguuuucucauuugacagguggacucaguacccccaaacugaacccaagugauucaggggaugcagaagacaaaagcuuggcaugacagaaucucugacuggccgggaacaccuaucacacaugcauaccuacuacacaugugccucaggugcuuggggguaagcacagcaaagcagagaucugcccguaugugaaccuaaagggccgagauacaaguaagggagaugcucuaucugucaacagaggaaaggccagugcagaguucacagccuccgaggcccuuccuugaaggcugugggugucuuaucuauucuuucuuuuuaucagcuggugaaucccauuucuggaaggguggggguucagcuuacuacaauccaccuguggcccacagcaaagccagggcagggcagacugccuuggauccucagaugaaagacacuuauuuuuuuucccccucuguuucuuuuuguuuaacaaucaagggagcucaaagaugcuuaucgugaguauucagugucucugauguuacuauuuuauaaucuucuuaauaaaagaauaauuugaaaucugacuggaagauuuaacuauuucagaugaaggguuggcccaugggaauaggggcccugcaagagagccggcaaauccaggccaucaggccaaagggcccggcuggucucccugaggcccucuaaacacuggacagggcaguuucuagagaguuagauaccucuaggccuccuguaggcuaccaaucagcauaggggugccuugggaagcuagggcucagacccuucccuccucucauaacuaggaaaccuguaagauggccauuuccugagccagggggcuuccugugggaggacagugccuucucagcacacagacagccagcagacuuuggggccagcuguucugacucuacacgggccccaauaagccauagagagggccagccuugcauucucgggaggggcagcuggccggaggcucggugccggcauguaagcugcucaaagcacccuuuguucagguccugccuguggccagcugcucccagccgccagccuaugcugagagcccaugggcccccccagugacaugugcugggcacagcuggaacccuuaggccaugcucacugcccacccuggggauugucagcucccauaggccaccagcuagucccaggugacacaaagccuucagagacucuaaggaggcacagagucagggccuaauggcaguagacagaaccaggacccuguagagacaugauccuuucuauaacaguccacucuucuccaaauguccuaggagucauggguaccuacuacuggugggguucugggggcacacagcacaacacagccaggaagcagggcauuuccaccagccaccaugaaaguuagugagcuauaagauagagcuagaggcagaagccccaguccugggagugggcagcagagucccacacacgccuucuucaauagccaguuccuaauggcacugggcacagaucagcagcugcuauguccacacuuauuaggguagacccaauuugggggcaacuuuaggagaugcaggguugcuuuccccugagaacccaucccaacugccagcuguccaggcagccauucuccacagugggcagaagaggcgaugaggcuugcucagucaccauggggacaagcuuucccauccaccggguagccaggcucugaaagugggcaacaacugucaccugguccucuaaucauagacccuacuucagcagguggcaugaggcccaguguccacugcugaaguuuacaggggaccaaaagcagagggagugccuugaagacuaauuguuucuccugaucauguucuaaauccauacugccccauguaagacuccuaaagggugcuaaggcccaugucucccuuuccuauaugaucuagaggccaccuucaggccaaagcucagccacauaggguucccugguaucaucccugacccucacauuaucauguuacagguauagaggcuaccacaacaggauguuggacaucccgacagacugucucugagagcuuccuaacaagcugggauguccaacaaucuuaggaaacaauaaaaguauaaucggguugcccaggagguaccucuugagcacacugugcccccaggucaaggcucaagaccuucugccccaaccaaauucccaaagcccuacuaaucacuuacugacacuaggucuaaacaggaggcagauggggcagagugaggauaaagcaaggaggcuuggcccacacuagugggcuagcccauucuugggcccauuaucauuaggaaaaauccuccucagauuggaggcuucuaggccucaaccuuggaauaaaggcuacccacccacagugggaggagagcaggcccuguggucacuuuaauuuacauguuucgcuggugcagggcugugugguacugacuagaguuacaugcgguuccggugguuuaaugagcugccuccagcucugagacccagcuugcugcaagcuggcaaggugggggucuucauacccugcccacucccuuccucccugccuggguguucuagaggucaggaggugaacauggggguucaguggccucccaaugccugguagggggcugggcagauggcgccaggauaugcacauagaccagcccaggaaaucccugcccagaauugccucaucagcagauucaaaccaagcaaauucaugcuaucccuuagacgccuccaguugugagccagugccugacagagagaaggcagccugggugcucuguaagugugugccugcauaggacagggggcuaugauuuuuuauuucaugaauuucaaacuagguggaggucacaaacaccagccagcaacugagaagcauggugacaggcagggguggaaaugaaguaucugcaacacuggggaaagggggcagucagagccucacugggggcaggacggauagugucuuuucauuaacagaagucagcucuacauagcuguucacagcugcccugucuucccucacccuguugaguuuccccagcuauuuaggagaguaccucucuauuccugcuaagacuucuuuuucccucucaauauuuuaaccauuuguuuccauguuucgaguuuuauucauucuuuucuccccuuuuuaaaauuaauuaauuuauuuauuuuuguuauuguuguuguugcuauugcuggggcagagucucauggagccugggcugaccucaaacucuauguagccaaggauaaccuugaccuuccagugcuccucucucucuucaucucccagcacuaggaucacagguguguacacugugcacaguuuauacagacuggagauugaacccagggauucauguaugccaggcaaacacuagcagcccuugcaguaaguucggaucagagaacacccacaucugucucaauaguguaaggcaugcauguccuuucuuuuaauaggagcuccaugggugaucggcuucagaagucuuccauggguccucuaaagagacagagaauacccacuaucaggcuccaaaaucacaaugauagcuugaaaaccugcuccccauacaccuugccacuccuguccuggaaucugggcuuuaagauuaagagagucagucucagucucucucucucucucucucucucucucucucucucucucucucucucuuucucucucucucuaacccagccccccuacauacacuacacaauugcuccaccccugaucuuguggacauuuuuuucccuuucuggaauguucauuucuaaaguagagcaacccaacaggcauaacagcccuagaggaggguuuccccacacuguugccccugugcuaaguagagaggugccagucccagagcugugcagccuacaggcuuagaagcugugcucuggguuuguagguggguuuuuguugggguagcauggcuagggauaauagcaacagucguuucaagguccuguuacagauucugaaccacuuaccugccuauguucucugacccugcaucuaacucaaagacuauucugaaagaauugccuaauggcaucugugaugcuuaggguugucagccugacaaaaucuagaaucaccuuagagucugggcucagaguauaccugugggggccucucuugauuauguuuguugauguggagagaccuagguugucuaggugggaacagcgagcaggacaauagcaaguacuucuucauuguuugcuucuucugaugugacauagugugaucggauguuucaggcuccugcugccuugacuugccuaccucaauggaccugugaggcaagauaaacccuuucuccuuugucaggguguuuaaucauaacaacaggaaaagcuaaucccucauagucaccaugguuaacccucuuuuccacauaccaugugauuuuucacaaguguuaugauguaugcugucuucauauuaauaacuaggcuucguccacacaaacucaaccugcuguggccugcaagucuuguucucuauuuuugcgugcaauuucuuugcauaguuuuggcuauccuuuuuuuuuuucaacuguccauuaugucuucuuuacuaaauguacuggacacaccugcuuuuuguuaaaaaaaaaaaucauaguggggccauagggucaccaguaauaugcuuaucuggcaugcacaaggccuugaguuauaucccuacuaccacaaaauuaauucuuuuuaaaagaauaaaacccuauauauuaguccucuacuuuuugugagauuuugcauaucuucuuuuggaagaugaauuuaggacauuaauauuuaauauaaaauugaauacaccugacuacauuuccauccucacuugucauaugguuucuuuccuugacccccuuuccugggagcugcuacguuggucagcaccacccucccuccuuaucucauggaagaggacauuuuacuguucucuuccauucuaccagacccuuaaauacaucucuuaucuaaaaaaacuuuccauagcacugauuucuugagauuuucucuggcaagccagcaaucuguguauggcucuauuucuuuugaccuccaucaucaagggcucuguggagaaaggcacaguuuaaaacaucuugucaaaaaaggauggaccaucuagagacugccauauccagagauccaucccauaauaugccuccaaacgaugacaccauugcauauacuagcaagauuuugcugaaaggacccugauauagaugucucuugugagacuaggccggggccuagcaaacacauaaguagaugcucacagucagcuacuggauggagcacaggaggagcuagagaaaguauccaaggagcuaaagagaucugcaacccuguaggugcaacaacauuaugaacuaaccaguaccccagagcucuuaacucuagcugcauauguaucaaaagauggccuagucggccaucacuggaaagagaggcccauuggacaggcaaacuuuauaugccccaguacaggggaaugccagggccaaaaaaugggaauggguggguagggaagugugugugggggggaggguaugggggacuuuugggauagcauucuaaauguaauugaggaaaauauguaauaauaaaaaauauuuaaaaaaaaaaaaaagaacgucuugacaaaggccaggcaauugaugccuaaggcucuguggcucucauggccuccacccugaaguggaagcgacaagagacaguacauccacaagaauuuaugcuauguacucauaaaaccugauuuguauagacauacaggcagagagggccaaguucacagacuucccgguuccucaucuucuggugggugagcguuaucagguaaaugccaucaacacaaauuccugucaauaucccacccucaggaugucaguaugugaccguauuuagaaacagggucuuuugcagauguaauuuaugaugaagcaacaauagcaugcagugugcuccucacccaacaugacugacagcuuuacagcaaagggacaguaaaauccaaaaacaaugggagaagggaaaccaagugcguaugagggcagauguguuuuuuacaauguuuuuguaacagaacaucaaggauugccaucuuccagagaccaguccgggaauggaauggguucuucucacggcuggaaggaaccuacccuuaucuuugacuugcaugcuagaaagaguggccccuaaucagauguaagcugucacucagaccaucucagaagcuguaucucuagagaugucucuuccaucaggccagaaaugacaccaaaucaucuuucuccuuguaggcauauuggcccacugcuuccucacaccacagugaaaugugggcuuugaagaacaaacccaaggcacugaaggcuagcaaggccccagguguacugcucuguccagacagaaggggagcucuuaaccccuauccagucccacucugcauagaccccugagaaugccuuugcauauaggaucaaccccaguuguccacccugaaaucugugcuaauuugcgggcaguggcccaauauugcucauaccugaacuccuagucaucuucacaugaauuuaaagcaggucucuaccucugccaggaaaguuaugcccaucucuaacccaguuacgugggguuuuacucuuagauccugacuucacuaccaauggcugccaacccccauggagagacauccaaagaugcgugccuuaacugagucuuggaugcauuuucauguguagggagcccacacuucuaaaacuaccucgaucaagaauuuccacaggacuaggaguuuagugaagcugagacccucagggugagcacccuucaccauagcugugggccuaggcaagccaguugagccacugccugaauucuaucuuugugggugucuagggacugaaccuauucaggcaggccugagacccacagggcauggggaugaguggaccaccugaccacagguuguucuuuggcuuuuugagcaugugguggggacacagugcuuguaccuggcuuauucauuguccguugauuugcacauagucauugugcaaauuuagacaucuuaaugaggggagaauuuaaacaguacuucuucuuccugucaugaauguuuuaagggacugaggaaauugugcacgaauuugcuguuuuaggagaugguaagucaacaacuucgggggaaguauacuacuucagggcauauguuuacacaguuccugggagauguaaaagugaccuaccaaggauucugagugcucaucuuuucauccuugaguuucauuccuuggagaaggggcgacuuccuggagaguccagcaaagguccacucucugcccuuucccccguguccugccaaacagggugccugcaagacucuuggaugguagacagcagagagcauggggauaggaaaggagcaacucugaugccauaguuaagccugaguccucucagagcucugugggugggacucugaagaggaugucauguacacacacacacacacacacacacacacaccaaaguuaagcuuagaaacacccccaagauggacuuuuuguguuuuuaagaugggguauuguuauauauagcccuggcuggccucucagucgguauaaagcccagcuuggccuagaacccauggcugucuuccugacucagucuccuaagaacuaugugcuaccacacccagcuucaagauggccuugucuuuaaacucaggaugaaguuccuuugcucuuuggggauucgaugcauuccaggaugagaguggccaaaauuuggccaaggagaaauucaaaauucauggguccaauguuuacuaauuuaugucaaaaaaaaaacaaaaaaaaaaaaaaacaaaaagcaaaaccuuuccugcuaggaaaaaaaugcagaugaaauuaauucgugggucugucuaauguggaaaagagaaauagaagacauuuuauacaaaccugagugaaggagcaggggguaccucccucaccgacucacccucggguaccaaagcagagcacacggcaggacaauuaggacugcuccaacgugagcauagacguaaauacuugacuuagaaucucggugauguauguuuauaggcauugugauggacauggcuuugugugacaaaugcgagggguuguuuuguucuuuacagaucaaugagcacaacucauagucuuagagaggaaaagguucaacuaucucaacaggaaaggcauuggguaccgcccaacaguaacugauacaguccccaggcccuggagacuaguaaaaaacaaagaacacacccugauuaccaucaccagcaaccucacacccgucaguuuuugugcuaucagacaccagcccuaaggaccacuuggccccucucugccaaacugaaugucuggugcaagguccccaacuggugccaugaggcaaaaccaagaaauaaaagagauguggaccaaaaaggaaaagugucaaugguuuuauuuagguugaccagacaucuccauagagaacccuaaagaaccuacagcgagcaaacaaagcaaguguguaguagcuuccccucuccuagucauaaguaaggugaacacaagaaacaaccgcuauccuauagccgaacaacaacccccaaaauacauugaggacagcaguguccuguaaggagcuuaaaaccacaaaggauaaagaagcagccuaaugggguggggcccuggagauugcauggcacucacaaccugcacugaagauucuucaccagguagagagagaaagcacagugcaguucagauggacaugaaacccaugcaucuuuaccccucccucccacaaugccagucaaaaugccaagagggcuggguauugguuuugauuugggauuguuguuaaaaacugacagccagauucucugauuuuuccugagauugugaagggcccagcagagcaucacacuuugaaaaugaaccaaauuggaggauuaacaaggccugacuucaaggcuuagaguagaagucacagcaaucaaggcugugcuggcacaacagcuuacaaaguccagaaauuggagccagugcauggccaacugauuuucaucaaaggcgccaaagucaucucaugaaaaaaaaaaaaaagucacagggacaugaggguaaccacaugcaaaagagacuuagucccgauucguaccugucuccaggcauaagauuaaacuuggaaggaauuacaaaucuaaacaagaaacaugaaacgauaaaguuucuacagaaaacaggagaaaggcuuuguaagcucacauuaggcaaauauuucuuagacaggacacaaaacacaugaaucuuacaggaaaagggggcauggaaaacacccugaugaaaugaguucaucaaaauuaaaaacugcuuucugaacgaucuugcuaagaagaaucaaagacgagaccaggggaggaaagaccugagcaacacagauccccgugaaagacagagucauggacaccaucuccucaauuagcacagaagagacauagaaucauuaaaacaaacaaaccaacagaaaagcuacgguccucugcaagagcauccagugcucuuaaccacugagccaucuguccagcacccaaagcagacaauucucagugcuagugagaacccacaguuaccaugcuggcaccuaggauggugauagcagucaggagcagccaucuugccaaagggcuuggcagcuucugagcaugcaguacucccacucagggacaggcagggaauaaccagcgagcaauagaggcaaguaacaacuccagagccugugugcagugcuuguggcagcuuuaaucauaauaaccaagcccuagagacggcucagauguccaucagccuguggacggguaaacaagcugcaguacacuuuauccuuuccaaaugagagaagaaucaaccagaacacagaccagaagcagacgggccucaagugagucugcaaagugaugagagccagaccccgggcuucaugcugcagaacugcguucucagggggacaggacaguucccaggugcaggugcagggaugggcugugguacagggcguacagagcgugugaaggaacucaacuuggccuaggaauuugccagaacucacugaaccggacaucucacaugagagagaguuuugcugcacauaacuuaaacccuacaaagcuaaaaccuaagacaagaaaacagaaaauaaauaagagaagccuaggagaugggugcaucacugguuacuuuuaaaauguugaaagaggagcuggcaagauggcucgguggguaaagacauuugucgcacaggccugggaccccgaguuggauccuugaauuccauuaaaagguagaaggagaaaaccaauucuacaaagucuuccucuaaucucuguggguacaacauggcacgcaugcccauauguaugcauagacaggcacacacaauaauaguaaguaaaauucuuuaaaaugccuagaguuuaagugcuuaaaaagagaaacaagcuaacauacuggagacuuuaaaaggaaccccaccaccaccaccacauuagguuggcuguagacacucaucugucacagcucgugagcacugucagugcuguccccagcauggccacuaaccuuccuccagcccccucccucagccucugcgaauccagcccagcugugacuccuucagccauuuuccuuggaggagacagccaaaugacauuuuauguugggcuaacuuuacuggucucugcacuugucacaaacucucaagugcagcugggccacagucaugucucugggccugguacccaagacaugggugccgcagacuaaagggggugaauaucacccuguaucuguauuuugguccccagcugaguaugcacuaugcacuaugcaagcuguacagcagccaaaagagcucaauaaggaucacaaagaguuccgacacucugguaucugcugcuuuggccucuccuaggcccuucuaguuaauccuccagugacacugaaauggagaccaggaggugauagcaagaguggagaacccacaaaaugcaaaaacuacaaccuguguugugguuccucccuuguugaagucaagcugggccaggaagucuguccuccuguaggacagggcugcuuggaggccaaaauccagagccaaccaggguacaggguaaagcuagcuucacugccagcugugucccagccugauaccucugaaccuugauagcuuacauaggguggccccuacucuaacauugcugaggguaucaggaaccaugacuccuccucacuucuaaggucugucccacccaggcaugcccacugccuucccuaauaucugugggcucaauaccucccagugacuauccuagggcucugcuugggaacaccagagucccugugacucugcagagcauacacugggugucaggccaccagcccacaugguuccacauucuacaugguaggaugcacagggucacauggguauauggcaccauaugcagcuacuuacauccaugccccauaagacaccccaaggccuaucaggccccaggcagcuggaaugcagcagugcacacagggccucuuuuuucuccccaaguacugagauggaggcccacccuccuggcagucacauuggcaugguuacuggaaguaucccaagaccuccggacuuagacugguaggcacuuugccuccauccugucucugugagccccaagggucauagaucaccucaaauuuucagguggaaaaccaggacuccaaagugcucccaaaggcaggcaagaguagaaaaaagauggcagacugaaaaacagauccagccaacaagagauccagguggccaaccaccagguguccaggcuacggacaccuaucguggagacaacaucucaacacgaaagcaaucugccucccugugaucugacaccacaggcucacgguacccaacaagaugccagggcucgauaauggucacuacaauguggaagaccaagggguucaaaaugaauauggcugcuggaaucagcccuuccuugggagaggagcucugacaccuagccuggagacagcccugcgauuaggacaccuaguucuuucuggguacccaguaccugucacggaacauccuccaaagugcugguguuugagccauaacagcucacaggaguugggguaugggcaaggaacagagccccuuuguucccuccaaauauguccucacuuuaccccaaguugagaguggcacuuccacaucaggugggccagcucucucucccucuccccucccuccccaucccugucucucuguauguguucacauguguguacaucccaaguucauuagccuauguccagagcccagagcucuuaugugugugcaagcaaucucuucuccucucucucucucucucucucucacacacacacacacacacacacacacacacacacacacacacacacacacagagucaaagagugauggaaugagacacucccccuucaaggggaucauuguauccaggcuccuccuucauauaccugcaaacucugauuaagaaaaaauuuccccaagguauuggcgaacucugaagaugucuuccagcgccuggccauuggcaaauguguccccuugggguaccccaacuacaucuacaagucuuaaaaagaaugagaauccaagcaguuccagagacauuuugguuacuuaggaauuuucuuuguuugaccugugauggucugaguaaguauaagaaugcagucgguuacaugacagauuuauguaugcaugugucccacuccaucucugauuuccuccacacagccaaauuugguucugauggcgaauguaaaccugucagaaucagugcaagccuucucuggaucccuugaguccagccugguccaggugugugccugcaugaugcauguaggcagugaccuucgggacagugauguucauaaaauaaacaaacaaucaaaaaaaaaaaaaaaaccugugccaugccacuuaaauucuacuuacaacuuucucauggagaguaguugggugcagauggcaucaggauaaagcucacuaaauacaagaaaauuauccuaugacaaccacacacaagguagggcaugugcaugaacacacacuaaagaaauaaaucuaaauuuuuaguaaauaaagaaauuaaagaucaagauguguucauguauuaccaagaugcuaauuucccccaagcugaccuccagauuuguauccccaauaaaacucacucugcucuuucauaaaaaugagcaagcuauuccuaaaaguuauaugaacaggcaaaagacccagaaauagccaaaacacuuaaagaauaaaacugaacgucacgaaugacuguuuuugcagcccugucucaaugcuaguaagcacagaguuuggcauuucaggaugacaggucagugacucagaacagucuggcagauucauucuuguggcacacuggacuuuaaaagggauggcaggagacucaggaaguaaagaauauucguuccagaaaaugcuacucaaccaauucagcuucuacauaaagacacauagacugccagccacauuuaguacaaggacauggaaaggacucuggaguucuagugccuaugcaagcaugaggggcuaaguucaaguucagguccccagcucccaggcauggcuacaugugaacucugaccccaggacuaacagacugguggauccaguggcccucuagguggacuguuuagcuccacgugcaaugagagacagaacauagagaacaaugggggaggguucuaacaucugucuaccucuggcuccacaaacaccagaaugggugaguaccccaucacguguacacacacacacacacacacacacacacacacacacacacacacaagcacacacucacaugcacacacacacucacgucacaucacaaaucuaaaacuauagaacgacaauaagaaaauauuuaugucacacuuuauauauauaugauuacuaaguaugaauuaaaagguaauuaaaacaacagaagauauaaauuugaccucacaaaauugaaaauuucuuuuugggggugauaggaaugaaaucugaggccuugugcacaguaggcaagugcucuagaacugggucacacuccaagacccaaacauuguuuuuuuguuuguuguuuguuuuuaaaccacacuguuaaauaaaugagaaggcaagccacaguauggaagaagguggaaauuucuaaggucaggccuggcuucagcuccaggcucugggaacaaccgcuacguccagggaacugucuguugucaauaugaagcaaugagcagggaucaagccucauccgugagcaggaagagacacagccaugguaaagaacgcaauguaguucaguugauagugugucugccuagcuuguaggaggcccuggguuuaaucuccaacagcacauaaacuggauguggcaaaguagggcuguaaucccagcacugaugagcugagggcagggggaucaacucaagaucauuuucagccucagagggagcuagggaauagaaccacguuaagaaaugaaagagaggggaagagaugaagugaggaaggaaggaaggaaggaaggaaggaaggaaggauggaaggauggauggaaggaaggaaggaaggaaggaaggaaggaaggaaggaaggaaggauggauggaaggaaggauggauggauggauggauggauggauggauggauggauggaaggauggauggauggaaggaaggauggauggauggauggaaggauggauggauggaaggauggauggauggauggauggauggauggauggauggauggaaggauggauggcuaccuuuaaugugaaagaaccccccaggccuccagagagcuccacagcacucagacacugaccagcucccacucugcagaauuaggcuccuaauccacgugugacaguucucauccaggcuccucgugcugauaguuccugaauucaaugugcaaauggaacgggccccaagggcaggggugucccacucccggcaggcucggauccaagcacagcauucaaacugcauaagugcgugacuccaaaguaugugcagauaagagaagugcacacaggucaugcacaugugugccuucucacacaucugugcauguauguguggauguguaugccccacccccuaccccccugaacgugcauaucacaacucagcgucccagcugugcucggcugccuuuucuuccaaccugcuauuuaacacuccugagcaaguguggaagccauuguuacuacucacaguucccagccucuuuugcagaccacaagugcuggguccaccugcacucagcccccagagccacaucucccgagaagagucuguguuauaaauacccacgagaacacaaagcuuugacaccagaggccagggcuugcuuucucaagcaucgcccacauaggggaggagagcacggccccugguugccacgacccugaagguacuugaggacauacuccauuucucaagcccagcaguccagacacacugagauggccucugggucagagcaccucccacagcuauugaagaggcugccauagcccagccccagccccagccccagcccuuggcccccaacccccaguccaaaaacaccacuugcuccacccagagaccccagucgccaugcagccuugucaccaggagacagacagucuacaggaagcugcugcuggagccuucccucaccggucagcucaaaaaagcaaggggccaaggggccugggugcucaagugugccucucgacccugagaggcugcccccagcccccucccucccucccaccugcgaagucacacaaugacaugcuucaauagcacacagcccgggccucugguuuucguucugagugacccugggaggccaagaacgugaugggagacccgucugagugugaugcccugggggacacucaggcccccagcccucgccacuuaggcagcccgcuccuccaggcagacagcuggcggacuccaccgagcugugccccucagccaugaggcccugcggcucauccucuuacccccaacgcagcccccaagcagcccccaggugccccacugcagagggggugccagggcagccuacucagcccaccccacuauauuaugucagcuguuagccugcacuuaaagcgaagugcuccagcuggccagggucagauguaaaaacaagggccuaacaaaacccggccacccccccccccagcuacucugaacuggagacccccaccgcaugcagcacucacugaggagacucuguccagccuugggcagagcauaaaggaaacaccugucccuggccggcacacucuaaucccacuaaacccgaguggagaaccacccccagcaggcagcucccaccccaggucugacuuuugugcugggccuaaaggaaggaugguggagaaggaaacccucugaucucaggaauggaagccuccuugggccccagccagauccaggucacugaaagcacagugccugaugacaguaccccccuuacccucaccccaacacacaccccuaguuccuggagucugaauaggaaccagccugccuugggguccuuggcuccugaacgguuguccuccuuuagaaggacaggaggcuccugccacagaaagaccuuuccuaccgacacgggagccccauguaacccugccauaagccaggacccucaaauaaccccugggagccccacacuuggccacccaggcugauuuaucacuacuuaccaaccuggagcugagucagcacaauuguuagaaaagggcagggggaguagggggugaagagaggggaguauaagaccacccagauaccuggaggcccugggagggggccaggaaacuauguacacacuacacaugagucacgcgcgcgcgcgugugugugugugugugugugugugugugugugugcucgcgcacagagagagagagagagagagagagagagagagagagagagagcauuauccugaugcugucucagucuccccuugcagaucuccuaacugaaugguacagggaaugguaagcucccaggaagguagaucuuggggcuaaaacagaacuguagauuuggggugggguggaggcggcggggggggggggugagagggucgcucccauugauucuguccccaugacaagauguaguacaggaguggaaacugaccacacgcccacaagggaacagugagagcuagugccaaggggucuucuugaggccaugagacccugcugccaagcacaugcuucucuuccccuuugggcucagagucaccaggaaaggguguggagaagagccuggagggagagaaacaggaagcaggcccugcaaacccagguaggccauggcuuugcaccuacagagccaaccacaggcaggcccugccugcauucgcgccacccugccuggaagccuccaacuaauccccacaugccagguagcgaggaauggguggcauccuucuagaagguucccaccaugucuuacuguccucuccuucugccccaggcuccucaggauuuuauccgguucugaacaaaugugcuacgugacgauucuugccacugcacacggcucgcucugguuucacagaggaugcagacaccagagcuauguccugcaagacccuccacgcuaaggccuaggaggcucaggaaaucugguggcagcugaggaugcuggcuuuccugcucuuacagugugcaggccuuguaaaaggaagccgcugccuccagggcagggugauggccaguuuaaaccccauaaaccugaggaccuaggauccauggcuccuaaacuguguccacugugauagagaaggccugaccugccauuuccacccucccagauaugucccaugcauccuacuuucaaaaauaaaagcaauaaaaggaaaggaagagaaaagcuguauuucaguuuacaauuccaaguuacaguccauuguugcggggaaguccaagugggaacuucagucagagucgagagcagagugcaaagaaugcauacuugcuugcuugcuugcuugugcucagcuucaguucuccccuaccagucagaccaagagguccuaccauccacagugggcuucccacaucaauuaacuuaguuaagacaauuaccccacaaacacacccacagaucagcccaaugcagaccaucccccacugggagucuuuccaagcaauccuagguuuguugaguugaccauuaaagccaacuauuacaguaacgagggagagcgccuucuucuaggagcauacacugacuuucuaaagauaagggacagggacauagucccagcaucuuuggaaagccccacaagauguauuuaaagagagagaaaagugacacagauggaguagagaaaaccaccuaguggccccaggcagagucaucugaaguggcaugaacuaagaacaagugucgugugugucaacauggaaauacagaagaaagacacugugaaaccaaaguauccacaagccauccugagccgcaaagaccagugugggacagugcagcacacccaugugguccagacacauuugcaacuuaagugccauuuuaguguccauggaucauuagaaaccaagagggucaggaguucaaggccauucaaaguugccagaugugguggcacaugccuccaaucucagcacuagggaggcaggggcagguagagcucuuugaguuuggagccacucugaacuacacaagguguugucucagaacgacaacaacaacaauaaaauaaagcauaccagcaaccaccauucugcacauucuccuucugaacagaaugaggauuggacaacuuucucgaaggccauaaaacacgugcuguagguuuuaagggccacacagucucuauccugguuuggaaaacaaccaaccaaaccacagaggaguccacaagccugcuggcuaugugcuaccaugcccuucuuagccccuagcaggcaggguuucagcacuccagccaaccccuacauucucuagcagcugaaauggagaagauauugggauccgcccaccguuccugccccagcucaugggcaccauaacagcaugugaaagaugcugggcagguaggaggcaaaaggcuuugcugcgccccaacauagcaggcauuucuagcaauccagcaggacauauaagcucugugcccaaccagugggacuuuuuuugcacagcuuggagaucuugagguccuuagaagcagcccagccccauccauucacccaugucacccacccauccccagacuaggugugacauccucccaccuagacuaagccacagagcagcugucuuccuggagagaggcaccaacaguucgggagaguacccccaagucccccaagccucuggaugcccugggggcuacaagcagagcugagcccaugucuguuccauuauccccaacagcccuccagggacuacacgcagauggcauguggcuuccaugucuacaggaccccaaggugugaguucuggguaggaacuugaagcccuugucccauuagcacacagccugaaacacaguuggagcuucacagcuacucucuuccucaaugaauguaggagaaaacaacucaaucaaaaaaggugggcaucucguggggaauaucuuuuaaaguggcaaaaugacagcuggggcaauaggaaccuugugugcugaggacguagaaaguucugguccagcugggcagugauggagcacaccuuuaaucccagcacuugggaggcagaggcaggcgaauuucugaguuugaggccagccuggucuacaaagugaguuccaggacagccggggcuauacagagaaacccugucucgaaaaacaaaaaacaaaaaacaaaaaacaaaaaaaaaaaaaaaaaagaaagaaagaaaguaaguucuaguccugagagggacacaauguuuccucagaggacccaggagcccaggagagagcuggcaacacuacuggguacacgguuagcuggacagcaucucuaaagagcccugagaacuagaucucuccaagcagggggcuggggccccacaggaagucagaucuugggcuuggugguggaaaacucaagcucccugcuggucuccugaccuugugcugcugcagcagugacucaaccugcagaagucuucuucccucggcugcaaacuagucuucagggacagggauagaguaagcauacugacucucacgagugcagcuaacaggugugauauuaaugcccccauaagagaucucagacagaacaacagaccaggcagugggacacauggccaaauacagugcaagcagcaacgguacacuagguacaacccaaggcgugucucagccaaaaaaacagaacacccgcugugacuccaagcaacagaagauggagagcuaagagcaagcucuacaacagauagaccgugaaaacaaacuaaaccaaagcaaaaccuagacacagcaccaagacaugaagcuaggcgcugaauuuaacgccaauaaagucuccacuggcaggaaagggugugaaaacgaaugcaagaacaugugaggcccugcugagugugaacgagggucugggaccuggggagcugacccuguuccacuugaaaguaggacccagcaagggcuguuuuaagggcucagagagcccaccggaucucauuuugccccugggaaacugaggccugccaagagaguuacagaaagcaagggcgggccaggaaggguccagcugcagggaggugggucgccccugcggggccagggagccucacaguaagggaggaaacuggagagaugaccucaucccccaggccuccggccgcgcggcucacggguuuuaaccgcaggcauggcgggacaguucccugguaugcgggcuguggggcucacggagcuggagugugugcuaggacuuuuucaaugcagcugucuuugugugggauuugaaaacaagcugggguuugagagacaaaaaacagcccugcaccugggccuggccagggucuccuauugcaaggagggguggguggguuuggcggcgugcaugcacauucagcagacuugcacguacacggcgugcacacacaugugcgccacgucuacagauguacauacagcuugcucuagauucagaggccggauugggggcugggcggcgggaggggggguguccuccuuggggccacaaacaaguuucaaggccaagcacaccuauaacaccccugaucaaaguucuagccagacccuggccuggcagggcccaguuuucuccaagaacagcuuuucagacccacagaauaugccuggcucagcagaaugcuuaaucccucggaggccgccuggcuuccuuggcccuggcugagauaacagggcucuggcaccacgaaagccaggcgcugaggcaggaguaccggcgcugggguuggggaacacagccucgcgugacuucuucuccaccauuuacccaaugugcucccagaaucccucacagagcucccuugcccugggcccccguggggcaccgcgggcugugguuugggcucccgcgcucggcacucugggcucggcccaagggcugcuggaauguguguuacaagagcgccaccuggugucuccacagcucgucagaggcugcccuguccuuagcucaaaggcugaaauaaacaucuuuguuuuucacccaacucccguccacagcauguagcagcugcauucuacacuaugucccccagccugaggcuccaacagccauucucacccuagaggccuggaauccacaaccaugauaucugcgugggccuaggacacaugcaccuuucggaggccaugagccaucugcaacagcacacaacuccuccuuaccuaacccuuugaccaaucaucaugucuucuaggaaaauaucaccacccuauauacaagguccuuugagccauacacuucuucacugguccauauguccaggcuggacacacgccagccucacaucugcuuccccaacaccauggucaugacucugaaguaagccacuagacacagccagcucaaauccuggaagguauggccucuaaaggcuagcaugugaggauacagcuuacgaacauggcaaaguuggggacagacaauggcucagcaguuaagaucccuugcuacgcuggcagagguucuaaguuugguuggguacgcauguugggcuguucacaaucgucuguuacuccaucucuaggggaucugccacauuaucuucuggauucugugggcauuucgagcacacacacacacaggaggcggcagggagagagaggcuuuaaaauaauguggcaaagccaaauggggagguuaagacuaaagccaacuauacuuucaucccuauacuuuacaguuggagacacugagguucagggguaucauuguauccuuagggggcaugccugggaacaagacuuaaaaagaaggggguucuguauccuacuccauauauacacucugagcagccgggguguugagccucccucugcauaguagaaaagugugaaagagaugugagccuacucaaagaagcccaucaucacauccagguugcccagaaaagagcagaggggaguuccagaagggagugugcagcguugaccggaggucaguccuaauaguaggaaagcaacccugcuggauauauauaguguuugugcaaagguccugaggcaguugggagggagagauggggagggaagggagguuuggagauggggggggguguaugcuuaaaugugugacacucugaagaccaugagggagaaauuggaaauuaucccaaaccacccagggagcgucugggacacucagguuuuuguccuauaaaaucucuucuuagcuguuguggggcagggaggguccagggaacgagaaggggacaaaagagguaaugaggucacugcccucacagugguggacaaagagccacuucugggaagcagaacagacuggggaggggcugccuugggaguggggacccgcucacacugagggaauggaggaggggugggucccacccacgccugccuuugcuuuaggguuguuggaucuguguucacaauuccaaaaguagccacaagauggcaagcaggccccagaaagagccuggccugagggaggcagcagaagccaccaggaaagggagccuaagccaaaaauuacugggguaaccaccccaagucuggagcuaccagaugagaaauggaguaggugcauucacaggcccacacacaugugaacauguguugacacaugaacauacaguaccaucuacacguaggcaugaacauagcuacacaugaagauacacaauacaaugcauucauucacaagugcacaagaauacacaaaaccaagcacaaggccuaauauggauauuacacauguaaauguccacuuacacucucacacaugcucagacaaaacacacacuuaccugaagacacagcuauauauaggaauguguccauuugaauacaugggucugugcauaugugaauacauucacguaagugcauauauagacuuguacuugggaggccucccaggggaauguucugacacacaggcccuucucagcauaggagccauuuuggcccaggcucuccagaccaagucccaaacuaagaacuacagaaaccuaguucucuggaaaagaaccugggccauuccccucagcaguaaccaggagcuauguccucucauaacauauccagagacuugaccucauccguguagcagccaccucuguacugggcaagggaacaauucugacaggaaccuguggggauagcaucacacauaaaacuaaggaacccagggcccucuuccccaccuugguucuauaagggaauacaagggccaugugaaauuccccaaccauaucuaagagcuccaucagacaggucuugaaagauuauacucugggacuaaggggugucauccaggaaacugaggcuaaucagcuaacacaucacagagagaugccagcuaagauuugguggcaucuuuccagccacauggaaccaacuagggaauaggcagacuggcuggauguugcuucuggaaaaacuugaggcccugaccccgacuugaagcccaggaaccauagguacaggaauuggcaccucuguuaaguguggggacaucauaggcuaaggcccacauugaaaagucccagaaaacuucagaagagaagucgcccucuagugaccacaacuuccaaucacagcuuguuacugucuguuagcagcugccuaaaccacaugugccuaaaccacagugacaucccaaccccagagguaggcacacugcuggcuggcaccacagccaucauaguuaauacuugguaccaggugugcccuggauugaaugcauugacuuuugggaugggaguaaggaacaagaaauuugccaggugccccugaauuuugcuacagagcucacuguaggguaugaacccuccaguggccuguagagaacuagguacuaccaggcaagccucauguuugauuuggucuacagugaaaacacguguccuauggaguuuugggaaagggggccguugggaugagcagcagggauggaacagagcagugccugccucaugcuucccuggagacuccuaaaagccauugacaguaucacacgugaauacucaaacuugaggaagaaggcacccaccacacucaggccaggaccagagagcucuauaauccaggaaaaggaucuuuccuguggcucagucucuagaagccauaaaggaaagauaaaguggacacaagauaaaaggguguggcugagcagccaccacugugcuucaagacuuagcaggacaagcugcccagcugacagaggcuguauauagauaacacugagaaacaccuaagacccccugugcagaaggugaagggcagcuaaauguggcccuuguucccuguaaggguagggaacaucccaucacagaaagcaaacacaagugcacccaagcagaaagacacuaggcugcaccauucugggcuuuaccaccuguugcuaucuuguccccauagucccagccaugcuggccuccacccaucuucccagaagcaucauagauccaucagcauugcuucuaaaggccacaucuggcccagcagagaauggugauacauggggugucuacccucauggcucuugauugcccucacagaacagggucugccucaguugcuucaguggauccuagcccuguuucagggacucauaucuaccagaucaacaguaccucagccccucaaagcauuugaguucacacacaacagggcacccugaagacacaguuggcucuucacagaguucagggucacaugagacaguccucaugcccuucacagaguguggaauccuaaaagacaucuaagccucucacaguacaugggucccacaagacaguccccaagcuccucggaguguagcuggaaccugguauuuggaaauuccauuccucaaauugcucuauacugggacagggcacacacucaugucuggccugcagagagcuauguacaaagguaguugugguacccacuaggacugccacgauggccuugccagaaaugauacaugaaaguccccugagcugaaaggcccaccccagugacugaguuagaauugggcuaggacaccagcagggcccaugagucagucagcaauggcacacacaagaaccaccccaccccucagugccacuguacccauguccuccuguccucucucugggccuaggucagaaauuccccauacaaagggacccuuucuauucuuccugcaucuucaacacacggcccaggggccugauaggcauggaugcaggggaauugcccugucugauagcccaguagcagggugguagagaccaggagugggugguucuacccuucccagcccuccuccaccucuuccaguugcagugaugacauuuacugauggccccgggugccuacauaccauccagaagagggucccgguggccagagcggcauacugcucaauaguggacaggacacugaagaugaggcagaccagaacaaugaggaagcugugagacaggggacauacggucaaugccugauccagcuucccugccaccucccucucacccaacaccccacaugcaagaucuuuagugcuggcauuuccagguauuccuuagcuaaugcacucaaacaugggauccaugggaugggaaccauuuaccauguuaggacugaccccagauuggugucucaauacacacugaccuugaacaugccacacugugccaucucaaaagcagccaauacucagggacgguacacagccugguggccauggccuuagggacaaugggucaguauauccaauuauucaguauaacccccaguauauccaagaaccuugguguacaauugaaguucagaaguacuauuuuuacaaaacaggagccuucauccccaggagugcagggggauagagucccuuagccaagggggagacacaagaaaggaaggccaagcacagccugaaccugugcccugaggacacccagaagucauagcuuuuacacugagggcacaguugcugccugcucugauuccaagggcacugggaagauaagucucccuuccacuaagcucuccaucccugggugucaucauccaagguggcccucaaaguugcuuccacuuuggggagggugcagauuauuagagagggggaugcuuuggggagcuucagagacucuacguacccuccuggcauguucuuggggaucagaauagaaguggggagcugaugcauugucccagggcuacaagaggggcagacagagaagguauacacaaagucaucagggccccagcacagaccccuguccucaacaaaggaacccacacacuccaucaauccuauaucagguuuucccaguauguaaggcccagaccaccagccucaggcucagccucccagagggcacacagcagcaguagccugacucagccaccauuuccugggagaggcacaacucagaucucccacaccucuuaagauugauuucauccauuccuggccucugcagccaccguuagaggcucagaagaccaacaggcaaagccccccccauugcccccucuuaccugcugugccaggucaaagccugaagucauagcuuacuaugccucccccaagacagacacucuuugucaugcccauuugcucugcgaugcacagcacguuccagccuccuccucuuguuccuccucaccccggcccaggugccaacucuaccaccuccagaucccccacaucaugcccagugugguacuccagugguacccugucccccucuuacugguauugaggaccugauguuacugcccugucuaaaggcagagacucagguuccuacaguguggucccauaucaucugcagaaguugcuccaguacccacccugcccccaugacaccuuaaacacaacacuuauggccaaacagcucugccaaguccuagugccuacagccacgaccaggcagugagcauccucagaacaggugacuaauauagagcuugguauacagaggucuugguaccccaccacauacauaccuccauuuaaucccaaacucuuaccccacucaccacaccuauaguaaccucacaucacaguaggcaacgucuccauuuggcacugaucccuggccaacacccacaccaggauucucacauagagcacacaucugauuuggccccagcagagccuccaggugggcuucaguccuugccacuccccaucucuaccaccaugaauuccucauaggccuagagcucugacagcagccagccucuaacccuggcacccaaugcacuacacaguauuguuuccucauguccacucuccacauggacuuaaggacucccccagaacagcacgacaggacaugcagguccuccuuggucccccaguaguguuccuccugaccagugguaaccauacugacuguuggcccacaucuaucuccuggcgcugaucauauggaagccccuuguaagcugaacaagccacaucagauccucaggaagccauggcucuuauguggacacagcaaacacuagguuagguuggagccccucugcuguccauccacagauuagauguccauccaugccugcuagagaagucuaacuuuagccauguauccucaacuucuuucagagaccguuguggccuuuugagacucaguuccucgcugacuaggcucugcucucuccucagacugacucuucacagaguggggccucacuaauccaggguguguguuguuuugauuuccagcaggcagggaaguaggguugggcucaucucuaggcaaucgagaguagaugccccaccccagaccauggguuacacauggagccagagagcgacuagcaugaagaaacgcagccuuuucuggcugccccuccacagugacauagucaggcagccccuacuucagauucccaauuggaacauuagcagcuuaggucuacccccucuuggaacuguggguuguggcacagugcacagcccucagugucucagcaccuagaagugagggagugacuuaccccaaggucuuugagaagcccccaagcuccuggcaucagcacacaugcaaagauauggugaaaacuuccugcugcuucccugggugcccuaaagcuuacacacacacacacacacacacacacaccccagggcacaauguagccagguccggucaccuggccacaguuugacagaauagcacuagucccucaagaaucugacaggucacagugucaccgugcuaaaacccagcuccuauuucagagggggacauugagguuccuggagcucuugaggucacucagguggaaucacaguggugccaaugauagcucuuaauggacuuucaauucuuuacugcuagggugacaacuuggucuuucaagcccuccagagccucggcuccaauauggaauauaauagcaccagcaccugaggaccagagagcuuauguguagcaagguaacagagaucuucaaauaggccacagggagaggaauggcugucauaggccacccugcccaugucugcagggggaucagggccccagcagggcagcagcugcagccuucggguggaaaauuccaacugcuuggaaggaagguaucaaaacaaggaggcuguguagaagcccccgccucuccaguaacucccacacggcaguagggaaggccauggaugcacagaccaauccugggguagagguacagagcagauaaguccccagugcagacaggaaaccaccuaguucuccacaaggcuggcaggggcuaggcaacacaaccaccaaagacagcccaugcuaaccugcccaggaaccuugaaguuggggacaaugguggcaaucugcccccaugugcuggcugccuuuuagccucgaguauuccgaaagcuaaacaguucuucaaauauuugaacucauugggcuguccgagaaaggguuauauagcauaguuuauuuuuuaucuacuccugauaaaaugaguuuuaucuuauuugcuacuuuaucuguuccugcccuggauagggcugagagccucagagaggccgaaccaagggucccugccuuuggggagcucgugggccagaugcccaggucacccacuccugccucuuuaggacaguugccaucccuccaccguaccuccauaacccagagccgcaaggucaggcuaucauaaggugcucuccauaucccccacccccagcagcagcagaggaaacugaggcccggggaaaugccagugucccugguuacagacuacauguuccuaagaggguucacugugcaggguaugaaacagaagguucucgggaacaauacccugcuuguuccgcucucaccaaaucaaacucaucggccgugaccgcagcccagcccugagggacguccaaaugccuuaucggacaucacuucaauaucucugugcccaggugcccugggaacccagaagaagauggcauccagccaaccccguauggcugcccagcagaagguaugggagcacaaggaacagugucgggaguacggacaggccagcuauggcaaacuuggagaucucuuccauacauguuaggcccuugaccaguaacugaucuuuaaaaagccagagcugguucuagacccaugggcaaccagaccugcucaggcacaggccugauggugauacugucccaucccacagccauugaggagggcaguacucuaugcaugcaaauagcaaagggucuccccagauaaaggggucagccuagccaccaucaaauuuccagcacucaaaacauggcagugaaacaucucaagaggucucaaaccauuguaucugcauauacaaucauagugugaaguucccuaaaacuguuguuaggcuggggcuggagguacugugcacaaaaggguagaacuugaggauacuugggaagauaagccagggaugagaugacacauauuucaggaucagagaccccugggguuaccaggucugcagagacagaaggcaggauggggugccagggauugggaacaguuucagucuaaaaugacagaaaguucuggagguggaggugagaauggcuagcuacacauucugugggugagcuucacacuacuggcauaagcacacagacacagccaggccuugugucucaccacaacuaaaauagauuuaagaaagaaaaccaggggcugggggcaugacuccauggccaaaagugcuugcuucucucccagauggucaaagguucaguucccaaugccucuguuggguggccuccagcuccagaggcucugaugcccuuguuuggcaucaaccaguuugguucacucauacaugcaugcacauguguacaaacaaauuaaaaaagaaagaaaaccaagcaaauggauuugauaauagaauugaguuggcuaaguacacuggccaugggcuauaauugaagcuaucaacauccaaaggccccuugggggcagcucuccacaggccaagaaacagucaacuaaaaaaaucuaagguaccaugagccuuuguaugcacgacacccauggacuaaauccuuaugugugagcccugagccauguguuugcuauuguauguguaacgcugacuuugcuauuguuccacagagagugacuuggaaagauuccacacuaacccucacauacgcuaccuggaaagggaagccuagagggggacccuacuaacucacugccaucacccacccucauggccaccuggacucccagcugccuggcuucagguuagauauagacaugucccaggauacuggacuuuuagaggggacaauaggcuuagggauaucccaggaaggaugguaccaauagcaacugucagaugaauagaguuggcaggguuagaagacuucaagguagccacuugcucacaacacaaccucuccaaugugcugcacaagguagagccuaggccaggguuaccuccuaaagggacacaccucagugcaugcugaaaacccaaggugugccagagacugaucaguuucccuuaacuaagccuuggguggaagaaguccaggggagacacaggggagugaugguuggucucagguucaauccacuuaugcauauuuagaaguuccuggauuagggacaacaagauauagccacuuguggggcgaauaagguccaacauuguauagagcacacacagggccacguaaacagugagcucaggcuggcuauacagaccacaaugcucagaauaggagagccaccucauucuacaugcuauucuaggcuaccucaccuccucuaucugaauggccaccuccuguucacucagaucucauugggcaccuucugaagggacaguugaccuuggguugggguauaccagauagcccagguuuucacauccuuaguggcaagagcuuugucuacaugaggccacaccacaggcuucaagaauaucuuugaggccuuugaguucaucauguaaccuacgucaaaccacccaucaacagugauucucagaggaucacgaauucuuaaacaucaagaucaguugguccaaagcacauacugcugucacaagcuuacgggugcucaaccuuuugacuccauggcagcauauugucaucuauaaaguccacacagaacugugggacuaacaagcaaaaagaaaucuuaaaaucuuaaguaaguuuaugauuugugggagggccacauucauagcuguguugggccacacaaagccugcaaguugugggugggaggugcuacauaaguuaggggagacccaaaccaguuuugccucccacacaccuuaggccuauacaaggucagcccuugccugccucccugaggggccuggccucaggcuggugccuuugccuauggcuagagcuucuaggccugagauucuccugggccagccacugccuacucccugagacuacacuggcucuaaacccuuuuaggccuggcucuggccauaguucauuucauuaaaauguucugguaggaaacaccagcaguggugacuuuaucaccgaggaagugagcguacuaauccauugucuugggagcccuuaaaugugcugaucuggaaaugcaaaccuaucaggagauuagccucagcccugcacugagaggccugccucaccucauagcaccagcugacacuguucccaugaucuggccuagaaaccccagaaaagcaggacauucaccuggcucugcagagccccccaaccucugugccuaugcaccccccccaaggcuacagggcagaaacccagugcaucuugugcccuuauucuagggcagcauccucagucaucacagaguccuaagaaaugaguggcccuaccuucccagguaucuaugucugguguccuccagcccacugauugcuugaaaaccucuguucuagcagagaagcucuuggcccaguagggggacccauuggcuggcacacaucugaaagccaagcaguaggccaaaaacacugugugugugugugugugugugugugugugugugugugugugugugugugugugugucuaguauuugcugaccgagugagcaauuguuaagcugagaggaagucucugguccucuucuacggaacccauuugugcaccugcucugaaucucuagcucaggcaagcucuucacagccucugaacugggucagugcaggauacaggacaaaacccagaccugaugcuggccaagucauuagcacuggucaugagcagaugaauguccuugguggcugucuccagauuaacagguuuaaggguggcaguacauccuaugucauacacaugaccaagccagguccuucuaaaggcugcagagguugaggccaccaggucacugagucaauggaacuccauagccacucuccauucagcuagacugcuaguaacaauuagaacacaugauuuccauuuuggaguaccuuccaagaacucaguguccuugucccuuaacacucagagcagcaccuagcauuagacaucccauccuaguagcaccaccaugugugacccagagaagcuugaccccucccaagccacuugucaggcaaggcaacauccccaagccugggucucaccuuaaucacacauguccacagcuuggcucguaauuuaucccagcucucagaauccaaacuuuacuucagcagaguccccaagaauaggcaauggugucacuguuacccccucucagggagcgucuuagucuuccucuccuagguuagcauucagauaggugaagaccauccuuggcaagggguucaagccaucugcacuaucauuugaaaccuuuuuuggaggcuggggagagcagcaagguacuugguccauagcaugaugacccgagucugacccucaaaaccuuuguuugaaaaaacaaggcauggugaugugugcuuauaauuccagcucuggagagacagagaggcaagcagauuccugggacucgguagccagcugguuuagccuaauuagcaagccuugggccaacaaaaagaccccaucucaaaaaccaagacugacaacccuugaagagggauucuuuugguuuaccucuggugcaccacacacacacacacacacacacacacacacacacacacacacacacacacaccuucacaccuuuuuggaacacuagagggauaggacagauuuggggggaagauaugcucagauaaugugcucagagcagggaggcaggaacauuagccagagucagagggaagagcugggagcacagcugcgcuucguggcuagugguuguaucugcagcucggagagccugugguggucaguguguugaccucuaucccagagcaacucagguugagaguuugugucugaagaucugcagccuaauaggaucugccuguagggccagacauacaugacucccacaaggaacagaaacugcagcaccugcccuggagcagcuggcaccugcccuggaacugcuaguuuucagacauguaagagccccuggggcuaccccagcuggauggcaccacauagggccagacucaagaauucaguuagcuagcgcucucuuauuccugcuucucucccuugccucuugcccucuugcucccccuccaucccccaccccacuucacguggucauggccagccucuacuucucuacucucucccucucucucugccuuucucugccucugcuacucucuuaacuccccuccccaugcccuaaauaaacucuauucuauacuaaaaaaaagaaaaaaagaauucaguuagcaaacagaucugaguccucuuacgaggucacaauggcaccccccccacccccagaauaugaaccagaagccucagguaugggaaaaaggaaaugaaccagcuaggaaccaaugucuuccugucaauuuaggagguacguagagauggccugucuuuuauuuacaggauugaaaagagaagcucagagaggguuuaugcccuucccaaagucccacagcaaucaguaguuagugagaucagggcacacaggauagaucuccucccaaauaucucaaaaccucuaggaaagccauaccccagaaggggagccaggcaucucccaaacaccuggcccuucaaggaaaggcucuggaagaaagguaguuaguaggccugguggaaggcccgugaucucucccacaccccagggcucagagcugucacugcuggguggcugaguacuccaaagacaaccaacagccuaugaguaaggaagcaugccauucuucuagggaccugaggaggccagggccagucaguacucuagaguguugugucccuuggccgucggccacacccagccuugcucccccaggcuccaugauaagaugccauagugacuauauuuagaaugugugguggggacaggcuuguaugacacaugcuugggaccugucagugaaggcauucaugguucuccagcgugaugugggggccacaugcuccccauacauauuccccacuugggacauggccucuguaucuuggagaugucucuacccaggacaguguuggcccagcagccucaucuggcucagaaaguggguauugacuacuuaggcaacucacugggcugauacaucccugcagccagccauauaccuguauaugucuacguucucacaguucaguccuauugggaaauucccucguuacaucaagcucaagucucucuugcugucuucugggccccauuccagagguuuuaaggaaucucuguccaccaagccauugcacaaccucugagccuccguuucccccacggaggaacuggaacacaucagacuguucagcagcugucuguguucaguaaaggcgggacaguuccacggugcccaaucccaaccauaucauugauauucuaauaaugguaucaacacccugggaucugacacaacagagguuucaagggcacauggccagcaucccuggcagaaaccugcucagguuccacugucuucuuugguacaaaccuucaauaaggugacuccaacaguguggccauaacaaaggggagcuggcuuuuggcuaugagggugacccaaguucagagaauugacaagguagccagggguaaccuaccacccgcuccaggaauaggcacccacaguugucucuguaggguuugggcacugccaugcucugaucagcuguauggugacugagauaaugugggguaaccccuaauauccccuccacauggguggaucauagggcuggaacaggcaaugcuuccaguuaggcagguucaguccccaucucucacacucucuuguaaggcauggugguggcagaaggcuucuaagauguggagacugaugaagaggacauggggucuuuuaggacagggugggugaguggaucuccugaccugugcccugaccuccuuccagcugaauggaauuccuaagugacauucagccaugcugacagcagagggcaccagugagagcaaauaaugacaccaaacagugacagccugcaaauagagacagccacaaagacccaaaucacccagggagcaauugagcuacagauuaucgggguccccaaagcuacuuuguauagauguccccuuaggguagggguacaacacaguaguaguaguggccccacagaagcccuugagcagcagacaguauacuuagugugacuaugcagagcccagggucuagucuuugcccuaccuagagaaacugaacucugagaaggauaggaucuacccuacauguugucaugacaacaaagacauggucucugauucuugacucaaaaccucagccugggucacuaggguagagcuguacuguuggagauggauaggcuggcuuccugacaagaaggagccucagguucagggagaagagcugccaguccagaguaugaaaugaccacagucacaucucagcagcuucugcccuuccugguaagggccucugugaggaucaaguacaugugcugggcacagguggcuuacuuccccuggcaucauucauugagagaccuacaugucaccuguccacuugacagacccugaccuugauguugugugagugaucuuggugcccuggucagaagugaccuggagucacauacuggaacaaagaaggaauauccugggucccugcagccaugguucauggcucaggagaucugauggcccaaaacccacucaacucugugguucucuucuugaggaccccucccucucacuaagagccagucaggcuggagaccccagagcagccacaggucucuuccugaaucaggaaccucagccuccugagauccugccucagugccaggcacccuccggaguucuacugcuguugcccaagugacuuggaccaagaaaagccucugaugacaaaacaagauggucacauucacuucagugcagccucagcaacacacagccucaggcagugcccaucaaugggacuguucuucugggucacaggcaagucucgaucucuugacagaugucugcaccaccgaccauaagacagaggaccucaggaucaugugggacaguguccuugucaguuuuacggugugaccacgcacauggauggggcuuccuuagaagaguacaagagaguacaguaagcaaggcacaggaugagggacaugcauauauggcuacagggauggggggagggagggagagagagagagagaggugugugaagggcaaggauggggagggacaggauguagagggucacacaugucaaaggagauguaccagacacacaguuucccugaccacccaucgcagaaacacuacccaugugccacuauccuucaaguccaaccccaagccacacucugcagagccaccgauaccuuagggagccaaccaggccacacccacagcucuacugccccuccacucacaggccagacccagugaaaucuauuagucacuagggauugcugggcucccuagcuaucagccacuguccugugccagacccccaccccguggcugcugccucaucccaggccuucugcucucaccagccacccaccccagccauagcucauccacuagggcccuggcaggguugcuucugggggaccaagaacucacuggacugaggaaguaagguccuucccacccuuaaucucagcuuacucucaagggcugaacauggcagcugguaugguggcacuaaagcagacagaaggaaccuggcagagcccucaggaggaggaauaggagcagcaaugggcaugccuaggccacuugcuagaagucaguggccaaaugccuaggcuccaaaugacacccucagacacaaacuccuagggacuagaggaaggccaagaguagcugaaggcccuuuugucaccccagcaggcucaagauauaugcaguacuuggggucacugccuuggggcagaaccauaaacuucaaaggcccugaagcccacaugccuauguauggaaaggcugauagcacugagugucauggcccuggaaggacccuggcccagcuggcacaugacagacacugaacccuggguuuucugucaucacaguggggcaagacccagagcggucucaggaagccaucccacuucccccgccucugccuggccaggacacacuucauuuccugagccucuuccucggcuaccacacucagcucugaccugugcccuccccugggaaagccaaguauccuuugggagcucuuuccuggcguugagcugaggcugaggccacgcuacacaucagugccuccucccugacucugaggcucuggggacuuccaaaagcuugccagcccuacccucuauagggccacuaccccuagccaccaagccuucaaagugaggaauguacuagguguggagagaaugacuguucucccagggcaggagugaggcagugacaauaauaauuaccaugggcagaguuccuucaggcugaguguccucauccuacaugggggcucuggccacagggccccauagccaguggacuaaaugauacucacccaguacucagacuucuguggaauucccuggaccuaacuaaacacugcccugcacacagaggacagcugcaccuggcuaggcuacacuagcucugggaagcuuuuggagacagguggcaauugguaucauguuuucacuucacagugccuucugguaaugcugcggcuuuagaaggaaaggcauuagccuaaagcuacuugccagaccuggcuccaccccuuuucaagggcccauaaggaacucagccuuugguacaccucggcugucauccuaaauggcuccacccagaaaguaccaacuguguguguaccaugcaggcucuacagaugcaacaaccgacaacauagacaccgaauacugugggggaagggguguacuaacaaauaacacaaugggaaaaacacaagaugaggucacagugacuaguggcucaggaagggcuaggucaccacgaaugauaggccagagacaacaagggaggucaugugaguggugggccaggaagccucauggggcagcaauguugaagcugugucauuagagcuggagacaggugauccagguagaauuaacugcaugugccaaggcccuggacaucuagagaccagaguagcaacaagugugaugggugaggacacccuuucauaacagagucagaaggaaggagauucucacaggcuaauaaaauacagagaaguuuggugggcacugcagauggcugcuguccaaugaaguaccaucagccacuaugugugcgggguguugggauacauuggagagcauguugcaguggcugucuuuuagaacccccaaggccugcccuaugccacauuccucagaccccuccagcaccccugccuacaccuguuaccuugggcucagccaauggccaccaagcuccuuuccuucagggagcccccucauuuuuuuuucuuccugucucuugaauacccagagccagaaguugacagaacaagaauggggcaugcgcugaagcaaaggaaaggguccagacaugaagaugaggcaggaaugccagcauguccaccacaugugggagcucuccauaauacccccuuguauauaagugggaacugcuauuuugcugccuuuggucugggauagccuucugcacaagaccuggcuuuccuugggcugaggauugagucuccucuccagaccacugauccccaggcucaaggacccagccuuccuguugcagaccaguuuuggccagaggacaguguuugccaggcagcagagacucugacccugaccauggaacagaggaaggcauacaacugggauaggaaccuugggcucucaucaaccccauucuccaagccaaguuaaugaacauaugcuguuaaaauaaaaaccuuugagguuaagaccauggcucaggauauaaagcacuugcuacacaaggaugaggaccuaaguucaaacccugaggacccauguaaaaauucagguauggcuaugcaugccuauaacccuagaacuggggaggcauagacaggugggauccuggagcccccugguccgcugaucaagaugaauggacgagcuuucaguucuuaagacauccugucucaaaaaaauaagguguggagugauagaggaacacacugauuucaaccucuggucuccacgcacacacauguguacagcccuauguacacgcacauacgcugcaaacaaaauaaaaauaaaaaccuuuggugguuucucuguccuucaagccaugcuuccuauaguacagugguaucugcucauugggaaccuccaaguccccauuuagaagcuucccagaccauugcucaaaccuguuuggggacaugacucacagucaugaugcgugugucuuccuccaugacccucucuccccacugcagguaugucuccuugguugaugacuuuaaguguuuacuggacauauauugggguagaaacugaacaaguaaccauccucagcccuucacagaucucguggggaacuaggaauaugauggucuuucuccuuaaaaacacccugcccaccuguacaauagucucuauacuggaagccaggaggagggucauccucuagggccuguaaggcuaucuauaugagacucgagucacagucuguggagucugcuuacuaaccuccccugcaaucuucauucucugucuaacauaaaggaugcuuauuccaggacccauugcuguuccuguguggaacacucaauuccaaucugccgcagauccccaguguagucuucaaggauauccuggagagcccaggcucccagaugugugccuguaaggcuauauuuuguaacaagguugccacuguacugauacauaccuacacaguugugguuuguaacccuguccaaauacuccagauaaugagauuauacuucgcaacuuuaccuucucuuuuuuuuuuuuaagauuuauuucuuuuauguaugugaguacacuguagcuguacagaugguugugagccuucaugugguuguugggaauugaauuuugggaccucugcuugcuccgaucgaccccguucacucugguuaacucugcucagucccugcuugcucugucccaaagauuuauuucuuauuguacauaaguacacuguagcugacuuuagacgcaccagaagagggcaucagaucucauuagggugguugugagccaccaugugguugcugggauuugaagucaggaccuuuggaagagcagucagugcucuuaccggcugagcaucucgccagcccgcaacuuuaucuucuaaggcagcuacuagaaaaaucuaauugcccacacagaggugaauaugcaugcccuacaccacuaggcgaccugaaaauaauaugguagaucucaacuaaccaaugcaagccaucuacuaaccaagaagagcagaaagcaaagccuauguauggcuccuugacagguggugccggacaaacugggacucugcaugcaaaagaagaacaccagacucuuacacuucauacccauaaccaaaggccugcauguaaagucuaaaacuaccaaacccuuagaagaaagccugggacaaaugcuucaugauauuaaauuuagcaaugauuuauuuuauaugacaccaaaggccugggccacuacagggaaaacagauucauuacacuucaugaaaauguaaauguuguguggcaaaaggcaaugucgacaaaaugggagauuuuucggaucuucuaucuaauaagagcuuaguauccggaauaaacaaagaguaacuaaggcaggcgaaauagaauucugagcaccuucaacauuagugucucacuuccuuuacucacauccuuaaaucagcaagcccugaacccacucaggauggggcaccaggaugaaucaccagccucaugccaaugcagcacccaauagggucacaccaagugugugugggggggggaggggacaggaagcccaaccugagcagagccacuguagccagcagggauccaggguacacugaggcuaauggcagaaggcuguacacacacagacauugggugcccacccuccuggaugcucaaagagaaguggcaaccuggaacuaucacguguguguguguguugggacccaacaagcaagucuucaugccaggagccauucacacagugggaagcagcugcuacaguuugucuugacagccuggaauugagcuagcaguacgagggcauacauguauucaugcauccaggaaagggacacagagcagagaaggcaggcacacugcaguguucccaccaauaacacaaggcagggguaggggguugcaagcucggcuuuaggggacuggauuccaauacgaggaaccuagcucuacugggagaagagcuggauuuuggacugggacagggaaaaucccagaggagucugcagccuuaggaauaagagacaggauccaaguuaaaacaaaacaaacaaaaacagaaauaauagaaacaaacagaaacccuaaaacagggccaccaugugacuuaaaggguuaccuaagagaccuggaugccaaagccacaguauuugaacaacagaaauaaagaguacagagcugggcauggugguacaccccgucaucccaggacucugagauggaggagggagaggagggcaacacaaauuauucugaggccuacuugggauaccugagacacucucuuaugucucaaaacaaaacaagacccacagggcuggagagaugaauucaugagcaggagugcuugcuguggaaacauaaggaccugacuucagaucccagugccuacccaaaacccacaugagugugacacccagugcuaugggggaauaaagggagcaggaggaucagaggaccuugcuacccaccagccuagcuccaggguaggugagagauucugucuuaaaggaauaagcuggagagugauagaggacgcacucaccccaugcccucuuugggaccuuacacguguauacauauaccacacauaauuauaacacacacacacacacacacacacacacacacacacacacacgcagcacaccacaaccaaauaacaaaacccaaauugaaacaaaacaaaugaacaaacauuaaauagcaguugaaguguuugccauaaaguaaauauccuuagguugcacugaucugaaucuauccagggaaaguagcuggagggcuuuuagggagacccucaauucugagacacaggaggaaacugggaaacagaugcccugcucagcaaacauuccagaaagaacaucacagauaaggcccacacacgggacaggagaaauagcucaguaguuaaagcacaacugucuuguagaccuggauucaauaccgaacacucacacggcagcucacaacuguaacuccaguucuaggagguccaauguccuuuuauaguuucuauaggcaccagacacacaggugguacauagacaugcaugcaggcaaaacauccauacacauaaaacaaaucuaaaauauaggagaucuacagaaguccugugucagucugacuuguaugucugaaggugucugccccaggaugguuucugaggauaaauaguuggcacaacagcccccacaggguagccaaagucaaugugacacaugaggggacagcacaguccagcagcccugcucagcuauacuccugggacccaaacugcagcuccugggcugaccuuccugcaaguucacaauuucuaucugaucacagaguccaucagauuggaggcaugggacgccaacagcuggcauuccucaaaaugccaaggucaugagagacaaagauggagcuuucaugagugguaggaaacaaggcagauguaaaaccugucugugguagagaucgcaaaagagaaaaauauauuuuuggugggauggcauaagucacuuacuggugacagucuccuggcuuuagucacauggccaaaugauagaauuugcugagacuaugggagcagcuggagaacucuacacuacccuggaacauucucaagccaagauuuaucuugaaauaaaaagcaagaaacagcugggcggugguggcacacgccuuuaucccagcacuugggaggcagaggcagguggauuucugaguuugaggcuagccuggucuacagagugaguuccaggacagccagagcuauacagagaaauccugucucaaaaaaccaaaacaaacaacaacaacaaaaaaccaaccaaccaaccaaccaaacaaacaaacacaaaaacaaaaaaaaacaaaaacaagaaaccuguacggaugcugagaaaccaaaucuuagcaccuguuacuugacccuucacuuauuuccugguggucugagccacagccaguggcccaucucuacugcccaccuuucucuccuaacccuaccucccucagcccaucuacuccagcccugucccccugcugcucccacaggugucaagcuuacauccacagggccuuugcacaccugaugagcuuuuccagaaaaagaauggcucaccuccucuauugaccccgguugaggugguggcuccccuggcuaccuuccagaaggaugcuugguuuccucccacucugcccuguaugugguuucuugggggucuugccucuuccugcauaucuguuugcaucugugucuacuccuuggaguaucacuuucuugucucauuaccucagcuuucccacaauuccaagggcccaaugggagggcagugggaugguaaugaauaggacaugaaacagaagcauaucgacaaugugccuucacugaauguuuguugagaaaaaaacuugcacuauguagccuggcuggccuggaacuugcuauguagaccagucuggccucagacucacaaagaacuugccucugccacuauauucagugagauucuauauuuuaaaauugugcacaugugugcauacucaggugugugggguguacugcacaagugugcauggagccagaggacaagcuggagauucauccucaggaaugcugcacacagacuuugagacagggucucuccugggcccagagcucaucuauuguugaggcugauugaccauugagcaccaaacauccuccccugccucugcauccccacuacauccagcauuauauguaaauugaggaucaaacucugguccucagaagcacuuugcugacugagucuuuccuuccaaacccugagguucuaauuuugucuucaucaaauuaaugaaguguuagguggugauccccaguuuuagagguagacgucaaugaugucucacaagguggguggagauaggucagggcauuuccugcaggccagugugacuuuggguuccagagucauaaagccgugggaagucuuugauccuaucagucuccugcagaugaugcccaaggacgcaauccugaguuccuguugaacugugaggauuugcaucagagugcuauuuuuaauagucagugaggaagugguccagguguccacaggagagagucaaacaagcuacaucaagaccacaguggaaaggcaaggaccaugcaggaauguaaacaaaacuuuaaaaagcaggucaaagcaaaggcccagcauugagauuuccucaaaugucugcaugaauguucagacacagauugcuagugugccuagugcugaugagugucuccugcugcucugaugaccugcugucccucaguucacuugccucacccucaaacacaggucauggacucccacaguuccucaggagaaacugagacacaaccaggaagaugaugcuaaagagcugcaguuuuuggaaaauugccuccugguucaacaucauucccguuucucuaaggcugugauaaaacacuuugacugggagcaucuuagaggaggaaaggguuuauuugacuuauuuuuccaggucacaauucaucauugaggguagucagggcaggaacccaaggcagaggccugaagguaggaacuaaggaggagugcaccuugcuggcucucucacaggcucacacucacuagcuuucuuauauaggcugccagggaaugguguuauucagacccccaggaccaccugccuaaggaaugggcuggauccuccuacaucaauaauaaagacaaucccccacagacaugccuacaugccaaacuggucugagcaaucccucuauuagauauccuccccaggugauucuaggcuguaucauguugauaauuaaagcaaagaaaggaaaucagagugugcccuguguauacacaagaccucaaguaugugcauacacacacaaaaagaagagaaaaaaauugugcaaccacuuacauuaacaagucacauagaaaaaaucaccaaaggaccuccaguuagccucgauagcuuuucuuacaacgaauuaauguuaaugucuuccuugaaauuccccaauguucucugcugagcauuucuggauuuuuuuuuuuuuuuuuuuugaucagaagaacuaacagaaaaccaugagugcccauuuggcagggagauguucagauacaucagggguggcaucaccacugggcucugacuagggcagugacacaauuguuaucuguuccuuggcucagaaaaggaacugcagggguuauaugaccuuucucuagcuuaucaaucaaauguguggaaaccaccaagucgcaaaccuuuuaaguuuguuacaauaugacuuaccaaaucaaacuuggaacuuuuucuacaucuguagcuaaaugccugauuuuuuuuuuuuuuuuuuuuuuuuuuuaggaauaagacuggaauuaugaugugugcauuaguuaacucccucauccaaucaauaccuuccaagaagcaacuuauggaggaggaguuuauuuuaacucaagguuugagaugugcagucauccuggcagagaaggcuguggcagggggaaugcuucucagcucuaaguugucaugugacacacacacacacuguagcaugcaugcauacaagcccauuagacaaauaaauaaauaaauaaauaaauaaauaaauaaauaaauaaauguaaagaccugcacacacauguccacagcucugugacucucaacagccuagaaaacgucccaaggaccuguaagaugagaaaccagaaaaugaaacaggaagccacacaauagcuuugaguuuuuguuuuguuuugcuuuguuuuugcaaacaagaguauuaaauuuauuuacaaaguacaccacaaaauuugauucauccuaaacaggaauaucgggggacuggugagauggcucaguggguaaaaaugcucaccauguaaaccugacaaccugaguuugauccccagaucccacauuaagauagaagaagagaacugauugcccagugagccagcaauccucugaccacacacacacacacacacacacacacacacacacacacaaauaaaaagugaauuucuuuuuccaaugggaaagaugggcucagugguuaaaguacugccacacaagcccaaagaccugaguucagaucugaacccuguaaaaagccaggcauggcuugugucuauaaucccagcacuggggagguagagauggguggaccccuggaacuuguuggucagagagucuagccuaauggguaaacucuaggaucagugagggauuucuguuucaaaaucuauggaggauaggguugaagaagacagcugauauuggcuucuuccauacacacacacacaaucuucaaugcuaaacaacuaaguuuccaccaguuuuggcuaauacuagcugagcacacaugccucaguuuccucaucugugaaagggaggcuguggugacauucccaugagcaacacugcaugaagcaugugauucagugcucaucauacuuccaagagcuggaaucaucuagacaagucauaucuaccuucuugguaccuacccaggucccagaaacuacaguaagcugccccaugaaggcaagauacucagucaauacaccuaccugcauccucaaugcccacuguccucagagcuccucuggaucccuccaccagcuaauaugugagucgggauauucugacucaaugcucuauuguuuggguggggaaagcaccuagagagcuaacacagcaaaacagaaauguuucaaaggcugagagccaucugucuguccuccuuggaccaccucucaagcucuuacaccuucaauuggaaccuuguguaaugacugagcaucuguguagccccaccuucccuaccuccugagguugucccuauacaauugcaccuuggugucccaaauccagcacuauugugauaggacuaggcuggacacccauguccacugcuugugcauaccugggcaccucagccccagguagagcuuucugaaggcucugcggcagcucugugaggaggagccuuggauuucacuggggaggggaucucaggguaugugagaacuugugccucucugccuggaaggugcccaucuuggaaggccaggauuaggggaugaugauggaaaggccuuugggaagacuccaguccauggcucagcaucacgagucacugucugcuugugucaucccugugugaagguauugaggucccugagugucaggauggcagcccugaagcugagauagagguaggagccauagagucauccaugcucagugcacacgaugcuccugaaagcagaaugccaccacgcugaguucaaaacaaggacaaucacuacucaggcaaguggagguacagggcagguaugguccccguacacucugaaugaugaagggccccagcaaaggacagcagccuaguuagguugacacaagcagggagccugagucacacagcagcaucccaucccauaguccccacccaacgcucacagugcuuguugagccagaaacucucaacacagcccucuauccuccaaaucaggaucuaaugaggagagaggucaggaaccagcucagcuuacaaagcagcugagcuguggccuuugcccaagugcagguagcugaucccaauauacacagaccuuucugggggcucugcaccccacaggucuguaccugaaagugaggaugugcgcacgugugcacacacacacacacacacacacagagagagagagagagagagagagagagagagagagagagagagaaacacaauauggaugaggaagcaggcugacuagcauguaugaaguugaauggauccuguccuguaaucagauccuuaguggggacugcuaaucccagcucugcuguccacagggcuagccuaugcuuccaaccgugugguucucucuuucucccuuacgugggucccagggaucaaacucagucaucaggcuugugcagcaagugcuucuaacugccauggaucuuggcuccuguauucacuuuuaaaucuucccaugagugccccauggacaggggcuccagaagcaacuucacccaguagugcuggagucucaucuaccacguuuuauggucacaguggggagggcuguuauugguuucuaccagggaugggugcauaacuccacacuggacucucaucacaauagacaaugucaccauuuggcagugaagaagcugccucuaugaacuagaccaucaugaagccagaucccauuaauagcugaguuccacagaggcuaaguaacugcuaggcacagagcccagccccucugcuaccuggccugaaaugauacuggccagcauucucacaacccagcgggcugcuggccccaugcucaccgaaggagcucuagauccauagggguaguuucuccugggggaaggugacccagcccagauauucccaggccagguagaagggccagcugccaccuguucacacuccaggaccagcuagggaugacagcagaaagccugccgcugucuccaugguaacccuagccaggcccucacucuuacccugauuucaggcccaucaccacauucugcuucugagcccccagacuuuccugccgagaggagaccucucuggccuaggcaggggaaucaaccaccuccacauggacacaauacccacgaaagcagaacccucgacaaagagucaccucuucuuugaaggcuucuacucuggaccucagucuugacagcuauaaaaugggacaucugggccugagcuugucuguguggccuccagcaaccacggccggccgccacgcugugaauugacaugccuuaagcaagaggcuccagaaagauucgagucccccugggccagcuauaagugggcagguuccaucaggcuuucuuccguucagccucugcacuuccccaagagggucugacuuuccaaagagguggcccaacccaguagcugcagagcuccaggggaggggguggaucagguuacagccagcaggucacgaucuggagccaucugguagagcccagcucccugcaggcucucaggaaugcugccagcccuauuuucaggggugugaccagccauggcguggucccagccuacccagccagcaucaggaugcaaagcagaccagugagaggcucuaggcuacccugcauucaccugaagcucugggaaacacagggcugcccuguccuggaagagaggcuaguagaauccacucccucauccucacacaggccuggccaguuuccccaguguagggaaaugccucuggcuugagcccggcucugcugaggucacccacagaggaugaggcucccuggguugugaagaaaaccugcuuuagucuuagcuggacaagccaccggggcagcagucugcccaaaacaggugcuugugcaauguacucuccugagcagugaguggggacaggguggggcugcacaaagcuacccaagcuguaucagacaaagggccacccaguaggcccuaaggccacagcuucugccacugcccugggucccucacuaagacaagccauagaggcaaggggcccuggugggggccaaagucccuuauggcucauacccucagauggccugcuacaugcugggcagagagcagcauuuggcugcacagggaaccucaggccuucuauccagaugagggacuugugacccuggcuggccacucaggagagggccacacaacagcacaagucuaguauuuagguucagaacacuuucuuuccuuugaagccucuggauaaagcgauccuaucacugccugggagggugcacugcucuuucugucccuugugacaaagagaagguaagagguggggucccaaacccuguaucucugggcaagccuuuagaaugguaccugcccuuuaguuucaagccuacuugugagcuaccugccccacccugccuaggcuguuccucaacugcccccaggcuuccagauccccagagaucacuugguccuccugguaugaagcauguacuaguuagucccaaagaaaagcuggcuuucuucagaccacagcucugcccacgcacaucaugcuaaccccagacuucccuaaggauaggaccuaggacucaggcccagagcccaaagagagacagugcuuuggggccaggagccuaugggaccccuccuucaagcaucuaucuaucccuaccccaacaccucucaaggaucaaagcucauucagucaagaguuuuccaccuaaaauaucaggaaacacuccccaccaccauggggguggggcaggugucuuauuagcuuuuuuuuuuuuuuuuaauggugagcuguuaauuauccaaaauacagaaauaccucuguuuguuuuuguuuuggguuuuguuuuuguuuuguuuuguuuuuuuuguuuuuuuuuuuuuuuuuguaacacaacagggauucuuuaaugucccuuucuggcucuuuccauguuagaugaccauguauccugaccccaggguaagcauccugucacuuaccaaagugagggacacuuuuccaugagugucaaacccagcccuaacuguuucuuucacaugcccugaccugacccugagucccuugucugagcacaguauucacagugcccugcagacagaaccugcggcuuuggguuaaucuugcagccaguucacuuugucaggagccccaggugcugcucauacacugaaaaguugcuuagcuaggaguauaugcugaccaaggaugaaguugauaccuccacaggccccugcaguggcuaguuccugccccagccuccagcugaggcccuccaggagacacagugagagcacacuuaggugccugugugagccugguaccccugaacuucugugagccugucuguguccuguucaauaggugccuggcacuuaagcauaccccacacaugacagccauuuguccccaacccuggaagaggcuggcuugcccaaggacacccgcccagggcgguaugacuuugaggccacaggcagccagccagggaagccuugauaagcacaguagagguggggccguccugggaaccaaagcugggaagccgcagagcccccagucuccccccuaacuccccaccccagcccuugugccaaggacagccagaacauucucacuagccuggggaggugccacaccucaaaaaugcuaacccagggaccuuggucugggacagagagggcaaguuuacacuuagcgggaaaccaucauuacugcacagguuggcagggacuucucaaaggcccuuuguauaccugucuuguguuuuaccuccuggccaagugagguggggaucaggugucccaggaacaaagcggggugucaccaggucacccaagaucaugggaugggccugggacagagugccagccccacuguucugucaaaaugcacaccugggccccuggaaccccaccaccacucccgugcuuucucuguggcgguugagacauuuccuggagguucccuguggcccuugcauugguucugcugcccuuagcucucuggugcacagcugucacaccggcagugacaccggcagugcuacagauuuaaagucgguugcaacccucaccaacuaagacacuucauagcugcucagcuaacuaggaaggauucugggugucgggucuggcccaacugcaaggacagaguuucugcccucucuuuacagcacccgucacccaugccauugguggagagucuccuuuguguuccugugaaccacuggccaguucuucccuucauuuuaccucucagcuugcuguuacuauugcacuacccuggucuuuggccugcuaggcucucaccugccaggccacccacgcccagaguucucuugugagacugguccacuggugcccuagaaacucauauuucucucucauggaaaggguuuucugaggacauggugggauacaacagcugccugcagaucacagugagagccugagaggcugcucacugcuuuuggucaccaggaacagccuuucuagaaacccagagcucucccccaggcacucacucccaggcaaguguaaaugucaggggagggguacaagaaagauaguaacccugacaugacaccccugccccugacauacacacccauacccuuguccaucuuuuccucuucacaggaacaccacauccaaucaaccaacacacccacugauccagacaugcauccacccaugcauccugugauagucuaacacuccaacuuccugagcccuagaagccggacuugggagcaggggccacauagaaauagccauuuaguauuuguggacugccacacugcccacccaacacacaugugcacacauggaaauauggacucccaucugggccucuccuacucagugagugucauggaagcuaucuggacagaguuagaggcaagcgugucucagcccuacuccagaucagcuuauaugguugccauagcuuaucuccucuaagcucuggagaacugccucucuacagaccuuauuuccagaauauucucaacauuuacaaggagaugacuaguucauauguccacuuagaaauaacucccuccaaugccagagacacagagguguugggcagugagaggguagccuugggggccuuuaaauggucauacauagcaagaugaggagcccaaacgcaugaucacaugaccuguuagcaucccugagauagaggcccagacccuauccacauguggggaaacagccccaaagcaaggugaccucccaggccacacaaccccaguacgaagucucugggauggugccacacccaucucaacugccgccugccacuacuacuugcucaggagaggacauucugcaauccagcaaaggcgagaggccagcucuguguacaugaagacuuccuguucuccagugucaccugagagaccaaguuccacagcuguaccacugauucccuuccacagaguccccccagaaagauggccauuguaucugucugcucagagaaacacaggcaaaccauguugccuuugcugccugggccugucuuuugucuaucgucuucccagggacuaggucacuugagggucacucgccauuuccugcuuucuacuuggcugggaggaucuggguuuuaugguuucucuggaaaccuccacuguguacugcauacagaacccuagaaggugaacccacaacuugucugggugcucagugaaucccagccuuccugggaucagagagcuuugugagaguaccaggcagggcuccugaacuaugaagcuagugcugccagucauugguagccagguguucaaucuggucugacucaaagacaccaaauuuccugugugguuuuguacacaucccuggccuucagguucucacaaagaauaaccacgcccaucuggcuaaagcaauucuaggacccagaugugguguguagacuacagcucccccgcugagccauggaaggaaggcaagccauauuggauucugucagcccugaaucaccuagccaggguacagaacaagaacacaggcuuuccugagacucucgccugcauagagggaacugucugaaagcaggcagucucacugcucaaggaggggcagaaccaugugggugacaacagguagcaauccacuccaggcuguccucuagaggaccuguggaguaaacagcaaacucacugugccugggccaagcaccaugauauuauagcccguccccagagagggagagagggacucuguaggagugacccuacagaacaaaaaccaccucaaagacuuuuaugcaugccucauuacuuggaaacugggaagggccuggccaguuaccaagugaaaaacuucaggcaggggggaggaggagagaagagggaggaggaggaaguagggaagguaaagggaggugggggaaggguuagggagggggagggaaguaggaaaggaaggaagaggagaggagggggaugggaaggggagaaggaggaaauggaaggugggaggagaaggggagaaauagaggaaguaaaagcaugacaggagaggaggaguugaagggguggggaauccuugcccacuuuccagacaacgaucgcuggacuucaggucagcacugaaggcagcugcaagccuuggcugucuacagauaggaccacagacuugcuguauggaaaguugaaaaacacuaggcauuucuucccuuucaagaaguauaagauagagccaggggugguggcacacgcgccuuuaaucccagcacucgggaggcagaggcaggcggauuucugaguucgaggccacccuggucuacaaagugaguuccaggacagccagagcuauacagagaaacccugucucaaaaaagcaagaagugcaagauagacaccagaccauaggagauauguaaguggcuucagccaaagucagguggcuucucugacuuagaaaugugaucuccacccccacccccacauuccugggggccuccagcagggccagggcagcuguaaguaagcuguaagcuuguacaucuuccaagguucaccaacagcccucugguuuuccuccccugacucuugcccuaacauuucuacaucccuccugucuccucacaacucucugagccaggugggcaugcuacugcuccugagcacugguuagcuccccaauguuaguccuccagaguuccaggucacaugaacagggccaauuccaggcagcacucagcuccuaugcucaucgccacauaacaacuuuguaagcacagauacgaugggccauucugguuaggucccuucaaguauucccagaagccuggccuucccaucucccugccaauauuacagggcuggcaugaaggagcacuagagcacugggcauaagccucagucuaucugcuccaucccugcauuuuccuggcauccuguccucagggagcaagggaacugaccacagaaggaucauagccaccucacccucucucacugggcagagccaguucacacagcagacauagacccaacaggugacacccacugcagaauggagcauacccucgagcaagguaaucucaaacuggguuuugcaauuuguuuaaucaggacccaagagagggcacaugcuacacacucucccaguccuucuacccaucucuccuccccugcauauuucgguccuuaggccuacagguccccuccaucuuaacuugcacaccucaauuccaccaugagcaccaaagcaugcuccucuugccacaguauuucccaaaagcuugaucaggaggcuguacucagcucauuuacuccuccaguagugaugccaauguagguccugguugaacaauucuacccaauaccugcugucccacccaucuagauuuuggacaaguugguaacugagacccucaaggccgaaucugugauuucaccaggacccaugaugguguagaucagcccugaggggcuuuugacauuagcaggauuuggcaaggaaccuccccccaaccccccacccaaagcugggaccucuucagugcuuugguuuccccguuacuguuacagugggaagcaagacagguguaugcugggugaguugugggcuaucaccuauucaucucugaaagagauggaagguccugucccuuagucacuaggacaacuggggaucugaguuucugcaaugcauucggacccacuccaacaagacacaccuucaagucuucuccaguccugugcugugcccuggcauccacuggccauuuccucaccuccugcuccaggaaugacuugggcaccugcuguggcuguaggcucagccauucccuaggaguuagaucucuagaguuaagggaauuuggggauagguaggcucacagcuucugaggagaccuuguuuacugccauuccagaaaacagaaaaguccaaucauagugaacgaauacugauaacugucauucauaugccagccgauucgggaucaaugcccucuaacuguugucaugauaacuaugcacuagcccucacccacaacucacaaacaguaaauagccucagagcaacgagagaaacaaugccaccccauggcauggacucugggagccuugcauuuguccugaagaagugacuguguagaugugagaguccacauuugccucuugguacacuugcuuuguuuggauccaaaggggcuguucuuuuuuauuuucuaguugagaaucauucucaguaugguaguacaucuuuaauccaagcacucaggaaacagaggcagcugacucucucugacuuugaggccagccuggucuuaccuaucuagagccaggcaagccagaggaagucuuugucucaaaaaacaagcaagcaaaacaaacagcccccauacacaucaacaccacaacaaauuugcagcuuuuagcaggucuuuuuuccuuucuuacaauauguuauauuuagacaauccccaguagagggagcaaacaaggauuugaucauuucuccucuccugggucuuuuaggcaauuuuuauuuguuuugcuuuguuugagacaaugucuugauauguagccagggcuggccucaacuuguggaaagccuccugccucagccucccacgcauugggauugcagauguguuccuacaagccuggcgccaugaugauguuuucacuaaagacucacccuaaaccuggguguggucccuuguggcacguguccauguggcacuccccacauaacuguuucuccggcccacuaggaagugaucucagcaugcugcgugaccagugagccccaucugacuauuuugugcuuuagccaucugaugauggggacaucugguuugagaugcugcauuuccuaauauggauuuuuaaggcucaguugccuuggcuaccaagcucuaagcacaucacuucuugggagugcuuaggcacaaauggacuuccucugggccccagguucuccccugucagguggauggggaaucuuggugaaggaaacaugggaauaagggucucucuuucuugggaagcugcaaccaacauggaaaaaauuguacucuggcccaagauaaaguggggggucccugggcugcuggaggggguucucuauaaagguaaaaccugaagaaaguuggagguggcuugggccucuaggcagcugaggaaaucugacuguggcuuucuuuuuuguuuguuuguuuuauuuuauuuucaagacaggauuuuucuguauagcccuggcuauccuggaacucacucuguagaccaggcugggcuugaacucagaaauccuccugccucugccucccaagugcuaggauuaaaggcaugcaccaccgcuugcccagcaaaaugauacuucagacagcuauaagucaucaaacgguuacugggauuugaaccagaguccauaggauccacagucagugcucuuaaugacugagccacugcuccagcacugacuguggcuuucuaauugcaaguuccaugaggaggugucuggagaguuacucugagugguuuuucgauuugcccaagaacauaguuuaaagaggguacagagaaaggcauccaccagcaagaagcauagaggacaaaccuaaaggucucuccuuauagaugagguggccagauauaagguagcaccuaguauugggaaaggaacagccaucagcagugcuuccuuggggcuuauggauagaggccaggcagagagagggugccugugggaacaugguacaccugagguugagagcagagcaucuccuugcuggagaacacuacaucguaaaguccucugggcaaaucgaaggagcccaaaggaacuaguaauucucuagcaguacaucccaaagaagagaaaaaagauagccugccugacaaagaauucaaacuaguguuuuuuaaaagaaacuuaauaugauaaaacagauuauagcaagauaauauaaagaaauuaggaaauuuuuguuuugugauaugaaugagaaauuuagcagaaggccagauugggguaggggaucuggacugaaagagcaagauauaugaaguaaaguauacaauuaggagucuugaugcagaacagaucagacagaagaguuucugagccugaauacaagucuaacaaaaaggaaagucagaccaaagauaugcaaaaggaaaggaaaacuucaagaccuauaggagagcagaaagugaguaaacagauacauuguggauguuucaggauaaggagagacaggaagaagcagaaauaaaauuguuuacaaaguaauuacugaaaaaccucacaauuuuugggugaaauacagacauuuaagccagugaaggaagcucuaaggaccccuauagauacaaccaaaagcacuacagggauggacagacuguuuagugguugaaagcacugccugcucuucuagagagccuggguuugauuuccaguauccacaucagaaugugcaucaguucuauggaucuagcacccucuucuggacucugcaggcacugcacacauguuauacacaaacacacaugcuggcaaaauauauccauacacauaaaguaaaaaaaaauuaaagauacuuuacaaggaacauuaucaucaaacuaccaaaaauacaaggcaaagaauuccaaacauaguaagagagaagugccaaguuacauaaaagggaaucuucaguauacuaacagugagaagccuuuuaagccaggaaagaauaggaugauaccaccagaguuuuaaaaggaaaugaaugaaugaaugaauacccaucaaccaggaauaugauacccagcaaaacuauccuacagaaaaaaaaaagucuuucuaaagcaagcaaaacuaaaagaacucaucaauagauuaguccuauaagaaaggcuucaaguagugcucagaaaaaacaaauauugucucuggucuuuuccuagcucaaacuguaagccaaaauaaauucuuucuuaaauugcuucugucagggauuauaucauugcagugauaaaaauaacuaacacggagacugaaaguucagggaugggaaacacaacucaggcaaaugaaagcaaaagcaagcaguaggcacacuuacaucaggaaagucaacugucagucaaagacuaaauagagacagggaagccuggccaagggauggagucaacaggugaauuccugcacccauuagaucucaaaggagaaacauuaucuaacagaaugacaguuaaggacaaacuguaucaauggacaaguaguccaggaaaaugucagugcaaaaaugcuggaguuaaaauacacuauagacuaaaaggaucuacaaguuguucacaaaauaccuucucaccagcacagggaauggccuacaguauagaccacaugggagaccacaaagucucacacacacacacacacacacacacacacacacacacacacacacagagagagagagagagagagagagagagagagaguuagaacuggucauugaaguuaacaaagauguacgaacaaaaugcauguuuaaaacuucauagagcuccauaucugaccacuaacuugcuaggacuaaaaucaugauagagccugcucauauuagauacaaaaggacagauauggguaacuaaaaaggcagauaucucuacagugaacauuacaaugacaagaaauugaagagugugcagaagauggucauagcauguuuguggcuccaaaggaaaauguuuaaauguccaucacggcacaaagcaauguacagauucaaugcagcuacuaacagaauaucaguggcauuuucacaggacuaaaaauaaguccgaagauugguauggggccacagaagaacccaaauggaucaggaaauugcauucccaaagagcaaugcugaagauagcauaauagacaacuugaaaauauccucaggcuggggacguggcucagcugacagaaugcuugccuagcaugcacaagauucuggguucaaucugaggcagaaaggagaggcuaggguuuaaaacagaugggauaguaucuauuacaggguguuuagugcacaucuguaaucccagcaguugggauguagugaagggagaaucaagagucuaaggucauccuuggcuacauagucugagucugaggucagcuuacauuacauuagacccuguuuuaaaaacaaacaaugcuucauagcuugaacaaccaaaacagcaugaaccuagcauagaaauagacacaauaugaggcugaagagaugacccaguaguuaaauccaccuguuguucuugguuaggacuaggguucaguucucaacacccucaugguaacucaacugccuguaacuccaguucccagagaucugaaacccucuuauuacuucuaagguaauuggagugagcauacucaggugcacgcgugcauacacacacacaacacacacacacacacucauucacucacuccugcuacagacggauggggugggcaauuuuacaaauggucucuuuuccaggacacaaugccuuugccuggaucuuucuggaaccacauccagguguguucugcucaguucccacaaccagaccuggggacuuuccaagaaguagccagaaagugggcaagcaccaugugagugcuucuaccucagaucugccugugcucagucagggcaguagcuaagacagaagcccuggcuuuauuagaacauuaauggguaggaaccucaggacuauccccaggccacugaaaagcccucuggcagccuuugcaucuacccaccacuuucucaagcucaggaaugccacuggauaaaaauacugcaggcagaugucaucagucuggccugucguggggcuuagaguuuuccaggcagcaguugccacagcccaggcugugagggugggguaaaguaaaaggugaagaaagccuuugaaaggagccagacagcucuagguggcccugccuguauggccucuuagcacucaggaacaucaagauacuugcuaacaccacacacacacacacacacacacacacacacagagagagagagagagagagagagagagagagacagacagacagacagacagacagacagacagacagacaguuuuaccaauggauucuuuaugugcuugaaggcaaggcaaggcaaggggacaaagacagaggcacugagcacauaugugccugggaaggcuuccuggaggaagcagcuucugaacauuugacagaguguguauugcgucugacauuugucaugucagacuccaacucauucccacaggacaagauccuuccauucagagacucuacucccagaagaauagcaauccacuccuuacuugguuugaucagcgugugguuuaugaggagggagcuccuggauucuugggcauagccaacugugugaccuuaggcagauaagcuacugucuccaaguuccaggguucccagaugcacacagcaaguagccauauuugacaggcccuugacagagccacugcuacaguccccuccaccucucaagaggccucugggcagggccagggaacggggcugggccacacagcagaagauaacguguucacagaggcaguccuuucacgggcucugaagccucaugaaaagucaggucuugugauggccacagucacccugcugauagagcaaccacuggcuccucucugaggcuugcagaaaucuggggcucugcaugcuccaagggguuaugaaaagggauucccaugaggaagagcaaggaggauacaucccugagugccucagguaggaugagcagagcuuagauggcauaaucuauuaaguagcaccacuuacucuuuggcccuaaggcccugcagggccacagccuaccuccugcucuaccuauuacuucuuaugcuuccccacagugucaaaagggccugcaccuucccucugcaacuauuccuuaguuucagcauccaaguggccccuguggccagcacuuaauuuccuucauucucccuaccagaggcauaagagcuucuagaagcuucucuacaaccuuucauugggacagaccacccauccccauaccaccuggacuccuuuugguccuggaacaugcccuggugucugccccagccugucaaucucaugaagagggaaaugaaucacagcaagguacauaggaggcaacagcuggacuggaaugucagagccaggagggaccauggggcuaaucaggguccacuuccuagauaagggugcagaagagagagggugggaggagcaggggcccuuacacuggccaugaccagaacugugcaucuuauuacucaggagccacuugauagagacagcugcagcucuccucacugcuaggcagaccugcuguggaugccacccugcacugugcuuuguuaaguaagcacuguuugcaaaggggacaccacacccaggaagcaugagcucuggacacuaccuuugccaccagagggcucuaaacaccaaacucccugagaaacagaggccauagcagcuggccugacaaugcccuguccuugugacaccaugggcuucuucccugccucagcagcucccaguacuaccuuagccuggcauagguccccaugcccucauguccaggguagggaggcucuuccucaggucggaguuccaugggauugucucuuccuacuacccagcugggagccuugccacaagggauguuuauggccacccaacucagaacaaaccaagaugaagugcuccacacacaggcacacaguguacacagaaaugccaggcugggucugaggacagguugagggguuauguguaccuggaaagucaagaugccaagagaguuagcugaugacaccaagggaccaggccccagaggagauggcauguggagaagcuucaaauuuuaucuaggguugaagaauagguagagguguuuauaguaaccagaaggaaagacuuggucaucuacacagcccucacugcucuguccccaucauccugacagccaucuuccuaggucugcuaacuaauugcccacuggccacuccaugagagucauaaccaauacacugcagccccugcaaucaaaaaggccagcccauuugacuaccaggaguagcuguaagcuccacucacgaucaacucccugagguacuagcaaaagccaccaaaaaguucucagggaacugagcaagccagaacugugagaggauagagacaggaugaucaaguucagguucaaaagugagggagguggguaguaucucuuaaaccccucuguuggucacaaccagggucuccaagcagcuugacagucagaguagauaguuuggaacaucugcccccaacccuggccaaggcccaacagcaaggcagcuggaccccugugaccuuggcuaggaagggggcugcucucuaugggaacucaaagagccacaagauaggauuagggugaggggguggggugggaacccaagcagcagagggcagugccuggggaccaguguccugacccugucaagcaggggaggucagcacagacacaggaagagccgcucuacuugggccaaggcaggggucccccaaggaggggccaggauguccgggucuguuuccccauacgcaugugggaaagcauaccccagagacugcaggacacuggcucucaccccuccacccccuccacccccacacauucaugcccugcuuuucaaaagcaggcuuguccuuugggccacagaaccaucccuguauguuuuaaggguccaucuuaccaagugcggagcucacaguuugccagccacauuugcuucuuagaacaucaccagggacaaccagcaugaccacacauuuuauaaagauguuaggcucccaacugcuggccaugacucuuuucuggaaacugccugacccagaggguccugcccaccuccugaaggugauggagaugagaucccucccccuagugucugagcaaaccacaugcuguacccagcaggguccucccagcuuacuuaccccucccucuuuguaacuaaacuccaugggcagccagggcugggcaagauucaccgaccaccacucaggagcuagcaucucucucccucuccuugacaaagaagaucuuagaccaccaaucuagaagccaccagggcucaguggcuccuggcuccuggcuccuggcuccuggcuccugaggaggcugggcaaaggcaagcucugcugagcaaacuucccgagggcugaacaauccaauucaggaagaaagcacaguguaagcacagacuuccucuggggcaggacaagcccucuuccuccaccagguccaggccaccagagucaggaacuuaacaacgcucauucuaaugaccugcauccccaggaggauuccaugcaagugucugaaggcugcccaccuuggcaaauggggcuccugcacaaaaagguaacagaguagcggcuucuccagcaccuuucaucucagggaucuuaggauccagcaggcaaguuauagaaagcagcaagccauguuugcuagacauuccuacagugguuaagguuaaggcccuuuggggucuuuaugcccugagaaaagcccacuccugcugcaaacacaugcagugccuccauccucgaaagaccagcaaugaagccucagggguccuggcacuuugggagguaaggcaggggguuggguggccuuaaggacauaccaagaaugccaguggggacaggguguccagagacuugcccuggauacccugggcaaucgucucccuuugcaaggcaaacagccauccgaauucacuuuugugagccugguucuugcugugccucagaggcauaaacagaccucuggacaaccaguggagguccuccccugcccagguggcaagacuagccacaaggaggucaccuaguggaacaucuaaagcaauuagcugcggggucgguugaguagaauccugagccagaggcuggcagggcaccaagaaacuaggcagccaggaagugcugccucgagguggccaggggaggcagcaaggagggcagccagcccauuccuggagaugacuuucugugacccugcccuugaaaaaugaagugcccugccccucucaggcagccugugagaauaagagccaccugguagcagugagggccaggugcagcucagcucccucuccuguucccuaaagcaggugcuguucucggacaaugucuacugggcucgcucagggcaucaagccugcuuucaucagccuggguuauugaagcugugggcacucccuguggacaucuugggcaacaccagugcaccugcuaaucuauccuguugcucugagugccuaagacacagacaccagccaaggccuggaugggcuugcacacagacaccagucacuccuggaggcuccugagucucucuugucacaacugacccacaccaaaaggucggcuuccagcuugcuuacuccuccuguagagacuaacaucuaagcgcugucccucuaucccaagugaaugcccugggggaucuccuagguugguguacugcaagugucccccuccacaagccacagcagagucccugaguuuaagggaccgacucucagucugguuucugcuuucugugauuagcccuuccuugccuccccuagggucauaguggcaccagcccuaagagucgugcgugcagggagguuacucacacggugaagugguacacgaaacacuuccaacccguggggcgcucgaggaaguuguagacucggcccuggaugugggugcgcgccagcagcgggcggcgcgcacuguagauggagacccgcgggucaaggcucacccgcggacgugggccgaggucugcaggggccggggcgggcgacacuggggucgacauggggggcgcgagcccgggggcuccgguuggcgcgaugggcgcauagaccgugcugcccucagggccaccuucggccagcuccagugagaagggacacuucuugaccaccgcgcugccccgccgggcgccuagcaggcggcuccaacccgcgcgcuuccuuucagcacugggcggggacgaggccguguccauggccagacaggaccccugaccccgcugcuccucggagcugaggugaaggcagcgcagagcgcagggcgcagcgcggguagccacugcugccagcccagccacggggggccgcug

SEQ ID NO: 4224 - RNA, 2190 nt, Mus musculus
gguaaggauggugcccacucauuuuucaaaaucuuguggaaaacuccuaaguaauggaccaaaauaaagggaauauauauuuuguuuaaaaggagcaaaguuuuguuuuaaguggcauuaucuauguagauaauaugaaaggacacauauacaaauucugcaacuauuaagggaccacagcaagguuacaugacucaaaauauacaauaaucaguuacuuuccuauaugccccaaguuaacgaguggaauuugaaacaaaguacauuauugcuuuggcaucaccaaaauaaacagauaaaaauauguacaauauauuuucaauauuuaacauauugaaaaauucaauauugccagauguccaauaacccaugcugauccccacauuaaaugcaaccuuaagcaaacacaaauguuuuaucaguauuggaaaauggacucuaaggcuacuguggaggaaaaggauagaauaugaaacauaauauuaaaggauaauuuaaaauuaaccuauuuuaaugcauugcuguaaagcuuuggggauccagaaacuauauuacuuguaaaagaauagguaaguaaagaugaaaggaaaagaaaauagcauguuaaaauacaaucuaaguucacucaacuaaucuguaguaaaggaacaaaaauaagaauggagaaaaauguucuuuuuuuuuucaacaaauggugauaaaauaaugauagccacauggaaaauguaagaaucuagauacagacuuuauacccaauaaauaaaaaauaaguugagaauggaucgcagacaucaauguaaaaguagaaaauagaaaauaucuucacauaauacagaccuaaaaaaauuccaaaccuugcacuaaagaacuaagucauuuugcauuuguaguuugauauuaagaaaaaaaaaacauguuaaacuguugccaccucuauucaacauaauggugaaugguuuaacuggaucaaauggauuagcuggacacauguaacacauguaaauuggaaaggaaguaauaaacaagauuccucauaagauuguauaugguaaauucaguagugcaaaagaauaucaguacacaaguuucauuucuauacaucaaaauugauauuuaagaguaccauugacauaauuucauuugaggcagcaguauguuauccacagcuuugauggccaggcuaccucguaauuauucuugauuucauagaugauaaaucugaaaaacuauauuguuuugcccuuacuacaauaggaaccacugcauccaaccaauucuugauucuugcacuuaaauaggucuuagcucauucauaccagauuguaaauacaauggauguauaccaaaauuaaggaacacugucccaauauaaugagaaauacuaaaaacccaaagagagccgggaagauauccauuugguaaagcauuuggcaaaaugcuuuuaaagcaugaggaucugagggugagcccuggaacucaugugaaaaugucauguauauuggauguuugcagucacagugauggaauggaaggaagagaauccaaagaguuuaguaauuuggcagucuggccuauuuggucaagucgagacuaucucaauggagguggauagcauuucuaguuaagaaaguggaggcuguccucugacuuagaacacaugaauaugcacaaacaugcaccuacauauauaucuuuguauauaaaagaacaaggccauuaucaaagaaauacaagucauguuccaguaaccgacuccaaaaaaccaggcacauuaacuuagugacaauuuaaaaugaguuaagaauagccaacuaaaagagaacugggagaguacaaucugaaaaacaauacaugaacaaaugaguuucaauaaagcuauagaaagcaaagccaaauucuggaggugaagaguacagugaaaggaaaauuguaagacuggcucaaaacaagauuuuucaauuaaaacuggaaaccuugaccuugaaaagaacacuuggaccaaauggauuuaacagaucuauagaacauuuuaucucaaaacaaaagaauauauccucucagcaccucaugaaccuucuccaaaauuggccaaauaaucacacacaaaaagccuuaaagaauccaagaacacugaagugauuccaugcauucuaucagaucaccacagacuaaggcuggacugaaauaaca

SEQ ID NO: 4225 - RNA, 6301 nt, Mus musculus
uguuuuucgucaaggguuuaccuucagggaaaguuaguuuacuaggucuuagccagcuaggauuuaucacaagcuaacugaacugaccuaaagcaauucaaauuaacucuagauuucuuguggaguagaaauaaccaaacaccagaccaguucacuuuagccauccuauaccacccaagaaaaaauauugaagaaugguugugacauucagucaagaggcucaguaaaagugagaccuaaacacagaacuauagaauguuucuuauauacgaaaccuuucuguauuguuaauaaugcccauucaauagaaguuccuuuugucugauacaucauaucugcuguccaccuauugaaaaaaaauacaaggauucuaaaagacauuaacuuuuuaaaacauagcagacauuucagauauguugaaauuaucggagauauuugaacuauaaaacuaaggacaacauccaaggacaauagcaaggaaggaaccaaacucauagggaaaacacaaaaagggcugggaaccagcaauagcaauguaugaaaaauacccucuguagacucauuugauugcacacagaugagaaaaaaaaucagaguaucuuuuuguacaaacaacaaaaacuaaaagacaaaaaugaacaaaacagugagaauuuggcugaguugguuaaguguuugucuuauauacguaggaccugaguuuggcucccaaguaaaaaaguuaucuaguuaucuccauuccuggggcagcauuagaagacaugucaaucccuaagaauacuagaaauagucauauagaagccaaaaacaaaacaaaaauaaaaaacaaauagaaaccauuugaaacaacaggaacuaaaaauuuccccuaaauuauuaucauacauuaaacaguucaggaagcugaaagaauaccaaacaggauuaauaacaaaacuugcaucuaaacauaucauuaucuacagaaaaucaaauauuuaaaaagcccuacaggaacaccuacuauaaaauagcaauaguacaaaccacauccaaucuguccucagaagcaagaagagcgaaauaacagaacaaaacaaaucgcuauauaucauucugcacucugcaauugucuuaagauuggccaguuagguaagauuuuguucaaaacaucuaaaaauguguuuaauuauguuuauguauacuuaauugaaaugaaugguaccagugauuuauagaggaguuaaugguuacuuuaggucauacaauguaugaauugguaugguaugauuugaaagagggcuuagcuuaguugaaaauguauacaagauccagagaaaucaccccaaaauaaugcuaguaaacaaacuuuuccaaaaacaguauugcaaauauauagcaaaacaaguuuguaguuacagguuguaucuuagcagccuccuggguccauuguaccagaaucccacauauaaaucucauguuuacaguagauuucagauugggaaaucuguuuugcauagucauuguuauuuaauaaguaucuucaccccauuuuguggcaaugcuaguagaggaaagugaauugcuacugagcuauaucucaagacacuaccauaccuuucuaauugcacaagcucuaaugccaucacaccuaaaagaagcucugaauuaaauacaauauaguucuuaacucguagguauuaccuaagagacuuaaagugauuuuugagcaggcuaaaaccaaccagccaccacuaccacaacaaaagauaucugcuaacaagccaucagauaggauauaucuaguaguauuccuguuguugccauugauagaaaaacauaucucucccagaacaugagaaauaugagaaacaaauuaggguaggauaaggaagggagaguugcuauauuuucuucuuguuugggagagauagcuauuugucaaaagaaaccaacauaauacuagauagaaacauaccucuccggaauuauaaucuugguaaagagaaaauuggaauaggaagguguguugacuuucugcagcacaacucuguuuaggggaaaugucuguuugucuuaccuggcuucuuguaaaaguaugguagauaauauggcccaugauaaucucauuucaaaguuccuaucaaaguaagaucugcuuauucucuauaacccuguggaugaagccauuucagauaaagaugagcaaaggguuacuaugcuuugaagagaaauuacaguauucaaagagaucuuuaagcccagacauuggauuuacuagacacauacuuaaagcaauuauuuuaaagaguuaaauauauugguaaucauaauaaaaauauaagcuacagacuaggacaaaacauuuaaaaaauauauaaggagcuucccaaaacuuaaaagggcugggaauguagccucacgacaauaggguacuugucuaacaugaacaaaacuuaaaauucuauccucauaaauugaaaaaaauauguguaugacugaauuuugcuuucugauuugaaaaacacccaaacaauaugaaguuaaugaauggcaacuuuaccaauaugcaucaguuuugcaggagaaacaccuccauuuagcauagauguuaaagacccacaucuuaaauccaaucucuagaagcacaauguugaugaaagaaagccaggcuuccaaagaacaucaucccaugccugagucaguuuaguaaaaucuacaaaacuggccaaugcaaaaugagcucuauugugaaggauaaaaagacaaugaagaacaagcaaugguaagauuauguuagaucaucaauuugaguacauugaugagaacuucaaaacuaucuaagaaugugcagugagggggguagguaucuuuuugccauauucucaaaugaaaaagcuuuaaaaaugaaacauuuuaguuuaaacaucuuauuucuugagggucuaaaagauucuaaaguugucaauguucacugaaacaaaaaagaugguaaucacauggaaaugucuuuuguaagagguuaauauacagggaccucuuaguuuucacaaagguaggauuuaugggcaggaugauaaacuuguuuuccugauagacuuucuuuuccagacuuaacaggcauaugaggaaaaaugguacacugaggcuauguauaagaagauaauaggcaaccuaaacagaaagcaccaugcuuggauggauuuacugauaaauucugacaaaucucaacuauuuaauggaagaauguauacuaaagguucuacagugucuuuuagaagguaggaaauauugcuuaacucauuuguugagaccaauguugcccuuauuucuguagcaaacaacacauuccaaacaagcuaaauaccaguaacucaugcuguauguguaaaacaauacacuacgcaacauuaauaugccaaauccaaaaauaccacaacugcucagugcuaugggacauuaaaaacuaagguaaguuaucacaagcauaaaauaagucacaggauuaugucaccagacagaaauauacauccgacaaaaaucuugaccaacccaugguaaaaacaacaacuuuggaacauuuagccucagguacguaaucauaagaaguaaaaagaacuuuuaugauuauaucacuggauacauaugaaucugacaaaauucuuuacuaacacaugauuaaaaaaaggacccuuggaacauuaccaaaucagguaaguaaucacaagaagaaaaaaaauguuacaugacaugauuauauuucuggauacaauaauucaucuagcaaaauucuuuacuaacucaugauguuuaaaaagccguuuggaacauuaaaaagucagguaaguaaucacaagaagcaaaaagaaguuacaugauuauauuauugaaaugcaucuggaaaaauuuuauaucaauuuuaaaaaagcccucuagauuauuaaaaccucagguaaguaaacacaagaagcaaaaagauguuacaugauuauauaacuagacaaaaaauuugacaacauucuuuaccaacucaugaucaaaacaaagagcauuaaaaucucagguaaguaauaagccaaaagaaguuacauacuuauucacuggauacaauuaccaacucauaauaaaaguaacaacaaccaacaacaacucuacacauuaaaaacucaggauaggguucacaagacccaaggggaaaaaaaaaaaggucugacaacauuauuuacuaacucaugauuaaaacaaaacaaacaggaaaacuucuggaacauuaaauacucaaguaagugaucacaagaaguaaaaauaucacuggacacaaaagugcaucugagaaaauucuuuauuaacuugugauuuaaaauaaagaaaaagaaaagaaaaccaaacaacuggggaucauuaaaaacucagguaagugaucauaagaaacaagaagcaagaaauaaguuacagaaaucugacaacauucuuuaccaauaauaccaaacaaaaaauaagcacacacaaaacccucuagaauauuaaaaacuuagguagcugaucacaagacacaugaagcaaaaaagauauuacaugaauauuucacuacacacaaaaaccugacaacauucuuuaccaacucauaauacaaaacagaaaaaaaaagcauacauaagacaucuggagcaucaaaagcucagguaaagaugacaagaagcaaaaagaaguuacaagauuauaucacuggacacaaaaaugcaucuacaaaauucccuaucaacucaagauaaaggaaagaaaagaaaaaccuaacaacucuggaccauuaaaaacucagguacaugaucacaagacacaagcaaaaaagaaauuacaugauuucacugacacaaaaaugcaucugacaaaauuccucaucaacucaagauggaagacaagaaaaacccaacaacucagaaacauuaaaaacuuagguaagugaucacaagacgcacacacacacacacacacacacacacacacacacacacacaccccacaggaaguuacaugauuauuucaguagacacagaaaccucacauuccuuaucaacucaacauaaaaaacagaaacaaagcaaacacaaaaacccucugaaacauuaaaaaccaugguaaguaaucaaaagacacacacacaaaacaacaagaaguuacaugauuauuucacuagacacagaaacaugacaacauuguuuaccaucucauaauacaaaacaaacacaaauccuuuggaauauuaaaaaaucucauguaagugaccacaagaagcuuaaagaaguuacaugauuauaucuuuggacacaugcaugcaucugaugauuuuuuaccaacucauggauuuaaaaaggggggaaaauaaaacccaacaacucuggaacauaaaaaacaaaaaguuacaugauuauuucacuagacacagaaaucugacauuuaccaacucauaauacaaaacagaagcaagggcuagaaagaugguucagugguuaagagcacugacugcucuucuagagguccugaguucaauuuccagcaaccacauaguaguuauauauccaucuauaaucugacucucuccugacgugucugaagagaacaacaguaugcugauauacauaaaauaaaucuuuuuaaaaacaagcaaaacacagaaacccucuggaaacuuaaaaaggugaucacaagacacagauaggcaaaaugaaguuacacgauuauuucacuagacacagaaaccugacauuauaaacucacaauauaggaacaaaacaaacacaaaacucuggaacauuaaaaaacucagguaaguaaucacaagaagaaaaaaaaaguuacauaauuauuacuggacacaagcaugcauccaacaaaaauuuuuaucaacucaucucaaaaaccccaagaacauuggaauauuaaaagcuuauauaagugaucacaagacccaagaagaaauaacgaaguuacaugauuacuucacuagacacagaaaucugacaacauucuuuaucaucccauaauacaaaacagaaacaaaaagaccacacaaaccccuggaacauuaaaaacugguaagugaucagaagagacaagaaccagaaaagaaauuacauguauguaauuucacuacauacagaaaccugacaacauucuuuaugaacucauaauacaaagcaaaaaaggcacacacacaaaacaucuggaauauuaaaaacucaggugagugaucacaagaagcaaaaggaaguuacaugauuauaucacuagacacaaaagugcaucugacaaaauucccuaucca

SEQ ID NO: 4226 - RNA, 1513 nt, Mus musculus
cacuguugcagaugauagguaguauggacccugguccuuguuucugaagugugcaguacagaccuugucuaaaauaauuauuuauguuuuacaauaauuuuuuuuguuuuauauuguuuguggguagccugaaagacugacuuaagguguuuucauuuuccccccaaauaguaauugcgaauuuucucagugugaaaaauaguggacaguacuugcaaacgcuguaagaccuucagagcaguuauaaugacuugagcaaagaucagugguugaagcacacagcggcccacugaaaagccucagaaggcaaucuagagagagcuuccuuggaauuuuagagcauuuaaaauaauaguaugugcuaauaacuuacaaaacaugcacagagcuagaugcuaagaagagcccugacaauacuacaaaccaguaucuaugagagauuucuauacguaaguuaccucaagcuacaagugaaagcaaagacaggauuguuaauagucuguccaaauauugaaggaaaauuccaguuuaguuaauuuacaaaagcuggacgaauccugcccuccuuuuauaccucgcugucauaaugaacugaacauaaaugaaaggaacagaacuucaaagaccacacauaacuucacaaaagaaaaauagcuugggaauaaauaaaaaaaaagcuuaaaaccacuuaaguagcauuaaaaaaucuggaggcagaaaagaaucuaauguccacaguuauaauauaaauaauugaaaauauagagcuuuaaacaaagaaaauauggacuauacagagaaacaauaacaaaguuccuucccacagaaagccgaaagaaguauagacacacuguacuuaacuugacaaaaaaauaauuuuuaauuaggcuaggaauguuucagcuggaaaagggucuugauacuuaagcccugugaccuaaguuugagcuccgaucccauauaaagguauaaggaaagaacuacauaaaaucagccccuaaccuagaaaugggcaccauggcauguacaguaaucucauugauaauaaaauaaaauuagucuaaguuaugcugaaagauaaaaagaaaaugauaaagaacuaaagaaaacaaagaauaugaagaaugagauaaaauuagaaaauggaauuaaacaaauucuagaacugaaaaguauuaacaaaugaaaaaauccauuagaggguuucaucagcagaucugaaugauauaagaaucaguggacuuaaggaucaagucugagcaccagggggggaaaaugagcauuucaagaauucuaugguaaacuaccaaguaugcuaauaucuuuguuggaaaucccaaaaaguaggugaaagaaggagcaggaagaagaauugaccuaguggcuaugccuccccaaauuugauuaaagacaaaaauuacuauguacaggaacauaagcaaaaggacccagaaaugauaacugagucacagaaaaauacacuaucaauuauugaaaggcagaacagacguua

SEQ ID NO: 4227 - RNA, 7527 nt, Mus musculus
ucauuugaaguccuuuaauccacaggcaaacauaccacauuuugaucuauuuccuuccagucuuuuuuuuuuuucaaugcuuaaguacaaugcaaaucacccuaacgaguaggcccuuuggcugagaaggaagaugcugcguacagucugguuuugguucucuugagagagggugaaacuuggcaguggguagucccagcuggggcaguugccacgccugaggcuacauucgccauuccagaccucccauuuuccuagaaaacaaaauuguuuuguucugcccugcacacuuagguccagauucuggcucugacaagacagaagcagccaaggaaugaaagcaucaaaaacuagaaucguuuuaggaaaaugugacuucacugucacuaggaaacaguacuuuuccuccaggaccagguacacugacauugguugguucagaagagaacaccugacauugcucuaguauccucuacacagggucuaaguggucauaugacccuugucacauucaccauggucucaguuuguucugcaguugggcuaucuuuuuauaucuuuaugaaagacaaacucugggcucuucagagaugaagugcccaauggggcuucuuagaacacaauacuugccccaagcucuugccuaagaggagcaccaccaguguguuuaaguugaaacccugcccucucaacucccuuucagaaucuuugagaugucugaccuggcugugaguacagauccaaauauaaaguggguggcaguccugaauaguguuucucccaugaaagagaagcaccccuaaagucucugaaacaugccuagcagacaacagucucuccuuuugacuuggaaaaacaacugugcugagccccucucugacccucacugcaggggccccaugaacccuucccaggauuaaaccaaagaguccacauuccucucuggcaggugcaggccccgcccgcuguggacagccaacugaugugcacauuuuaauuuccuaauaccaggacagagccuuucucaggaguugaggggcucacccugggcccucaggcuuggagauggcacuugucauucuggguguguagaacacagcccccucuuccagucaccucuuugcuucuccuuucuuguguauacaagugaugcaaguacugaaauauguauuuguguucuuuuucuuuuuuuuuccaaaagaacauuugaauccuggaugaaguuguagcugugacuugacaaguguauaauauaacccaguacacuugaaucucagcccugagucucuagaaugggaacaguaacauacucccaccacgucccagaccugugggccucuucaugugcacacauuccucaagguuuacaggucuuucccuggucucucugaggaugucacaggcacagagcccuuuacuugagcccuucuuccagcuaugacuaaguaaugucuguauaguuuccugcuggaagucugcugcuggccccuugggccaugagcuccugaguuuauuuauauuucccugauugcuagucaggcacaacaccuuuccauaagcucaucacgcuuuugaauucuugucucauuuugaaggggguggguguagggugucuugcuuauuuuucgguuaggucauuuuuuucaguacuagagaauuaaaccuaaggucuuauaccuagugggaagacacuaccacugagccaucucuagcccucauuuugcucuuugagaguuaucuugacucacuguugucccagcaagguccugaacauaauauuucuucuuccucagcuuccuagguagcuacgauuacagaccugcgccaccagacuuaucuauuuguucuuacugauuuaccuaacuuuuuauauguuuuaucauuuuugaaucccuuuuuacuauuuaaaauguauuuagauaucuagguuuugacucugaauguggcuaaauugcuauuuuucuuuuugauuauugcuucuuaguuauucuaccccaaagcaauguagauauucuucuauauccaggccuaugguccuucuaguucuacuugucauaagcccugaaacaccaagaauguguuuucaauguacgcugugagaaaauuaagggcccaguucaguguuuuccccaugugaauuuccuuguccuugaaugugucauuuaaaaggccaucucaugauaaguaagccuuuaauacauugcaaguguccauggguaggcuauuuucugacauccauuucuaucccacuagccaguuaagucucuccuugaaucaguucuacauuguauuaaugacuacuauguugaaguacuuguuuuugauaagccuauuagccacccuguucuuaaagaauauuacuuuucccuggucuuuuacacuuccaaauacaucucagaauccacuugucagaguauucaccacaaacauuaggauuuuaauuaaaauuuaggauuuuucagaauuuuuugaguguuuugucaaugcaauaaaggcaguuuucuguuugucggugucucuguuuaaaguuuugugcuuuucuuaauaguuuuuaaucuaucuuuauacacuagagauucuuuucuacuauucugcuucuuuucccuuuuaauuuguguguuuuauuugcauauauuacauauucuuguaaaagaaaaaauagucuugcaauguaccuuucacgaaguaccucacauaaccauguuacuuugauuaaaaacuaaaacaaguuuaauuuaauacaaugcuguagagcuacacuuuagucuuucucccaguuugaugcuccaagagccuguccaauaucuaccaucacgcucauucagcaggaccuugguguccugucaguacugucacuggaguugaugcuuuuaaauacuuaucaaaugucagugcuacucugggucuguauaacauucucucaaaauuagaauaggguuacaggugucguaaaugucauuaaggcaaggugcuuuucucauuuucuuccaucaccauggugucaacuuuacaugauuaaauagcucacuguaauugacccacuauuucaccuuuauuagaccuaguuauuaaaagcaagucaccaggucuggccaacauucggagaaugaggaauuucauucuaucucuugcaaagaguauuagagacucugugaauguguuaaaaucacuaaagcaauuaaaauuuauuuugggacuaaggauguaguguaguggcagaaugcuugucuagcaugaacaaagcccgggauucaaucaaugucacuggaaaacaacauaacuguaaaauggacaauacaaucauauaugauaauuaaaugaacaaaguggcuuuuuaguuuauuguauauguucaacauggaucaauaaagagaaugaaggaauaauuacaaaaaaaaaagauuucaccuacuaauucuauucuagccuucauccacggaucuuucaagcauuucuacggugcacuucugguuaacucguuccuucuacacuuacagagaucacuuuuuucaucucacuuucaguuauuuagaaauacagacggacuuggcaacuguguuucugggguauagcugaggauuauuguuuuguggcuaaccuuuuucuacuuuagccacuuguacaggagcccuuuagacaugcuuuccauuuaguuccuuuuagguucaucguguaguuucccugugcuagccccagaagcggccauucuuccaaggagccauauucgcuuuuauuggcagacuaacaguguuauauaugaccugggcacagaguguguucuuugccacaaaagggucacugauaacauauccuuucugcagguagaacuaggaaauauguaugucuauaaugaaagucuauauacauccauguuucaggguuuguaucuuuaugcagcuuaccucgaguuuauacuguuucugauuauccuuacuuuguccucagcucccauuuucuaguauagauacugguuuguauaauccuugauauacaguaccccugugugaaacaaaauuaucuacaagaauauuguguuuaugucaguauuuuuucucuagguuuucuuuaguccaaacauuauuuuuuaaagcaacguuagcaaguuccuccucccccagaccccaccuucucucuucagugcucuaucauguauucacaacacacagucuacucaccauagucuauuaucugucccaggauccuccaauauucuaguugauugcuggacauuauuccacugcauaggugggacagauagacacaccacgauuucuuuauucauuucacuguugccaucuugguuauaacuuguuuggugcaacuagagguaaaauugcuguauauuuuugugugcagauuuaugugaacuuaaauaucccauacacugagucauaaaucauauguguguuuauaaggcuaugaaguuuguucuucagagcaguugggccacuuugcauucccaccucgggcacaugaggguugcagucauucugccuccuugaagugcuggcuguuacaagguuuuaauuuaaugcuuuauccaucuucaugauaauuuucaggguuaucucacugaagcuuuaauauuguauuuccauaaagaccauagacuguggcugagcacaauuucccaugcuuauuuguaauccacuuuuuaagauggguuguuugcuucacuguugucaaauuaugaucauucuucuuuauauacucuggguacaaggcccuugauuccauuaagugauaugcaguaaaucugugacuugucucauugccuucacaaagcacagcauuuuaacagucagugagccuguuccuccuugcuucuguugcuacuuagaaaaaugcacuuguugcaggaauaacucauuuguuucuaauuauaauaaaauugaguccccucccccacuuggauuaaguuuucgguguugcaucucaauucucuuucaaaucuaaaguccuagagauuuugaaguuuucuuaacuuuuuuuuuaguuuuauguucuauuucagauuuuuaaaagacuauauauaguguucuuguauuuccauuguaugacuucuaaacauccuuugcauuacacauaaaugcuaaauguguuaaaauuuauauacacauacagauguaugcccacauuuguauguuuauauuggaaauaaauguaaaagacugcuguaguaguugugggaaacccauuccauaaaguaaaugcaucacuguaaaaaaaacaagacagucuuuaugauaaaacaacggaguguuaaaaagacaaacauagaccaagaaaguuauuuaugcuucauguaacacaagguuauuaucucuaaugaauuaaaaguuccuuugaaaugccaagcaaagguuauuaacgggcaauucugaaagaagaaucccaaacaagccagaagcagucagugaauaugaaaaugagaaaaccaucccccucucacaggcccaggaccauuauaaaaggggaugggaggacuguaagagccagagauaggcgacgacuggaacaaacuaacuucugggcaugacaggacaguugcaugauugccuacacaagaucaagccagucaacacuguaucauugaguacaagaauuucacgaaccccaagagguucuugaaaagcuauggacaauuaauggcuccugggaaaggagaguuuuuccuuaacauucuaacuccuggugggucauucauacugcaguauuacagcccccacacccagaauuacauggagagcacaaacugaaguugaugaauuauugaauuuuaaaacaagaggauacaaaauugagaaguuagaaggugguugaggaucaaaguucguugaucauagucucaaagaacuaauaacaauuuugaaaaugagaaagccucaguguuuauccaugcuuaaaaggccaagcaaaauugaaggggaggaauaguuggcuacaacuuaacagaagaacaauccaaaaacacuuauuaauauuaccaaagucaugcuaucucaccugcccaguauaucaacaacuuuuaacaacgaagauggauauuacaucacugucugguugucauaaaacuacaagacugaacauccauaaaauaugggaugaguaaaguuaauugugguagaccuaagcuaugggcucaugugcugcuaaaaugaucauuagaugcauagcugcauaccuaaagaaaagaaugucgcagaguaagaaaaacugacaagaacagaagucugcccaaguuuaugaccucacauuugugcuaccagaaaagccagggucccgggcagcagaugauuccuauaauugaggaccacugugaauuuuucaauauuccacucaucagaaguacuuaauacuauauuagauacuuuaaaggagaagugaguugagagcaaacacuaguaagcuggaaaugcugugaagacuaaucuggaucagugcccugagcuauggaagucagcuauugggacagucuggaggccucccucagagagaacccgguuaauaaggcaucaugaccagaacaaggaauucagcuugugauuccugauaagcagagguacuagcaccuuuuguugcaugguccacugaucugucaguguaugugugugaauagcacaguaguggagaucagugcuuucauuuguucuuggcacaaauguuuuaugugaagcuggugagaggccuagaacuuaacauacauagggcagaaccuuacucaguccuggaacucagccccagggcagcuacaacacuggggagaauguaccagccucuaugguuuacccugggaggcuaaguccccagguaccuggggaccaaucaauaagugaaugggcauaagugaauggaauaagugaaugcccacucacuuauuccacucaguguaaaccaaccugauggguaaggcuaaaacuuccaagcucuguccucacucuucaccugaucuugagagcuuacagguuuaucccauagcaauagcagguugggguggacauuugagucuaguucuguccaguucuggauccccuucaugaucaaguuucuauugaagccuaaugagcuguccccauaccuucuucacaguaaggaagagcccuacacugcuggaaguaagcacaccccauuucuugagaacaaacagcuuugcagaggaccuggaccuggaaggggagacacugcugacccccaucacccaugugucacagugaguguccauuugcccucaaaggcuggggcucaagggaacugcccuagcauagggcaaagcuuauccucuugcugggaugcagucuauuuacccaguacccacaacucacugccuauccuuaugaaccuggggacacuggcugcuggggcuggccucagggcucaggcaggagagaagggcaggggcuuucccacugaaucuggaaacaugauccucuuguuuugacuuauggaaaaccagacugaucauuuuccacuuguuugcaugcuuugagcgucugagaaacuuggguugguuuuguuguuguuguuguu

SEQ ID NO: 4228 - RNA, 3101 nt, Mus musculus
ugcaugugccuggcauccccgaggacagaaggaaggaucaauccccuggaaacuggaguuucagaggguuguaagccgccacaugggugcugagagacaaauguagguucuuucuacaagagcagugaguauucuuagccaccgagauaucccuaaccccgguuacaaccauccuuuagcugcagugccucaguugugaggcauuggcaccugcagcuuuaccaguuuggagccggccuggaaagaggcuggguugggucuucucacagcugccaguuaguacagacuaguaaguggcucuugugaacaauagauccagaaguuuacaguacacuuaggaggagaagaggguuugccucagagaaggcugcuugggagaguaaguggguggccucuaauacuggguuuccuuucccugugcuugccucugauaucagccuuugccaugguccucuaugcugccuggccccagaaagucugggucaguggccagaguccagacucccaggguccugaucagagucuucaggaaggccugagagauuagagcacagaacucuccuagccucucccacugggaacugaaagcuucccugagccuuuccuagggacugagacccuuguuugcaauuuaaaugugcccuccuuuauggaagaaucccagcuccuugaagagccuugagcucacccucccuagcaguuguagccuuagccaggggaagaaacugaucuaaugggccuuucuccuaauaaugcuaauuguggcaauuaggcucugcaauagagaaggggcagggccaggcccacuaguuugcccuuagcucaaauccaggccuucuuacucaggcugcuguccagguuaacuaagccuggugaagguacuaaauaagcagagguucagcagagggugguugaagccugcuggcuuccaggggcaaucacaguggauauggaucugagucuaauguucagucuaguauucauacaggugacucugggccuugccaugugauccucccagaagagggucuaacuggagcauaaagaugguuugaauuaaucaauagaccaauaucuacccuuuccuuucucucucucucucucucucucucucuuucucucucucucucucucucucucucucucucugugugugugugcacgcgcgcgcgcggcgcgcgugagagagaaagagagagagggggagagagagggagagggugagggugagggcgagggcaaaggugagcaggggagggggaaagaaagaagagugagcaggggaccauggauaagggcuuaucuggucuggcaggaaguuagguuuugaagcauauggcucuauggauuaagaaaccauuccucaguauggccaauuaguagaucuaauccccucaaccuccuaacauauacuaaaggaucaauguuucuucacucugcagggucuugcuuacaaagcacucuggguccuguucucucugggagcugggaaucuggucuaaugaaaggaaacacagcacaggcauaggcagccugaaugcuuaguuauucaaagguuacaccguagcugacuuugaaucaguauauagcgucugcacgguacggagacuuuccaggaagugaauuauguguaggaggcagggaagugauuauugcuccauuuuauagacucagccauuccacacauacuuguugaaaguccaccaugcaucgcacagcugucucgaggagggauuuuacaggagucaggucacgccuguccuauggugcuuguguguuguuauacacugaagggaauauucuuugaggucuggagauauagagaaaggacuauuaggaaccagccagaacccaucugggauccuaguuaggcacuaagaccaagaggacacuguggaggagggaacacgagagaaagaagcuagcuuucuaaaccuggguacagaucuucaguccuugcuuccugugaggaucuuggguuuguucugagaccacugagagcugcuaaggcucuaaguucccauuccauuuagaucccauuccacucagggaacuaaguggaauccacauuuuaaaaggcucuuccuccugaguggaggggaauggagguuaucagaagguguuguggccucccagaggagugacaauacaaaaggagggaauggguagaggggguaagcagccuggcuugguaguggacuaguugggucucagcuaggaaagaaggcguuggaagugauugcaggguuucagguuuacacuacuggaagaauuuuuguuugggguggagcaugaguuggaggaguggaguaugaggugacagauaugguggguccagcuauuggaaagcuaguuuuugucaguccaggagcuccugaugcugagggaagggaccagcguagggaaagaagggcagcacuacuuagugggugugaaacugggugcagagcuagcauggugaccggggauagauggacaggaaagaggaacccauucuugcagaggucauguggagucaauguucuagucuuaugaggguuggcaguggacagcaaccagccuagaaugugccuccugccaguaugacuaugacacuugccuuccucugugacuagagagaaggccuuauuucucagugguucuguuuucucucugcauuccuagaaucaagaguagcaaaagaacauuucuccauagaaugugcagggagggucaccucccucaggaggccucguccuugcuaaaguauuucauaaucuuggaacgauggaaaauccuucuacccauuuuaaugcaaagccgggcaagcuuuaaaaaaaaaaaaaacaaaaaacaaacaaauggccuugaauaggcugagaugaaaagcaaagagguugccaacgcuagagacugggggaggggugugcagugggcagggagauuuugggaggcuccaaaguuagcaguuucugagcuuuacugcucaaaccuagaggcccaaaccaaacagagcagguccaggguucaaggugcaagggggcaacagcccuguguggaagaugucucuuucuugucauuguuccugauuagcuguucaaacagccuucacagguucugca

SEQ ID NO: 4229 - RNA, 7834 nt, Mus musculus
ccaaggagaaauccuacuugucuaagaacuguuguucaaaauucucuuggauucaguuaguuaauacuguaaguggaccuucaucuauguucaccagggaagugccucauaauuuucuuuauuugugcucuccuuauuugaauuuggacaugcucugauucgaaauuuuaaaagauccuucuagcuggagcacaaaucccaaaacagauccacuuuuuuucuucaguguguuugguaacacauuaaaauagaacuauaaucaagcaauccaauccuuuaaauuuuucuccuaguaucuggaaaacaggugcagaaauggaucauuuaagacaccauagaaaucugguuaauccugccugccugcuuuccuucagcaaguauugccugaggauggcuguguauuaggcccauggcuggguggggcaagcucuagggaacagaacagaaaagguuccuuuuugguagugccuaacaaagggcacacgguaugagaaaagauuguuaaaugcauauuauuuguccuuauuacuauugagaaauauuuuacacuuuuuaaucauuuaagauaagacuauuuuuaccucuaugaauuacuuacucccuuuuaugcccagaaagguuacagcggaaagcacuccuccccauuuuacagaaaagggaaugugaccaacaagaacaacaaaauggaggacuaagguuugggcccuggccuugguccuuuaaaucaacucugacccacaugggaccccaugucucaaaaugugauucccacuuguuaaaaaccagacucuuuauacuucaguccugaucccuaccucagaccauuaugcucacacucaaaaccaacuuuaauucuuacuguacugcccagucagguccugaauauaacuagaaacccucagucugguccccaacagagaccugagccucugggaucucaauuuaaaaccacagaaaagaaucaaaucccaacugaaaaucuggagguaacucccaguucugcuauucccccaauucagaccugauucugacucugcaggucucaacgugugggucgugaccccuuuaggcuugaacaacccuuucauagggaucgccuaagaccaucggaaaacacagguauuuacauaaugacucauaacaguagcaacauugcaguuaugagguagcaaugaaauuaauuuuaugguuggaggucaccacaacaugaguaacuguauuaaagggucaaagcacaaggaagguuaagaacccacugcaaccacugcggccuccaccccaaguucccaaucccccacaccugaauuccgagucggcuccagacccgaaucucuacccgauuccaaucgugacuccacucuagacucggaaccacuguagacccacacauacacacacccaacucggauccaagagcuagaucacaacucgguucaaaacuccgaauaagcagccuuccccagccucaguuccacgauacccuucccccaccaugcgcgaacauuccgaacggagccccucacucucagcauuaaaacagcuaccacauaacaacacguacuccacucacuaccuuggugcuggccacaccgggcuacaaagcucaggggucuccagacccgauucgguuucagcuccagugcguucugacucggcccgggguuuagaauccgaaggccugagccgguguccuaggccacucaccuugggacucgaccgaccucggggcucaaagggccucaagaccaccccugcuucuguaagccugggccacaaagauggggacguggacgcaaaauacgagaacugagccacggccgugaaacgaggaccggccgugaaacgaggaccgagccguaacugcaaaacgaauacggagccacugcggcaaaacgaagauggagcccagccgcgaaagcgcggcacgaaucaccucugcuucuggccgugagugcuugccgcgaggagggggaggcuaugaugagcgcggccacgcggacuugcgacuugugccgugcugacucagagaagaaacccgcgcugagaaaaaaaccauaccuaggagaaccaugccgagaaaaagaagcgcugggaaccaagcugaacagaaaagcucuccaaguagaaucacacagagggaaaagaagcguguugaagaaaaacugagagaacccagcaggcuaaaaaaaaaugcugagaagccaaguggaucgcgccaaggcagccgaccgcgcuggagugauccgugcugaaacgauccacacggaagugacccaauugcugaggcagaucggaccauaucgccgaccaccaugacgaaacaagauaagaccucaccauggaggucuaggcucaggacaaacacugaggaggaucgcguugagcaaagcacacugaggauggcuagucgggacugagguguagugcucaagugauccgagcagaggcagcuccaaaagaacuguggacaaauaugcugaggcugguggcuggcugauaugaccucaccgugaaaaaccaugcagaggacgaucacacggaugaaaaccacgcugcugagacgagccacgcugggaaggaccaugcagagaaaagcacacuaagguguacuagaccguaaccacgccgaggagaagcccaccgaaguaauccaaaaugaggccgaccacaccgggccugacuggaccaaaaugcaccaucauagaccacgcggaggggcgccgcaaggaaagcugcgcagacgugcugaggcaacuguuccuccuagcgacaacggcuaggccaccuaccaagaccuuggugacguggcagccacgacacuguugauuggacagaugcugaauaaugacuagggagcucuuccucaugauaggcuggauacagauagcucugugcugacuauuuuuauuggccaagaggaaacagccugaugucuccagcauuuggauugggugagcuuguacaggauuguacgaccuagccugcuggguccaccaccccuuaaggccuaccuuccucaucccuuccuagcugaaccugggguucuuaacucugaauaagugugagaccaaccucaaugcaguacagggcagauaccugaggcagccaauguaccuaaacgguuucauggccaaagaugaguaugccccuggcucuggccugaccuugggaugcaaaaaagcaauccacccucucagcugucccauggaauccuacugugcaggccaggguguggucaucuaaagcacacaaggaggccacccugcuuguuuuuuuuuuuuuaaucaccaaguaaggaaagucuuggggcuaucuuacuuaugaaaaggagggggcccugggucugcccauguuauaaaacuagguaaugauaguccugagguuagaccccagccacucgacccauccuccagauucucuugguuccuggcccugucacuggaguguucaggaucguuuccacucuguccacuuacuuauccaugcauuuauuugacuaacacugucuacgcaccacccuguaucuagcauugaccuaaagccuggagaaacuugacaaaaugccagauuugggggacaauccacuugcccaggauucauaagcaagccuggggcgaggggggggaaugcagauuucugugcaaacuauaguuuuagcauguggaacucuggguauauucuccaaaccaccccuacccagaauugacuucaaacaggauuuaggggaaggggagggagagccaguccugugaacaggccaggguguggucaucuaaagcacgcaaggaagccauacaucuuaacugcuuuugcugaaaauauaugucuacaaaaacagccaggaagcucucuugccaaagaugacugaguauaugugggggaaggaggggaaggcacgguuuuuagguuuggguuuuuuuucuuuuucuuuuucuuuucuguucuuuuucucuuuuuuucuccuguuguuauuuagcuggagaaaagagaaacuggugucauccucuagcaacagacaguuccuuuuuacccucagaagcuacuccuagcuugguaccccaccuccuaccaggccacacaucugcuuugccaauuccuuuugggcccgucuggaacaugcugcauuugauucaaagggccaguccuacccuccuaccugaugggugguuuucuuuucugccuaucccagagcagaugugcaguuaauggggucccucaagaaccugucaccaucuuuaaauucaucauauuagcuuugagcuugcaucuuggaagugaagccugggaucuuuugccacaaauggccccuuccacuuccccagcauaagugacuaggcaccugcuuccugccauugccagccuuccaauugaccucuaagaggggcaucagggccacaugguaaacgugguuaucugcuccccuuggcugagaucagggaacccucucugucuuguuucccaucugucuacuagagaugcugcugcugaaccccaugaagcugcuaagccaggcaccaagagaaugugaaggggccauggggcucugauuugaaacccugcucuuccuuacucuaagcacugucccagcuuagcucugaggccuaagccuuuguuugccuccucuggccuagaaggccaggcauuuuccuuggauccuguuccugcaggccuguuucuugcagggaagguaaggggaguggaacccccaguucuuuagagacuauccacauguuuuaccaaaacacaacucccaguaagaaauguaggcaccuuuucaaaauguuauggauguucuuuuuguuugguugauugauugguuuuguuuuuucuaggcaggguuucucuauguagccuuggcuguccuggaacuugcucuguagaccaggcuggacucuaacucuuggagauccuccugccucugucuucuaacuacugaaauuaaaaguguguguuaccaaccgccuguuauggauguucuuaauccaaaccaaauggguagaucucugcugccuagggaagcugugucuuacaaagugccuugcugacccuccaggccucaccuguggguuucccaaaggucuguuuuauucaaauaugugaguaagcucggaagcuaacugaagcaaggucacuuagaggagugacaccuuccugggagcuugauagggauucuaucuugauaauggguuguuuguuuauuuguuuuggguuuguuguuguacuuguucuguucuguuuuguuuucuaagacaguguuucuucgaguagccuuggcuuuccuggaacuagcucgguagaccacgcuggacucacacucacagaaaucugccugccucuuccuccugagugcuggaauuaaagguuguauaucacaaccuccccaccaggcugagaauaguuuuguuuugguuuguuguuuuaauuaugaaaauuuaguuuauuuaaugguauacuuaaagucugaguucuaauugugucuuuagucaugacauacccaacaaguagauucaagagugucuguugucaguuuguagauucugggcccucaguucugucccuaaucaauuuccuuuugaugacaucugguauauaccucacugugcuuucaagaggucuccauaggucaaucuuugaagucgguuaggccaaaaaaccuguccuuuuccuuugggucauaggcucaauugacaccacccucuuccggaucauggggugcugucaaacaacuagcucugccugucaagcucaguauagcugcuauaugccacccccaaacccugccucucuacucuuuucagggagaccagagaggauagagcuugaucugaauguauuugaugucucauugagaaacaagacguauagguguuucuggagagaaaugggagaccugggucgauuccagacugauuggagggagaauagagcuggucugaggaaucaaagaauuugggggaaaggcagcagucauggcucugaggguuguacuagucccuucccaggccggggccagccuagcugaucugugaucaggguugucuuuggguauagugccuacauuuccuucccuuccagaggcuaagggcuguggggaugaggaugcugaggcagaagcagagagcccagcaccuggugcucuguacuugggcuuccaugugacagaggcaggucuuguccuccuccuguaucugguuuaugucaucugaacauagugggggcuggacuuaacguuccuuguguucccuccaacuccaacauuugggguucaaaagguucccucgcaggccucugcauccgagaacacgcacacauacaugcacgcacacacagcugaagagaauuaggcugcaaacggccacucggcuuuucucuugauuccaagguauuuagagugggggugggggaugagggggaggaaguugcugagcuaauucuucggcauuugccagcacagaagugcagauggggcccagagccccauggggucccaagggaaacaccagaucucuuccacacaggcaaggaaggagaaagggcugcagugggagccccucauccaagcagcaacucagcaggcccuggccaagggguucugugggccucacuucuccccacccccaucccuagagucuaaggauagaacuagcuucagccagguuaccaaguuacugcuuuucuccaaagcagagaggcccagggccacguggcugccugguuaggccaucuucugggaacaggcguugcuguaugcuguagucugcacucaacggggaccccauguuaucucugaguggccauuugcaaagcuaggaaagccauucuuaagguucacccuugcagacauuauccacagacuccacagccccuccucauuucccuguuaaugcucaaacaugugcauguggacaucucacgcuugcacacacacacacacacacacacacagucucugucugucacugucugucucugucucugucuuucucucuuuuucucucucucucucugcagaccuaggugagcucccuguaauuuuccgcauagucaauguguuugcugcagagccuuccucuucccacaaccucucugucucuugagccuacacuccaucuggaucuccccaccaaugugucuuuguggaccugcugauaacuccccauccauccuugagguucacagaucuacuuuucuccugcagaugcuggccaaugucccuguggcccuuguccccuuguucugucugcaucccuccuacaaugagcagguucugggcauugcccuguaggccgagguuggagguaagggacaaugagcaaucuuuagggacuccuuagagggaacuuuccuagaaagauuucucuggcugcuggauagaaagacugaagggugugcucaguggguucugugggagauuugacuuucugcagugggaaaggaggugauuuuagaggaagguaguauccaugaaagugagaaggacuggacuagggguaucuucaugaagaggugaccuugauuagacuuuguagcuaagguuagaccuuuagccaagugguaauguuguggcagugggcaagcgggcaagcaugcaggaaaguaagggucaaugucaaugcuaugucuuaagaaagucauggccuggggcuggagagauagcucagcaauuaagagcacuggcuacucuuucugagguggguugaauuccuaguaucuacaugguacuucguaacuauuuguaacuccaguucuggagugucugacacccucuuugccuucauguaucaggcaugcauagacaugcaugcauguaaaguaccaaaacacauaaaauaua

SEQ ID NO: 4230 - RNA, 7834 nt, Mus musculus
uauauuuuauguguuuugguacuuuacaugcaugcaugucuaugcaugccugauacaugaaggcaaagagggugucagacacuccagaacuggaguuacaaauaguuacgaaguaccauguagauacuaggaauucaacccaccucagaaagaguagccagugcucuuaauugcugagcuaucucuccagccccaggccaugacuuucuuaagacauagcauugacauugacccuuacuuuccugcaugcuugcccgcuugcccacugccacaacauuaccacuuggcuaaaggucuaaccuuagcuacaaagucuaaucaaggucaccucuucaugaagauaccccuaguccaguccuucucacuuucauggauacuaccuuccucuaaaaucaccuccuuucccacugcagaaagucaaaucucccacagaacccacugagcacacccuucagucuuucuauccagcagccagagaaaucuuucuaggaaaguucccucuaaggagucccuaaagauugcucauugucccuuaccuccaaccucggccuacagggcaaugcccagaaccugcucauuguaggagggaugcagacagaacaaggggacaagggccacagggacauuggccagcaucugcaggagaaaaguagaucugugaaccucaaggauggauggggaguuaucagcagguccacaaagacacauugguggggagauccagauggaguguaggcucaagagacagagagguugugggaagaggaaggcucugcagcaaacacauugacuaugcggaaaauuacagggagcucaccuaggucugcagagagagagagagaaaaagagagaaagacagagacagagacagacagugacagacagagacugugugugugugugugugugugugugcaagcgugagauguccacaugcacauguuugagcauuaacagggaaaugaggaggggcuguggagucuguggauaaugucugcaagggugaaccuuaagaauggcuuuccuagcuuugcaaauggccacucagagauaacaugggguccccguugagugcagacuacagcauacagcaacgccuguucccagaagauggccuaaccaggcagccacguggcccugggccucucugcuuuggagaaaagcaguaacuugguaaccuggcugaagcuaguucuauccuuagacucuagggauggggguggggagaagugaggcccacagaaccccuuggccagggccugcugaguugcugcuuggaugaggggcucccacugcagcccuuucuccuuccuugccuguguggaagagaucugguguuucccuugggaccccauggggcucugggccccaucugcacuucugugcuggcaaaugccgaagaauuagcucagcaacuuccucccccucaucccccacccccacucuaaauaccuuggaaucaagagaaaagccgaguggccguuugcagccuaauucucuucagcugugugugcgugcauguaugugugcguguucucggaugcagaggccugcgagggaaccuuuugaaccccaaauguuggaguuggagggaacacaaggaacguuaaguccagcccccacuauguucagaugacauaaaccagauacaggaggaggacaagaccugccucugucacauggaagcccaaguacagagcaccaggugcugggcucucugcuucugccucagcauccucauccccacagcccuuagccucuggaagggaaggaaauguaggcacuauacccaaagacaacccugaucacagaucagcuaggcuggccccggccugggaagggacuaguacaacccucagagccaugacugcugccuuucccccaaauucuuugauuccucagaccagcucuauucucccuccaaucagucuggaaucgacccaggucucccauuucucuccagaaacaccuauacgucuuguuucucaaugagacaucaaauacauucagaucaagcucuauccucucuggucucccugaaaagaguagagaggcaggguuuggggguggcauauagcagcuauacugagcuugacaggcagagcuaguuguuugacagcaccccaugauccggaagaggguggugucaauugagccuaugacccaaaggaaaaggacagguuuuuuggccuaaccgacuucaaagauugaccuauggagaccucuugaaagcacagugagguauauaccagaugucaucaaaaggaaauugauuagggacagaacugagggcccagaaucuacaaacugacaacagacacucuugaaucuacuuguuggguaugucaugacuaaagacacaauuagaacucagacuuuaaguauaccauuaaauaaacuaaauuuucauaauuaaaacaacaaaccaaaacaaaacuauucucagccugguggggagguugugauauacaaccuuuaauuccagcacucaggaggaagaggcaggcagauuucugugagugugaguccagcguggucuaccgagcuaguuccaggaaagccaaggcuacucgaagaaacacugucuuagaaaacaaaacagaacagaacaaguacaacaacaaacccaaaacaaauaaacaaacaacccauuaucaagauagaaucccuaucaagcucccaggaaggugucacuccucuaagugaccuugcuucaguuagcuuccgagcuuacucacauauuugaauaaaacagaccuuugggaaacccacaggugaggccuggagggucagcaaggcacuuuguaagacacagcuucccuaggcagcagagaucuacccauuugguuuggauuaagaacauccauaacaggcgguugguaacacacacuuuuaauuucaguaguuagaagacagaggcaggaggaucuccaagaguuagaguccagccuggucuacagagcaaguuccaggacagccaaggcuacauagagaaacccugccuagaaaaaacaaaaccaaucaaucaaccaaacaaaaagaacauccauaacauuuugaaaaggugccuacauuucuuacugggaguuguguuuugguaaaacauguggauagucucuaaagaacuggggguuccacuccccuuaccuucccugcaagaaacaggccugcaggaacaggauccaaggaaaaugccuggccuucuaggccagaggaggcaaacaaaggcuuaggccucagagcuaagcugggacagugcuuagaguaaggaagagcaggguuucaaaucagagccccauggccccuucacauucucuuggugccuggcuuagcagcuucaugggguucagcagcagcaucucuaguagacagaugggaaacaagacagagaggguucccugaucucagccaaggggagcagauaaccacguuuaccauguggcccugaugccccucuuagaggucaauuggaaggcuggcaauggcaggaagcaggugccuagucacuuaugcuggggaaguggaaggggccauuuguggcaaaagaucccaggcuucacuuccaagaugcaagcucaaagcuaauaugaugaauuuaaagauggugacagguucuugagggaccccauuaacugcacaucugcucugggauaggcagaaaagaaaaccacccaucagguaggaggguaggacuggcccuuugaaucaaaugcagcauguuccagacgggcccaaaaggaauuggcaaagcagauguguggccugguaggaggugggguaccaagcuaggaguagcuucugaggguaaaaaggaacugucuguugcuagaggaugacaccaguuucucuuuucuccagcuaaauaacaacaggagaaaaaaagagaaaaagaacagaaaagaaaaagaaaaagaaaaaaaacccaaaccuaaaaaccgugccuuccccuccuucccccacauauacucagucaucuuuggcaagagagcuuccuggcuguuuuuguagacauauauuuucagcaaaagcaguuaagauguauggcuuccuugcgugcuuuagaugaccacacccuggccuguucacaggacuggcucucccuccccuuccccuaaauccuguuugaagucaauucuggguaggggugguuuggagaauauacccagaguuccacaugcuaaaacuauaguuugcacagaaaucugcauuccccccccucgccccaggcuugcuuaugaauccugggcaaguggauugucccccaaaucuggcauuuugucaaguuucuccaggcuuuaggucaaugcuagauacaggguggugcguagacaguguuagucaaauaaaugcauggauaaguaaguggacagaguggaaacgauccugaacacuccagugacagggccaggaaccaagagaaucuggaggaugggucgaguggcuggggucuaaccucaggacuaucauuaccuaguuuuauaacaugggcagacccagggcccccuccuuuucauaaguaagauagccccaagacuuuccuuacuuggugauuaaaaaaaaaaaaacaagcaggguggccuccuugugugcuuuagaugaccacacccuggccugcacaguaggauuccaugggacagcugagaggguggauugcuuuuuugcaucccaaggucaggccagagccaggggcauacucaucuuuggccaugaaaccguuuagguacauuggcugccucagguaucugcccuguacugcauugagguuggucucacacuuauucagaguuaagaaccccagguucagcuaggaagggaugaggaagguaggccuuaaggggugguggacccagcaggcuaggucguacaauccuguacaagcucacccaauccaaaugcuggagacaucaggcuguuuccucuuggccaauaaaaauagucagcacagagcuaucuguauccagccuaucaugaggaagagcucccuagucauuauucagcaucuguccaaucaacagugucguggcugccacgucaccaaggucuugguagguggccuagccguugucgcuaggaggaacaguugccucagcacgucugcgcagcuuuccuugcggcgccccuccgcguggucuaugauggugcauuuugguccagucaggcccgguguggucggccucauuuuggauuacuucggugggcuucuccucggcgugguuacggucuaguacaccuuagugugcuuuucucugcaugguccuucccagcguggcucgucucagcagcgugguuuucauccgugugaucguccucugcaugguuuuucacggugaggucauaucagccagccaccagccucagcauauuuguccacaguucuuuuggagcugccucugcucggaucacuugagcacuacaccucagucccgacuagccauccucagugugcuuugcucaacgcgauccuccucaguguuuguccugagccuagaccuccauggugaggucuuaucuuguuucgucaugguggucggcgauaugguccgaucugccucagcaauugggucacuuccguguggaucguuucagcacggaucacuccagcgcggucggcugccuuggcgcgauccacuuggcuucucagcauuuuuuuuuagccugcuggguucucucaguuuuucuucaacacgcuucuuuucccucugugugauucuacuuggagagcuuuucuguucagcuugguucccagcgcuucuuuuucucggcaugguucuccuagguaugguuuuuuucucagcgcggguuucuucucugagucagcacggcacaagucgcaaguccgcguggccgcgcucaucauagccucccccuccucgcggcaagcacucacggccagaagcagaggugauucgugccgcgcuuucgcggcugggcuccaucuucguuuugccgcaguggcuccguauucguuuugcaguuacggcucgguccucguuucacggccgguccucguuucacggccguggcucaguucucguauuuugcguccacguccccaucuuuguggcccaggcuuacagaagcagggguggucuugaggcccuuugagccccgaggucggucgagucccaaggugaguggccuaggacaccggcucaggccuucggauucuaaaccccgggccgagucagaacgcacuggagcugaaaccgaaucgggucuggagaccccugagcuuuguagcccgguguggccagcaccaagguagugaguggaguacguguuguuaugugguagcuguuuuaaugcugagagugaggggcuccguucggaauguucgcgcauggugggggaaggguaucguggaacugaggcuggggaaggcugcuuauucggaguuuugaaccgaguugugaucuagcucuuggauccgaguuggguguguguaugugugggucuacagugguuccgagucuagaguggagucacgauuggaaucggguagagauucgggucuggagccgacucggaauucaggugugggggauugggaacuugggguggaggccgcagugguugcaguggguucuuaaccuuccuugugcuuugacccuuuaauacaguuacucauguuguggugaccuccaaccauaaaauuaauuucauugcuaccucauaacugcaauguugcuacuguuaugagucauuauguaaauaccuguguuuuccgauggucuuaggcgaucccuaugaaaggguuguucaagccuaaaggggucacgacccacacguugagaccugcagagucagaaucaggucugaauugggggaauagcagaacugggaguuaccuccagauuuucaguugggauuugauucuuuucugugguuuuaaauugagaucccagaggcucaggucucuguuggggaccagacugaggguuucuaguuauauucaggaccugacugggcaguacaguaagaauuaaaguugguuuugagugugagcauaauggucugagguagggaucaggacugaaguauaaagagucugguuuuuaacaagugggaaucacauuuugagacauggggucccaugugggucagaguugauuuaaaggaccaaggccagggcccaaaccuuaguccuccauuuuguuguucuuguuggucacauucccuuuucuguaaaauggggaggagugcuuuccgcuguaaccuuucugggcauaaaagggaguaaguaauucauagagguaaaaauagucuuaucuuaaaugauuaaaaaguguaaaauauuucucaauaguaauaaggacaaauaauaugcauuuaacaaucuuuucucauaccgugugcccuuuguuaggcacuaccaaaaaggaaccuuuucuguucuguucccuagagcuugccccacccagccaugggccuaauacacagccauccucaggcaauacuugcugaaggaaagcaggcaggcaggauuaaccagauuucuauggugucuuaaaugauccauuucugcaccuguuuuccagauacuaggagaaaaauuuaaaggauuggauugcuugauuauaguucuauuuuaauguguuaccaaacacacugaagaaaaaaaguggaucuguuuugggauuugugcuccagcuagaaggaucuuuuaaaauuucgaaucagagcauguccaaauucaaauaaggagagcacaaauaaagaaaauuaugaggcacuucccuggugaacauagaugaagguccacuuacaguauuaacuaacugaauccaagagaauuuugaacaacaguucuuagacaaguaggauuucuccuugg

SEQ ID NO: 4231 - RNA, 1487 nt, Mus musculus
gcggggcucaccggagaugagaggccccgacagcuucuugaucgcaccguucgcauuggccgcagcagucccgggugcaggacguccuggaauccccgagagaggcugguccuucagcuccuggccgcgcugcucuugauucucguccugcuccucgaccggcuccccauucugcuccucgaccggcuccgcacccugcuccucgaccggcuccgcgcccugcuccuccuccggcuccucguccuucuccucgaccggcucugcgcccugcuccucgcccugcucagagaccggcucaguucccagcucaucacccggcucagcacccgacuccucgcccugcucagagaccugcucagggaccuguuccucgccgucccgagucgccacguccggguucgcguccgggaucggguccggagucgggucggaggucgcgaccagggucaccuccggaauugggucugaggucagaucugaagccggggccggggucgcggguggggugggcuccgcgaccacggccgaggcuggggcgcugggcggcugcucaggcgccuccucuaggccgucgggggccucgccagccggcggcccagaacgcgggaugacagccacggccaccggggguggccggggccccagcugcaggcgacagcgccccaccugcaccgucucgcgguagaaggcgggcacagacucgcuguccaccuccauccacugcagacgaccagggccucgaagaggcacauccugcuggaaguugaagucccagcgguucugguccucggcguucagcucggccaggcgcauccgcagcucgcggcccagcuccucguggucuacaggcccgaagaggcugcggcaggcgcugcuacgcgcuaucacugggaagguaucgcuggaggccaagcguuccaucgcuguucugcugcggagguacacgucggacaugcccauggucgaaggcugugcaaacgcgggcagcgagaaagaagggaacgggaggagaaggaagaggggagaggaggagggcggaggcugggcgugggugagaccccuugcacagcccgcguccgccucugccuaaggacgcagcggcuaccuggcugauuggugauggacggcuccugcgucuggaucgcuuguccuguccagcuugggccgcgcccccucggagcuugccugccuguucgcuugcucucagucgggccuagccggcaccccucgagcacagcgcacucggccuguggaacgcccagcccgcugcgccccuuuauacgcgcuggccccacccccgcgcgcgcgggccuccucacgauuagcauaauguaguauuuucaguuucaacaacaccgcggcgauuggagggugcagcccgccccgcccacagaggcccugcccccgcgccacgcucauuggcugcgcgcacacacccccggggccgggcggggcgggugacgggcgggcgcugauuggcggccgca

SEQ ID NO: 4232 - RNA, 35626 nt, Mus musculus
ucucaguuuguguuucacaacuuuaauagaauauccuaacuauucuguacaaauugaaaacaccguauucaguuacaaauguguuauuggguaaggcugagcacacucuacauggcuggucacuguggacauggcuguccuggcuaccagagacaccaccauacucucagaaacaccccuccccccacacacaccaaccaccaacuggucaccaaacccagguguggcccuggugugcacaguacaagcugaagcuguacuccacaggccagagaucccuagugaaggagaacuucuguccccuggcuacagccugccaacuuccagcggcaauaacauguagucugcauggcacagcacagcacagcacagcaguugguggcaggaagcagcagggcuuccuccaugagccucccuccacuuggugucacauccuccugaucaagucagcaacauggucucguaagugggaggacagugaaguccaaagcuccccaagcacaaguaaauaaauaaguacgagggugaacccgauggcucuggccucagaggugugugccacaacccacccaccccuaaaaccaaaacgcaagaaaaaaaaugcucuaaggcgagcacagcuuccucuacagugcuugggcgaugacuagggcacagcagcuggagcagcuucccacgcaguucagcagcuggaaaucauggggccuugccaguagggagggccgggugcacacaaucacaggcucugucaaucccaggcacaaccucgguccaccccaagugaucuucaggcaccaaagcugcaggugcuacaacuaaucuccuauucugaacugcagcagucuccacuguacaaguuuagcaaaguaagaagggaaaggggagaggaaucaugcacuuggaaaugguuagaugucacagcacugucaacaaaauucugcuuuggcagggacugaggccccugccugcggccugcgguccugacagccauccacaaggcggccccacagggucacugcuucucacugcugcuugcacuccgcuggcuggcuggguucuuucugcaagaauacagaauuugaagagaauaaaacaaguaucacucaucaagccuccccuucccauaagaaccaagacccaaugagcucauuccuucuuaccaaaaagauggcucccacaaauggacuuuaagagcugacccagaaauaggucagcuccccagagagucccaggugucugcuuuccuguucuaauaauguaaagucuaacuuagaaugugcuagcagacacuugcuggggccacuacaaggaacuagccacaugagagucuuugcugcagguauagaucacaccggcugugccagcaaccuccucucucuagggcagcccaguccugggcauucacgcagugaaggcaguccuuccgagccggcuggugcucucugcaauacccaaacagauucaacuccagugguucacagugcaggaguaaauggucagaggccaguuccuauagagcaugucuaucagucucacagagcaugaguccagaucacaccugucugaagaacaaggugacuucaaucuaaccuaacacacaaaccuggugucuuuaaaacacauccaagauuugggagcuuuguauguaggacaauaaaagccugaggacagacaaggaccuuacugcugccucagagcuaaaauauguacucaacucgccugauuuccagaaucccugggaacuacaacuucaaaucacagugguuccaggcugaggcagagcaaugcaugcucaaggccagucugacccacacagcaaggcucaugucuccaaguaacaaagacuagaaaugcagccuagcagcguagcacuugucggguaugcccgaggcccugggcuugguccucagcaccacaucaaaaaaucuauuauuuuuagagaaggacuguguaugaaccccuggcugaccuugaacucacaaagaucugcuugcauuggucucucaagugcuggggaaaaaaaauuacucuuuugcuuugagauagggucucacuuauguagucuuggcuguucuggaacuuuguaaaccagaguggccuugaacucacaggaaauugccuguuccugcaucuugaaugcuaagauaaaauguguguuuugccuacauguaugucuacacaccauguauguuccuagugccaucagcagucagaagaggagguggucagacugcuuggaacuaguuacagagagcugaauguaagcugccauguggaugccaagaacuucaacuuuggaagagcagcccgugcucuuaagcuaagccuaucucucuagcccugauaaaauacauuuauuaaaaagcuauucuguguggugugguggcacacaccuuuaaucccagcacucaggagguggaggcaguuggaucucugguguuugaguccagccucuauacaaagcaaguuccaggacagccagggcuguuuacacaaagaaacccugucucaaaaaaccaccaccaccaccacuaccaccaaaaaaaaaaaaaaaaaaaaagauugacuauggcuaugggaguuuguguguguucuaagaaaaaccugcaucacauguauguuaacaccagaaguaccuaugguaugagaccagaauccaccuugaagcaucacacuucaggggcaaaaauacaauguugaggcacacgagagaaucuuggcuugguuagaccucuacuuuuuccaauuuaaguuuauuuauguaugcugugucugugugaggauagguaucagauccccuguaacuggaauuacagaugguuguaagcuauuguguggauauugggaagugaacccaggaccucuagaacaacuagugcucuucaccacugagccaucucuccagccugagaagaacacagggauauaacuaagcccuccagguuaugguucccaccccuguguuucaggggccuuguaagucaacaaggaacccaagcccagagaugcugugcuauucucagcagucaacuucacuguauguggaauuaacucaaacccaagcuguugggcacuccugugggggacuuuuuugaugggauuauuugaaguggaaagaccuaccuuaaaccuaggccacagcuccuagugguaguuuauguaaaggacauggagaaagaaaguuucugcucuuuaccugcuugcccucacugucaggcaaguccauuccuucacuggcguuagagccuauuucuuugggauggugacauauacacaaaaccagcugagacacccaacuuuguggaccaaguaaggaucaaauguuugaacuuuccauugggagacagucaguucuagaauaguugaaucacagacuauaagccacucuaauaaaucccauuuauaauggauucauucuaucaguuguuucucuagagaagcucaauucagaugccaaucaagcaagagcugucaaaagacagccaaggcuagaucuagagguagucaacacaguggucauggucacuaaccuacugaccuagagagcaucagaggcagggugucccaagcgaguacagcagggauaggagagaagaaggcaagcaaugcacacaagggaaggagugggagcucuaggggcugggaugcaacgggggucucccccagcacagaaaaauaaaggcauugcagguaaaaaacaagugggcaaggauuaggugccucccuaccacggccucagaacauaggcauccugaacuuuauccuguuacuuaaaggaagugguauuuugaccacaggaauguaaaauuuuuugucuucaaaaaaaaccaaaacucgaggauguaaaaauccaaaacauaagccauagcaguuuagguaaugaagcuaccgaggagaauaaucuuuauuaggguggcagaagaggccauuggaaagguaagaacagugaggcagcagguuuacacaaggaaaccacagcuccacaccccacccaugccaggcaguaggcagcaguguccacuuaugcuacuacugggauaacaagcccuugaaggggauuuugcaaacgggacacuggcuuuggccugugacacagucagaaacuaaauugccaacugaacuguagcuucugcuacaucacaaaucuuaaugacaaauuggccggccccucaacauuagcacuuaaaaugcauuaagucggucaaaaccucgaucaccacaggccuacaugaggugggguuaucaaaagcauggugggccugagaaagguggagcugaggucacuuauauacuccacuaugucagcugcacuagagggcaaggcccacaccaaagcuaccagcaaguggacaugcaccauaguucugcuacuauggccucgauaaagaggaauguuuuaacacugacagucaacuguaccuaacagcuagagugaagaaggcccagagugagcccaucaaagacaacaggacuaggcucugucagacuccugucacucuggacaauuccuuauaaacuguugccuacaaauaaaaaaaggcaggagccuacacaugagauccuuguggugccucccacucugccuggccuuucuuccuuuucuuacugcauuagauaugugcaaaagcugugagcaccccacagggaagacucugucacugacaagggccuccccucgcugcuaauuacuuauaggugagugugaucuccaaacuaaacagggaaaacaaggugcccuacauuguguccacaacuggcucugucauccuccaaacaaaucuugagauggggcuuuauaguggccaugcuggcagguacaccaggccaccugacaugaucguuuuguucacuuacuggucuacccaaugccugguagacaccuagacaaauccagagcgacuacagucacauagugucuuuaagccuggugcaguguagacaacaggcauuuuucuaucagggcuuuuuguccagggugaccccugaggcucuuguucuguuaccagugacaaugcuccccacagcacagcucauugcgcaguuaucaaaaacaccaggcccugaagguaggagcugagucucacuguucugcugguuuuacaaaugcauuaacuguggagccaguacaagugccacucacaaggcccagaggcagccccagcuccuauacgaugcaauggaucacaucuuucaaugucccagaagucaaaauaaucaacgaaucaauuacagacagcaauuuggaaguuagguaugaacagauuccaccuuaccuagaaacgcaugaaugauuaacacaaaaauuacaccuaaauggggaaaaaaauugaaaaggaacugucagcaugaaagaaaaugaaaugcacaaaauuauacaggaggcaacagccacauucucaagauacaagagcuuccaguagggguaggagcagcuucagcgcaccagagcugcaugccuucccgaggucaaacuuuauucccucuuacaauaaacaacucccagacaacacugugugcaguuuuuuagugaugauucuaguuaccuuccacuuuggagggugcacaugaagccacagaacaaucacaccuugaccuaaggacagaaggaccaccccuuggguugccugcaacaacagcucuacacuguacccccauugccuacuucugaagcuucuuuccaccccuagacaaugcaaaaggucaaguguuugugggguuuucuacuaaucucaugauaaguugggugagaggcucucuucaaaaacggggauaugagaggagacagaaggcaaagggaaaacaacaggaagaagaaauaaaugggagaggggaugcaauggaggcuaugugagacaagcacagcacagaagccaaggugcaccaaguuggaacaugcaugugacaagcugcccuggucccugccaacuguacugugaccauguguccauccucugcucacagagcaugaauagccaacaccccgaggcucaccagguaguauagucuccaugacccaugagugaccuuuagaggggaguggcauucgugugggugguggcagcuuucccauuuuucccucuggaaacuucccagugugugcaugcauucucagcagcacagcagucacaccaccaagucgcugcacugacagcuuuuagcacacacuccacccagggaaaacaaggacaacagacagacacuagccagucagagaugcaaggcacagggacaccaggcagggaugcauuccaacagacuccacacugucaaacacaggaaaguauggcugcacuagagcagcucagggcauccugccaucgggugccaaagcccccuaaugaagagucuccugagaccacagagaaaaccccaagcuuccaggugaaacugguggugcagauugucguuucuuuugccagucuuccuguccugcaacaaucacuaugcauauguauauguacauacgaugcuuuuuugucaaucuccuaagcaaaaauucugauuacaagcuaauuuucuuuacuaucgcacacaauccauaccaggugcucugcugaugcacacgggugcuuccugucacaacaucccucuagggaagagcuggaagcaaugcauguucaagucuacagagaacuaguaacaccugguuggaucugacgccuaauguuccaggcauaugaguugccuuuccucaacuguggauuuucugacauguauauucuuagcaucauugccucaaagugggaacagcuucaaaagucccaccgugcaauacugguaggcucaggacguccccaaauuacuaaccuugggguuaacaucagcaucauccucaucuucuccuucuucaucaccuuccaauuccuguauuagagagacaaaaaaaugaugacuagggugugaccaaagagcaucaccugaaccuguacaaaguaacacacagcuuacucugcacaacacuugcuaauucuuacaaaagaagccagguagggaugcacucuaacagacuccacacugucaaacacaggaaaguauggcugcacuagagcagacacucaaugcuuaagagcacagacagcucuugcagagacaaugaauucaguuccuagcaucuaugucaggcagcucacagacacugcaaacuuuuguuucaggagaucuaucugaugccuucugcacuccacaggaaccagcacauaugcaugcauaccaggacagacaugcauaaucuuaaaaaacaaauuauuucuuuaaaaagaaaaaaaaaguaguugaauaggcugaucuagaagcucagcuuccuguggugucuccuucccacaggcaaaucacagcagaguucugcauuagggccacaggcacuaacaauuacucuauaucuuuuuguuuucacagauaauucugaaacauuucuaaaaaaaaaaaaaaaaaaauucagacauuccuuauuaaauggcuacuaauaugcauuuaaaaaaaauuauuuauuuaacaugccuacacugucacugucuucagacacacagcagaagaagacaucagaucccauuauagaugguugagucaccuugugguugcugggaauugcacucaggaccucuggaagagcagccagugcucuuaacugcuaaaccaucucuccagcucuaauauacaucuuuauacacaauuacaggaucaaaaucuaugggcaccaaaaccaaaugguuucaaaaucgccacugaaaccaagcaagauccuuggacuuccuaacuucaagcagacaagggaaaaccacacaaggcuggaguaacaacacaacacugcaugacucccuuccuuaccuccucuucaccuuccucgccuucuucaaacugcagaggaaacagaaaaacaacuuaaacuucuagaacuuguagccccaaugccaagcugauaagcaaccugcuaggcuaaagguagcaugaaguuuggugcugcuacagaagcagugauggcuccagguacccgugaggcacaugcugcuguugcaggcccagcagaucagucagcacuguccugggacugaaaguugcucaagaguuaaggauggggaggggugaugacuugugacugaacaugcuggaauaguucccuuucuaucuucagacugaaacagaggcaacaggagucauuugggaagagggacucucaacugagaaauugccuccaugagaugugccuauaggcaagccaguaguacauguucuugauuaaugauuacugggguagggcccagcucacuguauguggugucaccccuaggcuggugguccucagugcuacaagaagacaagcugaguaaguuaguaagcaguauuccucuauggucucugcaucaguuucugccucuagguuccuaacuuuauuuuccuggaugauggaagauccagguaagaucaaacaaacccuucaucccgaaguugcuuucagugaugguauuucaucacagcaacagauacccaacuaaaaccaaggcuaaacuaaguuaaucagcugcuuaguugcaugcaaaaacuuuggcauuucacaccucagauaguggagugggauggccuuuauuagguuucuuuuuuauauauuuauuuuauaagcauuuauaaaaucuugguguuuagucaaaacuaaugugaaaccacaaccaaggcucugugucaauuucucugucuaauaguuuuugaucaaacaauuucaaguuccaaacacgagcgguuccuuaagcuggucacucuaguaccagugauuacuagcaugagaaggccccugauuugccacuuagaagaccacucgcauauuccuuugagacaguaugaaagugcaacuucaaaaagccagaacccacuggccuccuggcacuacaaagcagcaaggagggaccgagucacaaaguagugucuuucccccauggcaucuaagccgguuucuaaaagacaggccuuuuguuucuuuuaagaucagggcuucccuauauagcccaaacuagucucaaaacacucaauucuaucucaaguuccugagugccagggugacaguuguacugcaugaauccaagggagaagcuacaucugaacuagcccaguguuauuaucuuaagauucaaguccauuucuuuccucuggagcuugagaaaaaaaucaucuggugggguaaaaaggguccacaccaagugcaccucccacacugacagggucagcugcuucccccacuaacaacccucuggucuugugcccaguaguaauguguuucuuuuuuuuuuccuuuccuuucuuuuauuuuuuuuuuuuaauuugguuuuuugagacaggguuucucuguauagcccuggcuguccuggaacucacuuuguagaccaggcuggccucagacucagaaauccgccugccucugccuccugagugcugggauuaaaggcgugcgccaccaugcccagcaguaauagguuucuuacacuugcuuucagugccuggugaguaaggcugcuguagccagcuccucaguuuggggguagaagagacuauguagacccucaccugcuauccuuaaagcauaagcucacaguaucacacacucucuggcuugaacaagaaaauccacacauauaugcacaugcucacacugcuggcuuaggccuuucagaccccaugucaaguaugaagaccacugaauugggggcaaacuuuccaaugacucuggcuaacuucaacaucaguucuaccauuauagcagcacaugucaguggugcacacaguuagcccuacugccacccaccaucuugagaaugcugccuuagaauuguugugcaacuagauuguccuaaaaccuaugccucugcacugcaggaaacaaccaaugcuaagcaguauccacaaguaucucugccuaaggaacaagcaagacuuuuugaagcuaacacccacaagaacaaucaggagagacagcccuccaugcaucagagacaggccauuagaccggccugaucaccucacuccccaucuaaagcaccaacagacucaugagcucuucaaaugaagguuaacaacuugacaucuauagacugugauaacuuggcaacaacccaagccuuagccacgaugagauccugugccaggucacauuaaaaguauagccuacuaaguaauaccuggaacacaucacaaaggguaggaggcucuggugcugggcacuacuaugacacaugcuaguauauccacuacuaguaacugucugguauggcccaaucuccauaaggaagggcuucuucauacuggaguuugcucaaguucucagguuuuccacagaacaguuugacccucagggucuuaagaaggcaagguuaaaugagucacauucuagcuucccacguuacugaggacugacagccucaugggaaauccccuuugccuacagcuucuaggauucuccuccccuuagucuacugucguaagcacaggagagcuguagggccuugggucuggaugaauacacagcucugggccuuccagguaagagugucuaagcacccacaggucuaagcacccagguaaccaccccucugccccacauacauugucaucauccucuauggccuccccagugaaguagaggacagcccguggcacgaugcgcucacgaaaaaagugcccaauuucaaagucagaggcuaaggugaacucggaaucuucauccugagaggaaaccaauaguuaacucauuucaguggguuaaagacacguucaguacaccccgcccucuucuucacccuugcuucugaaugaucugcacugcugaguaagucaccacauucaaagccacuuacaauggccuuaaagcuaauguucaaauuacacuacaaaauuccaugaaaacaauaaggcagguggguggcagcucugcugcauguccuaugcuucagaguacaggguuggggucucuacugaggacuaaagggcaggcauggaaaaaaacauucucaugagguccaagguauaaugacuucacuuuaacuacagaaacuaaaggagaaaacggaucagaaagagcaagugcuuauucaagaaauacuugacagaaaaucagggcuuuugacaauacaucuuaccagagauucuccaucuccagaggcuagaagaagaaaagaaaacacacuuauauuacaacgacaccaauguuuuaacauccacacugaagggaaaucagcuggcaagcagcucucucagaccccaacaaggcaccgagacaccuugugaacauuucacaagcuccaucuguuacaauuauuucauuuagauaaggcagugggucaaaaaagcugagaguuuaaaggaugagcaggagguaggugaaucagcugcccuacuggaccauacagagacugauccuguaugcccuucaaugcugaaugguacauguuuaucugcuauggggcaaagagaagaauguacauucugcugaugauccugcagauggguuugcagccuuucacccaaagaugaugcauccauaggggucuacaugcaagaccaucaaaguggugcugauauucaccaggucaaaaagaagaugugggcuucuugccacaccuccaugaaaccaaacaaccauuaccugacagauaauuuggaccuugacuagcaauagguuggaguagaucuaaugcucucuguuuaacuguggugucagcauuucucacagggcucaugucaguuguuguuacagccugacagcauucacugguagaaaaccacaguauuggguguaugaacaccaccuacaagaggcuguuaccauguaggcaaggaacagucugagggcuggaccccgucucccaagugacaagcaccacaacacaugccuuccaggccaauucuauaggcugaaggucaauguaguagugucuccauccuaaaaucuguagcccagccccugagcaccauccuccuuccuuuccugguccuagaacucaucacuguuacauguugccugacugaaauuguagccacuuauuuucuccucuucaacuuccugaaagcacuguuuacaguuuuauauucauuucccuuuaaaaugcaggcuggaaacugaauaagcuaauuuuagaguugugccacuauaaaacaucaccccuaaaaaucacaucugcuuauaagugaauuccacuuucacuguugcuuuaggaacacuuuuagggagcuaagcaugguggcacuugccuuuaaucccagcacucaguaggcagaggcaggcagaucucugugagucccagaacagccugguauacagaacaagucccaggacagccagggcuacccagagaaacccuaucucgaaaaaaacaaauaauaauaauaauaaaaaagaguaguuuuagggaacuuccuaagauagggugucacuauguaacucuagcuguucuaaaacuuacuauguagacacccgacugucucugccucccaaaugcuaggauuaaaggcgugugcacuaugcccaucaagaagccaacucuuaaaggcagggauccuccaccugagccccacacagccagccugguccaccauguaugucaguguguacucuaaaggaauuuccucacacaggaaacuugagcacuaagcucuuacuugcuaacagaacauacuuuguguuuuguagguucaaaguuaaaucauagaaaauggccauuacaaugacaucacccaaaugucccaugaggcacacaugguggacaacagcagcaagcucuaagacaaagcaaagccaagugcccagaucuaggacuggaccugccuaagguuccccaaacaacucuacauuggaggauaaucuuggcagcagggaugaauauuuauguccaaagauggucucuucauggaaagcgacaagaaaaugccucauacccauucucuaacacuaaggaaaggucuagccaagcaccuuccccaucauacaauuacugugggacugccaagauaggaguccccaaguggacugcaguuauuacuaggcucaaugucccaucuuuauuauauagcucagaaaacuagcaaaaagcuucaauguuauaauucuguuucuagucuuuaaaaauguuaucacauagaaauuccaaguaaagcccugugcucugucgaacuguacaagacuagggaaaacugaauuuauaagaaaaagaaguugggggcuggugagauggcucaguggguaagagcacccgacugcucuuccgaagguccagaguucaaaucccagcaaccacaugguggcucacaaccaucuguaacaagaucugaugcccucuucuggagugucugaggacagcuacaguguacuuacauauaauaaauaaauaaaucuuuaaaaaaaaaaaaaaaaaaaaaagaaaaagaaguuggacuggugacucagguuuggaacugugacuagcgugagccaggaacgguccugccuaucccuuccauaugccaaaaaaguggucaucuucuccugaggugcacacacuauuucuaagagcuaagcaaguaugagggaauggaacaacuuuacagagaacacagagcgagcugccccugcccaccuuucagggggcugaagaaguugaagaaggacucauugggcacuugcuuggugaugguucguacggugccccggcccuugugcuucugcuuuuucuugaugguuuugacugugacauuuuuuccuuucuuccagucuauuguacaccugcagagacaagguaacuguuauagacauuugccccaagagaaaccccacuacuguccaggaaggaagccagagccauauguaacaucugacaccacucaucugcaaaccagggaaaaggaccccaaaguccaucuguaugacagcuuacaagagcuagccuggucccaucauccuugaauaaccaaugcucaaaagccuuacagcucugaaaugacaacagcauucuuccacaauaguccauaaggauucugaaaugucuucugugcaagacacuguaaguccacagaaugcucaagaacucaucaccacuccuuaugccugagcacaccuaggguuaccacucaugcacuccaauucagaaaucaacuaagugaacaggacagcaggggccacugucucacuucugguggcagcugaaugauaucugcucaggaaaacaugaaaaagcuaagcccucuccuacaugucagacuggcccuggaaaaagaucuccccuaaccuaacccugaguacuccaagccuuuaaaucaaguagaacuugaaugaagcccaaaaucauuucgugacauuaacaacacugagcugguucuggugaguguuuuacuucaacaauuaauuuuccaaacagugagacacaaccacaggagucaacuucaagcugaaucuccacugagugaucuagaaacuuaacaccgucauuuaucagguagcaaauucggugccauauuccaaagcuguaagugaacugugacauggauuaaacuucaucaaucaacaaauacuuuuccucguaagaguuuggggcuuugcugggcacgaugguagcauagcauuuaaucccagcacucuggaggcagaggcagguggaucucuaagugcagccuagucuacagagcaagcuuuaggcaagccagagcaaccuaaugacacccugacuaaaaaaccacuucugcuggagaaauagcucaaaagaccaguuuuugcuucccagcaaccacacaguggcaucacaaccacccucaacuccaacuucagagcaucugaugcccucuuucaaccucugugggcaccacaugcaugugguacagauacaccugcagacgcaacacucauacacauuaaauaaaaauaaaucuuaaaaagaaacuuggggcugaggacacaagccccaaggacacuuggucuucuacguaaagauccuagauuuaauauccagugucacaaaaaaacaaaaacccuucaauuccugguugucuaaagaauucaaagccuggccccauucaaacagcaacugaggauaggcuuccaaguauaucugaaccuuaaggcacgacacaccuuccaguuuuagccauguccacacugcagggucccaacuauaagcuacggcagacaacuucugaagggcuuuuaagugguuccagacuuuaaaauauauuuuuaaaaaaauuauugcuggguagugauagcacacaccuuuaaucccagcacucgagaggcagagacagguggaucucuguguucgaggccaaccugguuuacagagggaauuccaugauggagaaacccugucucaaaaacaaacagaaaaauauuucuguauaguucuaaguacaaacucuguguguguguguguaugugugugugugugugugugcguguguauguuugacucugcauacaugcacaggccagaugcagacagaagaggguaucagcuguucucguccucuccuaacacucucacccaauccuuugaagcagggucuucuugaacccagggcuccuguuuucuugacuaggcugaaagcccacaauucccagcaaucuuucuguccucuguacccucaaagcugggguuacagacauguggcuuguuauauaagugcuggaguuugaucucugauccuuagucaucucuggccccuaagacuuuuuuuuuuuuuuuuuuacaucauucucguuuuugauauuuuucuuuguuuuacagagaucuuccuguauauagccuagccuggccuugaacgcucaugcaccccuacaucugacuauuuuaaaauucaaaaccauuacugcuguuguugcagaaggacauguucuuacccaucacaguccacaauuucaggaccuucaaaagaaaacgggucggccuugucuggcucugauuucaucuuguacguuuucgucaggacaggauuggugaaguagucguuggguucaaagugaaacucuagcacaaaagacugaagcaaaaauccagaguaagaacuaccuaacaucugcacaaagaacuuaaggaacuaacucacaacgcauuacauagcccuucaacaugggcuauuucaccuuguaugaaaucuggaucagauuuuguguuuugcagugagugaaaacaggauccuucaugggagguaaauagagaagacaguguuagcugcucccuugaagcugcacaguaacucacagaguacacagggagucaauauuugcagaaagacagguauaucaaguccaauggcaucaagaaaaaaacuagccaauucacaaauauauaaacaaaaaaauaaaggaaaugggcagugguggugcacacaccuuuaauucuacuacuugggaggcagaggcaggcagaacccugaguucaaggccagccaaggcuacacagagaaaguugguuuaaaaaaaacaaaaacaaaaacauacaaacaaaaacaaaacaagcaagaugauuuucugaggcaaaauguaccaaaacaaaaaccucugugggauuaggcaaugucucucggacauaucaugcaaccaaaauaauuaaauaugucugaccuccauaaucaucaucugugauuuuuuuggaggaggugagggugggggaacaguccacucugauagagagaaugaauaucuuguguguuguauagaugcaucaccugucacuuaaaaagccuauggccuagacaggaaauagagguggaacaucugggagagaaaggauucugggauaaagccagaagggagacuggccaggaagaugugaggacacaugguaccugagcauaggcaaccaggcacguggcagaauguaagcaggaaugaaugggauauuuuaaguuauaucuagucagagaugagccuagcuauaugguaaagauauuuguaaauauauuuugagucuauaucuuacuucugggagcaugggacuggaaggaagaacugggccuaacuucaaugcacucuagccuagcugaucaugcucacaguaaccauugccucagcaggaguacagccccaacuaacaugcagaggaagauaagauuggcugggaauggauggaaucaucagaaaucaaacaagguacuaauaagaaaaaaaaaggagagagagagagagagaaagagagagagagagagagagagagagagagagagagagagagagaaaccugaucuagcugagaguaggugagcuuguacuuuauauucuaagcaccuggaaggcugaggcagagggagagugccaucauuuucaggccugccugagauauagugugaauagucuauuucaaaaacaaacaaaaaaaacccaaccagucaagguagcauacgccuguaauuccagaacaugaggagcagaaacaagagggcuacaacuuugaaaucagcuuagucuauauucuggguuagcccaggcuacacuacaagacccuauuucacaacaaugaaauaauucauaagaagguaaaaguacaauugagacuggaugaacugaaaguaaaaucccaccgagcaucuccaaucugcccauccaggaaagguagagaucagguagcacagccagagcuuugggugggaaagagcuccuguggccacgugaacaagaggcaaucuucagaguagacagccaaauguuaacguuuauaaaaggaaagugggaugggauguauacagcugccccuaaggacugauaaagaaaucccacccacuguccuaucuccaccuguuaaccagggacugggauagaaaugagaaaauuaaaaccucuagcuuccuccgucaagaucccuugccuaucuccuuuuagugugucuccaagaccugaaacugaaagccacuagccagccagucagucaugugucacuggaaauccuguagcacuggaauggaacccaccagccacagcaaggcugacagguuacgaacagugcugaguagaaggugaggcccagcacauccuaguaagcccaucuucccagaggccagaccacgucccauguuugaagccauuuugggguaguuucagucacaucuacauuggucauuuuaaggaaguauuuuucuuagaaucuggauuucugaaccaguguuguccauguuuguuuauguuguuuccauucuuuuaagaagagaccucaagcggggugugguggcacacgccuuuaaucccagcacuccggaggcagaggcaggcggauuucuguccgaggccagccuagucuacaaagugaguucuaggacagccagggcuaugcagagaaacccugccucgaaaaaaaaaaaacaaaaaccaaaaaaccucacugugcugugacucaggcugaucccgacuccuauacucaaguaauccaccucccuucucggauuaugagcccaugucaccauauccugcuacuucccaggugacuccuaggaaaaguaugguaugucaaucuucuccaccaaacaagaaaauccagcaacugaaucagaggaugaccaggugauaaccacagcccagcagucaaggcaaggucagcguggcaccagccuguauucagcuggcuacucagcuuugggacaugauaugguccauguuauuggcuaaaugugcccauuaccaacugcagcaacaagagaagucugaugagcaggcauccucagggcugcccaacucuugaguaacaaaaaucagaucuuuugcaccuuagucaacuaguaaggagcuuggucacuacucaccauagguuguccagggucugaaaacuucacuuuaauauccugcagauguuucaagaucgguucaucauauuccuaacaaagaaagagagaacccugaacaacaguccaccccucauggcagucauagcugcaugugccccagaugcuggguugucucuauuggcauccugucucuguccuguaguaacuucuggaaagcaaugccaauuuguucacuauguaucucugguggcggcaguaacacaccaagaaucagcugccaccugucucuagagugucaucaaugcuggcuacagggaagucccaggcucuccugccaccaucugacccuacaguuggcacagugccaccaaccaagacuucuggccuccaacaucuaaaauagcaaaguaaaaggcuuggcaucaggggagauggcuaaauuagcugcuggucuuccugcacaguauuaacuagggacaauuaauaucccaaaucugcauaugccacuucuguaagaacacagaaaaugucaaagccuaacauauaggagccaacagcucccuuugcucuaugacuuacaaugacuauugcuuagacuuguacaguaaagagccuacaugagaaaaagcuaaaggaaugaagacuuggauaccugaaaugacauacuacuuacagguuagaaugguaauucauucacccuaagguugacauugagucucagaauuuaaaguuccaaaccucuaagaacuaagcccacuaaaggccacgccccaauuuugagguuuguuuguuuuuuguuuuuuuuuaacauuacagaauaaaaacaaaucauaccuauuagcuauuagaaaaacaaaacaaacaaaaaacaaaauaaaaaaccagaccacaccaaaagcagucacaugucugacaccaauaaaggugcaugaaccuacacuaauaugccugccaugcuaugcaucugaucugaauggccaucccagcagccuaucaugcaucuacugccaccccaaaugggaugucugaacaucagacgagaaccaauauggagguaugagaauaaauacaugcacauacacucccauuaaaguaccagcacucucuccaaaagcaaagcaaagcaauguuaccaacaaguccuaaugcccccaucccucacguuuaucagagcugccagaaagcugaccagaccacacauacaacagagugacuccaagagauaagcagccuaguaccuaaaugcuauacuggaagcuauacccucauuacaacugaguuuuacuugguuuauccccaccuagcagugugagcaacaacacccaggagcacaaaagaaaauacaacugucccaccaaccugacucaaccccccccccuuuaugcauacuucccaucccauaaagccaaacaggacuaugagccaccuggggcauacauugaucaugugaggagauucugaaaacaccucuccccagauucccuguguucacaggaggaaccuugugaacaaggcuuuggugugcaguucugggcucuauaggagguauaggagagaaaccucucaagcucuugugugggcagaauuauaagccuugccaaguaaugccaaagaaaauucagccuucuucaacaaaggucuuuagagcaccgagggaucagggcuacugcccaagugccagcccccaaaaggagacuuuucauucaucuuaaaaugaaucccgccgggcggugguagcacacgccuuuaaucccagcacuugggaggcagaggcaggcggauuucugaguucaaggccagcuuggucuacagagugaguuccaggacagccagggcuacacagagaaacccugucucgaaaaaccaaaaaaagaaucccagcagcacccaguuaagcagcgaguaaccaccaccagccaagcucucaacauacaagaaucgggcaucaccccagucucccccaacccaccugcucaccagguagaagcaccucaccugcaccagcucacuaagcauguccacauuucugaagauggugaaccagaacucagggaugccuuugggguucagcucuuccacuguugcugcuucuuucucagcuaugacuacuuuauucuucauaucucccuacaaaucagauuuuaaaagucuuugaaauauggaagggaacacagccccaggaggaagguagguuaaaggaagcugaaccaaauggauucugaaugcuuaucaugaugccugguaagucagaacaacaugcagagaucuuuaaaucaucaaaaugggcuuuucuuggaucauuaggaacaaacuaauguaaaaccacagcuucaaccaaguucugccaaugucuaaaagcagaacacuggcugggugugguagcauaugccaucuaugugaguuuaagaccagccuagucuaacaaugaguuccaugucagcccaaguuacauaaugagacccuguuucaaaaacaaacaaacagcuggcauuacguauauccauaaaaauuaaacauauuuccaaaaagaucacugaaagauaguucuauugaaccaaagcuaucuguuaucuaaacacaaaauuaggcagacagaggcuuugguguaacucggugguagaacacuugucuuuugcaugugugugucuggguuacaucccuaguaccuuaaaaaaaaaaagcaaagcaaaccuccagaauacaaguuaaaaugaaccuuguaccaugcuagaacuuuccaugguauguggaugagacugucacagaaaguggauacaaugucaugaugcuggucaaucaguuaccugauggucuaaagacagagugaggacgagcagccugaggcuccagauggccccucgauacacgugccuuccuccccacugaggaggaagauguauagcucccacccauuguaacccccaccuccucuagccuuggacucucauugauuagcuuuguucuagagacagagucucacuauguagaccaugcuggccuggaacucaagaaucugucugccuaacucucuaaugcugggguaaaaaucauguuccaccaugccuugcacacuacaaccaauuauugccugccugaucuguauuucaacccuaugcugcacagaccacuaagaaagaguaguaacucacuugucauggcaacuaagcacaguugccaugugccucagaugccacagugucaucauaaacucaugcacccaguggagagaagggaacuacuauagucccacucuacaaagcuuuguggacagaaaccaugaagcagagcaagcccuugaggucaucuccuaauaccacaaaaauaacuaggauuaaacaacaguguacagcagaaacuuacagccaacuuguccuccuccucauucucacugugccacgcugacucugcaucugugggcuccacgucaccagugaugaauucucuucucuacauaaaaagccaagaguccaucagcacauuaggcucucugcaaacucaaaagcuaagauguuuacacggaccucugccaagacagucaaauucccugggugguaccgugucucacuccagagucacugcaugaagcaagcacauuaacagcacgcaccuugucaaauagaggcugguacaaggcugcauacuuccucuccaggucaugaacuuccucguagaacuuagcuucuaugugcgcacaccucaccuggagcugcuucagggcauuaauucuucuuuugacagcuuuagguaaacuacaagagaacaggaaauaaaacaccuaguaccagcaaacaacuaaauauacacauacaauaagcacccugauuagaaagagcugcuaaaacccuacuugcaaacaagccaacagaaaagaauggacugcuugcugggcaagguggguacaagccuuuaauuccagcagaggcagguggauucucugugagcacaaguccagcccaucuaccuaacuuaacaaguucuaggacagccagggauauauagaaagaccauaucaaaaaagaaaagaaaaaaaucaaucccauaauauaucaaaagcagaaaugggguaucaguuuacaaaauugcucucuugucccaaccaaacuggugaugaaaaacagagcaaagagcacauuugcaaucccaaucacgugggaggcuacaacaauaagaguugcagaaguugaaugcuauucugggauacacagagaccaaggaggaaaaguguaggucaaagguagcacagcaaccuaauauacagauauuguccaauucccaccacacacaggcacauacacccacaaacaccacacacacgcaccauacacgaaaaacaaaacaaguggggcucugggcaugguguuaugcaccuauaaucuuaacacuugaaaaguggaugaagaaggaucagauguucaaggcuuguuuggcuacauaguaaauucaagcucagacuaggcuaccacgcaagauuuuaucuuucaaaaaaagcaaagacuggggcuggaauggcucaacaguacuugccacucuuacagaagauccgaguucaguuccuaacacucacgcugagugacuuaaaauuacucuagcucuagggaaaucagaugccucuggugucaauguguaucuguacucaagcgugcaugcacacacacauacacucauaauuuaaaacaaaagcccaccaaagagauggcucaguugguaagggcgcuugcuaccaagccuaaugaccugagaaguuagguccgugagaaucacaagguagaacgagaaaaccaacucuuuuaaacuaucuucugaccgcuacauacguacaacgggaugaaauaauaauaaagagcaaaagcagaacucccacacaaggacuagacacaggcuggcugacaaggacucgggcauguaggcccugaugcuagaacugaacaugaagucuauggacaaccucauagaauucucucuccuaaucguaccagcuaagaguuucuuugccuugguuccacaguuucuuuucuuucuuuguaugagcacuccuaaaaucaaaaggaaaacaaacaaacaaacaaaacaaaaccaugcaggggaagugguggcacaugccuuuagccucagcuugcagguggcagagauaggugaaucucuugaguucugaagucagccugguuuacagaguaaguuccaggauaaccagggcuacacagagaagcccugucuugaguaugaaaggaaagaaaaaggaauuuaaccuauaaaauuguuucaauuaaaaccugaaaaauaaugccaccaggugaaaacauguucacaguaaauuugaauacagguccacauaaacagccagugcuggcccaacagauaugugaggccauguucucacaagcuaucaucacccugugccugucucaguaagcaaaaccagaaaaccagacaccauucucaaaccccucacuauauccuaccaccuacuccacaaacaaacaaacaaacaaacaaggaaugccaaacagaacuaaaacgaacuguacccacugaguagaguaaacccagaaagguuucuaaauggacacaaggaaugucuccuccuauuguaacagcuaagccuuacccaacuggacauggagccugagguggcucauuucuuccagaaggcaaacagggaggcccugagaagcaaugucucauuucuaccauacaacagagccaggacacaggacacaggcuuccugacaaggguaaaaguacaagugucccacaguuggccaaauagcacucuagcuucuuagcugagucgucuaccagccacguggugguacugugcacuaccaagcagacaagaggagcugcuccugaguuaugaauaacacaauugcugcuccucuaagacacaaagauauuuguucuguugcuuaacuggcuauggacuuacguuucuauguaacuagaaggagugugagagacguugucaagacguuccugcaaagcugccagcacuuguggguucugcaucaccuggucugugaguuuuucuaugaggaguuggaaaugagaauaauuauuuagcagccuagaaccccaacaccaaccuggaucucaggcuggucaacccagcuacucaaaaggcuaaguaaggaaaugccaugccagaccuuccuuaucucaaaauaaaacacccacaagaagcugggcgugguggcacacgccuuuaaucccagcacucgagaggcagaggcagguggauuucugaguucgaggccagccagaucugcacagugaguuccaggacagccagggcuacacagagaaacccugucucaaaaaaccaaaaaaaccaaccaaacaaaaaaaaaacccacaagagugcuggacuguaacucaauaguauacuacuugccuagcauaugaagcccuggggcuaaauccuuauuaccacaaaugucuguuagaaauaucagcacaggcuguuaucucagcacucagaaagaagaggaggacaaucugaauucugggguuaaacuacauaaugaguuccaggacagccagggaugcccagagaucuacaaagagauaucucaaaaaaaaaaaaaaaaaguaguacacaucaccuagugcuuuuaagccagaauuccguauaagaaaagaggcuuguguuggguccagauaagaagaaacuguagcaucucagaccacacuugcuuuaaaauaaacaaauauaaaaauccccaacacauguuuacuuaucuuugcuccuaaauuucuaaauauaguaaaauacuuguuuagagacuuguaucuuaaaaguaucuuuugggggcuggagagauggcucaacaguuaagagcacugacugcucuuccagagguccugaguucaauucccaguaaccacauguggcucacaaccaucuguaauggggauccgaugcccucuucuagugugucugaagaaaacaacaguguacucacauacacgaaauaaauaaaucuuuuaaaaaaaaaaaaguaucuuugggaugggggaaugggggcagggugggagaggcagguagaucucugaguuugaggccagccuggucuaccugaucuagccaguuccaggacagccaggguuacacaaagaaacccugucucgaaacaaaacaaaaaguaucuuuguuaaucacccuagugggcagguggcgacagaggcuccugccuguagccagccuagguccccaagaucacugacuaccaacuuucaggggcugguaauuaacucugguuacaccuugcuccccagucccauugguguuggaagccagggacaaggacaagauuagcuucuaaagcauucacccacuuaguucaaagagauggcuuuccccagacugcccucuucccuagaaagccguuuccccacccaaaccuaccugcaaaaaguacucugaccuucucacaugccuuuguucugaacuuguaacacugaacuauuauuuagaaccugccccccaccccccauaaaaggagacaccaagagaauaggaacuguccuucacuaggugauggaguugaacaauuccucucuuauacaauccaggcccaccaggaacuuaagauucuccugcuuggacucccaagugcuagaauuauaugauggucuacacagccugcucagagacaguuaagauuuuuuccauuuuaucauuauuaguguguguauauauucaaucaaaugugcacugaacaugacugcaugugaauuuacauacacaaacauacuucuagguuuugcuucagaauaagcaggagaggaaaguugggugcuagucugguuaacauucugacacuuaggucauuuauaguaacaaacugguucuggagaagaaacccucucuaaucacugcuucauccacugcacugaccuguauuacuggcauuuuuagcagcuuccacagaaucugcagggccuccaucugaaagacuaaaacaacaaguuuacaaaguauuaugaacagaaucucagagauagaaccaauuggcauuuucaguguuuauccaauguauuagggucugucuguacagcaagagacuccaggucaggugaagacaacacuagcugggcaugcugcaccaugccuuuuauccuagcacuugagaggcaacagcagguuuaucucugugacuucaaggccagccuuuucuacauaguaaguugcaggacagcuagagcuacacaagaccuugucccccacggacaaacaaacaagacaacauggucacaccuguguuauuuaagggagacuuccucccaucuaaacagaucacacccacccagcucccuuuccucacacccaauacaaaggcugcucuaaucuauaacccuugccucauuuuuaauuucuaaaauuaaaaaaaaauaccuuguaugugccaugcauggugauauacaccuucaaucccaacaccugggaaacagaggcagguggauuucuaggaauuuugagccaugcuuguguacccagggaguucuaggccacccagggcuacuacacauugagacucuguccuaaacacaaaacaaaaacaaaacccaacaacaaaaauuauguuuaugaguaugucauauguggauaugugcaacgccaauggaggccagaagaggacaucagauccuccgaacuggaguuugugagcugccuaaugugggugaugggaacaaaaaguuaagucuuugcaaaagugguacauauucuaaaccauugagccaucucuccagccugcuaauuuuuauucugacagucaaucucuugaugauauaacuggucuauagugcuuaagccacuucacuggaacaacaagcuacccccuggucagcagagcacacaaguggccuuguacagcagaugcaacggucacagugcucugccaaccaugcagcaucacuaaaacaauggcuucacaaacacaagccugacuggcuaccaaagagccauguauaccuuccugaagacaaaguucuacaagcccuuccagugcaucucugggacaugaaagcagagggagcuaugggaaaaugaagggcaauuaugaacaaaauuaaugacauacauguaugaaaauggcacaauaaaauuuauuauuuuauauacgaacuaaaaaaaaaaaaaucaaaacaacacucaaccaacacugaccuugcauaucccacuaacaauccuuucccugaucccuggcagguaugucagauuaaugacaugacuucaccaaggguggggaaacagggauuaaaggcuagggagcacagaaacuucaccugagacagcuggugagaucaauuucuuugccagcaaaagggagaaaaaaggacauuaccacuugaaguuuaaacuaguuaacuuugaauccuagcuucugaaauauagcgggcucuagcucaauuccuaaacuuugaaaucuaguaaacaaaguccauuuuggcuuaccuguuuucugccaucugaacgccuuuguccccuacaaaugagaaaguucacaauuacauucacacacacacacaaauguucuauuacucuucccgcaucaugauggcacuccaccagucauggcaguugagaccuuuuugcaggugaaggaaauggaaaugcccugaugugaccugaaguuauacgagcagguacaugucuaaucucauagacagguacacuuaagaucuagguuucacuagacauggugaugcaugucuuuaaucccaaccacuggguggcagacacaaauggaucacuugagucugaggcauaaagaguucuuggcaaauaaugcuacacagugagaccaugugaaaaaacaaaguuaaaaugaaauggaaauuuuuuugagacaaggucucauguagcccagacuggccuucaauuugcuuuguaguugaugacccugcaugucugacccucagccuccacauccccaguacuaggaugacaaguauaugccagcaugcuaggcuuaugcagggcugguauaaaauccagggcuccaugcaugcuacaaacugagcuagauccaaaacauucuuacugacacuaaagugaccagacuucacaguaagaaaacagaauccuaaucugccuucucuuuacaguaaacccgacagauccacacagcaacuuccucaaacaauucaaaagcacauuguuugaacugucucucacauagacagaauaaugcuaaucuaucuuuuaugccaccuacacuguaaaaacacuacgagacacucaacacgaccacucuguaagaauacuugaucucuagcagccgacuuacuucaagagaguaugaugaaugagaaaaagacaaccauacaaagccccucacucuugccaaguguacauaaugagaccuucugaaagcuauacuccugcuaggaaaacaggagacaggaaaaacaguuccagcaagagugaugggcaacugucucacaguuaacuagcugaauuuucuauuagguuuucauuguuucaaaauaaaauaugugcaggugguucaugccuuuaaucccaggauuugguaggcacaggcaagugucuacauauugagguucaggccagccagggauacacaggaaauccugucucaaaacaaacucaaaaugcacaaaaacaugucacaugucuuagguaggguuucuaucacuacaaugaaacaccaugaccaaaaagcaaggggaggaaaggguuuauucugcuuacauguccacauugcuguuaccaccaaaggaagucagaacagggaacucaagcagggcaggaaccuggaggcagaaacugaugcagaggccaucauggaugcugcuuacuggcuuguuucccuugguuugcucagccugcuuucuuauagaacucaggaccaccagcucacuugugaucccaccuacauuggggugggcccuccccgacugaucacuaauugagaaaaugccuuacagcuggaucucauggaggcauugccucagcuggggcuccuuccucucugauaacucuugugucaaaaugacacacaaaaccagccaguacauaugacuaguuuuuuaaaauuuaaguaauguaugaaagcacaaagaguaagacaacaacaguacugcacaugaccaaacccagagcaacacagcagcuucccacacucagcuucaccuucaacgaaccuuccucacacccuagaucuuugcaguccaaacucacuggccacugauguacauuccuacaucuacccuacaaagugaaccauucucaauuccagaaaacacuugcccagauguccaacaaggcuuuucuaccguauacuuuuguuugaggucuccauugaacgccuuagucaaaugugguuugccaccccuugcuauucuuaacuuagauggcaagauuuucauguaacauuucuggguuacaagaaugagcaauaaacacugagcugguuacacacaagcauuccuuacacuuuggcuccacaguuacaguaccccauuaccuaccuauggcuaacagcagcuucucuggacugcauucccagcccaucacccuuucccauuuguacagcaauccucaguacaucagucucaccaccaaagacugagaagccacgcccacuugaagcacuacagugguacagcaagucagcccaucucugauacauucauauagacuauccugccccgugagucuauccucugcacacugaaaccaaggcaaagugccagcacacgcuccagcaccauccauuacuguguuuaccaaacacugaaagucauaaaagaguuaugcaggugucgagagaaacauccaucuuguuuuuaagguuaaaaugacagguuuaauaccgguuuuaugacucuauagcacaaagccuuauuaggcaaacuacuuuuaaaaggcaucaagagucagacauaaugaugcacgccuguaauuacaggacuuggaagguaugguuaugcugaagcuagaggcuagccugggcuacaaaagaaccugucuuaaaacacaaaacauacaaaaacccuaacgaucaaguuagaucaugacagucaucagugauacuacuagaauacagaacuuuagguucauuuccucuuuuugcuccaaacaacaaaaaaacuuucggaaggaaaacauuaaauuuuuauagcaaauuuuaaacuggccacuucuuaaagauuaaaaaaaccaaaucaaacaaacaaacuuuuuaugcauaugaaugccugacugcauguguagcauauaugugcaauacccaaagaggccagaggagggcacuagauccuccugcaacuggaguuaugggugguuuugagccaccacauaagguaaugagaaccaaacccauguccucugcaagagcagccagugcucuuaaccaugaacaccuaaacugccacucccgaaagacaaagaaaggcauaaacuguggaguggcaucacacuucacaaaacccacacuuuuauauauuaucugucuucauaaaagccaaaggucuucaaagccuuaacacaagauaagcacaugauuacuauaaccuaaacuggccuggagagaugggucagugaauaaaggugcuugccacuaagcccgauaaugugaguuugauuacugagucccauauggaaggaaagaacagacacccauaauuauccucugacuucuacucccagcacauaugcaaguaugugcacggauauaaaggaucuaaaacacaguaacuugguucagucugaaagauggcaggcugacccagcgaagcuggggacguguaaccagguccuacaggaguacugacuuacaacuuaggaucaugucaaagggacaaaggaaugacauguuuuaagaaggaaucaggaaaggccuccccacccccacuccccggggagguuguuuaugcuauacacauggaggucagaagacaauuuucaggagucuguucucuccuuuuaaccaugugaagccagcagcagacaucuuugccagcugagccaucuuguuagccuguaauauuuuuaagcaaucagauauacauuagauuggucacugaaggugcuagguggugcuuuucugcuugcuuuugaaacuucucauuagugaggccaaggaccaaagaagaaaaacuuccaggagggcagagcauguccacugacucaaugcagaguucagggcuuagcaaaggacuuggcaugaaacagguagccagauaucuugucucaguuaaucccugcauguaagaaccacgguacugaacucccuuugaacaucuuggccuauccuaagcaauuuuggaagacacaagaugaggacauuuccuuagucacaucugcuuacaacauguacugaaacaccuccagcagaaaacagcaggucaucucaccagagauuucuagaagccaaaccaccaggcuucaggaagaaaggacaaaaugauuuuuuuuuucuucccucaagcaaaaugcuccucuggcagacgaaguaccucggcagcauuuggaaaaguuaugaaaauaugaacaagcagauauuaggacaauuuucuuaauucagcacuggcuaucucuucuuguugcuaagaggcauuuucuucccccauauuugaaauuacaaacuaccuuccaagacuccagugucucaaaaguauccucccacaucugacucucaccugcucccgcugcaggaagggcaaggccauucacuauuugcuuuacacuggagacccuaggcuggagaucuugcaugaauaauacacguuacucugaagcaacugaaugugacuuaaaucauaaauauaauaauuaucuuuuuguacauaaagcucagagcuaaucuuaccucacuagacugagucuccuggacacaggauggaagcacauuguuacaacagcugacagaacacagaaaaaaggaauuuaaggcuguacagcaagcagcuagaaucaaaagguaaaguucacaaagccagcuucuguaguuuucacacuauaaaaauaccacaugccuccuguuacugucaaauucaauagcagagcaaaguaaagcagaugagcuuccucucaggagacaggagaccugacugcuagaugaaaacaaaucuaugcuaccaucaacugucuucaaaaugccuaaaaauccauuccaagacucugcuauuuacccauuuuuacccaccaaaacaggcuuacugaucuaugauuaauaacaggucccaaguguagucuacgaagccuccauacuaccacuaucagguagucccuagcaaaggcugaggguagaaggaagucccugcuauuucccuaguaccuuccucuacuuuggcaauaggugcagcaagaugaagaugacaucagcuucaauucuaaaugccuaaaugcacuucaucuuucuugcaguagcgcuggcuggccuugagcuuccugcuucuaccuuuuaagagcuggaauacagauacaagccaacacacccacuuacauuuccuuuuaaguaaacaaaaaaaccuuguacucacgggcuagaaguccccaacagcucauuacuacugccucuuuuucaaaacaggucaccuggggcuggaugcaagcagcaaagaacucacugaugugccuauuucacacugagaguugcccuuagaccuucagauuuaaacuacccuuucuuaaauuucuaacuuauuuauguguaugggugguuucccugcuugucugugcacuacuugcagaggccagaagaggcuguuggaacccugggacuuaaguuauagacuauuagaagccaccuuaugaguaugggacucaaaccuagguccucugcaaaagcacacaaugaucuuaaccaccccuaaauuaacucucuugucuaggauuuuuuuucuuccaaaaaccaaaauuuuagguacuggcaguuaaauuuuuauacaaauacaacauaaacuuuuauacacaacauaaagacagcuagcagggacaguauacuuucacuaacaagaggcaaacaggaaaaaaaaagugagauaggaucuugcuguuuuuccaagacagauuuuaaacaguuccagagcaguugggaaucuagguguauacugccauaucuaucuuagcuggggcauuuuaagacucaaguacaaagucagaccaaaguggugaacuaccucauuucuaagaauaccaccccugcaggagauuuauugcccacugguauauucuauauacucaacuacacaaagccaaauggccagcucacaagccaugauuucugagaagaucccaaaauacauacauuuucccccagaacuuugguaauacaauuccagaauuuucaaaaaacgauaaaaucacuauuauuuucaccagcuauucuauauuaacugugaaaaacaguucgggauuuaaagcuaaaacaucaaaauguguuuaaauguuaugacacugugaaccaauauuggucaacuaaggggggggguugagaccgacaacugaguuuuacagcaucuacuuuaguuaaaaugauacagcuguagacuacccgacaggugaacuauacucuaguccuaucaaagcccugcuuucucugaaucuuacuguucaucugaauauuuguuucaauacguuauuuauuuaauaauaaacauuuauuauuaaaacugagccagauuaaaucuauuugaauuuagaugcaagguaccaucacacuuaaccuaucagggacuuaauuugcaauacaggucgaauacuccuauaccaaaaaaaaaaaaaaaaaaagaagaagaagaaaagaaaucagaacgucccaaaacccacuucuuuucgagcacauuuuggauuuccagauuagguacgcucaucugucagaccuacaaauauuccacaaaccgaaccacuucaaaacccaggcguuucuugcuaaugcacagucagccuguugcaccuacaucacguacuauugugaaugaguuaagacacgucaggagcuuaaaggagccccugguguguaguaagcggagauuagucaccgagaggaagcaacuacuaugacaggaaggcggcaguaacuuaaaagcauuuaacuuuuggaccaaaaacuuaaacuugagucuuuuugcuguggaauaugcauaugcucguuaccgcagcgcacgcgccggaagcuaccgcggaaauuccuccaagaggcagcgaagcagaguuggaggaagugcgggccaacuugccccaaggauacccucggaagaagggguacugcugacgacccugaacccguuaggggcgcccgggucugaaggcucagugugugucacuaggcuggcuccgccuccaccgcaggcucagagagugaggucuggcucagagaccggggcacugugcggagagcaugcaaagcccggaagggcgaggcggcggcccaguagaccccuuccuucccaggcgcggucugagacgaggcguacccaggcccaccucgcuggggaggccuuguccucucaaggaaccgccugcgccgcuucgcguggguucucgggcggcgggaacaaagcgcgcugaccuucagccgggggcggggcugcacggaggagggaccggcccgccauccgccgccacccgccacccggaccucugacccggucgccgcccgccucugcucgccgccauggcgcgucggccugcccgcgccgcccacuccuccccgucuccgccuccuccgccccagucccucgccagccgcccgccgcgccguuacccgccagcaccgcaccucgcgccuccugcggcaguggcgccuguccuaagcucgcuccggggcugcaccgccguggucgccaacaaaaccaccugccauuggccguaucgccgggcuccacccucugcgagcaaaacgggcgacgaauggacaauagagcuguuuaucaacugcac

SEQ ID NO: 4233 - RNA, 1130 nt, Mus musculus
agagaaagagaaagggugugaacauagagaagacaggaggagcgaugaggaagaccaaaacaucugguuuauauagggaagagccucugggggaagggcaguccagccccugggcuggaaaguucaggguuacagcaaggguaugccagguagggacugagggaugcugagagaaccuggaggccagguuugcuuugaaauauaaaauuugcaccucagucccuugucccaaggguacauaaccaaacaauacauauuaccaaguaucaauuauuuuuuaauuaauuauuuauuuauguugagacagagucucuuauggagccauggcugacuuggaacucacugagaacugccugcuucucccuccugaguuuccaggaauuaagaccaugguugccagaauauauauauaccagaauauauaauuguauuuauuuauuucccugcacacacacacaacacaugucuuuuucaccacaggcaugcaaagcccacaaggaucaaaagaggguuaggaucccauggaacugaaguuacaaccgguugugagcaguugugagugcuagaaaucaaaccgguguccuccagaagagcagccgugcucuugaccaccgaaccaucuuccaaccucaaaacggagcuuuuaaaaaaaaaaaaaaauugugagacagggucucgcuauauaccuggcuauguuucuaaaauaauacuuuccauuucuucucauaaaccucccucugauggugugucuugggaggcgacaucaggaauuaaggaacacacaggaaauaaaaggauucaggagagaguguaacaggaaccaccuguuuccaggcuuguguggccuuuuggagagugucucagaaaaaggcgucuuccucgccccucuccuccagucgcugagucccuugccccacccuuucccuugcaucucuuuaaucucuacucguuuugccccgccccucuacccagcuccucgccccucccacucccccauuucgucccgccccucccagcccucuucagcagcccggguuugcgcuucucacugucuuagcccuuuggugucuauuaaguuccgcgccagcguaaaccauaguauucucccaucaugccccacgucggcguca

SEQ ID NO: 4234 - RNA, 42103 nt, Mus musculus
aagaaagacugacuuccuugcucaauugagcuguuaguguuuugaaaguuuacagagaaguucuucaaaaucucucagggcuccacuggcacuaagcagcagcaaaaggcacuucagcgucaagaagucugaaagcugaggcagcuuaagcgaugcgugcaugcauugaccaaugaacuagaccaggacugugggucagccauaaagaggaaggagagccucauauacguuaggcgucccuacagagcccuaggccacaaggagcuggauggucucaaaaggacaaagagcuuaugcaucuacuucugagaacccuagagucucaggccuacugaagcagaaagcagaaugaaacaccuagacuggagagggacggacagugaguaaguagcucaugggguuacaguuuuauuucaguaagauuggaaaguucugaagguggauggguggacuuggcuugauugcaaaagucuauaugauaugucuuugggagcugguggcuagggaugugacucaguugguagaaugauaccuggcaugcauccccugcguuccaccccuaccauggcuacccagucacugauaguacacaccuguaauccuagcacaaaggaaaugucuguaggaggcucaaaaccucaaggucauccucagcugagguccagaccagccugggcuaugugaaacccugaucaaacacaaacaacaaaaaugaaacaaaaaccaagaaaccuagccuacucagcaugcuccagagaucauaucucaacaaaacaagguggaggaacucagugguuaaaaaugcuuacuguuagugcuagagaguugcuucaguaguuauuguuaugaagugaaugaaaaaaaaaaaaagaaauggaaaggaaaagaacuccuagguaugguggaagagaaagucuaugguugguaugugggagagcacagagacagcugagagaguccagaguggaccagacugagcugggccauguggggagagggaccucagguccugaguuugcuauucaacacucacaaaucaauacugcagguagcagagaccuccaccaaucaaucaauauaggcaucauagacccccaacaaccaauacuucaggcagcagagacgacccccucugacacacacaagccuagagcugcccuagggggagacaggguuucucuguauaguccuggcuguucuggaucucacuuuguagaccaggcuggccucgaacucagaaaucugccugccucugccucccaagugcugggauuaaaggcaugagccaccacugcccggcucuuuccuucuuuuuuugacagguucucucaagauagucccggcugucuuggagcucacuaccuagacugaacuggcuuugaauucaugaauauucuccugccucugaguguuggaauuaaaggcauggacuacuacauccaacucccuuucuguucucucucucucucccccucccugccucccucuauacacacacacacacacacacacacacacacacacacacacacacuggcucugaugaaguaccacaggugugacacccucacagguaugacugaggauguggcaaggcugggccugauguuuggauaugcagaacucuagggcauaaaaaaaaaagaaagagagaaaagaguaaaggaaacgguucaucagaagcucagugaaugagcaggcugguccagucagcaaucaugagugcugaguggaggagcuaccaggaagucaugagucacuugacaucagcuagguuuaugguaauuuccaaaaagccacauaggugcauacagugucuggagaaaaauaguuggcuaguucucagccaucccagauaaacugcuuuuuauucagguuaugugagaaacagaguuaugcuuuaaguuuuuauuacugugccuaagaggugugugaaacaaaaaugccucuaaucuguaagccccucccugccuaaggacagaugccuccagaaaugcuggaaacuaauauuuacagaagauuguuguguuuauaaaaagauaaauagaggaggaauauguuuugguggguauguagucaggugugggggaagggguaccucggcaggcccaugcugaggcaucucuuccuccuucaagaccagcuacaugacaguauaguauagaguuuauucagggcauggggaugggagaugagaggguaguagagacagagaaagggggaggggggcuggcaaugaguauguggagagagaugggaagaggaauggggagagagcagggaaggggcaagagaacagagaaggagcaagaaggaaagagcaagagagaguggagggggcaagcagccccuuuuauaaugagucaggcauaccuggccauugcuaaguaacugugggguagagcuuagacaaaaugcuaacauucccccauuuugauuuaauuaaaaagaaaaaauuagaaagaggugaugguggagcaggaauaggguuguugugaucuuuaucuacuuccugcugauuuuggggccauguaucucuaggaaaccuaggaaagaggguaugggaauguugguucagucuuaggagaauugacuuuuuccuugcuguccagggucuguggacugucuguggauagaucagaagaaacaagucuaguagaaggaucugugucugugagaggagauuggagcaucuggaaguugcuucucuagagcuguccuagauguaguaagcaccuggacuugacaagaugcugaagcacgcacacacacacacacacacacacacacacacuauagguagagaaaaagauuacguauguuugggaaaaagagauuuuuuuuucuuagauguacauugaaacccagaggaaucccacccucuagaauagguaauaagugggaacuuuaggcuauugauuagcagauguacuuaucuggauggagucuauuugguccaugagagauagaacugcgugguuuuccuguagcuuauaaguuuacaaaagaaauaacaacaugagcuaacaacaugaagaauccuuaagaagagccauuuuuggagcagaaggaucaagggucuuuuccucuugucuaggagacugaauauacaucacuuuaaauuuaguuaaaagacaaccaaagaaaacuuaaaauuugaauuugugacuauucaauuggauuguauaguggagauauuuaauguuagggcagugguauagcaaggagaggaaauaugagacauuuugucaauggaaacaaaguuuagguaaggaaguaacagauuacaucugugaaagccuguaucugaacuuauauaucauuuaucaugaagucuguaagaaaucuggcaucuuagauaguuaaugaauuuauuaaugaguaaauauaguuguagauugccuuaggguaaggagcuaggucuguuuucuagcugucaagcuacagcuacguuaucugucaauguagucagaaauguggggaugaauaaauuauaaucuagaagucacguauuaauuaaaaaugacagaguucaucuauaauccacuaccuaaacaguucccuguggucucauggcgacuuggguagaguuagucuggcuuucaagcccagaagacaaagagccuuuucucuguggaacagauaacaugugaaaugagaaaugacucaccuugacuuaggcaauaugagucaguugacucuuaggauauccagucuuguccacaguguuucucaaugguuaucauaccacaauccaaacagccucuuguagaugugucuauaucuucugagaccuuguuggguaagcuguuaggcuuugggagauucugucugucauaaacuuaaagauauuaauaauuggcaacuucugacaagauugagagcuauaucaauuggucauaucugaguuagaaaacuuguuuuuguuaaauuacuuguuugagaauauauacacuaaauagagcauagagaaaaauguauuuuguauuagcagagaaucacuugccuucgagcugguguggaggaccagaauguaagggaguaagagugcuggcagcaguggcaugagacugugcuaacagaaagugaguguguccagguggguucaggccugugacaugaacugccaccagcuggacccagucggagucuuuccaccuggggaagaaggcaggguccccguacucaggugggcaaggaguuggcgaguaacaaacaaacacgaacacaagaggguguuggaucugaauguaauuucucaaagcaucagacuuacuuuacagaagaaaacaaggaaguuaguuucuuggaagacagucuuucacaacuugacacacaaacacaucacuauuaagccucaauccuuacuuucuuauauauccccaagaucuaaauaacuuuaaaaguuccagucuuugaaaauucuuacauauuaaaauuucaauccuuuuaaaauguccaaucucuuuuaaaauccaaagucuuuuuacaauuagaagucucuuaacugugggcuccacuaaaauaccuucuuccuucaagagggaaaaauaucagggcauagucacaaucaaaagcaaaaucaaacuccaacuguucagcugccugcacucuacugcugccuauacucuacugguggucgccucaugguauuggcuucuccaaaacacuggugucuucugcugcaacuaggcuucaccaauagccucucauaggcucuauucauugugccaagccucaauuucuuugcaugaccccuucaguccugggccaucaacugagacugaggcuguacuuucaccagugaacuuccacagccucucacagugcugagccucagcugcuuuccaugaccccuucauuccuucaaaaccuguaccaccugggugacucuuacauguuacuaagucaagccgcagcacgagguacaaccuugggucucucuggaacacagccucacuaaaacgcugagguuugugcucuuggaaaacacuuuccagaagauuucaccuaaguaauguuggugauaucuuccuaaucaccacuaauuucuugguuccagcuaaccagaaucaauaguaucaguaaugcagagguuuugauuuaguaguucuggcaucguguuaaucacagcggauucuucauccccagcgaaucaaaaccacagaaacuuggcaaucaaaacagcaacagcccugauaaaagucucuaauuuucccucugaaaucucacaagucagaucuccauuuucugcacuguucucacauuaucuucuaagcuccuaagcaacaucccacagagcucuucacaucccaaugacucuucuaggaaaagguuccaaaguccuuccacaguccuccucaaaacauggucagcuugucacaggaauaccccacuccugguaccaacuuagucaggguuucuauuccuacaaaaacaucaugaccaagaagcaagaugggguggaaaggguuuauucagcuuacauuucaacauugcuauucaucaccaaaggaaaucaggacuggaacucaagcaggucagaaaacaggagcugaugcagaggccuuggagggauguuacuuacuggccugauucuccugcuuuguucagcuuucuuucuuauagaacccaagacaaccagcccagggauagcaccaccuacaaugggcacucccuacuugaucaauaauugagaaaaggccuccuggaggcauuuccuuaacugaaguuccuuucuuugugauaacuccagcuugugucaagucaacacacaaaaucagccagcacacagguugucugacaagaaggccuaacucugcaccaagaaggccauguaccugggauuugaccuccaggaagauaggaaguccuuauccaagucccauaaacaauguuaggaauuaccauccuaucagugaaaaguugauucagggaauuuugggggucagcaggauacuauaagcgaggcucuggauuacuggauuugcugaauuagcuagaccuuuaugugaagucaccaaagggucugaggauaccauucaaaggcucucuaacaccucugccaaggaaggauggcaccucaccacugaugggacaugaauccuucccuagauccugaaaggauguuggcacaauuacauauuuggagucaucuagguaugacuaaauugaccaguuuacucaacagggacuacuauaucccagguguggaccagauucugcaagauacagucuccggaugucucgacucauggguaccaacccuauugggaguuccuguaccaaggguaaaagagaaagggaaacugucucagggguauauugggaauuggacuucacugagauccaaccaagucaauauggauagauauuugcuagguuuuguagauaucuucucaugauggacucaaguguuccugauuuaaaaaaaagaaaacuuuacauauaguggcaaagaaacucuuagcggaacuccucccagcuucucagcuaugguguuccuuaggauuugacgaugugccagcauuuauaucuuagguuguacaagguauaccuagaaccuugggagucaauuggaaauuacaccauguacaucauccucagaguucaggacagguagaaagauugaguccaaucuuaaaggagaccuuaacucaauuaaccauagaaacuggugagcacugaacuaaacccuccccuuugcccuuuuaagaguuagaaauacucccugaugauaaguuauuuuuccaccagugaaaugagccaauucaagccagauuagauuauauuaaacacagguuuauugggaaauuguucucaguugaguucacugacccagggaagaaggugagggaaguuaccauagguauggggagaaaggggaaggggaagagaaagugcccaugugcagagagagaacaaggaagaccaaaauccucuggauuauauagggaagagccucugggggaauggcagcccagucccuagguggaaagcucaggauuggggucaggguaugccagguaaggacugagggaugcugggagaaccuggaggccaggucugcuuugguauguaaaauaugcaacuaagcaacuuguccagggcucugaaaccaaacauuccagccuucuguugauaauaaaagaauaaggggugauguauuuauucaucuaugauuucuuccugcugacauuggggcaucauuaugggguggcccaaaaaacuugauuguuggcuauuucugggaggagcuggcugucucccugcuguccaggcugugggaccaucuggugcuaggagugcacaccccaauucaaggacccugugagacugggcuggagcaccugucaguaacuguuuugguccuguggcagcaggggucuccuaccaaaguccagguagauaccccuggucuuggcuucugcuuggggacacauaaauauuugaggucucuguccaacugaccccacuccucaucuggaaaucauaggagagcuggucacggugggagagcaaggcacugaccacacuccuaggcaaguggaaauuuacugagcagugagagcaaggcacugaccacaucccuaggcauguagaaauuuacugagcagugagagcagggcacugaccacaccccuauccaaggguaucuacuccaguaagaacaaaacgcuguccuuuccacgaaggaagugguccaauguagucaaccugccaccagguugcuggcuggucaccucgaggaaugaugccauaucuggggcucaguguugguuucggcuguuggcagaucuggcaaucagcagcagcuguagccaggucggacuuggugagcggaagcccauguugcugagcccaagcauaaccuccaucccgaccaccauggccacuuuguucaugugcccauugagcaaugacagggauggcuggggagagaggcugacuguccacagaaggggucaucguauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagugccugaccauccagccaauccauuggcuacagcccaugagucagugaauaaucguacaucuggccauuucuucuugcaaacaaacuguaauaccauguguacugcccgaaguucugcccacugugaagauuucccuucaccugugucuuucaggguugucccagaaagggguuguaaugcugcagcuguccacuucuggguggugccugcauaacgcgcagagccaucaguaaaccaggcucuagucuucuccucuucggucaguccaucauagggaccacauaguugaccacauagucgaccacaccacuagccaggaggaaauuuacugagcagugagagcagggcacugaucacaccccuaggcaaguggaaauuuacugagcagugagagcaaggcacugaucacaccccuaggcaaguggaaauuuacugagcagugagagcaaggcacugaucacaccccuaggcaaguggaaauuuacugagcagugagagcaaggcacugaccacaccccuaggcaaguggaaauuuaccuaguagugagcacaaggcacagcacugaccacaccccuaaccaaggggaaauuuacugagcauugagaacaaggcacugaucacaccccuaggcaaaaagaaauuuacugagcaguuagagcaaggcacugaccacaucccuaggcaaguggaaauuuacugaguagugagcacaaggcacagcacugaccgcaccccuagccaaggggaaauuuacuaagcagugagagcaaggcacugaccacaccccuaggcaaggagaauuuacugagcagugagagcaaggcacugaccacacccuuagguaaguggaaauuuacugagcagugagagcaaggcacugaucacaccccuaggcaagggaaaguuuacugagcagugagagcaaggcacugaccacaccccuagacaaguggaaauuuacugagcagugagagcaaagcacugaucacaccccuaggcaagggggaguuuccugaugugcugaggagaagcaaaugguuagcgcaaguagaggggagaagcagcugaagaggugaauuccagguuuggaguucacuaugguagguugcagaagccugcaggaacaagugauccauccaugcauaccuuaggaagucgucaaaccaacagcaugguuuggcuaggagaggcugagucucuuggaugggggucauauuccucucugguuucaggcaccagauguacaaagugaggacaaaacuguuccauuucugguuagggggaaggguuuuauuguagauaggagggagagcucagccagagacaucuggaugaguccagagcagagagaaaguaguagauuaaacaugaccuacagacugauucaggccuuaagaggaggcugguggagagugggagaggaagagaaguaaggaccagaagagagggggaaaggagaggaagaaccaagaaggcacauuaccaaaaaauggcaggguuaccugggaaugagaagcuaggggaagggaagucagugagguggagacguguaaggugaggucauguucuucaguauguuaauaggaaccacaguggaccauucauccugaguuucuuuuggaccugauaccaggacuugccuucaucuaaauuguuacuuacucucaaggagggccuccaccagagagcugcagagggcaauuguuaaccuguggugguuugaauugguuuggcccucauagacucauguguuugaaugcuugccucauaagaaaugguauuauuaggagguaugaccuuguuggaggaaguuugucacuguggggacaggcuuugaggucuccuauguucaagcuguguauaguguggcacacagucuccuuuuauugcuugcagaucaagaugcagaaaucucagcuccuucuccaacaucaugucugcuuagaugcugccaugcuucccacuaugauaaucauggacaaaacguccgaaacuguaagccagucccaauuaaauguuucccuuauuagaguugucuuagucuggaucucugugauuuugaggccagccuggucuucaaaucaaguucaagacauuaaaaaauaaaauaaaauaaauaaaauaaaagaguugccuccauaguaucacuucauagcaauaaaaggaagcuaagaaaacaucuguagaaccuuuaucuucuuaugauacggaagacaacaacggacacaauuagcacacucaaaggugauaacaguaggaacagccgguuucugggaucuaaaagugggaaaaacaagaaacauuuuggucaacuccagaacagaaugcucaaaguauaggccauggcuagugugcccugguugaauuuauuguauuuuuggcaguacuggggauugaauuuagggcuucaugcauguaggguaauacccuaccacugagcuucagcccaaacccucaauuuugcauacauuguuaacugcaguuccagcuuucauucuuucauagguguagguucuuuugcuagcauuauuauaaucaucaucaucauuauuauuguuauuauuauuuugguuuuucaagacuguguuuuucuguguagcccuggcugcguggaacucacucuguagaccaggcugaucucaaacucagaaaucugccugccucggccucccaaugcugguauuaaaggcaugugccaccacugcccggcuagcauuacuuauugaagaggcugcccuuuacccacugaaugucuggugcaagggucacauauuauaaggaauuauuaaaaaugccauuaacaugggaaugagacaaugugaugcuucagucaugaaaaagcaugaggcgcugacagagcuucagucuagaucagccuuaauacaugaugcuugggaagcucagugguuaaggcuuucuuguaaaggacccaaguucaguuuccagcauacacaaggcagcucacaaccaucuggaacuccagucccauacacauggcacaggcauacaugcagaaaacccccauccaugcagagaaaacaugaugcugaaacccagacacaaaagccacacauggcaacucuaccucugugaaccauucagauaggccaggccacugaggcagaucuuccugggagggugggucgaagagagacauacguuugggagacauauuguaacagauagaggagcugguauucaguuucauuuugauguccacuuugaaacaguuaaugcuaugguauguauauuuucauucaauaagaagacagccauagcacuggccaccuauguggccgaggauggcuuuguugggcagcagugagaggaaagacccagaggucugaggguauuuggugccccaguguagggaaugccaggaagggaagacgggagugggagcacccucaagaggcagggggugaagggaugggauagggguuuuuugaaagggagaccuggaaaaagggaaacauuuuaaauguaaauaaagaaaauauggagaagaggaagaagaagaagaagaagaagaagaagaagaagaagaagaagaagaagaagaagaagaaagagggggaggaggaagaggaggaggaggaagaggugaagaagaggaagagcaagaagaagaagaaggaggaggaggagaagaagaagaaagaggaggaggaggagaaggagaaggaggaggacaagaggaggaggaggaaggccuuggaaauuaaaaauaaaucugucuuacuugaaacagaugaacugcacacaguguuagcuguggaguugcauuccuggaggacagggauuccuuggggacaccugcagagagacacccucaguucauccugccagaccccuccugcauucaucagcagcagauguccagcaaggcgugaugccccuccaaaccacaucaggcagcauccugauccaagaucugcaacaguguucuggccacacagcugccaccagacccacuggcaucucagacaguaucguguuauuacuacuuaauacacgucaguuacuacauuuuccuccuccguugauguccauagcuucuuugguggacuugcagugaggaaaaggagaggccugccuggccucucucaagagacucagaguuuagauuccccagagaaguaacaguccuuuguaaguggcuugugcuggugccccuaggacucaacaacuccaucugacugaagcaacacucuuacugaggggugaaaccacaggauuucccaaaccuugcccagcaguuucaucccagaacccccauguuaacccaguacuaccuugcugauaaugaaugaggcauuacccagcccuuccaaagccaaauacacuaagaacccucuggaagaccuaacucaggaaaaccuagugcuuuacccgguguugucuacuuucucucaagggacauuagccauggagaucuccagcaagaaguccuguaccacccagaccacaaagucuccaccacacaaugucaucugccaaaguaugagacagacugucccucucccuggacauuagaggcuauucaggcaacauauaaagcuaccaccuacccaggccacagugguacuuacuugguacaugggcggcacgauucuggaaauuuugggucauaguaguaaagaccuguucggcacuggcauuuccggucacugguggcugagcagucggccaccauuuccugaucugcaauccagggaagaauagggucagguugcaguauaaaccuucacauaugcacacagaccccacugucaccugaaaggaacacaauguguccugguaaaccuucacauucccaucacagauguacggagugcuaagcagcacuacugggaguaucucauccuugggccucuggggugguacccagaccagagaugauggcuugggagguccauuguuuagcauccuguguaauagcaucacacugccccuaaggacuccaacaugggugguccugaucuguagacacaccucugccccacaaaguucccucuccagaagccaccauguccaucagacaucucugaagaugcuuuguuuaaucaccuuauuguucucugaagagcaccuagugaucuuguacccagagcccuagugggcccuugggcucuggguguauaccuuccuuaagugagacuuacucaguggcuuauaaaagaagauggcuuucccauugggguguucgauuuuaaccuuguguucaggacaccauaaacacucaagcuauaaaugucaccucucacaauucucugaaucuaggcauuguccuuucucagaauacagcagggagcacaggcagggaggacucucagcccagcucucugcagaugucuuacagcaucagggaucugugaacguggaaaaugguucugucuuuuuuguuuuuguuuuuguuuuugcgacaauaugucucuguguagucaugauguccuagaacucacaacguagaucaggcuguauagagagaaugucuuauguuuguauggauguggcaucugucaauaagucugauggccuauggcuuaggcaggaaauaggaggugggacaacugagagaaagaaagaauucugggauagagccaggcaggagauugguccaggaagaugugaggagacacaugguaccugagcacaggcaaccagccauguggcagaauguagacuaagacaaauagguuauucuaaguuauaucuagucagagaagagccuagcuauauggccaagguauuuauaaauauauucugaguacaagucuuauuucagggugcauggagcugagaggaagaaccagaaccuaauuucuacaauuaggcugcacacuaaagcguccuuucuauaucugccuccugugcucuggaaccagagaugugugcugguauacucagccuguuuccaucucuaugcuuaguagaugcaaaugacagggcugaagcaugagauacuguaguauuugccacuuaguuuaacaugauucuguggcauaggagugugugcauaggcacacaugcaugcacacacaaaacagaaucuucgcccccacuccccucuacgucagagaacaaacccaggccuucuucugcauacuaggcaggcacucugugagcugcuuccaguccuccaacaaaugcuuaaaguuuguauguuuauuguguauugauugagucuuacuauguagcuuuggcugucuuuaaacucacuauguuggucaggcuguccuugaacucacagagaucugccuuuagagugcugggauuaaacagaugugcugccaugcucugccugcuuaaaguuugugaaaaagguuuuauuauauuucuauauccuguaagacaucugcagguguggcccucgucucucugcugcuuccccagaucugugugcccucugaucuacucuuuuagcucuucucugugugucugggaagcacacaugauugcuuauccacagagguaugaucuuucuagguaccagcauguguuuuacuagguucugcauucaauugacaaguagaagaaaaauuaucuuuauaaaaaaggcagaaggcuaugauugugcuuguucugacauugauuuuacggaguccuuuuuacucauaaucaauaauuuguggcuugguuugauuuugacacagggucucacuguguagccuuuagaacugcccuggaacucacuguauaaacaagguggccucccaggacagugguggugcaggccuuuaaucccagaacucaggaggcagaggcagaggcaggccaauuucugaguucgagaccagcguaucuacaaagugaguuccaggacagccagggcuacacagagaaacccugacucgagaaacaaaaaccaaaaccaaccaaccaaacaacaaaacccaggguggccuccaagacagagaccagcugcuucugccuucuguguaaugggauuaaacauuguacaaccaugcccaucggcaggaaacaaguuuuaugccaguggggauucuguggcugcauucuggcauccauuagucaugacuacuccauccagguacuucugacucuaaugccagucuucauagcuagucugccucugcuaagucacauacucaccuuuaucacagguggagcaaaguauacaagcauccagguaauuaucuuucucugugaauguuccugggugacacuucucacauuguccuugaguaugggggauuucgcagggcgccuugacaaauguaccuggggauaagggcaaaugggaucagccuugcucaggcauucagcaauaaagggcuauguugcucuauguaggcuuaacaucuuuaucacaaguucaaaauaaucucugggcugucacaaagugcuugaggaucuaugagggcugcugguucccugagcuacacucaguccuguggacaucugacccuuaggggacuaggaaccaagauagccuagggugaguagaaugagauccugacucccuacugggcuuccauaggcccauguaagucaccagggagugacacuauuugaaaggauuaagggguguggccuuguuggaggaagugcaucacuggggcugggcuuugaaguuucaaggguccaaguguuuguuuuuuucuucugccuuugcauaugaacagagaacucucaccuacuucuccagcaccauuuuuaucuuuuucaacccuaccugcagucaggccuccugccauugugauaauggacuaaacuuucaauacugcaauccaguaaaaugcauuccuauauaaaaguuguggucauggugucuuuucacagccacauuauacuuuaaacaaucucuagaaaagagacucuggcucccuguaaguugugcugagugcuuugggcauacagcuuuaauaaguugucacccaugcuaggcucauauuacaauauguaguugcauuagucaccuaugggugugaaagcgaccccaauaaccucaaugguucaccaaaccacacuuggguaaaucgcuucuuuggucuguucucagugacuauuaucacuuccuguuaucuggagugaacaguugguguuuaugucuccccagaaauaauuacagaaccaggguuccugauacagagcacaugugcuguuagcugagagcagaagagcaaggauggacauugccaccaagguagagugugaccauagcaagcuacuuaagccacuuucucuauuggaagugguagcaguaggggcuaaggguucccuggcacccaagacaaguacagguagaugaaauuaacccucccagcucccuuuucugaaccuuccucucagcuuggugccuuuggauaugggcauagaacucaucaugccuugcaggguggagaguugggugacccuacacuagugaggccuugcaaugaauacucacaccaacccucuugaacacacagagggccuccuuuaggggugacauucuguguaccuugguuaggaagcaucuccuagaguuugaaagaguaggcaguggcugaguugaccucccuggcacacacccuccucaucuuguauagccacuggugugcuucaaaggucacccaugucuaugcuguggcauugggucccagcaaagaacucaccugcagaacaguucuugcaacagacgucuuuagaccaguauucaccagcgggacauuugaaggaguguaauucuagcauagcaaauuuuaccuaugaguggaaaaggacaaggggcagcuuauuuuuauugguaacugcagaggaugguuuggaugaugguggaaaaggaaguaccaaggcagggccuccuugugcagagcccagcggggacuaucugaugcuacgcuguggcugaugcuaugcuguagaacucugaagccugcaguugcccaggaaagcuugcacaauacaccacuaccaagucuaguggcucuuggcuuuuugcacagcaguaucaugcccaccccacuccauccuuaguucacuuuuaucaucaucaucaucaucaucaucaucaucaucaucaucauuagcagcagcagcagcagcagcagcgaauguucuagcacaacuugugaccuacugggauccuaucauccaaaucucaagcuuugauggcugcuuccuaugcuggggcugcagauggagacaccaguuggaacaacuugcaaaaggauaaaggagugauagcucugcuuuguuuuuuguucucucuuucuuuccuucuuucuuucuuuccuuucuuccuuccuucuuuuuuuuuguuuuuuuugaagaauuguuuauuauuuuauguaugugaguacacuguaguuuucuucagacacaccagaagagggcaucagaucccauuacaaaugguugugagccaccaugugguugcugggaauugaacucaggagcucaggaccucaggaagaauagucagugcucugaaccucugagccauuucuccagccccccuuuuuuuucuuuaauucaccuccuucacauacuauuucucuaagaacccuaaagcuuuagaaguguuucuagggcugaagagauggcagguaagagcauauggaguccaggcagagcaguacacaucguuauccaagcacucgagagacaaagaaagguggaucucugugaguuccaggauagucagggcuugucuuaaaacaacaagaccauaacucccaaaaaacaaacauaugcuguucuuacagaaggccagaguuugguucccagcaaccaugcaagaggcucacagucaccuguaacuccaguucaugagaaucugaugucaucucuggccuucucaggaauugcagacaaaagugacauacuuaacaacccuuuaggaaacacuuauacaaauaagcaaaagcaaauacuaaaauaaauaaauaaauaaacaaauaaauaauaucuaauuuuguuuggucuuuuauuacucaaagccucaaguaauuguaaagaaauaacugguuuuacuuuauuuuauuguaguacugaggauuaaacccagggcucacucugggcacuaauuaauuagcaaugugcuauauuucuagcucugcaacagaugauuuuaaaguuguuuuuuguuuuuuuuguuuuuguuuuuguuuuucgagacaggguuuuuuuguguagcccuggcuguccuggaacucacuuuauagaccaggcuggccucgaucucagaaauccaccugccuuggccucugccucugccucugccucugccuccugagugcugagugugugugccaccauuggcgcaacagaugauuuuaaagauuuauauuuguguuuaugaguguaugccugcuugaaugcauauacaccauguaugugcagugauugaggaggccagaagagaacagcagaauccugggacuagaauuacaaacgugugggugcugggaacugaguccuauuccucuacaagaauagccaguacuuaaugcacuccagacacugauacaugcaacaugaaacagaggcaaauaacaaaacaaaacagcaacaacaaaaaaccccaagaaacaaaaaaacaagagcgaaaaccauaaaaaccccaaacuuuauguggugaucauugaucacauaggggauugaaagaucauguguggagccaugauaucacacaagcuaauagagccuauaaaugaauaggugauucacuauuuaccaucaucaugucucacuuuucucaucuguaaaauggggauaguaauauacuuacuauuuaggguugugaaauuaaauaaugcauauagaacaguucauauguucccaggacguucuaucuccuccccacuuccuucucugaguaaccuaccuugacugauacccaaacacugggaaggagcucaaacuaagcacacaaaucaacugagcucuuuaacaaaaaaacaaacaaaaaacuauugagcacugaggcucacuucuuuauauuugcaucucuaugguacauacucugguaaaaaauucuccacagcaucaacccuuagggcccaucuauacauucgugggagccauccucauucauacuuaccacugugcucugaucucauacucgucaguguuguccagccuucagcaggagucugguucauagauaggauaucucucucucucucucucucucucucucuguguguguguguguaucugucugucuaucaucuaucuaucuaucuaucuaucuaucuaucuaucuaucuauguaucuaucuauguaucuaucuuuguaucuaucuauguaucuaucuauguaucuaucuauguaucuaucuaucuauguaucuaucuauguaucuauccauguaucuaucugucugucuaucuaucuaucuaucuaucuaucuaucuaucuaucuaucuaucuaucucuuucugguggucucugcuaucuaucuaucuaucuaucuaucuaucuaucuaucuaucuaucuaucuauguaucuaucucuuucugguggucucugcccauuuaauucugucaggaauucugcucuuaacugcuaggcaggagucuucuuuuuaggguuccuagguucaauaccuucaucuugauucaucgucaccauuauuauauguugaagcugacacuucaucacugcccugaaggcaauacuauuuuaccccuuggaaauggccugcuucaccuguacuuacacuuaggaaggacaugaccacagguuagacaguggauuuaguaggauaucuucacagccuaugucuuuaaucccagcaggcagaccucugaguucaaggccaaucuggucuacagagcaaauuccaggacagucagagcuacacagagaaauccugucucaaaagaccaaaaaucuacacacaugcccuauuuuuuaaaauuucaauauucuuugaggauagucuuuuuaaaaaauauucuugaaagagauguuaucuucagucuuuuauuuuuauuuuugacuuuuacaggacagugucucauacacagucuggcuguucuagaacucacuauaaagaucagacuaaacccaaauucacaaacaugucuaccucgucucucaauugcuagaauuaagggcgugcacuacccggcccagcucauccucagucuuucuuuggaguaccuucauuuuguggcauuauuugagaugaucaccauuuuuucuuuacaacaaccuuaaaacaucaacaacaaaaacaaccuaauauugucuagauuguuucuggggauuucuggaggacaaaaugcaccacuuuucaggcggugccugggcaggcauggagccccagagcccuaauagggaugggaagagauuucagggucaagggccaucccaugugaaaccugccugugaaauauguucgaagucccucaaagugcugggaacuuugaagucaccucugaguugcauauccucuggccccuugcccaggagauucccagggaagcuggaugcccucuggguccauuucugugaaagcugcucaccagcagcuagcaaagaauuacuauuaaccagcuccuaggugguuuaaagaaaugcugauuacauguaaguggucucugacugcucagauacuaucuuagaacaaucuaaggguuauuuuguuguuguuguuguuguuauaacuaaagaucugaauguguuacaaaauggauauccuuacagguuauaaaacauaaaccuuuuucugccuauuuuugggaugaagacucuuaugagagaaaauugacauaaaauuaaguuggcuguaacuaaaaugucauuuacaggaucgucuagguuuuuuguuugguuguuugguugguuuugagacuccuuauguagaucaggcugcccacuaacuuagguuuaacugcaguuuaugauuaaagagacaagaagcgaucucgggacgaacuuagcagagacccgaaaggcccaggaaaggcauagccaggccuuccacacagauccuuuuguaguaguuaguacuacaccccaagaccagccgggccggacccacccaaggcgcacagucgcgcgggccacugcaguccgcaauggcacuuuccggagucgccuuccgauggaccgcuuucugaugagaaagggaggagaggcguguccaccuugucccggagcucagggaccaaccggacacacuuucucuggcuacccgcuuggccauuccccugccucugcuucaccuccucaaucccccaacucuggaccacuuaagagcagacgaaguucugaaguguugguuggcgaugcccaggcugauggcacagcccgccaucaguucaccgccggcaguagcuuuccucugcaguccggggauccggugcccagagcgagucucagcuccgcagggccauaucuacucaccugcaagggcagauucagcagcagcagcagcagcagcagcagcagccgccgccaaaggaaccagcgacucagacuggacaccaagcugcagaagaagccaaacauggccgagugcaagcacgccgcugcugcucagcugggaggagcugcugugguggccacgccucuccucagcggauugguuccuguaugguugccuuaucucgugggcggguccagcgccaccacucuugccuucccaccacaaucagugcucaguaauaucuaguuuucuauaaauaacguaauuuuaaaugccuaugacguuauuaacagaaucauauuuguuauaaacagcaaguuaaagucgaauucucugccuucguuuguuuuucauuacgguauacugcucuuuauuauaaguuaauuaaaaauuuuccuggaccugaguggagggagaggcaugaacuauuguuggaaucguuauaaaagucagacugcagcagacuguaaaccuucucaaaagcaacaaacaaaaagaggaagauaagcuacaacacacacugucuuagcucaacacggagaaguuugaaguaacucuaucccuguagcguuccugugaguguucacuggucaauggucuggagcagcagcugaaggcuucacugucagggucugaggggcugugugggacucgcugacucugaggaccucaaaauauccaggacugguaggcacucuuccaguucugggguuggggggugugugucgggggaggagggcuguaugaacaucccuggacugugagucccucaccucuucuuccuuucacuguguuuagcuccacugugugugccaauccaagcucaugggacacaggacauuuaagccaagucuacuagccuaacacaggaaguagaacgcuuauuucucuagggaacuuggguugguucaucuguuccacccggccccuccagguauucgaaaaaguggcccacuaccagccccauccaucucccuuccaaaugccacuuccucuuuaaaaugagggaggacucagaguccuggauuucaauggcugccccaaagaagaggagcgugacuucaggcaccugguacucuuuaaaucaucucuugccucucucccuagggccagggaguggagccugugcccaucugcccucaccuaggcuggggagugggggcggccaauuccuuggccagccugauccucuucuauuucuugucuucccucaggcuggugucugcucaggaguaaaccaaaucaaaacacaaacaaguguuuagaaaguuugguuaguucaacacgcugaacugucccccacccuugggaagcagagggaaaguagaggaagggaagaggagaggagugugcacuuguggaugcuguugucccaccagucucugaguagcucgggagcagggggaggcuaguggcuuuccuuuucugcauacaguuuacagaucugccuugucccacacuguagguggaggggaggugaaaagaagaggccugucuacccugggcuagauauuugugcuccagguccuucucugcccucugcccuuugcuccuuuaaaacauuuauuuuaaaaugugugugugugcaugugugugugcgugugugugugugugugugugugugugugcgcgcgcgcccgcgcgagcguccgugcgcacaggugccuccagaggcucgaggugacauaucuccaauagcuugagauacacauggcuguaaucugcuugauaugaaucuggagaucaaacugguguucucuguaagaucauagcauccucuuaauggcuguaucaucucuucagccauuucuacccuugcucuuuaaggugggauggaggugccagaggcuggacucaguuggucccucaaccuaggggaaaaaucagggucccgguacucaggugggcaagaaguuggccaguggcaaacagacacaaacacaagagaguuuuguaucugaauguaauuucucaaagugaccaacagauuuauauuacagaagaaaacaaggaaguuaggggacacaucagccaagguacauugaagucaucugaugcauaaugacaaaaaacagagaaauacauacauaaaagacuagcaggaaccaggcagugauuacaacugagauaaaagcagcccuaucuaaagucagcuauucuaggagccaggugaagauuucacacccuagucacaauucuagucuacuguauaacccaccaccaggggucccuuaguaagcaccuaagugugguauuccucugagccuugugaaaacuugcaccagggguuuuucacucuugcuaaccuuuucaugaauaaugcaauacucuagucauccuuaaacuacaacccuccuucuuccuagaccauuguaaauuccugcauaugggagugacuaggcugucauucuaaguguuuugugggggaccuccauuuaccagaggagcccagcaacuuuccucuauuagggaaucuagucugucuaauaugacuauaauaagaauucuaagcuuucuuuguuaaacuugccccgaaauuucuaacucuauccaguaaauuguaaugccugauuucuuucacuaucucucuuucaacacuggaggcauuuugucugaaugaauaauguucuuacgaaaucccaaucccauguugggcucaacgacugccuaggauauugggacaccagugaaggccagaaagcaauguucaaucuaacuuagcuauuugucaaaucauuccuuuggggcaccuauaauaaaacaauacugaaggaaagcacucagaacccuccaccaacuaucgcaagcacaacuguggaccauauuuauuuaugggaugccagagacucuccaggagaccaguuuccaugaaacuuugugccucagaacuucggcuaagcuuuuggacuugucauacugacuccccuggaguggguauggcaaugaacugagcaggcaggcaggcugugggaacgugggaacaggccucgggcaugagagcauugaccccuuccauuucugaccuggaccagacgaagaagcaagagacagacacguacucaugcguaguugagguacaaggggcacgcccaggccagguuguuagaugcacacagccugaagggcacugauugcaaagacucacaauaacaguaugcauaccccugguagugaggggcugcggaaccucugaacagcugcaggggucgggguggugguguggaauaccugagagaaggcagugggagcaagcaagugggacuggacuuucuacuagcagcuggaaggggcaauggggggaggacaucuuucccugacccacgauacuacacagaauauggguggcaagggcagcuuucccaugccccuaccaccagagccagcugaacugugcuguccaggcaagguauaaugccuacucucuuguguguugcagccagugaagggcagggaaagcuaugcccaggccuuggacaucaauaugguuccaugugccagccuauggcacaucugcaggaucuuuggugguaaccacaugagccacagauaugagccagaguucccugcuacugcaugcucacagaccaaagcauggcccucagcagcagcacuggccaggauuucaccaugaccucagaugguagggcagacuacucacaucaggcuauuccucucuaccuacuucauagugcuucuuuuuuuguguguggcucuugaaucacuuuauuuacguagugucuugucuucucuagugucuuuuuuuuaauuuuguuuuuccauuuuuuauuauguauuuagcucauuuacauuuccaaugcuauaccaaaagucccccauagccacccacccgcacuccccuacccacccacucccccuuuuuggcccuggcguuccucuguacuggggcauauaaaguuugcauguccaaugggccucucuuuccagugauggccgacuaggccauuuuuugauacauaugcagcuagaaucaagagcuccgggguacugguuaguucauaauauuguuccaccuauaggguugcagaucccuuuagcuccuuggguacuuucucuagcuccuccauugggagcccugugauccauccauuagcugacugugaacauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuuuaacuccuuccauggguguuuuauucccacuucuaaggaggggcauaguguccacacuucaguguucuuuuuucuugaguuucauguguuuaggaaauuguaucucguaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguaguaccacauuuucuguauccauuccucuguugaggggcaucuggguucuuuccagcuucuggcuauuauaaauaaggcugcuacgaacauaguggagcauguguccuucuuaccaguuggggcaucuuuuggauacaugcccaggagagguauugcuggauccuccaguagcacuauguccaauuuucugaggaaccgccagacugauuuccagagugguuguacaagccugcagucccaccaacaauggaggaguguuccucuuucuccacauccacgccagcaucugcugucaccugaauuuuugaucuuagccauucugacuggugugagauggaaucucaggguuguuuugauuugcauuucccugaugauuaaggauguugaacauuuuuucaggugcuucucugccauucgguauuccucaggugagaauucuuuguucaguucugagccccauuuuuuaauaggguuauuuguuuuucugaaguccaccuucuugaguucuuuauauauguuggauauuaguccccuaucugauuuaggauagguaaagauccuuucccaaucuguugguggucuuuuugucuuauugacagugucuuuugccuugcagaagcuuugcaguuucaugaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguuguuccagcaccaauuguugaaaaugcugucuuucuuccacuggaugguuuuagcucccuugucgaagaucaagugaccauagguauguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauuuguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccaaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauauuucaaguacuauguugaaaagguagggagaaaaugggcagccuugucuagucccugauuuuagugggauugcuuccagcuucucuccauuuacuuugauguuggcuauugguuugcuguagauugcuuuuaucauguuuauguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuucauugauggaauuucguauauuaaaccaucccugcaucccuggaauaaaaccuacuuggucaggauggaugauugcuuuaauguguucuuggauucgguuagcgagaauuuuauuaaggauuuuugcaucgauauucauaagagaaauuggucugaaguucucuaucuuuguuggaucuuucugugguuaagguaucagaguaauaguggcuucauaaaaucaguugcguagaguaccuucuacuucuaucuugugaaauaguuugugcagaacuggaauuagaucuucuuugaaggucugauagaacucugcacuaaacccgucugguccugggcuuuuuuuuuaucugggagacuauuaauaacugcuucuauuucuuuaggggauaugggacuguuuagaaggucaacuugauccugauucaacuuuuguaccugguaucuguccagaaauuuguccauuucguccagguuuuccaguuuuguugaguauagccuuuuguagaaggaugugaugguguuuuguauuucuucaggaucuguuguuaugucucccuuuucauuucugauuuuguuaauuaggauuuugucccugugcccucuagugagucuagcuaaggguuuaucuaucuuguugauuuucucaaagaaccaacuccucguuugguuaauucuuucaauaguucuucuuguuuccacuugguugauuucaccccugaguuugauuauuuccugccgucuacuccucuugggugaauuugcuuccuuuuuuuccuaaagcuuuuagauguguugucaagcugcuaguaugugcucucuccccuuucuucuuggaggcacucagagcuaugaguuucccucuuagaaaugcuuucauugugucccaaagguuuggguauguuguggcuucauuuucauuaaccucuaaacagucuuuaauuucuuucuuuauuccuuccuugaccaagguaucauugagaagaguguuguucaguuucuacgugaauguuggcuuuccauuauuuaugcuguuauugaagaucagucuuaggccaugguggucugauagguaggauauaugggacaauuucaauauuuuuguaucuguugaggccuguuuugugaccaauuauauagucaauuuuggagaaggucccaugaggugcugaggagaagguauauccuuuuguuuuaggauaaaauguucuguagauaucugucagguccauuuguuucauaacuucuguuaguuucacugugucccuguuuaguuucuguuuccacgaucuguccauugaugaaagugguguguugaagucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccucauugucuuuuuugauaacuuuggguuggaagucgauuuuauccgauauuagaauggcuacuccagccuguuucuucagaccauuugcuuggaaaauuguuuuccagccuuucacucugagguagugucugucuuuaucccugagauggguuuccuguaagcagcagaauguuggguccuguuuguguagccagucuguuagucuauguuuuuuuauuggggaauugaguccauugauauuaagagauauuaaggaaaaguaauuguugcuuccuauuauuuuuguuguuagaguuggcauucuguucuuguggcugucuucuuuuugguuuguugagggauuacuuucuuguuuguucuagggugugauuuccauccuuguauugcuucuuuucuguuauuauccuuugaagggcuggauucguggaaagauauugugugaauuugguuuugucguggaauacuuugguuucuccaucuaugguaauugagaguuuggccggguauauuagccuggguuggcauuuguguucucuuagugucuguauaacaucuguccaggcucuucuggcuuucauagucucuggugaaaggucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuucuuuauguuugggaaguuuucuucaauuauuuuguugaagauauuagcuggcccuuuaaguugaaaaucuucauucucaucaauuccuauuauccguagguuuggucuucucauuguguccuggauuuccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccaguguugccucgcuuuggguuuucuuuauugugucuacuucccuuuuuaguucuaguaugguuuuguucauuuccaucaccuguuuggauguguuuuccuguuuuucuuuaaggacuucuaccuguuugguuguguuuuccugcuuuucuuuaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguugucuugauuucuguuaguaggauucuuacguuugccuuucaccaucugguaaucucugaagcuagcuguuauaguugucucuguuaagagcuuguucuucaggugacucuguuagccucuauaagcagaucugggaggguagcucucuccuuaguuugagugggcagaguauucucugcaggcacgcucucuucuugcagggaagguacccagauaucugguguuugaaccggacuccuggaaggaguuguguuccacucacuagaggucuuaggaucccguguggaauccugugugcgcccuugcgggugucgggcaacucugcuggcaagguaaccuggggcucgaguggagcggaaggggcuugugccccaggucaggcccggguauuccgcuucccuauuuaccgcagucucagguucugcgugauuggauuggggcaggggcuguguuccacucaccagaggucuuaggaucccguggggaaucccgugugggccuuugcggguguccggugccuccacuggcaagguaccucggggcucgaguucauagugcuucuuauucucuccuaucccucuaucacauaauugcaugugguaguggcucccacugcagggggcgcuaucuuagaguuuuacugcugugaacagacaccaugaccaaggcaacucuuauaaagaacauuucacugggguugguucacagguucagagguuuaguccauuaucaucaaggcaggugcauggcagcguuugggcaggcauggugcaggaggagcugagaguucaacauuugaaggcuacuagcagaauacuggcuuugaggcagcuaagaugaagaccuuaaagcccucacacaaagugacauaccuacuucaacagggccacaccuucuaauagugccacucccugggcugagcauauacaaaccaucacagggaggccauauggcagaguacaggcuucugggugccuccaguucacacaugucucccucgaguuugcuuuuuuaagcuucugaaaaaugugacuuguugacauuuucuguuagccuaggaauggaccuguguucauuucuagccaguauuuaauaaagcuugauucaaacuuggcuuaaaaauugugggaguggucuuauucuugccuggugggauuaucauaaaacuacaaucggaaaagcacaaacucaaacuguaauuuaccuugaaacaugcacuuaaaauucaggcuaaaaaguuaagagaaucaaagaaagccagguaucaccucccacauuugcugccucgccagaugaccugaguucagaaucccugguauccacauauuggaaggagagaacuaauucccacagguugucuguccucugacauccuuacacaggcacacguacaccacucaaauaaauucauaaaugcaaaacaaagaauuuaaguugagguuuucuuaaguaguaucagauccuuugaagcaaggguggcccuugaacuuggaaguuauguucuuucagcaggcugacaucccaggggguccuccuguuucucuuuuacuuggugccugaguuguagcucugagaaggaagccugugcaggacugugccugggaugcagaugaaagugcucacuauugcgugaagcaagagcucuuaacugcuuuguugucucucugacuuaguauuucucucugacacacuugugaccuucguguuugcuuaagucuauuuuuucuuuuuuuuuuuuuuuuuuuuuaagauuuauuuuauuuauaugaguacacuguagcugucuucagacacaccagaagagggcaucagaucccauuacagaugguugugagccaccauguguuugcugggcauugaacucaguaccuuuggaagagcagucagugcucuuaaccagugagccaucucuccagcccuguuuuuuucuuuuucauuuucucuuuugagauugggucucucucuguacugaggcuggccuggaacucaauauguagcaaugguuggccuggaauucccaggaacucacagguuucaucuucaggauugcacaaucaaccacaguuucuuuucagacuucuaucauagucucuauaaaaauauuuuguuguuguuguuuuaagccaccagaucugucaguauggguguaaaacagguaaaagagaguaaauccagcuuuacucaugaaucuaacagccccucaagaaauaauccugccuggcucaaguaaaccugacugguggaccucuagaggaagcaagcaucuugcccugcugcuucaagaggugacucggguccagaauccaacacagugcaauccaaggcuuucuccaggguggggagagaguacugggucuggggugggggauuaaaauaacaacaaucuccccaguguaaggcaagcaaggacaugccugcuccaagguauguuugaagggaagguuuuuaauuuuagauaugagggagaguccagccagaggcaucuggaagaguccagagcagagagagaaaguaggaaacuaaauaugaccagcagacugacccagaccacagugggaggggugcgacaagagaggaguguuaguuuacagacaauuccucuaguccccacccaccagccaccuaccuagaaacagcuuacuaggggccugccaggugugaaccaggccuguaagacuacuugcuacccacucucucucuugcccuucuucacucuuucucuguccccacaugcucccagcuggcuaccucucucucucucucucucucucucucucucucucucucucucucucucucucuguucuuccucucuguacuccuucuuucccuuucucuguugcacugucccuacucuccuuguagguccuuauucccucccuucccccaauaaacuuacuuuuauacuaggcauauugcauugagugauuccuggggggugggagggacaccucagcaugggcccaccaagguauccccacagcugcuacaauuauauugcuuuauaaaacauaauaacaaggagggccaagagaggcggggcuuaaggagcacgggggguggggugggggggugggggggugggggaggaccaagaagguccaugaccaaaauggcuggguuauauaggaaugagaaacuggaggaaggaaagcccaaagaggcugagaaguuuaagguacugguggggugagaagagccucagguacugagugagccuggggucagcaugcucuuugauaugcuaauaggaaccacaguucgccauuuguccagaguuuuuuuuaaaccccaaauucuaacuuuuuguuaaugacaaaggccugcauaaucucaucuguaacugcuucuuagcugagauuaugauguaaucaucaggacacagaaaggcuggaaugcuggucaaagacagggaagagagaaagaguucaggcuuggggacaucugguuuaugccuagccaaguucugugggaccacauggggcuagagcaggcagcuuugagucagucuggaaauguugguucuagucuagggcuaacuggcuuugauuuggagcaguuuucagucgucaguugauugggaacuggacauauauagacuaaggucagaagguaaaguuaaggaccuuaugggaaaaaucuuuaugucgggugcacacuugaaauaucuaggccuaugguggcaagugguaggcugcuucuucuuucuuucuuuucuucuucuucuuucuucuucuucuuucuucuucuucuucuuucuucuucuucuuuuucuucuucuucuuuuucuucuucuucuuuuucuucuucuucuucuuucuucuuucuucuucccccuccuccuucuccucccccucccccuuuauuuauuuauuuauucauuuauuauaucuaaguacacuguaccuguauugagggcaucaaucucguuauagauguugugagccaccauguaguugcugggauuugaacccaggaccucuggaagggcaguccguacucuuaaccacugagccaucucuccagccccaagugguaggcuucucuuccucuuuaccaguggccucucacacgcacuauugucucgccagcaagaacacacgcgugagaaaccggauccuucugcagcaacuuuauuacaccaguuucaagaugaagaggaagaccccaagcaccaaaaaggugcugcuuguauacaccuuaguguggcauguccacaccugauuggcugcucucccagagccucaucaccacaccccgggaugggccaugacuuggcacgaaaacacucucccacaugugcacauugcuuguuuaccaauuaggccaugcaggcacagugaaaaccgcuuccaaaaguggcccaacauuuuugaaaucuaaaccugggcaugagcucucucgcuucuuggaagacagcccuucucaacuugaccuacaaacacaucacuguuaagucucaauccuuauuuucuuauucauccccaagaucuaaauaacuuuaaaaguuccagucuuuacaaauucuuacauauuaaaauuuuaaucauuuuaauauguccaaucucuuuuaaaauacaaagucuuuuuacaaugaaaagucuuuuaaaugugggcuccacuaaaauaccuucuuccuucaagagggaaaaauaccagggcccagucacaaucaaaagcaaaaucaaacugcagcuguucguucagcugccugcacucuacugcugcuccuauucuugguggucgucucaugguauuggcaucuccaaaacacuggugucuucuccugcaacugggcuucaccaauagccucucauaggcucucuucauugugccaagccucaauuucuuugcaugaccccuucaguccugggccaucaacugagacugaggcugcaccuucacuaaugaccuuccacagccucucacagugcugagccucagcugcucuccaugaccccuucaugccuucaaaaccuguaccaccugggugacucuuacauguuacuaagucaagggucucucuggaacacagccuuacacaaacuuugagguuugugcucucagaaaacucuucccagaauauuucaccucaguaaugcugguaucuuccuaaucaccacuaauuucuuggcuccagcuaaccagaaucaauauucccaguaaugcaaagguuuugauuuaguaguucuggcaucuuguuaaucacagcggauucuucaccugcagcgaaccaaaaccacagaaacuugguaaucaaaacagcaacggcccugauaaaagucucuaauuuucccucugaaaucucacaagucagaucuccauuuucugcacuguucucacauuaucuuccaagcuccuaagcaacaucccacagagcucuucacaucccauugacucuucuagcaaaaaguuccaaaguccuuccacaguccuccucaaaacauggccagguugucacaggaauaccccacuccugguaccaacgugcuuuagucaggguuucuauuccugcacaaacaucaugcccaagaagcaagaugggguggaaaggguuuauucaguuuacauauccacauugcuguucaucaccaaaggaaaucaagacuggaacucaagcaggucagaaagcaggagcugaugcagaggccuuggagggaugcuacuuacuguccugauucuccugcuuuguucagcuuucuuucuuauagaacccaagacaaccagcccagggauagaaccaccuacaaugggcacucccuacuugaucaauaauugagaaaacgccuccuggaagcauuuccuuaacugaaguuccauucuuugugauaacuccagcuugugucaagucaacacacaaaaucagccagcacacagguugucugaggagaaggccuaacucugcaccaagaaggccauguaccugggauuugaccuccaggaagauaggaaguccuuauccaagucccauaaacaauguuaggaauucccauccuaucagugaaaaauugauucagggaauuuugggggucagcaggauaguauaagugaagcucuggauuacuggauuugcugaauuagguagaccuuuaggugaagucaccaaaaggucugaggauaccauucaaaggcucucuaacaccuauaccaaggaaggauggcaccucaccacugaugggagaugaauccuucccuggauccugaaaggauguugacacaauuacauaguuggagucaucuagguaugacuaaauugaccaguuuacucaacaggaacuacuauaucccuggucuggaccagauucugcaagacacagucuccagaugucucaacucauggguaccaacccuauugggagguccugugccaaggguaaaagagaaagaaaaacugccucaggaguauauuggaaauuggacuucacugagauccaaccaagucaauauggauagauauuugcuaguuuuuguagauuccuuuucaagauggacugaaauguuccugauagaaaaaagaaaacuuuacauauaguggcaaagaaacucuuagaagaauuccucccagguaugguguuccuuaggauuugacgaugugccagcauuuauaucuuagguuguacaagguauaccuugagccuugggagucaauuggaaauuacaccauguacaucauucucagaguucaggacagguagaaagauugaguccaaucuuaaaggagaccuuaacucaauuaaccauagaaacugguaagcacugaacuauacccuccccuuugcccuuuuaagaguuagaaauacucccugaugauaaguuauuuuuccaccagugaaaugagccaauucaagccagauuagauuauauuaaacacaguuuuauuggaauauugcucucaguugaguucacugacccagggaagaaggugagggaaguuaccacagguaugggguaaaaggcaaaggggaagagaaagugcccaugugcagagagagaacaggaagaccaaaauccucuggauuauauagggaagagccucugcgggaauggcagcccagucccuaggugggaaguucaggauugggggcagguuaugccagguaaggacagaaggaugcugggagaaccuggaggccaggucugcuuugguauguaaaauaugcaacuaagcaacuuguccagggcucugaaaccaaacauuccagccuucuguugauaauaaaagaauaaggggugauguauuuauucauuuaugauuucuuccugcugacauuggggcaucauuauggggguggccaaaaagcuugauuguuggcuacuucugggaggagcuggcugucucccugcuguccaggcugugggaccaucuggugcuaggagugcacacacccaauugaaggauucugugaggcugggcuggagcaccuauagguaacaguuuugguccuguggcagcaggggacuccuaccaaaaucgagguggacaccccuggucuugguuucugcuuggggacacauaaauguuugagggcucuguccaacugaccccacuccucaucuggaaaucauaggagagcuggucauggugggagagcaaagcacugaccacacccuaguuacauggaaguuuacugagcagugagagcaagccacugaccacaccccuagauaguggaaauuugcugaguagugagcacaaggcacugaucacacccuuagccaagaggaaauuuacugaacagugagaguaaggcacugaccacaccccuaggcaaguggaaauuuacugaguagugagcacaaggcacugaccacaccccuaggcaagugaaaauuuacugagcagugagaacaaggcacugaccacaccccuagccaagaggaaauuuacugagaagugagagcagugcagugaucacaccccuaggcaaguggaaacuuacugagcagugagaaaaaggcacugaccacaccccuaggcaaguggaaauuuacugagcagugagcacaaggcacuaaccaaacccauaggcaagugaaaauuuacuuagcagugagagcaaggcacugaucacaccccuaggcaaguggaaacuuacugagcauugagaaaaaggcacugaccacaccccuaggcaaguggaaauuuacugagcagugagagcaaggcacugaccacaccccuagccaagaggaaauuuacugagcagugagaaaaaggcacugaccacaccccuagccaaggggaaauuuacugagcagugagaacaaggcacugaccacaccccuaggcaaguggaaauuuacugagcagugagagcagugcacugaccacaccucuagccaaggggaaauuucugaguagugauagcaaggcauugaccacaccccuaggcaaguggaaauuuccugcuauggugaggagaagcaaaugguuagagcaaguagaggggagaagcagcugaagaggugaauuccagguuuggaguucacuaugguagguugcagaagccugcaggaacaagugauccauccaugcauaccuuaggaagucgucaaaccaacagcaugguuuggcuaggagaggcugagucucuuggauggggucauauauauuccucucugguuucaggcaccagauguacaaagugaggacaaaacuguuccauuucugguuagggggaaggguuuuauuguagauaggagggagagcucagccagagacaucuggaugaguccagagcagagagaaaguaguagauuaaacauggccugcagacugacucaggccuuaagaggcggcugguggagagugggagaggaagagaaauaaggaccagaagagagggggaaaggagaggaagaaccaagaaggcacauuaccaaaaaauggcaggguuaccugggaaugagaagcuaggggaagggaagccagugagguggagaagucuaaggugaggucauguucuucaguauguuaauaggaaccacaguggaccauucauccugaguuucuuuuggaccugauaccaggacuugccuucaucuaaauuguuacuuacucucaaggagggccuccaccagagagcugcagagggcaauuguuaaccuguggugguuugaauugguuuggcccucauagacucauguguuugaaugcuugccucauaagaaaugguauuauuaggagguaugaccuuguuggaggaaguuugucacuguggggacaggcuuugaggucuccuauguucaagcuauguguaguguggcacacagucuccuuuuauugcuugcagaucaagaugcagaacucucagcuucuucuccagcaccaugugugccuccgugccuccaugcuucgcacuaugauaaucauggacagaacuucugaaacuguaagccagucccaauucaauguuuuccuauauuagaggugccuaguccggaucucugugaguuugaguccagccuggucuucaaaucaaguucaagacauuaaaaaauaaaauaaaaugaaagaguugccuccaugguuucucuucacagcaauaaaaggaagcuacagacaccaucuguagaaccuuuaucuucuucagauacagaagacaauuagcaucaguaggaacagccaguuucugggaucuaaaagugggaaaaacaagaaauauuuuggucaacucaagaacagaaugcuggaauuauaggccauggccagugugcccugguugaauuuauuguauuuuuggcaguacuggggauuaaauuagggcuucaugcauguaggguaauacccuaccacugagauuuagcccaacccucaauuuuucauauguuguuaaauacaguuacagcuuucauucuuucauagguauagguucuuuugcuagcauuauuauuauuauuauuauuauuauuauuauuauuauuauauugguuuuucaagacaguguuuuucuuuguagcccuggcuguccuggaacucacucuguagacaaggcugaucucaaacucagaaaucuacuugccucugccucccaagugcugggauuaaaggcaugcgccacuaaugccaggcuagcauuauuuauugaagaggcugcccuuuccccacugaauauuugguguaagggucuacauauuauaaggaauuauuaaaaaugccauuaacaugggaaugagacagcgugggugguacaugaugauucaaccgugacaaggcaugaggcgaugacagagcuucagccuagaucagccuuaauacaugaugguuggguagcucagugguuaaggcguucuugcaggggaccccgguucacuucccagcaugcauaugguggcucauaaccacaacggggaacuccagucccagguaaguugacgcuucuucacacacauggcacuggcauacgugcagcaaacccccauccaugcagagaaacaugaugcugaaacccagacacaaaagccacacacggcgacucuaccuccaugaaccauucagguaggccagaccacugaggcagaucuucuugggagggugggucaaagagagacauauguuugggagacauuguaacagauagaggagcugguauucaguuucauuuugauguccauuuugaaacuguuaaugcuaugguauguacauugucauucaauaagaagacaaccauagcacuggcugcguauguggccuaggauggcuuaguugggcaucagugggaggagaggcccuugggccugaggguguucaaugccacaguguagggaaugccagggaggaaagaugggaguggaugguugggagcacccucauagaggcagggggaggagggaugggauaggggguuucugaaagggagaccugguaagggggaaacauuugaaauguaaauaaagaaaauuuucaaaaaauaaaaaaagagaagaagaggaagaggaggagaaggaggaagaagaagaggaagaaggaggaggaggaggaggaggaggaggagaaagccauaguauuuaaaaauauaucugucuuacuugaaacagaugaacugcacacaguguuagcuguggaguugcauuccuggaggacagggauuccuuggggacaccugcagagagacacccucaguucauccugccagaccccuccugcauucaucagcagcagauguccagcaa

SEQ ID NO: 4235 - RNA, 14861 nt, Mus musculus
cagcugagcagcagcggcgugcuugcacucggccauguuuggcuucuucugcagcuugguguccagucugagucgcugguuccuuuggcggcggcugcugcugcugcugcugcugcugcugcugaaucugcccuugcaggugaguagauauggcccugcggagcugagacucgcucugggcaccggauccccggacugcagaggaaagcuacugccggcggugaacugauggcgggcugugccaucagccugggcaucgccaaccaacacuucagaacuucgucugcucuuaagugguccagaguugggggauugaggaggugaagcagaggcaggggaauggccaagcggguagccagagaaaguguguccgguuggucccugagcuccgggacaagguggacacgccucuccucccuuucucaucagaaagcgguccaucggaaggcgacuccggaaagugccauugcggacugcaguggcccgcgcgacugugcgccuuggguggguccggcccggcuggucuugggguguaguacuaacuacuacaaaaggaucuguguggaaggccuggcuaugccuuuccugggccuuucgggucucugcuaaguucgucccgagaucgcuucuugucucuuuaaucauaaacugcaguuaaaccuaaguuagugggcagccugaucuacauaaggagucucaaaaccaaccaaacaaccaaacaaaaaaccuagacgauccuguaaaugacauuuuaguuacagccaacuuaauuuuaugucaauuuucucucauaagagucuucaucccaaaaauaggcagaaaaagguuuauguuuuauaaccuguaaggauauccauuuuguaacacauucagaucuuuaguuauaacaacaacaacaacaacaaaauaacccuuagauuguucuaagauaguaucugagcagucagagaccacuuacauguaaucagcauuucuuuaaaccaccuaggagcugguuaauaguaauucuuugcuagcugcuggugagcagcuuucacagaaauggacccagagggcauccagcuucccugggaaucuccugggcaaggggccagaggauaugcaacucagaggugacuucaaaguucccagcacuuugagggacuucgaacauauuucacaggcagguuucacaugggauggcccuugacccugaaaucucuucccaucccuauuagggcucuggggcuccaugccugcccaggcaccgccugaaaaguggugcauuuuguccuccagaaauccccagaaacaaucuagacaauauuagguuguuuuuguuguugauguuuuaagguuguuguaaagaaaaaauggugaucaucucaaauaaugccacaaaaugaagguacuccaaagaaagacugaggaugagcugggccggguagugcacgcccuuaauucuagcaauugagagacgagguagacauguuugugaauuuggguuuagucugaucuuuauagugaguucuagaacagccagacuguguaugagacacuguccuguaaaagucaaaaauaaaaauaaaagacugaagauaacaucucuuucaagaauauuuuuuaaaaagacuauccucaaagaauauugaaauuuuaaaaaauagggcauguguguagauuuuuggucuuuugagacaggauuucucuguguagcucugacuguccuggaauuugcucuguagaccagauuggccuugaacucagaggucugccugcugggauuaaagacauaggcugugaagauauccuacuaaauccacugucuaaccuguggucauguccuuccuaaguguaaguacaggugaagcaggccauuuccaagggguaaaauaguauugccuucagggcagugaugaagugucagcuucaacauauaauaauggugacgaugaaucaagaugaagguauugaaccuaggaacccuaaaaagaagacuccugccuagcaguuaagagcagaauuccugacagaauuaaaugggcagagaccaccagaaagagauagauacauagauagauagauagauagauagauagauagauagauagauagauagauagcagagaccaccagaaagagauagauagauagauagauagauagauagauagauagauagauagauagacagacagauagauacauggauagauacauagauagauacauagauagauagauacauagauagauacauagauagauacauagauagauacaaagauagauacauagauagauacauagauagauagauagauagauagauagauagauagauagaugauagacagacagauacacacacacacacagagagagagagagagagagagagagagauauccuaucuaugaaccagacuccugcugaaggcuggacaacacugacgaguaugagaucagagcacagugguaaguaugaaugaggauggcucccacgaauguauagaugggcccuaaggguugaugcuguggagaauuuuuuaccagaguauguaccauagagaugcaaauauaaagaagugagccucagugcucaauaguuuuuuguuuguuuuuuuguuaaagagcucaguugauuugugugcuuaguuugagcuccuucccaguguuuggguaucagucaagguagguuacucagagaaggaaguggggaggagauagaacguccugggaacauaugaacuguucuauaugcauuauuuaauuucacaacccuaaauaguaaguauauuacuauccccauuuuacagaugagaaaagugagacaugaugaugguaaauagugaaucaccuauucauuuauaggcucuauuagcuugugugauaucauggcuccacacaugaucuuucaauccccuaugugaucaaugaucaccacauaaaguuugggguuuuuaugguuuucgcucuuguuuuuuuguuucuugggguuuuuuguuguugcuguuuuguuuuguuauuugccucuguuucauguugcauguaucagugucuggagugcauuaaguacuggcuauucuuguagaggaauaggacucaguucccagcacccacacguuuguaauucuagucccaggauucugcuguucucuucuggccuccucaaucacugcacauacaugguguauaugcauucaagcaggcauacacucauaaacacaaauauaaaucuuuaaaaucaucuguugcgccaaugguggcacacacacucagcacucaggaggcagaggcagaggcagaggcagaggccaaggcagguggauuucugagaucgaggccagccuggucuauaaagugaguuccaggacagccagggcuacacaaaaaaacccugucucgaaaaacaaaaacaaaaacaaaaaaaacaaaaaacaacuuuaaaaucaucuguugcagagcuagaaauauagcacauugcuaauuaauuagugcccagagugagcccuggguuuaauccucaguacuacaauaaaauaaaguaaaaccaguuauuucuuuacaauuacuugaggcuuugaguaauaaaagaccaaacaaaauuagauauuauuuauuuguuuauuuauuuauuuauuuuaguauuugcuuuugcuuauuuguauaaguguuuccuaaaggguuguuaaguaugucacuuuugucugcaauuccugagaaggccagagaugacaucagauucucaugaacuggaguuacaggugacugugagccucuugcaugguugcugggaaccaaacucuggccuucuguaagaacagcauauguuuguuuuuugggaguuauggucuuguuguuuuaagacaagcccugacuauccuggaacucacagagauccaccuuucuuugucucucgagugcuuggauaacgauguguacugcucugccuggacuccauaugcucuuaccugccaucucuucagcccuagaaacacuucuaaagcuuuaggguucuuagagaaauaguaugugaaggaggugaauuaaagaaaaaaaaggggggcuggagaaauggcucagagguucagagcacugacuauucuuccugagguccugagcuccugaguucaauucccagcaaccacaugguggcucacaaccauuuguaaugggaucugaugcccucuucuggugugucugaagaaaacuacaguguacucacauacauaaaauaauaaacaauucuucaaaaaaaacaaaaaaaaagaaggaaggaagaaaggaaagaaagaaagaaggaaagaaagagagaacaaaaaacaaagcagagcuaucacuccuuuauccuuuugcaaguuguuccaacuggugucuccaucugcagccccagcauaggaagcagccaucaaagcuugagauuuggaugauaggaucccaguaggucacaaguugugcuagaacauucgcugcugcugcugcugcugcugcuaaugaugaugaugaugaugaugaugaugaugaugaugaugauaaaagugaacuaaggauggaguggggugggcaugauacugcugugcaaaaagccaagagccacuagacuugguagugguguauugugcaagcuuuccugggcaacugcaggcuucagaguucuacagcauagcaucagccacagcguagcaucagauaguccccgcugggcucugcacaaggaggcccugccuugguacuuccuuuuccaccaucauccaaaccauccucugcaguuaccaauaaaaauaagcugccccuuguccuuuuccacucauagguaaaauuugcuaugcuagaauuacacuccuucaaaugucccgcuggugaauacuggucuaaagacgucuguugcaagaacuguucugcaggugaguucuuugcugggacccaaugccacagcauagacaugggugaccuuugaagcacaccaguggcuauacaagaugaggagggugugugccagggaggucaacucagccacugccuacucuuucaaacucuaggagaugcuuccuaaccaagguacacagaaugucaccccuaaaggaggcccucuguguguucaagaggguuggugugaguauucauugcaaggccucacuaguguagggucacccaacucuccacccugcaaggcaugaugaguucuaugcccauauccaaaggcaccaagcugagaggaagguucagaaaagggagcugggaggguuaauuucaucuaccuguacuugucuugggugccagggaacccuuagccccuacugcuaccacuuccaauagagaaaguggcuuaaguagcuugcuauggucacacucuaccuugguggcaauguccauccuugcucuucugcucucagcuaacagcacaugugcucuguaucaggaacccugguucuguaauuauuucuggggagacauaaacaccaacuguucacuccagauaacaggaagugauaauagucacugagaacagaccaaagaagcgauuuacccaagugugguuuggugaaccauugagguuauuggggucgcuuucacacccauaggugacuaaugcaacuacauauuguaauaugagccuagcaugggugacaacuuauuaaagcuguaugcccaaagcacucagcacaacuuacagggagccagagucucuuuucuagagauuguuuaaaguauaauguggcugugaaaagacaccaugaccacaacuuuuauauaggaaugcauuuuacuggauugcaguauugaaaguuuaguccauuaucacaauggcaggaggccugacugcagguaggguugaaaaagauaaaaauggugcuggagaaguaggugagaguucucuguucauaugcaaaggcagaagaaaaaaacaaacacuuggacccuugaaacuucaaagcccagccccagugaugcacuuccuccaacaaggccacaccccuuaauccuuucaaauagugucacucccuggugacuuacaugggccuauggaagcccaguagggagucaggaucucauucuacucacccuaggcuaucuugguuccuaguccccuaagggucagauguccacaggacugaguguagcucagggaaccagcagcccucauagauccucaagcacuuugugacagcccagagauuauuuugaacuugugauaaagauguuaagccuacauagagcaacauagcccuuuauugcugaaugccugagcaaggcugaucccauuugcccuuauccccagguacauuugucaaggcgcccugcgaaaucccccauacucaaggacaaugugagaagugucacccaggaacauucacagagaaagauaauuaccuggaugcuuguauacuuugcuccaccugugauaaaggugaguaugugacuuagcagaggcagacuagcuaugaagacuggcauuagagucagaaguaccuggauggaguagucaugacuaauggaugccagaaugcagccacagaauccccacuggcauaaaacuuguuuccugccgaugggcaugguuguacaauguuuaaucccauuacacagaaggcagaagcagcuggucucugucuuggaggccacccuggguuuuguuguuugguugguugguuuugguuuuuguuucucgagucaggguuucucuguguagcccuggcuguccuggaacucacuuuguagauacgcuggucucgaacucagaaauuggccugccucugccucugccuccugaguucugggauuaaaggccugcaccaccacuguccugggaggccaccuuguuuauacagugaguuccagggcaguucuaaaggcuacacagugagacccugugucaaaaucaaaccaagccacaaauuauugauuaugaguaaaaaggacuccguaaaaucaaugucagaacaagcacaaucauagccuucugccuuuuuuauaaagauaauuuuucuucuacuugucaauugaaugcagaaccuaguaaaacacaugcugguaccuagaaagaucauaccucuguggauaagcaaucaugugugcuucccagacacacagagaagagcuaaaagaguagaucagagggcacacagaucuggggaagcagcagagagacgagggccacaccugcagaugucuuacaggauauagaaauauaauaaaaccuuuuucacaaacuuuaagcaggcagagcauggcagcacaucuguuuaaucccagcacucuaaaggcagaucucugugaguucaaggacagccugaccaacauagugaguuuaaagacagccaaagcuacauaguaagacucaaucaauacacaauaaacauacaaacuuuaagcauuuguuggaggacuggaagcagcucacagagugccugccuaguaugcagaagaaggccuggguuuguucucugacguagaggggagugggggcgaagauucuguuuugugugugcaugcaugugugccuaugcacacacuccuaugccacagaaucauguuaaacuaaguggcaaauacuacaguaucucaugcuucagcccugucauuugcaucuacuaagcauagagauggaaacaggcugaguauaccagcacacaucucugguuccagagcacaggaggcagauauagaaaggacgcuuuagugugcagccuaauuguagaaauuagguucugguucuuccucucagcuccaugcacccugaaauaagacuuguacucagaauauauuuauaaauaccuuggccauauagcuaggcucuucucugacuagauauaacuuagaauaaccuauuugucuuagucuacauucugccacauggcugguugccugugcucagguaccaugugucuccucacaucuuccuggaccaaucuccugccuggcucuaucccagaauucuuucuuucucucaguugucccaccuccuauuuccugccuaagccauaggccaucagacuuauugacagaugccacauccauacaaacauaagacauucucucuauacagccugaucuacguugugaguucuaggacaucaugacuacacagagacauauugucgcaaaaacaaaaacaaaaacaaaaaagacagaaccauuuuccacguucacagaucccugaugcuguaagacaucugcagagagcugggcugagaguccucccugccugugcucccugcuguauucugagaaaggacaaugccuagauucagagaauugugagaggugacauuuauagcuugaguguuuaugguguccugaacacaagguuaaaaucgaacaccccaaugggaaagccaucuucuuuuauaagccacugaguaagucucacuuaaggaagguauacacccagagcccaagggcccacuagggcucuggguacaagaucacuaggugcucuucagagaacaauaaggugauuaaacaaagcaucuucagagaugucugauggacaugguggcuucuggagagggaacuuuguggggcagaggugugucuacagaucaggaccacccauguuggaguccuuaggggcagugugaugcuauuacacaggaugcuaaacaauggaccucccaagccaucaucucuggucuggguaccaccccagaggcccaaggaugagauacucccaguagugcugcuuagcacuccguacaucugugaugggaaugugaagguuuaccaggacacauuguguuccuuucaggugacaguggggucugugugcauaugugaagguuuauacugcaaccugacccuauucuucccuggauugcagaucaggaaaugguggccgacugcucagccaccagugaccggaaaugccagugccgaacaggucuuuacuacuaugacccaaaauuuccagaaucgugccgcccauguaccaaguaaguaccacuguggccuggguaggugguagcuuuauauguugccugaauagccucuaauguccagggagagggacagucugucucauacuuuggcagaugacauugugugguggagacuuuguggucugggugguacaggacuucuugcuggagaucuccauggcuaaugucccuugagagaaaguagacaacaccggguaaagcacuagguuuuccugaguuaggucuuccagaggguucuuaguguauuuggcuuuggaagggcuggguaaugccucauucauuaucagcaagguaguacuggguuaacauggggguucugggaugaaacugcugggcaagguuugggaaauccugugguuucaccccucaguaagaguguugcuucagucagauggaguuguugaguccuaggggcaccagcacaagccacuuacaaaggacuguuacuucucuggggaaucuaaacucugagucucuugagagaggccaggcaggccucuccuuuuccucacugcaaguccaccaaagaagcuauggacaucaacggaggaggaaaauguaguaacugacguguauuaaguaguaauaacacgauacugucugagaugccagugggucugguggcagcuguguggccagaacacuguugcagaucuuggaucaggaugcugccugaugugguuuggaggggcaucacgccuugcuggacaucugcugcugaugaaugcaggaggggucuggcaggaugaacugagggugucucucugcagguguccccaaggaaucccuguccuccaggaaugcaacuccacagcuaacacugugugcaguucaucuguuucaaguaagacagauuuauuuuuaauuuccaaggccuuccuccuccuccucuuguccuccuccuucuccuucuccuccuccuccucuuucuucuucuucuccuccuccuccuucuucuucuucuugcucuuccucuucuucaccucuuccuccuccuccucuuccuccucccccucuuucuucuucuucuucuucuucuucuucuucuucuucuucuucuucuucuucuucuucuuccucuucuccauauuuucuuuauuuacauuuaaaauguuucccuuuuuccaggucucccuuucaaaaaaccccuaucccaucccuucacccccugccucuugagggugcucccacucccgucuucccuuccuggcauucccuacacuggggcaccaaauacccucagaccucugggucuuuccucucacugcugcccaacaaagccauccucggccacauagguggccagugcuauggcugucuucuuauugaaugaaaauauacauaccauagcauuaacuguuucaaaguggacaucaaaaugaaacugaauaccagcuccucuaucuguuacaauaugucucccaaacguaugucucucuucgacccacccucccaggaagaucugccucaguggccuggccuaucugaaugguucacagagguagaguugccauguguggcuuuugugucuggguuucagcaucauguuuucucugcauggauggggguuuucugcauguaugccugugccauguguaugggacuggaguuccagaugguugugagcugccuuguguaugcuggaaacugaacuuggguccuuuacaagaaagccuuaaccacugagcuucccaagcaucauguauuaaggcugaucuagacugaagcucugucagcgccucaugcuuuuucaugacugaagcaucacauugucucauucccauguuaauggcauuuuuaauaauuccuuauaauaugugacccuugcaccagacauucaguggguaaagggcagccucuucaauaaguaaugcuagccgggcagugguggcacaugccuuuaauaccagcauugggaggccgaggcaggcagauuucugaguuugagaucagccuggucuacagagugaguuccacgcagccagggcuacacagaaaaacacagucuugaaaaaccaaaauaauaauaacaauaauaaugaugaugaugauuauaauaaugcuagcaaaagaaccuacaccuaugaaagaaugaaagcuggaacugcaguuaacaauguaugcaaaauugaggguuugggcugaagcucagugguaggguauuacccuacaugcaugaagcccuaaauucaauccccaguacugccaaaaauacaauaaauucaaccagggcacacuagccauggccuauacuuugagcauucuguucuggaguugaccaaaauguuucuuguuuuucccacuuuuagaucccagaaaccggcuguuccuacuguuaucaccuuugagugugcuaauuguguccguuguugucuuccguaucauaagaagauaaagguucuacagauguuuucuuagcuuccuuuuauugcuaugaagugauacuauggaggcaacucuuuuauuuuauuuauuuuauuuuauuuuuuaaugucuugaacuugauuugaagaccaggcuggccucaaaaucacagagauccagacuaagacaacucuaauaagggaaacauuuaauugggacuggcuuacaguuucggacguuuuguccaugauuaucauagugggaagcauggcagcaucuaagcagacaugauguuggagaaggagcugagauuucugcaucuugaucugcaagcaauaaaaggagacugugugccacacuauacacagcuugaacauaggagaccucaaagccuguccccacagugacaaacuuccuccaacaaggucauaccuccuaauaauaccauuucuuaugaggcaagcauucaaacacaugagucuaugagggccaaaccaauucaaaccaccacagguuaacaauugcccucugcagcucucugguggaggcccuccuugagaguaaguaacaauuuagaugaaggcaaguccugguaucagguccaaaagaaacucaggaugaaugguccacugugguuccuauuaacauacugaagaacaugaccucaccuuacacgucuccaccucacugacuucccuuccccuagcuucucauucccagguaacccugccauuuuuugguaaugugccuucuugguucuuccucuccuuucccccucucuucugguccuuacuucucuuccucucccacucuccaccagccuccucuuaaggccugaaucagucuguaggucauguuuaaucuacuacuuucucucugcucuggacucauccagaugucucuggcugagcucucccuccuaucuacaauaaaacccuucccccuaaccagaaauggaacaguuuuguccucacuuuguacaucuggugccugaaaccagagaggaauaugacccccauccaagagacucagccucuccuagccaaaccaugcuguugguuugacgacuuccuaagguaugcauggauggaucacuuguuccugcaggcuucugcaaccuaccauagugaacuccaaaccuggaauucaccucuucagcugcuucuccccucuacuugcgcuaaccauuugcuucuccucagcacaucaggaaacucccccuugccuaggggugugaucagugcuuugcucucacugcucaguaaauuuccacuugucuagggguguggucagugccuugcucucacugcucaguaaacuuucccuugccuaggggugugaucagugccuugcucucacugcucaguaaauuuccacuuaccuaaggguguggucagugccuugcucucacugcucaguaaauucuccuugccuagggguguggucagugccuugcucucacugcuuaguaaauuuccccuuggcuaggggugcggucagugcugugccuugugcucacuacucaguaaauuuccacuugccuagggauguggucagugccuugcucuaacugcucaguaaauuucuuuuugccuaggggugugaucagugccuuguucucaaugcucaguaaauuuccccuugguuagggguguggucagugcugugccuugugcucacuacuagguaaauuuccacuugccuagggguguggucagugccuugcucucacugcucaguaaauuuccacuugccuaggggugugaucagugccuugcucucacugcucaguaaauuuccacuugccuaggggugugaucagugccuugcucucacugcucaguaaauuuccacuugccuaggggugugaucagugcccugcucucacugcucaguaaauuuccuccuggcuagugguguggucgacuauguggucaacuauguggucccuaugauggacugaccgaagaggagaagacuagagccugguuuacugauggcucugcgcguuaugcaggcaccacccagaaguggacagcugcagcauuacaaccccuuucugggacaacccugaaagacacaggugaagggaaaucuucacagugggcagaacuucgggcaguacacaugguauuacaguuuguuugcaagaagaaauggccagauguacgauuauucacugacucaugggcuguagccaauggauuggcuggauggucaggcacuuggaaagaucacaauuggaaaauuggugagaaagacaucuggggaagaaguauguggauagaucucuccaaaugggcaaaggaugugaagauauuugugucccauguaaaugcucaccaaaaggugacuucagccgaggaggaguucaauaaucaaguggauacgaugaccccuucuguggacagucagccucucuccccagccaucccugucauugcucaaugggcacaugaacaaaguggccaugguggucgggauggagguuaugcuugggcucagcaacaugggcuuccgcucaccaaguccgaccuggcuacagcugcugcugauugccagaucugccaacagccgaaaccaacacugagccccagauauggcaucauuccucgaggugaccagccagcaaccugguggcagguugacuacauuggaccacuuccuucguggaaaggacagcguuuuguucuuacuggaguagauacccuuggauagggguguggucagugcccugcucucacugcucaguaaauuucuacaugccuagggauguggucagugccuugcucucacugcucaguaaauuuccacuugccuaggaguguggucagugccuugcucucccaccgugaccagcucuccuaugauuuccagaugaggaguggggucaguuggacagagaccucaaauauuuauguguccccaagcagaagccaagaccagggguaucuaccuggacuuugguaggagaccccugcugccacaggaccaaaacaguuacugacaggugcuccagcccagucucacaggguccuugaauuggggugugcacuccuagcaccagauggucccacagccuggacagcagggagacagccagcuccucccagaaauagccaacaaucaaguuuuuugggccaccccauaaugaugccccaaugucagcaggaagaaaucauagaugaauaaauacaucaccccuuauucuuuuauuaucaacagaaggcuggaauguuugguuucagagcccuggacaaguugcuuaguugcauauuuuacauaccaaagcagaccuggccuccagguucucccagcaucccucaguccuuaccuggcauacccugaccccaauccugagcuuuccaccuagggacugggcugccauucccccagaggcucuucccuauauaauccagaggauuuuggucuuccuuguucucucucugcacaugggcacuuucucuuccccuuccccuuucuccccauaccuaugguaacuucccucaccuucuucccugggucagugaacucaacugagaacaauuucccaauaaaccuguguuuaauauaaucu

SEQ ID NO: 4236 - RNA, 20071 nt, Mus musculus
auuagauuauauuaaacacaguuuuauuggaauauugcucucaguugaguucacugacccagggaagaaggugagggaaguuaccacagguaugggguaaaaggcaaaggggaagagaaagugcccaugugcagagagagaacaggaagaccaaaauccucuggauuauauagggaagagccucugcgggaauggcagcccagucccuaggugggaaguucaggauugggggcagguuaugccagguaaggacagaaggaugcugggagaaccuggaggccaggucugcuuugguauguaaaauaugcaacuaagcaacuuguccagggcucugaaaccaaacauuccagccuucuguugauaauaaaagaauaaggggugauguauuuauucauuuaugauuucuuccugcugacauuggggcaucauuauggggguggccaaaaagcuugauuguuggcuacuucugggaggagcuggcugucucccugcuguccaggcugugggaccaucuggugcuaggagugcacacacccaauugaaggauucugugaggcugggcuggagcaccuauagguaacaguuuugguccuguggcagcaggggacuccuaccaaaaucgagguggacaccccuggucuugguuucugcuuggggacacauaaauguuugagggcucuguccaacugaccccacuccucaucuggaaaucauaggagagcuggucauggugggagagcaaagcacugaccacacccuaguuacauggaaguuuacugagcagugagagcaagccacugaccacaccccuagauaguggaaauuugcugaguagugagcacaaggcacugaucacacccuuagccaagaggaaauuuacugaacagugagaguaaggcacugaccacaccccuaggcaaguggaaauuuacugaguagugagcacaaggcacugaccacaccccuaggcaagugaaaauuuacugagcagugagaacaaggcacugaccacaccccuagccaagaggaaauuuacugagaagugagagcagugcagugaucacaccccuaggcaaguggaaacuuacugagcagugagaaaaaggcacugaccacaccccuaggcaaguggaaauuuacugagcagugagcacaaggcacuaaccaaacccauaggcaagugaaaauuuacuuagcagugagagcaaggcacugaucacaccccuaggcaaguggaaacuuacugagcauugagaaaaaggcacugaccacaccccuaggcaaguggaaauuuacugagcagugagagcaaggcacugaccacaccccuagccaagaggaaauuuacugagcagugagaaaaaggcacugaccacaccccuagccaaggggaaauuuacugagcagugagaacaaggcacugaccacaccccuaggcaaguggaaauuuacugagcagugagagcagugcacugaccacaccucuagccaaggggaaauuucugaguagugauagcaaggcauugaccacaccccuaggcaaguggaaauuuccugcuauggugaggagaagcaaaugguuagagcaaguagaggggagaagcagcugaagaggugaauuccagguuuggaguucacuaugguagguugcagaagccugcaggaacaagugauccauccaugcauaccuuaggaagucgucaaaccaacagcaugguuuggcuaggagaggcugagucucuuggauggggucauauauauuccucucugguuucaggcaccagauguacaaagugaggacaaaacuguuccauuucugguuagggggaaggguuuuauuguagauaggagggagagcucagccagagacaucuggaugaguccagagcagagagaaaguaguagauuaaacauggccugcagacugacucaggccuuaagaggcggcugguggagagugggagaggaagagaaauaaggaccagaagagagggggaaaggagaggaagaaccaagaaggcacauuaccaaaaaauggcaggguuaccugggaaugagaagcuaggggaagggaagccagugagguggagaagucuaaggugaggucauguucuucaguauguuaauaggaaccacaguggaccauucauccugaguuucuuuuggaccugauaccaggacuugccuucaucuaaauuguuacuuacucucaaggagggccuccaccagagagcugcagagggcaauuguuaaccuguggugguuugaauugguuuggcccucauagacucauguguuugaaugcuugccucauaagaaaugguauuauuaggagguaugaccuuguuggaggaaguuugucacuguggggacaggcuuugaggucuccuauguucaagcuauguguaguguggcacacagucuccuuuuauugcuugcagaucaagaugcagaacucucagcuucuucuccagcaccaugugugccuccgugccuccaugcuucgcacuaugauaaucauggacagaacuucugaaacuguaagccagucccaauucaauguuuuccuauauuagaggugccuaguccggaucucugugaguuugaguccagccuggucuucaaaucaaguucaagacauuaaaaaauaaaauaaaaugaaagaguugccuccaugguuucucuucacagcaauaaaaggaagcuacagacaccaucuguagaaccuuuaucuucuucagauacagaagacaauuagcaucaguaggaacagccaguuucugggaucuaaaagugggaaaaacaagaaauauuuuggucaacucaagaacagaaugcuggaauuauaggccauggccagugugcccugguugaauuuauuguauuuuuggcaguacuggggauuaaauuagggcuucaugcauguaggguaauacccuaccacugagauuuagcccaacccucaauuuuucauauguuguuaaauacaguuacagcuuucauucuuucauagguauagguucuuuugcuagcauuauuauuauuauuauuauuauuauuauuauuauuauuauauugguuuuucaagacaguguuuuucuuuguagcccuggcuguccuggaacucacucuguagacaaggcugaucucaaacucagaaaucuacuugccucugccucccaagugcugggauuaaaggcaugcgccacuaaugccaggcuagcauuauuuauugaagaggcugcccuuuccccacugaauauuugguguaagggucuacauauuauaaggaauuauuaaaaaugccauuaacaugggaaugagacagcgugggugguacaugaugauucaaccgugacaaggcaugaggcgaugacagagcuucagccuagaucagccuuaauacaugaugguuggguagcucagugguuaaggcguucuugcaggggaccccgguucacuucccagcaugcauaugguggcucauaaccacaacggggaacuccagucccagguaaguugacgcuucuucacacacauggcacuggcauacgugcagcaaacccccauccaugcagagaaacaugaugcugaaacccagacacaaaagccacacacggcgacucuaccuccaugaaccauucagguaggccagaccacugaggcagaucuucuugggagggugggucaaagagagacauauguuugggagacauuguaacagauagaggagcugguauucaguuucauuuugauguccauuuugaaacuguuaaugcuaugguauguacauugucauucaauaagaagacaaccauagcacuggcugcguauguggccuaggauggcuuaguugggcaucagugggaggagaggcccuugggccugaggguguucaaugccacaguguagggaaugccagggaggaaagaugggaguggaugguugggagcacccucauagaggcagggggaggagggaugggauaggggguuucugaaagggagaccugguaagggggaaacauuugaaauguaaauaaagaaaauuuucaaaaaauaaaaaaagagaagaagaggaagaggaggagaaggaggaagaagaagaggaagaaggaggaggaggaggaggaggaggaggagaaagccauaguauuuaaaaauauaucugucuuacuugaaacagaugaacugcacacaguguuagcuguggaguugcauuccuggaggacagggauuccuuggggacaccugcagagagacacccucaguucauccugccagaccccuccugcauucaucagcagcagauguccagcaaggcgugaugccccuccaaaccacaucaggcagcauccugauccaagaucugcaacaguguucuggccacacagcugccaccagacccacuggcaucucagacaguaucguguuauuacuacuuaauacacgucaguuacuacauuuuccuccuccguugauguccauagcuucuuugguggacuugcagugaggaaaaggagaggccugccuggccucucucaagagacucagaguuuagauuccccagagaaguaacaguccuuuguaaguggcuugugcuggugccccuaggacucaacaacuccaucugacugaagcaacacucuuacugaggggugaaaccacaggauuucccaaaccuugcccagcaguuucaucccugaacccccauguuaacccaguacuaccuugcugauaaugaaugaggcauuacccagcccuuccaaagccaaauacacuaagaacccucuggaagaccuaacucaggaaaaccuagugcuuuacccgguguugucuacuuucucucaagggacauuagccauggagaucuccagcaagaaguccuguaccacccagaccacaaagucuucaucacacaaugucaucugccaaaguaugagacagacugucccucucccuggacauuagaggcuauucaggcaacauauaaagcuaccaccuacccaggccacagugguacuuacuugguacaugggcggcaugauuccggaaauuuugggucauaguaguaaagaccuauuuggcacucgcauuuccggucacugguggcagaacagucagccaccauauucuggucugcaauccagggaagaauagggucagguuguggugcaaacgcuuacauaugcacacagaccccacugucaccugaaaggaacacaguguguccugguaaaccuucacauucccaucacagauguacugagugcuaagcagcacuacugggaguauccucauccucgggccucuggggugguacccagaccagagaugauggcuugggagguccauuguuuagcauccugugcaauagcaucacacugcccugaggacuccaacaugggugguccugaucuguaggcacaccucugccccacaaaguucccucuccagaagccaccaucuccaucagacaucucugaagaugcuuuguuuaaucaccuuauuguucuaugaagagcaccuagugaccuuguacccagagcccuagugggcccuugggcucuggguguauaccuuccuuaagugagacuuacucaguggcuuauaaaagaagauggcuuucccauugggguguuccauuuuaaccuugugcuuauaguucaggacaccauaaacacucaagcuauaaaugucaccucucacaauucucugaaucuaggcauuguccuuucucagaauacagcagggagcacaggcagggaggacucucaguccagcucucugcagaugucuuacagcaucagggaucugugaauguggaaaaugguucugucuuuuuuuuuuuuaaucugauguuuuauuucauaucaaugaacauuuuuuuaauuagguauuuuccucguuuacauuuucaaugcuaucccaaaggucccccauacccacccccgcaauccccuacccacccacucccccuuuuuggcccuggcguuccccuguacuggggcauauaaaguuugcaaguccaaugggccucucuuugcagugauggcccacuaggccaucuuuugauacauaugcagcuaaagacaagugcucccggguacugguuaguucauauuguuguuccacuuuagggaugcaguucccuuuagcuccuuggguaauuucucuagcuccuccauugggggccgugugacccauccaauagcugacugugaucauccacuucuguguuugcuaggccccggcauagucucacaauggagagcuauaucuggguccuuucagcaaaaucuugcuaguguaugcaauggugucagcauuuggaagcugauuaugggauggaucccugcauauggcaaucacuagaugguccauccuuucgucacagcuccaaauuuugucucuguaacuccuuccauggguguuuuguucccauuucuaagaaacgguaaaguguccacacuuuggucuucguucuuguugaauuucaugcguuuggcaaguuguaucuuauaucuuggguauccuaaguuucugggcuaauauccacuuaucagugaguacauauugugcgaguuccuuugugauuggguuacuucacucaggaugauacccuccagguccauccauuugccuaggaauuucauaaauucauuuuuuaaauagcugaguaguauuccauuguguaaauguaccacauuuucuguauccauuccucuguugaggggcaucuggguucuuuccagcuucuggcuauuauaaacaaggcugcuaugaacauaguggagcauguguucuucuuaccgguugggacaucuucuggauauaugcccaggagagguauugcuggauccuccgguaguacuauguccaauuuucugaggaaccgccagacugauuuccagagugguuguacaagcuugcaaucccaccaacaauggaggaguguuccucuuucuccacauccucgccagcaucugcugucaccugaguuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaacgcugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacagugucuuuugcuuugcagaagcuuugcaauuuuaugaggucccauuuaucgauucuugaucuuacagcacaagccauugcuguucuauucaggaauuuuuccccugugcccauaucuucgaggcuuuucccuacuuucuccucuauaaguuucagugucucugguuuuauguggaguuccuuaauccacuuagauuugaccuuaguacaaggagauagaaauggaucaauucgcauucuucuacaugauaaccgccaguugugccagcaccauuuguugaaaaugcugucuuuuuuccacuggaugguuuuagcucccuugucaaagaucaagugaccauagguguguggauucaucucugggucuucaauucuguuccauuggucuacuugucugucacuauaccaguaccaugcaguuuuuaucacaauugcucuguaguacaguuuuagguccggcauggugauuccaccagagguucuuuuauccuugagaagaguuuuugcuauccucgguuuuuuguuauuccagaugaaucugccgauugcccuugcuaauucguugaagaauugaguuggaauuuugauggggauugcauugaaucuguagauugcuuuuggcaagauagccauuuuuacaauguugauccugccaauccaugagcauggaagaucuuuccaucuucugagaucuuuaguuucuuucuuuagagacuugaaguucuuaucauacagaucuuucacuuccuuagaaucacgccaagguauuuuauauuauuugugacuauugagaaggguguuguuucccuaauuucuuucucagccuguuuauccuuuguguagagaaaggccauugacuuguuugaguuaauuuuauauccagcuacuucacugaagcuguuuaucaggcuuaggaguucucugguggaauuuuuagggucacuuauauauacuaucauaucaucugcaaaaagugauauuuugacuucuuccuuuccaauuuguauccccuugaucuccuuuuguugucuaauugcucuggcuaggacuucaaguacaauguugaauaguuagggcgagaguggacagccuugucuagucucugauuuuagugggauugcuuccagcuucucaccauuuacuuugauguuggcuauugguuugcuguagauugcuuuuaucauguuuagguaugggccuugaauuccugaucuuuccaagacuuuuaucaugaauggauguuggauuuugucaaaugcuuucucagcaucuaacgagaugaucaugugguuuuugucuuugaguuuguuuauauacuggauuacauugauggauuucuguauauugaaacaucccugcaucccugggaugaaaccuacuuggucaggauggaugauuguuuugauguguucuuggauucaguuagcaagaacuuuauugaggauuuuugcaucgauauucauaagggaaauuggucugaaguucucuaucuuuguugggucuuuuugugguuuagguaucagaguaauuguggcuucauagaaugaguuggguagaguaccuuccguuucuauguuguggaauaguuugugaagaacuggaauuaggucuucuuugaaggucugauagaacucugcacuaaacccgucugguccugggcuuuuuuuuggcugggagacuauuaaugacugcuucuauuucuuuaggggauauaggacuguugagaucauuaaccugaucuugauuuagcuuugguaccugguaucugucuagaaacuuguccauuucguccagguuuuccaguuuuguugaguauagccuuuuguagaaggaucugaugguguuuuggauuucuucaggaucuguuguuaugucuccuuuuucauuucugauuuuguuaauuaggaugcuuucccugugcccucuagugagucuggcuaaggguuuaucuaucuuguugauuuucucaaagaaccagcuccuugauugguucauucuuugaauaguucuucuuguuuccacuugguugauuucaccccugaguuugauuauuuccugccuucuacuccucuugggugaauuugcuuccuuuucuucuagacguuuuagguguguugucaagcugcuaaugugugcucucucuaguuucuuuuuggaggcacucagagcuaugaguuuuccucuuaggaaugcuuucauuguuucccauaaguuugggaauguuguggcuucauuuucauuaaacuccaaaaaauccuuaauuucuuucuuuauuccuuccuugaccaagguaucauugagaagaguguuguucaguuuccacgugaauguuggcuuucuauuauuuauuuuguuauugaagaucagccuuaguccauggugaucugauaggaugcaugggacaauuucaauauuuuuguauauguugaggcuuguguugugaccaauuauguggucaauuuuagagaagguaccaugaggugcugagaagaagguauauccuuuuguuuuaggaugaaauguucuguagauaucuguuaaguccauuuguuucaucacuugucgugcccgcucucgaccagcaagaacgacgcgaccaccaguccuucuaacagcaguuuauucaguccugauucuucuuguuuauaucucccccgaacccugggccucucacuccuuuuauacucucucucauccacgcaccgcagggcaagcccccucgccagucacgaggcuucagcuaaucagggcagcagggguaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaaucacuucuguuaguuucacugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugaguaugaagugccccuccuugucuuuuuugauuauuuuggguuggaagucgauuuuguuagauauuagaauggcuacuccagcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggggaguugaguccauugauauuaagagauauuaaggaaaaguaauuguugcuuccuguuauuuuuguuguuaaaguuggcauucuguucuuguggcugucuucuuuuaguuuuguugagggauuaucuucuuguuuuuuucuagggugugguucccguccuuguauuggcuuuuuuuucuguuauuauccuuugaagggcuggauucguggagagauaaugggugaauuuaguuuugucguggaauacuuugguuucuccaucuaugguaauugagaguuuggcuggguauaguagccugggcuggaauuuguguucucuuagugucuguauaacaucugcccaggcucuucuggcuuucauagucucuggugaaaaaucugguguaauucugauaggcuugccuuuauauguuacuugaccuuuuucccuuacugcuuuuaguauucuaucuuuauuuagugcauuuguuguucugauuauuaugugucgggaggaauuucuuuucugguccagucuauuuggauuucuauaggcuucuuguauguucaugggcaucucuuucuuuagauuugggaaguuuucuucaauaauuuuguugaagauguuugcuggcccuuugaguugaaaaucuucauucucauccacuccuauuauccguagguuuggucuucucauuguguccuggauuuccuggauguucugaguuaggaucuuuuugcauuuuccauuuucuuugauuguugugucaauguucucuauggaaucuucugcaccugagauucucucuuccaucucuuguauucuguugcugaugcuggcaucuaugguuccagauuucuuuccuaggguuuccaucuccagcguugccucacuuuggguuuucuuuauugugucuacuucccuuuuuaggucuaguaugguuuuguucauuuccaucaccuguuuggauguguuuuccuguuuuucuauaaggacuucuaccuguuugguuguguuuuccuguuuuucuuuaaggacuuguaacucuuuagcaguguucuccuguauuucuuuaagugaguuauuaaauuccuucuuuauguccucuaccaucaucaugagauaugcuuuuaaauccaggucuaccuuuucagguguguuagggugcucuggacugggcgaagugggcguucuggguucugaugauggugaguggucuugguuucuguuaguaggauucuuacguuuaccuuuugccaucuggcaaucucuggaguuaguuguuauaguuaucuuuguuuagagauuguuccucuggugauuuuguuacccucuaucagcagacgugggagacuagcucucuccucugaguuucaguggucagagcagucucugcaggcaagcucuccucuuucagggaaggugcacaguuaucugguguuuggaccuccuccuggcugaagaugaaggcccaaaacaggaucugucccagaagcuguguugcuuuggccaggaagguggcugguugucuggugccgaagaugucgccgccucagaagcucucuggcucucgccugucccagaaacugcuggccucuguauuccauacccucacccgugcagccugcccuccacggaaucccgguaccaagguggcucccgccugagccugaggcagaaaccucucagggccgggcggaccccugugcucucaccaggaagguggccgguugucuggagcccuuguuuuuuuguuuguuuguuuguuuguuuguuuuuguuuuuuguuguuuuuuuuuuuuuuuugcgacaauaugucucuguguagucaugauguccuagaacucacaacauagaucaggcuguguagagagaauaucuuauguuuguauggauguggcaucugucaauaagucugauggccuauggcuuaggcaagauauaggaggugggacaacugagagaaagaaagaauucugggauagagccaggcaggagauugguccaggaagaugugaggagacacaugguaccugagcacaggcaaccagccauguggcagauuguagacuaagacaaauggguuauucaaaguuauaucuagucagagaagagccuagcuauauggccaagguauuuauaaauauauucugaguacaagucuuauuucagggugcauggagcugagaggaagaaccagaaccuaauuucuacaauuaggcugcacacuaaaguguccuuucuauaucugccucccgugcucugggaccagagauaugugcugcuauacucagccuguuuccaucucuauguuuaguagaugcaaaugacagggcugaagcaugagauauuguaguauuugccacuuaguuuaacaugauucuguggcauaggaguguguacauaggcacacaugcaugcacacacaaaacagaaucuucgcccccacuccccucuacgucagagaacaaacccaggccuucuucugcauacuaggcaggcacucugugagcugcuuccaguccuccaacaaaugcuuaaaguuuguauguuuauuguguauugauugagucuuacuauguagcuuuggcugucuuuaaacucacuauguuggucaggcuguccuugaacucacaaagaucuaucuucagagugcuuggauuauaugcauuugccaccaugcucugccugcuuaaaguuugugaaaaagguuuuauuauguuucuauauccugucaagacuucugcagguguggcccucgucucucugcugcuuccccagaucugugugcccucugaccuacucuuuuagcucuucucugugugucugggaagcacacaugauugcuuauccacagagguaugaucuuucuagguaccagcauguguuuuacuagguucugcauucaauugacaaguagaagaaaaauuaucuucaaaaaaaggcagaaggcuaugauugugcuuuuucugacacugauuuuacggaguccuuuuuaacucauaaugaauaauuuuugccuugguuuuauuuugagacagggucucacuguguagccuguggaacggcccuggaacucacuguauaaacaagauggccucgcagggcaguggugaugcaugucuuuaaucccagcacucaggaggcagaggcaggccaauuucugaguucgagaccagcguaucuacaaagugaguuccaggacagccagggcuacacagagaaacccugucucgagaaacaaaaaccaaaaaccaaccaaccaaacaacaaaacccaggguggccuccaagucagagaccagcugcuucugccuucugugugcugggauuaaacauuguacaaccaugcccaucggcaggaaacaaguuuuaugccaguggggauucuguggcugcauucuggcauccauuagucaugacuacuccauccagguacuucugacucuaaugccagucuucacagcuagucugccucugcuaagucacauacucaccuuuaucacagguggagcaaaguucacaaucaugcaggccauuaucuuucccugugaauguuccugggugacacuucucacauuguccuugaguaugggggauuuugcagggcgccuugacaaauguaccuggggauaagggcagaugggaucagucuugcucaggcacacagcaauaaggggcuaucuugcucuagguaggcuuaacaucuuuacuacaaguucaaaauaaucucugggcugucacaaagugcuugaggaucuaugagggcugcugguucccugaucuacacucaguccuguagacaucuuacccucaggagacuaggaaccaagguagccuagggugaguagaaugagauccugacucccuacugggcuuccauaggcccauguaugucaccagggagugacacuauuugaaaggcuuaagggguguggccuuguuggaggaaguauuucacuggagcuuggcuuugaaguuucaaggguccaagucaggcucaguguuuguuuuuuucuucugcugccuuugcauguggacagagaacucucagcuacuucuccagcaccauuuuuaucuauuucaacccuaccugcagucgggccuccugccauugugauaauggacuaaaccuuuaaaacuguaauccaguaaaaugcauuccuauauaaaaguuguggucacggugucuuuucacagccagagaacacuuuaaacaaucucuagaaaagagacucuggcucccuguaaguugugcagagugcuuuuggcauacagcuuuaaaaaguugucacccaugcuaggcuaauauuacaauauguaguugcauuagucaccuaugggugugaaagcgaccccaauaaacucaaugguucaccaaaccacacuuggguaaaucgcuucuuuggucuguucucagugacuauuaucacuuccuguuaucuggagugaacaguugguguuuaugucuccccagaaauaauuacagaaccaggguuccugauacagagcacaugugcuguuaacugggagcagaagagcaaggauugacauugccaccaagguagagugugaccauagcaagcuacuuaagccacuuucuccauuggaagugguagcagugggggcugaggguucccuggcacccaagacaaguacagguagaugaaauuaacccucccagcucgcuuuuuugacccuuccucuuagcugggugccuuuggauaugggcauagaacucaugccuugaaggauggagaguugggugacccuauauuagugaggccuugcaaugaauacucacaccaacccucuugaacagacagagggccuccuuuaggggugacagucuguguaccuugguuaggaagcaucuccuagaguuugaaagaguaggcaauggcugaguugagcucccugauccacacccuccucaucuuguauagccacuggugugccccaaagcucacccaugucuaugcuguggcacugggucucauugaagaacucaccugagggacaggucuugcaacagacaucauuagacugguauucaccaucgggacaguugaaggaguaugauucaggcauagcaaauauuaccugugaguggaaaaggacaaggggcagcucauacuuaugguaacugcagaggaugguuuggauaaugguggaaaaggaaguaccaaggcagggccuccuugugcagagcccagcagggacuaucugaugcuacgcuguggcugaugcuaugcuguagaacucugaagccugcaguugcccauggaagguuguacaauacaccacugccaagucuaguggcucuuggcuuuuugcacagcaguaucaugcccacuccacuccaucccuaguucacuucuagcagcagcagcaaauuuucuagcacaacuugugaccuauugggauccuauaaucugaaccucaagcuuugauggcugcucccuaugcuggggcugcagauagagacaccaguuggaacaacuugcaaaaggacaaaggagugagagcucugccuuguuuuuuguuuuuucuuuccuuccuuccuucuuucuugucuucuuucuuucuuucuuccuuccuuccuuccuuccuuccuuccuuccuuccuuucuuucuuuucuuuuuuuuuuugaagaauuguuuuuuuuuuauguaugugaguacacuguagcuguccucagacacaccagaagagggcaucgaugguugugagccaccaugugguugcugggaauugaacucaggaccucaggaagagcagucaaugcucugaaccucugagccaucucuccagccccuguuuuuucuuuuaauuuaccuccuucacauacuauuucucuaaguacaccaaagcuuuagauguguuucuugggcuggagagauagcagguaagagcauaugucguccaggcagagcgguacauaucuuuauccaagcacuccggaggcaaagaaaggugaaucuccugaguuccaggauagucagagcuugucuuaaaacaacaagaccccccccccaaaaaaaaacccaaacauauucuguucuugcagaaggccagaguuugguucccagcaaccaugcaagaggcucacagucaccuguaacuccaguucaugagaaucugauguccucucuggccucaggaauugcagacaagugacauacuuaacaacccuuuaggaaacacuuaaacaaauaaacaaaaucaaauacuaaaauaaaugaauaaaucaacaaauaaguaaaaucuaauuuuguuuggucuuucauuacucaaagccucaaguaauuguaaguaaauaacugguuuuacuuuauuuuauuguaguacugaggauuaaacccagggcucacacuaggcacuaauuaauugcuaaugugcuauauuucuaguucugcaacagaugacuuuaaagauuuauauuuguguuuaugagugugugccugcuugaaugcauauauaccaugugugugcagugauugaggaggccagaagaaggcagcagauuccugggacuagaauuacaaacaugugugggugcuuggaacugagccuuguuacucuacaagaguagccauuacuuaaugcaccccagauacugauacaugcuacaugaaacagaggcaaauaacaaagacaacaaaacaaaaaaacaaaaaacaaaccauaaaaaaccccaaaguuugauguagugaucauugaucauuuauaggggauugaaagaacauguguggagccaugauaucacacaagcuaacagagucuauggauuaauaggauauucacuauuuaccauccccaugucucacuuuucucaucuguuaaauggagauauuaauauacuuacuacucuagucacuugagcucuuuacaaaaaaaaugagcacugaggcucacuucuuuauauuugcauuuuuaugguacacacucuggaaaaaaauucuccacagcaucaacccuuagggcccaucuauacauuugugggagccaucaucauucauccuuaccacuguguucugaucucauagcuagccaguguuguccagccuucaggagaaauuccuuggccacaggauuuuccugguucauagauaggaucucucucucucucucucucucucucucucucucucuguccguguguuuguguguguguguauguauguauguaucugucuucuguccgucugucugucugugucugucuaucuaucuauaucuauguaucuauguaucuacguaucuauguaucuauauaucuauguaucuauguaucuaucuaucuaucuaucuaucuaucuaucuaucucuaucuuucugguauucucugcccauuuauuuugucaggaauucugcccuuaacucgccaggcaggagucuucuuuuuaggguuccuagguucaauaccuucaucuugauucaucgucaccauuauuauauguugaagcugacacuucaucacugcccugaaggcaauacuauuuuaccccuuggagauggccugcuucaccuguacuuacacuuaggaaggacaugaccacagguuagacaguggauuuaguaggauaucuucacagcccaugucuuuaauuccagcaggcagaccucugaguucaaggccagccuggucuacagagcaaauuccaggacagucagagcuacacagagaaauccugucucaaaagaccaaaaaucuacacacauacccuauuuuuuaaaauuucaauauucuuugaggauagucuuuuuaaaaaauauucuugaaagagauguuaucuucagucuuuuauuuuuauuuuugacuuuuacaggacagugucucauacacagucuggcuguucuagaacucacuauaaagaucagacuaaacccaaauucacaaacaugucuaccucgucucucaauugcuagaauuaagggcgugcacuaccccgcccagcucacccucagucuuucuuuggaguaccuucuuuuuguggcauuauuugagacgaucaccauuuuuucuuuacaacaaccuuaaaacaacaacaaaaacaaaaacagccuaauauugucuagauuguuucuggggauuucuggacgacaaaaugcaccacuuuucaggcggugccugggcaggcauggagccccagagcccuaauagggaugggaagagauuucagggucaagggccaucccaugugaaaccugccugugaaauauguucgaagucccucaaagugcugggaacuuugaagucaccucugaguugcauauccucuggccccuugcccaggagauucccagggaagcuggaugcccucuagguccauuucugugaaagcugcucaccagcagcuagcaaagaauuacuauuaaccagcuccuagaugguuuaaagaaaugcugauuacauguaaguggucucugacugcucagauacuaucuuagaacaaucuaaggguuauuuuguuguuguuguuguuguuauaacuaaagaucugaauguguuagaaaauggauauccuuacagguuauaaaacauaaaccuuuuucugccuauuuuuggguuugaagacucuuaugagagaaaauugacauaaaauuaaguuggcuguaacuaaaaugucauuuacaggauugucuagguuuuuuguuugguuguuugguugguuuugguuuuuuuuuuuauuuguuugguuuuuuuggguuuuuuuuuuccguuaguuuguuuugguuuucagccuuucuguguguaguucuggcuguucugagacuccuuauguagaucaggcugcccacuaacuuagguuuaacugcaguuuaagauuaaagagacaagaagcgaucucgggacgaacuuagcagagacccgaaaggcccaggaaaggcauagccaggccuuccacacagauccuuuuguaguaguuaguacuacaccccaagacgagccgggccggacccacccaaggcgcacagucgcgcgggccacugcaguccgcaauggcacuuucccgagucaccuucggaaggaccgcuuucagaugagaaagcgaggagaggcguguccgucuuguccgggagcucagggaccaaccggacacacuuucucuggcuacccgcuuggccauuccccugccucugcuucaccuccacaauuccccaacucuggaccacuuaacucuggacgaaguucugaggaguugguuggcggugccaaggcugacccuggcggaagagccaauucaccgcccgcaguagcuuuccucugcagcccggggauccggugcccagcgcgaaucucagcuccgcagggccauaucuacucaccggcaagaacagauucagcagcagcagcaagaggaaccagugacucagacuggagacguggcugaagguaaccauggcugugagcuagcauggug

SEQ ID NO: 4237 - RNA, 25276 nt, Mus musculus
auuuccuuugccaucugagcgacuuuugauaggucaugaaaggcuuguuuucugccaccaaaaguaaugucagguuugcuuucugucgcugugaugaacacguggcaaaaagcagcuggggaggaaaagggcucacuucaccuuauagcucauagucuguaaugaagggaaguugaggcaggaacugaagcagagaccaaagaggacuucugcccacuggcuugcuugaaggcuuacucagccuguuuuuuuuuuuuuuuugcaccacugaggaccaccagccagggguagcgccacccacagugggccaaggccgucacaucaaucaucgguuaugaaaaugcuccacagacaagcacaggccagucugauggaagggaucucucaaaguuuccacuucgcagguguguucaguuaauuugugucaauuuugucaguaggagcucacagagagcucacagagggaauggguguguccugcuucuuuggcucacagcagucuggauucccugugcaucaaccugagcccuuucucauuccugucccuuuugcguuuggguaacaccaaucaaaguagauacaacuuuuuuuuuccauuuuuuauuagguauuuagcucauuuacauuuccaaugcuauaccaaaagucccccauacccacccacccccaauccccuacccacccacucccccuuuuuggcccuggcguuccccuguacuggggcauauaaagcuugcguguccaaugggccucucuuuccagugauggccgacuaggccaucuuuugauacauaugcagcuagagucaagagcuccgggguacugguuaguucauaauguuguuccgccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucgauaaaaucuugcuaguguauuguaguggcuauuccugguugucaacuugacaauauuuggaaugaacuacaauucggaauuggaaggcucaccagugacccuuaucuggaggcuuggagauccuuaucuggaucuugguuugaagaucuugagccauaguggcuauggauuccagaagauuuaaucuccgaguuaaggaacacaccuuuaaucugggcuaugccuuucauuugggauuaaaggugugguggaacacaccuuuaaucugggcuacaccuuuugcuggagacaauauaaggacauuggaagaagggagucuagcucuugcucuugcuccuuugccugcuugcugcgugagacugaguaacugcuagauccuuggacuuccauucacagcugcgacugaacaauuguugggaauucggcugccgacuguaagucaucaauaaauuccuuuacuauuuagagauuauccauaaguucugugacucuagagaacccugacuaauacauguaugcaauggugucagccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuucuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggaugguccauguagagacuuccauaucuagauacaacuucuuuaggucuaguuccuccucagccauuuuuccucaggcccagggauucaggccucacuuccucccucagaggaaagccaaucuagacccuucaggcugcgucaagaaugaaguucuuagaaugugucuugauagaugggcuacagcgucugcuagacaccuguaaaaagaagggccagcgugugagugacacagcucugaggggaaaguuuuccccaguguaaguacugcagcucugugggaguuuuccuggcaguaggaagccaaggaauacuacaauucacagugcauagcaaauuucacacaagaaauuuauuaggaaagacacaagaggguggcugccucugcucagccuaaaggcagcagaaaccugagugggaggcaggcuuuauguagaguuucuuggggaagguguauuuuucaggguggagauuuccagggugagggauuggugggauuuaaagucuuaagcuugggaaaagcucaaagauuggugggacuuuaagcucagggauugguggguuuuugagcuuagggacuggaggguuuucaaaaccuagaagugaacuuggggcuuuuuacuguggcugcacacaucaaccuuuggcagcucagaagcaacuuucaggggccugggaaacauucuuaugaaauaucugucucugugggaggacagccuuccacucugaaaaccacuagacagcaaaugcuacuggccuggucucaggcaaagugaaucuguaggggaaaagaucugagcccucuucaggauuugaagaccuaucaaaccccaccaaucccuaggggggugggggugggggaaucaaucuuugacaggaaacccuaccaauuacugagcacggaaucccaccaauccuuggacuuagcuugaaguccccacccuagaaaucucuuuucuggaaaacuccucucccaagaggaguuauaggccugucuccugcucaguucccugcugccuuuugcccuagcagagacauugaaucucuaguauuuuucccaaauaaucucgugugagauuauggugcgguaugacuuugcgguauuccuugacaggauaccuucccccucagaacuggaacaccuccacuggggaagaguucagagcuauaauguccccuccggggaaauucuccaccucagagcugcaacacuuccuuugaggaaggguuccaagcuuacacuuacagagccuuuguucuuuucacuucucuaacucuccccccaugcccccagcccccaugaucccucugcccgacuugcuaggagacuuuuaaaugugguugauucuggaggucaggcagcguaguuauguccacuagcucugccacagaaggccccuugauggaaggucugaggauaguggcugccacauuacaguucagagacuucaaggcagcuuguuguuguuugcuuuuaucaaaaccaucuugcucuugcacuaggaaggcagcucaguugguugagugcuugucuugcaagcaggcagacaugaguuugaugccuagaacaaguuuuuuuaaaagcuggccuggugacaacugcucauaaucucagcaguggggagacagagaccacagaucccuggauucuucuagccugcaaaccuagccuacuuggcacaagguccacgcuggcaagagcucaucacaaaacaaagcaaaacuccacaggugcuggggaaugacaccuaagguugcauuccagccuauaugcacagguaccccacccccuuacacacacgcacgcacacacacacacacacacacacacacacacacaccaccuuuugacuggcuuaucugggucaucaauagggaaccuuuugcuauuaggagccugaaaacuccaaccucagcucaagcuaacagccuuccugaacauacgccuuuauaagaccaugcuuuauuaaugcacacacagaccacaagccacuucaccucugcccuuuuccccaugccacucauugccaugugcccuacuccauacauauuucuaaauccuacccuccaagaguggauugaagauucgguuacucaucuccaccccccagcuaucuugcaaaacuccuuucagugauugguacauuguguggcagacaaugaagaccuaguuuggaacuguucucaaggcuaagacauauuacucaaaaaaaaaaaaaaaaaaggucuagccaauugaugagcuucaaugagagaaugagagcuucaaugagagaaugagagacccuaucucaaaggacaagauagagauagagagagaggaagacacuugauagagaccucuggucuccacauauaaggacacacaggcauaaaguuacacauacccauacacauccacguccaucccucacacacacacauccacaaacaccccaaccaacccccacauacacacacacucacaugaucuaauuugaaaggacuucacugcucacauaagggacccaagaacacagggucaguaaagaaaaacaaaacccguuuguccauccugauaaaaguaaguuguugguuuggauuggcaagauggugcaguagguaaaguacuugacaccgaccccacucccccauucuauagcagcuguucucaaccugugggcugcaaccccuuggagguugcauuuuacauaccuugccuuucagauauuuacauuaugauucauagcaauagcaaaguuacaguuauaaaauagcaacaagguaauuuuaugguuggaggucaccgcaacaugaagaacuguauugaaggcucacagcaugaggaaggcugagaacuacagcacucuaguaauaaauguuuuuuccugguuuuuagagacagaguuucucuguguagcuuuguuuguucuguaacuugcucuguagaucaggcuggccucaaacucacagaggucugccugucuuugccuccugagugcugggauugaaggcaugugccgccacugcccagcagauuuuuuuuuuuuuuuuuuuuuuuuuuuuuuuuuuuuuuuuuuuuucauuuuuuuuuauuagguauuuagcucauuuacauuuccaaugcuauaccaaaagucccccuuacccacccacccccacuccccuacccacccacuccuccccuuuggcccuggcguuccccuguaccggggcacacaaagucugcguguccaaugggccucucuuuccagugauggccgacuaggccaucuuuugauacauaugcagcuagagucaagagcucagggguacugguuaguucaaaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaauaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucauggguauccuagguuuugggcuaguauccacuuaucagugaguacauauugugugaguuccuuugugauuguguuaccucacucaggaugagauuuuuuuuuuuuuuuuuuuuuuuuuuuuuaauuugucaaaaguuaaagagcugaauuuuugauagaagacuaucagcugauagguaauaguuuaaugaguuugaaagaaugcugaaaucaagucaacucuuccuaccaagaaguaugcuaugucccgaguguccucaaugaaugcuagguuaucaggguugaagguuguuuggaaacauugcauuuaccagucucaaaauaacacucugcucauuuuacuuauuaaucaggagaaagaugggggcaaaagagauggcucagggguuaagagcacugacuuaucucgaugaagauccaggcuugauuccuaguaccaugugccaacucauagcuccaguuccaggggugaccauguauguauguauguacauaugcauguaugcaugucaaaagcgcuagaugccuuggaaguguaaauacugaugguugaagaaccaugugggugcuggggcuugaacccuguuaucugaagagaagccacuacucuuuacugcugagccaucuuuccagucccgaccguauauucuguacaaccuauuauucuauccaaauguguacccugacuggaucccggggccuggggaaaaaaagagcaauaaaggacauuguugggcagcugaggcaccagcauauggacaguagcuaacaguguugaagucacuuccguuaccaguuugauucauuguggcugcagaagagacucucgccaggagagggcgacuguaacuaacgaaugucagguggcaggaaggaacaagaugaaaagagugaaacuucacagcugcuuuguuaaggcuccccaauacccuuaggggcacggagguaugacugaguccugcccaccaagggacccguuuggcuguccugcugggaccucaacugcauucacagucugcuagcugcuucuuccuugcugaucuggucuggucuugucucucggucuccgcaguauauguuguuccgugcacaagaugcucuccuucagguaggagcuaugcagcagaguaaaaugaggcacgguaggggcaggcucagagccugcgccgcagaauccacacuugcauccuuccucccaccaagcggagucagaccgccgaccccaggggcgugggcggggcguggguggggcggggcccguccugcugucaaucucaagacugccgccgccgacuggcgggccuggugggcucugagucagcucacugccuucaccaaucacaggacgcagcucgcgaaauccacuuccgauuggucgucugugaccucacaucaucuggggcggagcuucaggcaggcacuuagaacacugcuggagagcguggaucagccgccuggauuccgcacucaggugagaauucgugugcacggaccaggccagagugcaggagaaggacggugcgcacagaugugugugugagugggggcggggggggggaagcgucgagagugcagaagaguggaccguauguauaaaagaagagagugaguauucaggaaggaggcaguuugugcaauugcgggggcggcaggagauguguauguagaugaggguauguguguuugcacagguuuuagguagauugucgaacagaugugcagauuuagaggcgugugcacaggagagagaucuauguguucugguuuggggagaugugugcugagggagggggccugaaggccgaguaggaggggggaugcuuugcccagauggucaggugcaccugugaugagguauggagguggaggcaaccaucuccugugagaugaggauccagcucccugggguaccuucgaaugcuagaauguagaggggcaaguauaaacucaccccuugacccauucuccuaucccagagcauauacaaccuggagaaucucuuaauuggauuugaaugauucuauuauucucucaggagauagauggauugcccacuggcauaaggaucacaggacgaucuaggcauaccuggccuccccagguuguggagaguccccugugcccuuaaagaucgagaugguuuucaaaggaagaauucaaacaaaugaacaucuuuaauuuuugagcuacuuugauagaaucuuuuugaaauugcucuuuaaaacaaacaaaaacaaaguaguugauggguauagagagggccugcaugcugcaugccagaaagagguacaccuaguaguguaugguaaagcccugcuaccaaagaauuugguaaaaacaaaacaaaacaaaaacaacaacaaaaaccauuuggauauaaaggagggacaguagauuauauaaaugagaauuuguggaacaaucuggaaggguaaugaggccugggauggacuugagggaggagaaaacacuuuugguuucacaucagacguauauuuuggaacuucugaaaagcagagaucuuauagcuucgauuagaaccagagauuauuccaaaucucuggucauuuccuuccucauuggacucauuucugggggcuucaggaauugcuguuccuccacagggaccucaagcuuucaagauagucagaccacaguucuguguucugcuggagaggauccucuguauccccugugcagagcuuaccagccuugggucacuccagaagccagccucccugaccuggggaaaguggugggccuagugaauccccacaugccauuuaauuacagaagcucuucugcuagaaaaaucgaggaaaccccaacaugccaacguuuguaaugcuaucuauagucuuccagguccuuccguaauacagggcaauucggugacuuguccccgcuaacaccugcagagccggaucuuucuagcacugagugccagagcaucugauuucuuuggugauugucagugggugugacagaaguuuacgugucuauacagagcacugcaggaggaucuugugucugccugcugccaaagccccaaguauuacccaggauaaauucccauugguacacguagggggacaugcuucucgccauacacccauuuccaggauuuccuaccuuuccaucuuaaaauccaaccugaggcuaacagaucuccagauucauuacccuacuguuucuggaauauuccggcgacauagaugcuucucuguauggaagaucccuggaaucugguaaugcaaaguuaaccaugccauuguuacugcacagccucccugugugccaaaguggagcaccaggcccagccuugucugguaggcugcaugagcagucaccggauugcccugccuuguucuuuccccaucgucccaucugugaacauuauucauucuuccggugggcugggcuccuggcacucggcaaaugcugaauggauuguagcucuagcaucaggcggcagcuccuuguagacaccuuuuuguugccccuucaggguguggaaugaccgagcugugaccacuagggucuggugaugucucauauccuuuccaaggagagaucuaaaaggcuugccuuucccuagcacugcccgaaugaguuucucacugccuggaggccacccauaagccaggccaagccagcccacgugggucugugggaggagaguccacucccaugacauacuuccccagaccuugagaaaugcugaaaggcuuguuuagguuugccaugccccggcuuggugcuuccugcugaugucauagcugucuccucgccuccacacaugcuccuuuccauaagaaggauggauaaauaaauuauuaaaaacugacacaaacauguaaccacuaauacauaggaaaugaagccagauggguuagaaauuuaagguuauucuuggcuacacaguaagcucaaggccacaugcccauguagaagaauggccugucaccuuccucugugcugggugucaccccucaaggcgacagguguucugcuuuuuggaucaaccacccugacugcagcagcuuccauuacagcguguuggcaucucaggccuuggugccccaacacaaccccuccccuuggaucuacagccaucagguucauggugagcacuuuugcuuuucucuuccugaauugucacugaaaucaucccacugccuuaggugugguggacaguuuuccaguugcugcauggccaugcugcccaugguggcuuugucuggucagcugaacaaagccuucagcuuucuugaccugagucagguuguuuccuuuuccuuccuuuucuuaagacagggucucaguuuuuugcucugcugaccuggaacucacuguguagaccauuugggccucaaacucacaaagaucuaucugucucugccucucaggcgcucauuaaagaugauaguaccacuaugccuggcccguugguuucauuuagcguauggggcaccagugaaccuuccauaucuguccuuuauaaagaugaccaucacaaauccuuggggacauagacuuaggugccauggggcacccaauagaucccugauucucuugcauucucgugaaaacugguucccaauccaggucuuucucugagcuacucuguguuuguggcaucucaguggcuucuaguauguucugugggaaugugccagcuccagggugaaugccaggaugguuuuacauguguaggugcggcugucggcaucccagagaaaucuguuacuaucugucaggccuaccugugcucccucuagcacuccugagccucuggaacuuugcauucacuugccccagcucgacuucucaggcuccugcugacauggcucugucaccccuagauggacucgguguaccccaagcccugagucuggcccuugcuugaugucaacagugacccugacacauacaguguggauccuuaucugccauucgccuugacauuucagccuccugggugaccuugguguuucuguggccucuaugucaggguguugcucaguauauggacaaggauuuaucagaccuugggggacuucugagccuggacauuuugagaaccauuuuugagaaagacaacaucauucuauugugaaaccuguagcccagaggucaaaggugaguguguugcucacagugcccuugagcacgggcaguggaagugagguacuguuuuaaaagcugacgaauaggcuggagagguggcuggguggcagaaagcacuggcuguucucccagaggaccuggguuugcccagcaccuauaugguggcucacagcucuugguaacucucuucaguuccagaggaucugacguuuuuuuuucugcccucugugaguggugcacagacauacaaguagacaaaauccacaugcacauaagauuaaaaaaauaaugaaggaaacagugcaccagucacaugucagcuguucagugaggcucgggaguggaaggggaucccaucuccccagccaccacacauuuauaucuuuuuacagaauccggugccugugacagagguaugaccagauaccugaccuccacauacauuuaaaauaguuacuuuuguauuuuuuccagagucuccuguagaccaagcuggccuugaacuuuaucuauaguuuaagauggccuugaacuccugaucuccugccuccaagugcgggaacacaggaguguacuaucacuuggcacuaucaguuggcuuggcucugccaauucuaccaaguaagcuacaggaccagccccacucagacauucaaugugugauuuucaucacauuucuguccuguguuuggagaaggaauauaucauagggccuagaggucagaugacaagcuauaagaguugcuucucucccuccaccacauggguaacaggguuugaacucaggcugucugccucugcaacagacaccuuucccuacugagccaucuugccaaucuuugucuuuuuauuguuucaugguagacagugcuuguuauugcuaggugugguaaaucacaucugucaucucagucacugggagggagagacaggaagauugcugugaguuucgggccagucuagguuguagaguaagucccugacucaaaaaaacaaucagacagccuguacuguggacagcgcgcuuuaguaucucguguuuaggucugagguucuugucucaugggcuugcauaguuuccuagcacgguagacuaucagaaagggaugcuggugccaagcuuuauauccuuggggcucaucugugagucagggcaagaagaauaucaguccccucuuuggagacuccuggaaggcauguggacacguggcccuggguuuacugugauuaguguaggcacuagagaucugggagauuagggaagcuuugguaguugugugggacuguaaaugggagcguauaccaagugcauugugugugcugcugagcaggaagcagugugauaguuuucaguggguggggugagguugagggagucagggguggggcugucaaaagcagguugaucuauucaggcagcacaggcucugaggccaggcuugcuggagaacagacuucauacuggcagaucucuccaguguucccuuuccauucuuuguuuguccuuggugugugcaugcaggcauaugugcacaauaugugggugggugaacgugugccauggggugugagaguggaggucagaagucaacuuuggcgaguuaauuuuucucugccacauaguccuggggaugagacucagguggucaaauuugguggcaggcauccuaaccugcugaaccauucugcuagcacugcuuuggccccauuucacugauggugugugugugugugugugugugugugcgcgcgcgugcacacguggguaugcguguacgugcgcaugggaggccaccgauggucaacauugaguguccucccuccuugcucuuuccuccuuagcuuuugaggcugcagccaaugcugaacucuuggcugacugauuuggcuagacugccugccagagaacugcaggcuacucuuuccuuucuagcacugggauugcaagaccugugcugcugagccuggcugguuuuuuaacaugggugcuggggauagaccucagguccuuaggcuugcauaguaaaugcuuuacugagccuucucuacuggcacucugagggcuuuuaagauaucacuuuaaauccuugauaucuuaaaauuuuuuacaagcuagacuuguuuuagaggggaaggggaagcacuggccuggggagacaccuggagaccuuaucuaugaaguguguccuccuccccucaggguccugaagggggagggaugaauagugagcugccuucuauuguagggagagggacagcgcacaaacaaaacgcgccugugcagugagcagaguuauagagggaagccgcuugccauuagcuggucacagucaacugagaaggggaccugggaccuuuuacauuagugcuguacagggacaucugugaacaugcuucgagaaguagugcguacuaucaggaaagcugaaagccauauucaaagauggugaagauccuggggucuggaggagcagggaggagccagucucugcaucugccacagcuggggaagauacuaaugagugagguggggagguugggugggaggcagcaggcucagcaaacaccuaagugccuucuuuucuucucccagaaucuguuggggguaaucagguacugagaaagcuacaaagguugccugcucuagucagcacuugaguccugguggggucugacuuucugggaagaucugagccuuucuuccuucccucagggccugauggcuucgaaaucccagcacaacgcucccaaagucaagagucccaacggcaaggcuggaucucaaggacaauggggccgugccugguaaggggcuugccuauuuuacuaacaagaggaugaggcugacucucgaggguuucagucucagggauauuauggaucuagaaaaaaaugauuauuuuauaaagacaaaugaaaggcaagcuguuucccacuccacaaaaugaagaauuggaaagaagaguuuagaagccauuuugggugcucuguuccuugccugaagugcuugggaauggaaauaaucucauuucugacaugugggugcuugcgagcacacacacauugagauauguauguguauguaaucugauauaucuuagggagaugguuguaagaaccccaugcucauuccaugaagguaaccuauuuuuagcaugccuauguuuuuaaugcaacuuaucacaugagggcagaguugggacuuacccugccaggaauccaggucuuucagauccaggcccuaagagucaucuugagcccugccaccaacccagaaaagcuggguuggugucuuggugcucugucugccauugaggaauaugaauacauuguguguuaaguguccuuaauauaagaaguguauuaaauggaaggggccuggggagccacuggcccugagggucaggaagagcccccuguacucauguacuggucugugggcuuuuuguuggugaucacaggacaccuggugcugccauaggaacagcauaaaugaucugcccuggcuggagggauuucucaacugauacccuuuuccaccagguucuaauggguguaaaggagaggccgagggcaacuuggaggccccauguggcccaaggagggcaugucagagagccuuguagggcucaagggacagaagagagucucagaggaauggaagagugucuuaagcauccuaccaugggguuugagggacaaaagggaaucucagaguucuccauggagcccaagggaugggacauuucuguccaaggaacagaagagggucucuaagucccuguggggcuugagaacaagagcccucaugguagccacccucuguccuucucucagggaaguggacugguucucccuggccagcaucauuuuccugcugcucuucgcuccauucauuguguacuacuucaucauggcaugugaccaguacagcugcucccugacugcccccgcauuggauauagcuacaggccaugcuagucuggcagacauuugggccaagacaccaccugugacagcuaaagcugcccaacuguaugccuugugggucagcuuccaggucaguccacugcuuugggguuggguugcagugggguccugucugggaugcagacuucugacccagagugauguucaagucagggugcagcaguuacauagaagcagauacacagagcaggaagcaccugugugucacauuguauccuuuaugguuaccccccccuuccacccccaccugacugagcagugagggcugccagugggagggcauagggugccugagggaguuccuucacacagcuggaaucuuucacgguagcuucugggagggguuguccuagacuucacugcuuccacagguugccagauaguccugaucaugagugcuuuuguaaugcaaccucucuaacaggaaaucuaagaggucacuaggcaggagcagccuucacaagucggauguuggacagggauggaagucuacaguuaggacagguuagguagggaaccacaugggaaucaagucacauuuuucucccaggcagaaucuugcuuugagacuugucucucccagggcccaagccuuuggacuccagagucuuccuccuuuucauuaccucuguccucugggugagaaggauagcaugaguugagguugcuaaagcauggaaaagcccagcuguccaguagagggcuggauaaacaauacauggucuguccaucaguagaacgcuacuggaccauagaaaggaugggccucugaccaaggccucccucugggccaguguuggaaauaguugccaaguggaagaugcuaagaccaauuggagugauuguauuuaugugaaaugucuagaucacauugacacacuggaaagauuggcggcucccagggacuguaggagaagaugagaaacaguugacagugggaacaugguucccccuguuuaaacaagguuuaaaaaguauuuggggguggggguugagacaagguuucuuuguguagccuugggcuguccuggaacuugaucuguauaccagacuggccuugaacucaagaggucugccucuuucugcuucccaagugcuggcauuaaaggcaugcaccacuaccacuuaaguuuuuuuuuaauauauauuuauuuuauguguauggauguuuuuucuacacacacacacacacacacacacacacacacacacacacauauuuagauuuacuuauuuuuuauuuguaugaguacacugcagcugucuucagacucacacuagaagagggcaucaaaucccuauuauagaugguugugagccaccauguggaugcuggagauugaacucaggaccucuggaagagcagccagugcucuuaaccgcugagccaucucuccagccccacuacaccucuauaugugcgcuguguguuuacagugcucaguggaggccagaagaggaaauaggaucuccuggaacuggaguuacagacaggugugagcugcuauguggguguugaugcugggaaucuaacccaugaccucuggacgaguagcaguugcuuuuaccagccaaguuuucucucucccauccuaggguucccuuugguaguguugucuuaguuaggguuuuacggcugugaacagacaccuuaaccaaggcaacucuuauaaggacaacauuuaauuggggcugacucacagguucacggguucaguccauuaucaucaaggcaggaacauggcagcauccaggcaggcaugguguaagaggagcugagaguuuuacaucuucaucugaaggcugcuagcagauacuggcuuucaggcagcuaggaugagggucuuaaaggccacacccacagugauacaccuacuccaacaagcccauaccuacuucaacaaggccacaccuucugauagugccgaucccucugccgagcuuauacaaacaaucaaguguccuagagucaguuuguggugauggcugccuggucuugugagccuauuacaugacucugagccacaguguugaaagaaugggcuucaagggacguggaucacagucaaugcuuuuauuguuauuuuaugguuuguuuguuugguugguuuuuuuaaaacagacuuuuuagaaauuaucgauuuuuauucuauaugcauugguguuuugccugcauggauguuugugcgaaugugucagaacucucggaguuggcguuagacaguggugagcugcucuguggcugcugggaauugaaccugaguccucuagaagaggagccagugcucuuaaccacugagccaucucuccugcccucaucucaauguuuuuaaauggcuuuggaaagggguugggagggcccaugugucccgggaagccugcccagccccugaagugcuaagcucuagaauagcaauaguuguacuuccugugucuguccacuaaaaccaggccaggugagaucacacagcucucaccgagcaggcugccggucuucccacucaaaacuccauuucaggugcugcuuuauuccuggcuuccugacuucugccacagauuucugccagguuaugugggaggcguccaagaaggugccauuacuccagcagguaacccuugccucugaguuggugggugacuugcccugccuagucugucucugacuccugggguggcuuuuccaugcugcaucccaaauaagaaccaauuuaguuugcacgcuguccgccgggccucaagguucuggaggagaucuauugcucuuguagauguggcacauucagcgcucaagaaugcggucccugacucuugcuaucuuucaguccuacugcuuccugggaggaccccgacuuuaccuugcuaaugccaugggguuggaaucccaccugugccuccagcagagaucucagagaggcacugcagcaaaggggaggggagccugggagaacauaggguugacuucgucugaccuugcucacaccuuauaguccuguccucaaguugggauggauaacaagggugagaagcaacacagagcagccaaagccucacagugugaagggugcuacuagccuuuaagccuggguaugaaacagaaaaugaccccuguccuucagaaugguaccuggaagcuguagccagggucuacagcaacagagaccagggagcagauaggugugaggcagggacauggccaggccaggugauccaaccagaguucucugucugauugucucucugcagggguuguaaacaaguaugaggugaaugggcugcaagccuggcucauuacccacauccucugguuugugaacgcuuaccucuuauccugguucucccccaccaucaucuuugacaacuggauccccuugcuauggugugccaacauccugggcuaugccguguccacguucgcaaugaucaagggcuaccuguuccccaccagugccgaagacugguaaguuccuuagcaucugggcaagccuggaauggaugguacauacuuccccucagggccuggcagagagagaguugagaagugagaccugggaucagccuuuuggaugccuggauuuucuugcuugaagaacugcuagcgguagccaaggcugccaugggagcaguugaacuagaagggcaacuucuggcugcggaggaggcagaucuuugccucuuucuuuggauuauuucuuaugagagugccuuagagaaacucuuguuaucucagcagcuuuaccguagcugcuuccuaggagagcccgugcuugcucacagcauuuucauaguuggagaucaacuauccaguccauuccaucuacccaucuacuccuccauccacccaucuacccaccuacuuaccugcuuacucacccaucugcccaucaacuacuccucuuccuauucauacacucauuguccucauaucugucuacucacccaccucuccacccacgcagccauucaccgucuaccaucuaaucauccauucgcucucuacauacccacccauacaccuaucuuauuuaucaaccuauuuaccaacccauccauuccuccauccauccacccaucauccauccaucuaucuacuuauccaucugccuaccugccuaucuacccauauacccauccaucuaccuauccacucauccaucuacccaccauacacucauccacuuauccaucugucugucuaccuauauacccaucuagcuacccacucacccauccauccauccauccauccauccauccauccaucuuuccauccacucauccaggaacagaaaauuggggaguucuucuggaguucuuaauuuugucuggggauacagaugaaaagagaacaucucucccuuaacuguuggcuuuggcuuugggcagugagccucagaugagaauguuguauggcuuguguuacccuaugugcaguuuacugccuuacugucuuuuauggcucccagagccguugcugcuuuuguagauguaauauuugguucuuucuacuuagccugacugugggaacuaggcaugagaaccugcugucccagcuagcaauaaucccugugcgugcacaguaggcuauagcuaggaagggucuucaccccaauuaucucagcugauucucuccccuagucuuggaugaaggguuuacuguggggcaggugaccaagaccaugaacuuggucacugaacuguggaacagggagaaacguggagcuuaggcuaugagcacaggacauuugccucguaauccaagugccccuguguuuugugucucugcugagcacgagcacaguguccucugaaugcaaauaccgguuugagugcaaggcugcuauguucuccccugcauggacacuuuaaggucacaguggcauuuaggcugccucuuucaauugccagaaccugaaccuugguguccacaaagcuggaugagcuauguauggcgagauauacuacuugauuacaugugucuuuggagagcagggaauauggcucagugguuaagaagagcacuggcuacuuuugcagaggaccuggguucaguaccuagcacucacaaggcagcucacaacuguucagcucccucuucuggccucugagcgcccuguacccacaugauguacaagcaugcagauaaaacacauaaaauaaaucuaaaacaaaauuuuaaugugucuucugucugcuuuuaagcaaauucacaggcaauuucuucuacaacuauaugaugggaauugaguucaacccccgcaucgggaagugguuugacuucaagcuguucuucaauggacgaccagggauuguagccuggacccucauuaaccuguccuucgcugccaagcagcaggagcuuuauggccaugugaccaacuccaugauuuuggucaaugucuugcagguaacuuggugcgcuugcagccaggaagggcagggugccacaccugcuggacucugagagaguucccagcaugcuguccuguacagagcuggcccuuccaaggucacagugaggacaugcugaaaaucugccacuacauagaugccauugugccagcccccaaagagacaccaugcugucgggccuaguccaaggacgacgacucccuuaggugcugcccucagauaggaucugagaguauaugggcuuuuguucaccagcuagagaagagagauggcaggcaugcugugggcucaaggagugaccuguggagucuucauagugggagugggagagguugagacccugaggaagguccucuguccugagcagccacuaggaagcucauggccaggugggacaaacaugggaguuuuccaugcuucaguuaaaggcaguugucacucaggagguuguggcaggauuguuaugaguucaagacuagcugggagcuacauauugagugugagaguagccuggauuacagggugagacucuauuuuaagaacaacaguaagaccagggagagggcucugugacuaaaggggcuuucccugagagcaugaaggccaaaguucagggcuggagagaugacucagagguuaagagcacuggcugcucuuccagagguccugaguuccauucccagcaaccacaugguaguuggcaaccaucugaggugggaacugaugcccucuucuggugcaucugaagauguacucauauacauaauauacauauacauaaaauacauacauacauacauacauacauacauacauacaucuuuuuuuuaaaaaggccaaaguucagauaucccagaaccuguguaacuccagccucaaaaggcagaggcaggggaauccccagaacaggcugaccagugagacuaaacauaucgguaagcucuagguuuggcagagagaccuugccucagugaauaaaauggaagacuucaaucuguggccuccacgugcacagacauuuguucaugcacccacauauaugucccuacgcauauacuacauacacacgugugcaaaaggaaaaaaaggggggggauuuaaaaaccaauggaaaaaaaugcccagggguaccagaguguggccugggucuauaguguguccagcagggcugcaggggccagaaagaguaacugcagaugaggaggaggccacgggcacagcucaggcuaacugacugugugcuggguggggccagacugcagaugaacaacuggauggaguaagucccugccucucaccaacucuggucaugcagaccuauggaccugaggagcgagugguauggccaggaccauggccuuugggagggaucuucucugugguccuccauaaagcucuuucagugcugggaaagagagauagauguagaagagacccacagagcacuggggucugggcuccuuaggccagcuuccugguacagccaaggcucaggaagcugggacugugucuaugugcuauaggcaaaucccagcaugccugagcaauguacuacuuccccuuuauaaaggacugccuuaggcaaggugagcauugccacuuuugcaacucugacuagcacacuuagcacccuacugaugauucuagagucucucgaaggcucucugugugcccuagucacaacuuauggcccuugaggugggaagugaugagcaaggacuuugcuuguguccaucucugugaauggaucucagucuccuuggauaccuuguauaugucaugguucugaugggcagcugacaggggccagcgcuaggacauugaccauauggauguacauaucggugucuaccauggugcuaagugccagcuucccagggacagucccugagcuccuccaucuugagcccccacugcucugagcuccacaucuaaugucaccugugggaacuauggcugggagcccguccugcugaugacaguggccccuccaccccucuaauguucccagccccgcaguaacuuaaucaaguuacuuagcaacaccccaacugccugacccccaucccucccuugcaugggacugugaugguaacaguguugucucugucuuacaggccaucuacguguuagacuucuucuggaaugaaaccugguaucugaagaccaucgacaucugccaugaccacuuugggugguaccuaggcuggggagauuguguguggcugcccuaccucuacacacugcaggugaggaggagccaggggguggggcacgguguuaccagcuucauuagcauuggcuguguagucuucaggugcuucaggcuguccuugagcagauacacaugcugagcuugccaggggcuuaguccuugggguucacugggucagugucuucucccaagcagggaaagcuccuugcaucacagaugucuuugacccaguaugggauuuggcuccgacuccacccaucguacaaugaacgaaccaaaaguggaaaguucauuuaacacaccuggccuaccaacuguagcucacccuugccuucccuaacgcauacauggccauggcugggaaagucaucccaccaaaggcuuggaggacugcugagaccuauacugaaacugaauagcagacuauguggaaugguuuucacaccgucuuaggcugauucauguagccaccuguaguuggucugggagagccuggcauggccccaacgugagcaugucccuaaucauccuuauggucauggacucccaccuuccccccaaaucaccaaaggcaggauagagccaccaggguggccagcagugacuugagcuggccuauaugucuauucccacccacuugcauguguuggcaccaugguaguagugggccugccugcugcucggccccugcugcugccuagagcagcuggagggagcucagaaggauguuggccucuccaggagcgggggaaucaguaaggugggccucuguuggcugaucacacagcugauggggacguggguuguggaaguggucuggcucccuaugcaagggugcugcugcugcugggaaagcaguaguucccagcagagcagagcggggagaauaaggacuugggugggugucagccccagacucacacuguggauccucaccaacgguaagcagcugacgugguuggguuucugcaccgacugggcacaggcuccuggggcaucucauuguaucuguaugaacagaucugucaucagugugugaacugaugacagagaccacacuuacacaggucuuuguaucuagcaggccucguuuuggccucaggauacaguggccucuauguuaaauaguccacagauuaaaccaagcaugcauuggaaguaauuuuuuaaaaacuugcugcugggccugggggcacacacauguaaucccagcucuugggagguugagguaggaggguuaagaguucagucccccucagcugcaugguacguucgaagucaacuugggcuacaugaggcuaucucaaaacaagaucaaaaaucccugagggcuggggugacagaugugugccuuccugccccccuuguaucuuacuuaacagaaaaggaagcuggcgugacaagucuggggcaggggcagggucagggucuacacuuccuagcccacacugaugcucacccugcucugugguagggccaccuuuuaccuuucuucucuccccuuuuccccccagggccuguacuugguguaccacccugugcagcucuccacccccaaugccuugggcauccugcugcuuggccucguggguuacuauaucuuccgaaugaccaaccaucagaaggaccuguuccgcaggacagaugggcgcugccucaucuggggcaagaagcccaaggccauugagugcuccuacacaucagcugaugggcugaagcaccacagcaagcuguuggucucaggcuucugggguguggcccgccacuucaacuauacuggugaccugaugggcagccuugccuacugccuggcuuguggcgguggccaccuccuccccuacuuuuacaucaucuauaugacuauccugcucacccaccgcugccuccgugaugaacaccgcugugccaacaaguauggccgugauugggagcgcuacacagccgcugugcccuaccgccugcugccuggaaucuucugagggcagccuugggaagcauagagaggugucauugaguguguggaguuggaugcaugggggcuggcaucuggcucuccccugcaaacugccuccucaguuugcucaucuggagaauggagagccuggugucccacaguggcugcugacagcuggagagcugaauucacacggauaccccagcagaauggcuuguucucucuguucagcauccugauagcagaggcccuuucaugucucucugcuuggagcccaccaucuauucugucuagauaacuuaggcuuaucagaugucuccgaugauugggccauccugguaaaccggagaccaugcaggauuuaaagaguuuggcaaugccaucacccccccgccgcacccccccccccccauccuggugagcuaggcuccauuuuugucuguagcaugugcaguguuaauugaucagccaaggguucagaggccauugaagaagggaggcuuuuuuguuuagguucuugauuuuuuguuucuuuguuuguuuuuguuuuuaccccaggaauggcagacaguggacuggaauauucagggggcacugcccacugcacagucccuggcuaacuugauaaacaggguucccaggacuccccaagugcccaccuagcagcucauccaccugcccucuucuggaaggugcuucuuguuuaccccugagacuuggcucggacaacccagaacguaucaccagucaguggccuuagccacaccuuccccaacuggagacccaguguuggggaaggaacacauucucauuagggacacugcccccccccccaaacucaggguauucuguaaaacuagauaggcuuaucuuagccuugcaggcaguucuuuguauuaaaucugcuuuguuaaaugagu

SEQ ID NO: 4238 - RNA, 3770 nt, Mus musculus
ugcuuuuaaacugcaaaggcaaauuguuucuuuacaguacccagugguuugguuugguuuguuucuuuuaagaugauaucaugcuaucaugccauugauacugaacaauugaacugaacaguucuccugccucagacucaugagugcugggauugcaggcaugugacacuucaccugacugucauuuuuguuuauuuuugagacagggacucauucuguagccuaggcuggcuuaggcuuuauuuugaagcccaggcuggcuucccacuccuggcaaucuucugcuuuagucuccuguguacugggaccgcagcugggugcagccaugccuggcuguggccagugagauuuuucaagugggcagacaccuuuauuucuuuguaccccuccccacuauuuauuuuauuuaaacauuuuuauucacuuuguaugugcagagaccagggguagagagaaguucacggaggucuuuccucuccuucugacacauggauucuggggaugagcucuucaggcucgguggcaggcucuuucacccaugcugccgucucagcagccccccuacuuugguuucuugaagcaggauugcacaccguagacccggcugagcguucccagugggaacugcucuggccaguucauucucucaauacaaaacagucuccugcaaugguggggugugagcugaacucugucugcacaguuuguggguugugccccucuccccuuucuccuuggagguucuuggccaccagccugaagggagaaggggagcugagguggcaaagagcaggguucagccaugagugugucugggaugaccucuguagacugcuucagcgagacgaggcuauuguuuuagggauaggguauguaagagcaucuuuagggcacaguggaugguuggucauggcaucaagcgagcaggaagggccgcuugguuauagcacagcaccugauugucaugcagugggaagccggagugggacuucugggcugaguuaugcagccuugcacaaagcucugaacaaggucacuuuucagacauggccagccagagccagccaccugugcucagggacacucucaggcagagacaggcagacaggggagccccagugagaaagggagucccccauuuuaugcucagaaaaccacccagucauggaggacugcuaccuuaauaacaagguuccccaacagagguguccaaggucauccuaaagaaugcaacccuuguguuccaaaugaacacaguaugucucuugggagucuuaacucaugcugacugcugucuugucuccuuagacuacucuaguggcuucgguggcaaauacggugugcaagcugaccguguagacaagagugccgugggcuuugacuaccagggcaagacggagaagcaugagucucagaaagguucggcgggccuugggcuccuuguggaugagugcgcucuuuuuuugucugucugucuguuuuuuguuccuguguuucuucuaaucuuuucauaccucaacuuuucuuagacuuauuuauuuuuauuugauguguaugggugugugugggugcuuuguguacauguauguaugugcuuuguguggaagccagaagagaagcuacauuuauaggugguuaugaguggcuaugugggugguaggagccuaaaaagguccccuuaaccacugaacucuagugcaucaguuuucaaccuguggguugugaccccuuuggggucgaaugacuuuuucaugggagucucagcagguauucugcauaucagauauguacauuacaauucuaaacaguagcaaaacaguaguuaugaaguagcaacaaaaauaacuuuauaguugaggucaccacaacaugaggaacuauauuaaggucacggccuuaggaaggccaagagccacugcucuugugccuguguuuugagacagggucucauuuuguaguccaggaguucaccauauaaggcuucacacuugaccccaucuuccugcccagcccaggugugaguguguguuggggacaugcaugccaugugugaaugccagaggacaacuucguggagucacaucuucuaccuguuguggguuuuagggauugauuggauaucggcaggcuuguguaguaaacaccuuuuuguguuuuguuguuugagacaggaucucuauuguguagcaggcuguccuggaacuugcuauguagacuuggcuggucuggaacucacggagauccuccugccucugccuuacaagugcuuuaccuugaacuuagacaugcugagccaucuugaagucuccaugcccccucccucccaaucccuucuuuucuuauuuuuaaagacuggguuucacuggguaguccugauugucuugggggcagggacugggaguguauauagcucaguggcagagcacaggaucuggauuugagcaccacauacucaaaaggcccugcuaggccauccuggcuuuuucuccuucccugcuguauaaagagcaggcacauguuuacagauaccgcugcacauuggucuuccuggugcuguuuguuuuuugugcccacaugaguuauuucuguuuaguguuuaccaguauuugaaaaucaagagcuugcaugaaaaagaagcccuuguauuccccacccccaccccccuuuuagauuuacuuauuuauaugaugcucugucuacacaacacccgaaugccagaagagguuaucagaucccauugcagaugguugugagccaccauguggguacuggggacugaacucugguccucugcaagagcgucagugcucuuacugccgagccagcucuggcccuuucuguuaacugccaagcugucucucucuggcccuuuucuguuuuucuuuuuguuuguuucuauguuucauuuuguuuuuguuuauuuguuuuuuuucagccaaggucucacuuuauagcuuugaacucaguguguauuggcuuuguuggcuucagauccucagcaauccuccugcuuuggccuccugagugcugggagauaggcaugagccaccgcacuugggcucucucuucccaccgugucagucccagggauugugcucaggucaucuagcuuagggacaauugccuuugccugcugagcuaucuugacagcucacaacucuuaaagaccauauaacaugucauuuugaccuguugcuggcuuaccuuuuuaauguuuauuuuguacaugcguaugucugugcacaugugugacagucagaggacugcuuauaggaguugguuuucuccuuauaccguguaccaugugggucccagggauugaacucugaccuucaaauuuuguggcagccccucccccaccccgcucuccccuccuccccccagccuucuaacccacccguugcuaguuuuuccuacagugcuguuguuguuucagauuacuccaaagguuuugguggcaaauaugggauugacaaggacaagguggauaaaagugcugugggcuuugaguaucaaggcaagacagagaagcacgaaucccagaaagguaccugcugcuuccuuccucuagccagccccucccaggaucacaggcguggccacaggagaagagaaaaacaggcugucaccuacaguggucagccuaaggcggccggucccagcccaugggaacucacacaguggccucagcuuugaccccaagccccaguguugcuuguagcaguguccugucacgcacgucugccugugugugaugagaccuccaugcc

SEQ ID NO: 4239 - RNA, 4155 nt, Mus musculus
cgcgagacgcugggcgggaaagccuaaggugauuuccuaugugggaucgcugaggggcagcccggcguaccacugccauggacccauuccuggugcugcugcacucgcuguccggcagccugucgggcaacgaucugauggagcucaaguucuugugccgcgagcgcgugagcaaacgaaagcuggagcgcgugcagaguggccuggaccuguucacggugcugcuggagcagaacgaccuggagcgcgggcacaccgggcugcugcgcgaguugcuggccucgcugcgccgacacgaucuacugcagcgccuggacgacuucgaggcggggacggcgaccgcugcgcccccgggggaggcaggugggcagggggcggggaaugggcggggaggccuggccucagugcacccuccacuggcuccgacugggauggacucuagggcacgcccacuuuuuucaaccgcuugagccggaagcugggaggucuuguuucuuacuggcagugccaagguugaacccaaggguucgugccacuugcccaaccccaguauuaacucgccucagaccugcagugcuucguuggaaaacucagcuaagaagugaaugugacuaaggcaucuuaaccccagugaggguagcguugaagagugggcagaggucacgugugccggcugcucggcaccauuuccguagugggagugccuguguccaagacugcccuuccuggccaaggaaagauugcgcggcggcugugcucucugguccagagugcagugucugguuaucggcaguuacuucuguuuugcguagagaggaggcgcuaugccuccccauaacgcacaguggauagcagccacagcugagcaacaccaggcuggccuugggauguagauacagauuaagcauauauuagacacuugaucacuugugacaaauacucgagaagccauuuaaaggggcaaagguuuauuuaguuccugguugguugucaccguugcucuuugucuacagugacacagaacaucaaagcagcuggagggccuguggaguaaagcuucccacugccggugugugcaagauccacacgaaaauggauuguguauucacaucuccaaggcauuccaauguuuguuauuguuacaggaauccaguaaagggucuucagccacugcccagggcucccuacagagauuacaccuugccugugucuaagcaggggcuccagaguagcacagagacagaucuuuuguggugucuggucaaaccagcaaaggucacaguguaagauguagcuuuggggacuuuggccaacccacuauugagcgggguguuagggcagcccugcuuuuucccucugacacuccaguccucaguugacagucuucuaagccauagcucgcuguggcccaggcugagaauguggcugggcagaucaggccacuuuggguaucuugaaguagcuccugugcuacuuagugucagcacaggaccugaguggcuuugaagugauguugucuucgaagugcucaggcccaugcuugguggccgguagggagacuugccccagcuccucagucaagucacacugcucuuuucccuccuagaucugcagguggcauuugacauugugugugacaauguggggagagacuggaaaagacuggcccgcgagcugaaggugucugaggccaagauggaugggauugaggagaaguacccccgaagucugagugagcggguaagggagagucugaaagucuggaagaaugcugagaagaagaacgccucgguggccggacugguuaaggcgcugcggaccugcaggcugaaucugguggcugaccugguggaagaagcccaggaaucugugagcaagagugagaauauguccccaguacuaagggauucaacugugucuuccucagaaacacccugacaagccuacagcuccucucaggagucacuguggacuugaucacaccaugauguagcaccaagugccuuuugugcccagugccaaaaagaccuugcugauccagggcggguccccucccaccagcuccuggaguauaucuguaucuacggaaccucugcucccugggcuuucggaacacaugaagguuccccgucguguucuccaccacugcuccucccccccacccccccaagaggucucuggucuugcaagaaggaaguugaagcugauggcacaugugcugacugcaguuugagagccuucuucuuguuccuugggggaagacaccaucucaguuaagaucacuugguugccuuacaguuggccaagaggacaucugucucacauccuuggaggccaucagacagcagcuccugaccccccacccucaaacaagugcaagaccccugugaggacugugguuuaaaggguagcaccuugccuccaugguggucuguaagcaagugcccugggccuaccuacauauaguggcucacucugaaauccuagcacuugagaguugagaacugcacuuuacagcagccugagcuacaaaugagauguucuccccaaacacacaaaagcaagugccuuuaccuggagauaacuugugucaccaagaauuucuauuauauuaagaacccuucuaaccucagaaaucccucccaucaggcugacugaggugugcuuacagcccugggugcuaguugugaauggagugaugugauuuccuucacaccagcaggggcccugacugccacacuuggagcccaauaaaccauugucucagcuuucuaaccuuuggcugggugugauaauacauaccuuugauccuagcuuuuuagggagguggaagcagguggaucucugugaucuaugaguucaaggacagccuagccuacauagagaacacuaaguagaaagaccauaucucaaauaaauaaaaguucaugucuggagaagaggaucuuagccacagguucuccugacagagugaagagcuguaccucacuguccuaaccuaauguggacuucaagugaccagccuggggccuguacucaaacacagaucagucauuuccuggcacuuagguucuaugcccucauuuccugcucccugcuccaccuauccaccagacagcugaccccucagcacacuugaacucuccucaaucgccuuccgcauuguuggucccuccugcauuccuuggguugcacccuccuccacagccucaagccuaccauguucuucagcucagcauugcuccaucuggcuguuuguucaaauucuuggccauugaggccuccugacuacucuggggacucauccuguuuucucugaccccauuucucaccuggcuguagccacaaugcucuugacuccccagacuaugcauaggccuguauaaggugucugguggguguucucugucauucucuaccccucccccuuucuccaguuugaaggguuuaagacacgguuucuuguagcccagauguaaccuagguuggccucaagcugaguguaacugaagugaccuugaacuccuuucugaucauccuaugcgcuaggaagccugggcaacccuacugcucuugcugaugccuuuuaacuguccuguggcaagucacaggucgaugggcuuagaugucacuuuuuuuuuuuuuuuuuuuuuugguuuuuccagacaggguuucucuguauagcccuggcuguccuggaacucacuuuguagaccaggcuggccuugaacucagaaauccgccugccucugccuccccagugcugggaucaaaggcgugcgucaccacgcccggcgugucacauuuuuuguacagcucaggaauccaaaauggcucuccagaguucagcucagauaugagcaagcugguuuccuucuagauuuaagagaaugucacuugcuguauuccccucuuuaaguggcaguauugaguuacuacuguugcagggcuuuugggccaccaaagaaacuuaucccuuuguacagagucccuucaaccacguuggggauuaaaacgcggucaucaucagggugagcaccccacacaucucugcaucuccccaacuugugcccaguuuugcccugaacaccucagcaucaauuccuccugcugcuaauaaaggcuugucagagcugcacagcucacaggugacuc

SEQ ID NO: 4240 - RNA, 6364 nt, Mus musculus
ugguucuuuaaacagcaggaauguauugucacagccugaaggccagaagucuaaggucaagcugguggguaagguuuuucaaggcuugcuugcggugccuccugagcuuuuagggcagccuccagccacuuagcuguggaagcuucacccugacuuagcccccagguccacauggaaucucacugguggaaugcucugaaugucuaugugccuccccauggggcuugugugcgugugugugucccagccuacagccaaauuucuucaucaggacacuaauggcuuaucguggugccuucccugagccugcauggccuucuguaagcuacucacaucuagcaaaaccuuucagaaaagguuguguugugucaaccagggucaaaugguagauaggaacugagcaggacaugaauguuccugccucccucccaacccacgcccagugugaagccacuggccucugacuaagggcaagggacagauccccgaaguggcccagacuccuguugggucaguuuuaaauauuagccaacagacacuucccaguccccuauuccuccccaggagcuguugaggugccuggcucguuccggggaacauaagcccuaucccgagggugagggcagcucuaugccaagguucucaucacagagauacagaggaagcugggccugucuuaggguuggcugucuggagauccuggagcccuggagguggguagcaagaacaaaggaaguacuucaccugauaaaaacaguucccagagaaacacauauacgcuucauauacaggagugcgagugugugugugcgcgcagagaggcagaggccuggaagucaaaaguucagggccaguuugugugcaugcuucacacacacauguucucaggaauacaccaacacccuucuacacacaugcuuguggguauuugcagacauaagaacccacaaacacaugcuugcauguagcaccucagcccuuucucaggacacagccagucugacaccuugcagggaagcccgcagaucacugccuucuucacccuccacagaauaucucaguuggagccucagggcaugcuaagucuguaucccagcuguuaaauagcaagacagaaagacaccuuuaaugugugaaucacagcccccuccacgguccacugccucagguugccaggacugacugccauuggcugggcuccauccgggauuaggaugaccccuguaauaagaauucccucucauguaacuccacauacaucuugaacuucgagucuuccagagucucugacucaagccccuuagcagcuggcacuugcucuuugaaagcuguaaaaggcaugcaaguucuuggucccccaagcagccagcccaaagacaaggguggggaggccagggcuccaagugaaucuugggugcccacuggaguuggucucagagggcuuuccagguggccacucaggccacagccaguccaccuguaugcagcugggugcuuggaguggcccugguagacaaagucuccaucuugccaugaucacuugggcucugcuucuucugccuccgcugccugggcuggcugcccucuccuggggcucguggcuggcuacucugcagcagccgcaccaucucaugguccuuguggcccagcacucggggcaggaagagagaggacuuuugugugcggcgggucuugaagccccugcguggccgacccuugccauucaccgacacguaccaaggucucugggcaccagguugccguugagcuccuggcccacuggacccugugcgguacaggcgggaagcauauguauuguagcccagcucauggauccguuccacaaacucacacucugcguuguagugauccugugagacagaagccacagucaacagccuuggagccaugaugucaauggggcuacaucuccccaaugccucccuuucuccuaaggcugccuggaccagcaguccacaccugccacugucuaggcagcuuggcuauccaaccuguccaagucugugcccugcuccaagugacuuccuuccacuauccccuuuugcugcagccuugcacuuggcucagugcuugguaugugguagacagagcaugcuggagguggcuggcuagcuggugugucagaggguggaugaauggauguguuggugaguggcugaacaggcagguggauguaauagguggauggguagcuagguauguugcugggugggugagugacuguguagguggauagacaaauaaauguaucagugguuagauaauuggguguaaggaugguacauggguggauagauggauggaugauagguugggacguaugaacgaguguauagauggagguguggguagaugacugaguguguagguggguggauagauggcaggcugaguagauggguggauagauggauggauggaugauagacaaugaauggacagacugucaugaaggaugagcugacuucauucagccugcuuuuacaguagagggagcugugggcaguuguggucgaagacuuccaggagguggggauugacuauggaaugucacugucccauggauauagcacauaggcagccacauuacgcacccaggacacccagggacaggucuacaggaagaggccuuagacaccagccagcagcugaaagaagcugggaccugucugcaagucuguaggaccaucccugauggguuaucuggaaaguucuacuccaaccagugggaccccugaccucaucaucccugcuccccugaagccaagagagcacaggcaugccccccaucauguucuucccugugggcagaucugucauugaguguacccaaaaccucacccuaaggcagaguuucugggggauagucagguucauuguaaagucagcugaguucacucacuagagugggucaggacacagagucuaagagucagggaaaucaccagcccagcucugcagcagcuaagacccaucacucaggcaagaguguguuucugucacaccucaggucaggagaauggagaccccugagcuccuccuguugcccauccaggagcguggaggccaauucagcuagguuagcuggggaaccccaaaagccauccugccuccucccccugcccugggaugaccacacuuuauccuggcuuugauacaugggugcuggagacccucagguucucaugcugugcaaccaguacuagacugacagccauuucuccagucuccugcuaagccagacaacuguugccuucccacccugagaagaacaggccaagcaccagccuuccuccuuccacagaugcagggcagguuugccaugaccugcucucccucaacugcagcuaugguggcuacucacaccauggagguuugggacccugcugccaugcucacuuccugucuccaucauuucgacguuuagagaaagagacugacuucagacagguggaaagggcauuuuccugagcaccuaaagucuguguugggcaggcacucagaagcccaggagggaucuggacgagcuugagucuggcaugaccugggggcuaagaagucuaucucucauguccucuucugucccccaaucagaugcucaagccagaugguuauuccaucagcaccugcccaccaguaauggaacucaccgaagcauacagccguccucucuuguucauggccagguaccgcccagaaaagagcccuuugauggccaccacgcccacuuccaccgcaguaaucuccaggaugccuggaaagagucaggaagaguccaucaacgucucaaccuaagcagaaccucagccugagccagcuucccccucuaggcucaggaagcugggacaggucugguuggaaguccugguaggaagaaaacauugagcaggugguaaggaaaggggcauccugccacugugcgggagaccuuaauccuaaccucaggagaagacaugaugggaauguucugccccugccaugcaccuugggugcaaccuggacagaucgacccagucuguauuuugugcaaucuugugaaugccucggucucgcaagcaucaaguaacuuaagccacacauaaugguuugggagauccaaaccccagagcagauggagacccagaaggggagguggccaagacucuuagggaagccaggguuugcagcccagccccccacuggcagcaagugauccaaagaugugugcugagagguagccugccacagaaaagggccugggugcugaggaaaggugacagggcucacccaggccuaagaguagguacaaaaguuaacaaucucucagcgcagaugacagagaaguugcagagacugaucaccagaguuugaucgaggaacccacaugauggaaguagagaccagacuccagcuaguggcucaaugaccuccacacacucacuguggcacacaaaacaaacaaaauacaaaaacaaccaaacuucuaccagccuuugccgugaacaguauagugcuuuugggaggggagcggaggucaaagacccccgggauagugggucgaggauucacucccuuucuagggagcggccgcugggacccagcaugguccagauuaccggacucaguugagauucugcccuagccacgguuuggaggggugcaggaugaggccucuacagcuggcgccagacgagcaccagacugagugccccuagguggcagcgaaugugccccuccucuacaucugggaccucccgggauccagcaaauggggaguggugcgcaugaggagccccgcgcuccaggcccgacagggucuaguccccaggacgcccccgcggggcugcggcuuugcaggaggaagcugcgguucccccccgccgcccgcgccccccguucggcuuccugcgccccgggcgcggugaguuuugcgcggccucccucccacgcagcgagcaacgcuccugguccagcuccgcucguggguacccaacugaagaagccaaacccugcaauacucgggaacuggcccuggguaugaucgagcugcgggcugugggugcgugucagcagcauccggaacacgaggggacgccuguuuguccugucgcgcucucuugcagggcgcaggacgcgggacaagccugucgucagaugccgcguugcggaaaccgagcucugccuaguggaguguccuccgcgcaucggcugagagcaaagagaacgaaagggacuggccaugcaccccggggucgucaaaacaauaaagagggcgauaaauccuuguccaacggcuuuucauugaguaauagaaacgugucagaaccggggucgccucccgcgcagcuccugggggagcgggacgggcggggcagcuugcugaguucgguagcugggaccgcggcggcgucuucggacugaccucagcucugccucuaucuaggacguggcggcaggggaccgagcccuccggucucuuccgccacccuccccucccuguccggaccugaacacucacuauaggcgcuguucucaaggcugccguucacgcggccgcuugggugcagcuggaggugguacuugguagcgcaguagagcuugcggcgccguggcgccccgccgaggugcucguaaacgccaccacggccgcccgcaucgcgucguagucgcgucccgggccccguaguuggccagcuggguuccagcaagcugagcagcagaagccagaucaggcccaucccggcaucgcgcccgcccgcagcggcugcugcgccagcgcgggucucacgaaggcgcggcgcugggagcacacgcccgcgcgccaggccggcucgacuguggcuaggagaggaagggagggagagggggaccgggaagaggugggagacaggggagggaggaagaggaggggagacagggagagguggagagagguggagauggagauaaggacggguggagcaggagaggggaagagauaguggagagaagacaagaaagaggagagggagauggagaaagaagacuuugaauuuucacccaggaaugggggucguguuucuuugccgaacacaguucugaagaaagggcgcuugacaacaaaaggcggccguggucccuggcgggggcgcgggacucaggccgggcgucgccugcgcacagcucccgggccagagccgucgggccgccgcuccuccgccgugcgcccugagcccccucccgccucugaaagguccccgccccgcccccgcccccagaccaauuaugccucggaaaauuauagagcgaggccuaaaggcaaccgcccccaggcccugucacccccucccgccuuacaucaauccugggugcacaaugggacugu

SEQ ID NO: 4241 - RNA, 4510 nt, Mus musculus
aggagaaaugcucugaugcccgggucaccuacccgcggggcccgcgggacgaaacguauauaaggccgcgugcccggagccaccccacugucggagcaguaacucugugcgccccacgccacaagcgcccaguugcuuuguggguugugccugcccugcgccugcaacuugaguccccgccgcaucgcagucuccgcgccaccuuuguaacggccuucaggaccccgaggugucauggcgagaaaguggaacgggcgugcgguggcccgagcccugguccuggccacucuguggcuggcugugucugggcguccccuggcucagcaaucccagucugugucagaugaagauccacucuuucucuacggcuggggcaagauuacccgccugcaguaccuguacuccgcuggucccuaugucuccaacugcuuccuccgaauccggagcgacggcucuguggacugcgaggaggaccaaaacgaacgaagugaguaucauucagcccguccccuccggucccuuaggacccagaagcacgugggugugucgccguggccuuaacauccucccaccccugacuuccagacuggagcuggggaagggcgaugcaguguggccccgcuguacucacguguugcuggggcccggcaacaucuuucucuugcucgcagauuuguuggaauuccgcgcggucgcucugaagacgauugccaucaaggacgucagcagcgugcgguaccucugcaugagcgcggacggcaagauauacgggcuggugaguguuccuccacgcggcgggaugcucgcggccgcguuggguccguauuguuuuuguuuguuuguuuguucuuucgccuccugcucagguccaaaaggaacuucgagggcaagguaccaaugauaguggggcuaauauugcucuugcccgcccugcguaaagugauggccccaggcuguagcgggggagcagggagaccagagaagcugucuaaucuucccaaagacugggcuaacugcugagucccauucagcuuucggccccuuugauacugaacaggaaagccuccucuccuggcuuugcguguucgugguccucgauuuccucccccucccucaaauaaaaaagaaaagaaaaaggaaagaagggucuuuucaaucaauuuuucuuagguccauggugugaugcaaaaauuagauacuuuagaaaguacccaagaugcucaucugcuugugaccugggggaacuggagugaggcgagauggcuagguucacauaaccccuaaaaaucgguagucaugaaguauguaggcuagugcucuguaggaauagaggcuggguucaaagaagccuucagcccuaccucuggcaguaccagugcgaggucccccaguggggaaggauggcuaccggacuuaacguuuuuguuguuuuguuucuuuaagaguccccaaauugucuguggcucugaaguugauuuaucuacaugaaaagaccacagagaaaggaaagaaagaaagaaagaaagaaagaaagaaagaaagaaagaaggaaagaaagaaaggggucugcagagaaaggaaggggcuucagaggaggggguccccugccuggcugaaagcugacacccaggcccaagcaaaucuccugccuguaucuuccugaagucuuuauuugugcugggcaaggaguccgaccuccauucugcacuaauguaaauaguguaggaaggccccaugggagcuuugccccccaauucuagugccacccuggaucuggugggcauaauucauuucagacucuccuuuuuaaaaauagaagccccauaauccauuguuucuauauggaaaaaaaaaagagugaccaguuguccauaugaauucuccaggagaaauacauccuguguuuaucuacaguucacauuuuuuuucagggaacauggccccuccugccugguggcucugucucagugccaucagccagggcaggagcaauugguuccuggaauuagccuguuaucagagccuuaucugccaacugucuucuaccugcaguucaaugaccucugcaugcuuaggcagacacagccugugcuuauugagccauguaggcuccccaagggaauauggcaccagucugggagacuaccacugguaccucaagccuggggacuaggaauauucugguacuuaggauuagggacagcuucccacugcauucauuuccggccacccacagagugugggcuuggucccuggcauggugggcgggaggaguugcggauuauccggcagauccaggacagcugccggcagauccagggggcuucucuucucacaaugguaggagacucaaccaccuaagcauuagaaaagcuuccugagcugcaggucuagacagaaaggaucccuuuaucccuggucccaggcgaggcugcaguuacuacccagaaaauguaaucuaaccaggagcaggguuuuggaaaguugauaaugaucagauuucaaugucacuaguuaaaaaccaggaagauuugcacacugccagcuucugcguggauauccaguugggguggauaauuggaaaauuccaaucuucuggaagcgaaggcaggaggagugcugagagguaaaggccucagaguuagagccugucucaaaaaacaugacauggcugggaaauugagcuaguggagugguuugccuagcacacucaaagcccuggguucaacugagcacugcauaaacccagcucaguggggcuccuugucaucccagcucuugggaaguggaggcagaaggaucaggaguucaaagucaacauggucccggagguauuuguuucaaaaugaaaauccaggccuaacaugguuauagaugccuuuaaucccugcauuuggugacagaagcagguggaucuuugaguucuaggccaggcagggcuacauaugguaagaaucugucucaagagaaaguugcuggauacuucugggaugagccaacaaucucauguagccccagcugcucuucaacucuggauuucuugccuccaccucucaaggagugggaugguagucgagcucagccaugccuugauuucugugugcuuaaaggcgguugauagaagaagcacucugcugguuaccacugggacgguccacgguggugcuugcucaugcacacagccucuugucucuuucuccaaagauucgcuacucggaggaagacuguaccuucagggaggaaauggacuguuuaggcuacaaccaguacagauccaugaagcaccaucuccauaucaucuucauccaggccaagcccagagaacagcuccaggaccagaaacccucaaacuuuauccccguguuucaccgcuccuucuuugaaaccggggaccagcugaggucuaaaauguucucccugccccuggagagugacagcauggauccguucaggaugguggaggauguagaccaccuagugaagagucccagcuuccagaaaugacaggauuccgacaggauggagaaaaccccaaggucccgugaacuucccccuuaggaagcuguacauauucuaagucucacauggacccuguuguguuaguggcuagacuugaucaugaacuuaaguugacaaccugccuggcugccaucggagccccacugacuuuggaggcugcugauaugugccuaaguuacuccaguucuguuugaauaccuccacuaauagggaacuuacuccugugaaacauucuuaguuuugagccaaaucugugacuuggaugguuuuagcgaggaagccagaagguaugaagucaaaugauaaaauucauguauagaaagugggcucuaaaauauauauucccuauauggaucucaugggaucuuagcuugccccccaaaugucuccuggccagaacuaacugggguuacaaacuuggaacaaaggacagccuagaaaacuuugggagccuugaaggauggucuuaggauuacgaauuccagcugacuacguagcuucccccuuuuccacuuauaaaugucagauggaagugacccuuagcugagugcauagccaagcugccacuuaggccccaggagcuugucucugucccaugaccccagauuuccaggaccuggaucuucuccucugaccuuucccagaguucaccugggcucuccaaccccagagcagguagcuuaugagccauccaguuguguccccagcuccuggcucucaguucuggucaccaaacauugugaaucaacgugucugcugccugugucaaccuggaccccucauuuacaaacaagauuaggaagccccaaauucuccaguggcagcuggggaacuguggaguccuuuccccggcacuuacguggcagcaugauauuuauaaguaauuuauugugugugugucuucuauuuucuuacuuuauuuaugccccagaucauauuuauguacaugacuuguuuucuacauuaaaaaggaguugguuuguaucaaaag

SEQ ID NO: 4242 - RNA, 4510 nt, Mus musculus
cuuuugauacaaaccaacuccuuuuuaauguagaaaacaagucauguacauaaauaugaucuggggcauaaauaaaguaagaaaauagaagacacacacacaauaaauuacuuauaaauaucaugcugccacguaagugccggggaaaggacuccacaguuccccagcugccacuggagaauuuggggcuuccuaaucuuguuuguaaaugagggguccagguugacacaggcagcagacacguugauucacaauguuuggugaccagaacugagagccaggagcuggggacacaacuggauggcucauaagcuaccugcucugggguuggagagcccaggugaacucugggaaaggucagaggagaagauccagguccuggaaaucuggggucaugggacagagacaagcuccuggggccuaaguggcagcuuggcuaugcacucagcuaagggucacuuccaucugacauuuauaaguggaaaagggggaagcuacguagucagcuggaauucguaauccuaagaccauccuucaaggcucccaaaguuuucuaggcuguccuuuguuccaaguuuguaaccccaguuaguucuggccaggagacauuuggggggcaagcuaagaucccaugagauccauauagggaauauauauuuuagagcccacuuucuauacaugaauuuuaucauuugacuucauaccuucuggcuuccucgcuaaaaccauccaagucacagauuuggcucaaaacuaagaauguuucacaggaguaaguucccuauuaguggagguauucaaacagaacuggaguaacuuaggcacauaucagcagccuccaaagucaguggggcuccgauggcagccaggcagguugucaacuuaaguucaugaucaagucuagccacuaacacaacaggguccaugugagacuuagaauauguacagcuuccuaagggggaaguucacgggaccuugggguuuucuccauccugucggaauccugucauuucuggaagcugggacucuucacuagguggucuacauccuccaccauccugaacggauccaugcugucacucuccaggggcagggagaacauuuuagaccucagcugguccccgguuucaaagaaggagcggugaaacacggggauaaaguuugaggguuucugguccuggagcuguucucugggcuuggccuggaugaagaugauauggagauggugcuucauggaucuguacugguuguagccuaaacaguccauuuccucccugaagguacagucuuccuccgaguagcgaaucuuuggagaaagagacaagaggcugugugcaugagcaagcaccaccguggaccgucccagugguaaccagcagagugcuucuucuaucaaccgccuuuaagcacacagaaaucaaggcauggcugagcucgacuaccaucccacuccuugagagguggaggcaagaaauccagaguugaagagcagcuggggcuacaugagauuguuggcucaucccagaaguauccagcaacuuucucuugagacagauucuuaccauauguagcccugccuggccuagaacucaaagauccaccugcuucugucaccaaaugcagggauuaaaggcaucuauaaccauguuaggccuggauuuucauuuugaaacaaauaccuccgggaccauguugacuuugaacuccugauccuucugccuccacuucccaagagcugggaugacaaggagccccacugagcuggguuuaugcagugcucaguugaacccagggcuuugagugugcuaggcaaaccacuccacuagcucaauuucccagccaugucauguuuuuugagacaggcucuaacucugaggccuuuaccucucagcacuccuccugccuucgcuuccagaagauuggaauuuuccaauuauccaccccaacuggauauccacgcagaagcuggcagugugcaaaucuuccugguuuuuaacuagugacauugaaaucugaucauuaucaacuuuccaaaacccugcuccugguuagauuacauuuucuggguaguaacugcagccucgccugggaccagggauaaagggauccuuucugucuagaccugcagcucaggaagcuuuucuaaugcuuaggugguugagucuccuaccauugugagaagagaagcccccuggaucugccggcagcuguccuggaucugccggauaauccgcaacuccucccgcccaccaugccagggaccaagcccacacucuguggguggccggaaaugaaugcagugggaagcugucccuaauccuaaguaccagaauauuccuaguccccaggcuugagguaccagugguagucucccagacuggugccauauucccuuggggagccuacauggcucaauaagcacaggcugugucugccuaagcaugcagaggucauugaacugcagguagaagacaguuggcagauaaggcucugauaacaggcuaauuccaggaaccaauugcuccugcccuggcugauggcacugagacagagccaccaggcaggaggggccauguucccugaaaaaaaaugugaacuguagauaaacacaggauguauuucuccuggagaauucauauggacaacuggucacucuuuuuuuuuuccauauagaaacaauggauuauggggcuucuauuuuuaaaaaggagagucugaaaugaauuaugcccaccagauccaggguggcacuagaauuggggggcaaagcucccauggggccuuccuacacuauuuacauuagugcagaauggaggucggacuccuugcccagcacaaauaaagacuucaggaagauacaggcaggagauuugcuugggccugggugucagcuuucagccaggcaggggacccccuccucugaagccccuuccuuucucugcagaccccuuucuuucuuuccuucuuucuuucuuucuuucuuucuuucuuucuuucuuucuuuccuuucucuguggucuuuucauguagauaaaucaacuucagagccacagacaauuuggggacucuuaaagaaacaaaacaacaaaaacguuaaguccgguagccauccuuccccacugggggaccucgcacugguacugccagagguagggcugaaggcuucuuugaacccagccucuauuccuacagagcacuagccuacauacuucaugacuaccgauuuuuagggguuaugugaaccuagccaucucgccucacuccaguucccccaggucacaagcagaugagcaucuuggguacuuucuaaaguaucuaauuuuugcaucacaccauggaccuaagaaaaauugauugaaaagacccuucuuuccuuuuucuuuucuuuuuuauuugagggagggggaggaaaucgaggaccacgaacacgcaaagccaggagaggaggcuuuccuguucaguaucaaaggggccgaaagcugaaugggacucagcaguuagcccagucuuugggaagauuagacagcuucucuggucucccugcucccccgcuacagccuggggccaucacuuuacgcagggcgggcaagagcaauauuagccccacuaucauugguaccuugcccucgaaguuccuuuuggaccugagcaggaggcgaaagaacaaacaaacaaacaaaaacaauacggacccaacgcggccgcgagcaucccgccgcguggaggaacacucaccagcccguauaucuugccguccgcgcucaugcagagguaccgcacgcugcugacguccuugauggcaaucgucuucagagcgaccgcgcggaauuccaacaaaucugcgagcaagagaaagauguugccgggccccagcaacacgugaguacagcggggccacacugcaucgcccuuccccagcuccagucuggaagucaggggugggaggauguuaaggccacggcgacacacccacgugcuucuggguccuaagggaccggaggggacgggcugaaugauacucacuucguucguuuugguccuccucgcaguccacagagccgucgcuccggauucggaggaagcaguuggagacauagggaccagcggaguacagguacugcaggcggguaaucuugccccagccguagagaaagaguggaucuucaucugacacagacugggauugcugagccaggggacgcccagacacagccagccacagaguggccaggaccagggcucgggccaccgcacgcccguuccacuuucucgccaugacaccucgggguccugaaggccguuacaaagguggcgcggagacugcgaugcggcggggacucaaguugcaggcgcagggcaggcacaacccacaaagcaacugggcgcuuguggcguggggcgcacagaguuacugcuccgacagugggguggcuccgggcacgcggccuuauauacguuucgucccgcgggccccgcggguaggugacccgggcaucagagcauuucuccu

SEQ ID NO: 4243 - RNA, 3964 nt, Mus musculus
agaugggagaagcuaagcccagaccaggguccacguacucagucacuaaagaaguaccgauuucagggcccaggaaguuccagagagugauggcuggguaggaacuccccccagcuacuggguaaugccacaaccacccccaggcugcagaggcacaagccucccacuugcaggaaugccugggcucaugcaggcucugcuugagcuagugagcucuaaugaaggcagagccaggcuggagaagcccagccuuccagggcccuggauaggcacccugcggagagaugauccugggaaggugagugaaagccaauccuggugggaaaagaaauccaggcagaggccgcaggcugugcucagcuggcacagagcuggugguuaauaacugccuccagagugucagcuaauucccagggcagggagccacucugaggcuggguuccauucccaaggggcugcauguggauuuccucacagggugauucacagccauacuuggaauagcugacagcacaccucucaccuggggaggaggagugugauaaagaugccccgcuuagggcugccaucucucaggugguucugggagucuuugcucaucagucucuacuguaaaugcuucucugaugaaagcugagagaugcauuagucuuuggguaugaugauaagucacuacaacuaggguuuaugacuggccuagccacagguucuuagcccuaacaauggugccaggucucggcuccgccucgugaagugagccuuaacuccaaucagaaagugguugguuacucucaggacacuucugccacuguaccaaugggcauggcuucccagguccauaguuacuguagcucucagaaucacagcuggauaagauuggagauucaccuucuccuccaguguguacauagaaccugccagcaaugugaaagcuagcugguaggggucacaccuuccaggucaguaccaccuugauuucuccauauuuuaugacucaagcacauggugucuccagcaacauagucuuacugucaaguucuagagaguauccaagagcaguggcagcagccuguaauguucagagauugauggagccccacugaccaacagcagcaaaagaaguaacucauuccuggcucggaggaauuauccugugguaucugguaaggacaugccuccucccauucuggggucacuccaguuaaauucaucuuauaugugcauaugcauauuacuuuaggaaguuccuauagcaguagguuuccaugugggucaaucaucccuccccauacucccuccucuauccuauccccccaccccaggcuuuaaggcagcaucagaagaggaggagguaaaauuggagucagaggugaugaaugacuacauggaaauauuguauucuguauaugagggcuccaugcacagccucuuguccuaggccuccauucucugacgcagugacaccagcgaggucagugaguuuccucagaucacacagcacagacugggcacgggauggugcucuauugugugcaaagguucccacugagaccgggccuggggagagcagcugugaggcagggacaucauuacagaugcuucucuccuagaggcauccuucugagcagacauagaaauccagccgauggcugcaaagguuuguuuccuuuaacguguguaaaaacgccucuuccaaggguguggugcaaguggaguauuugagaggugguagcccucauggauggcauucuugcccuuacagaagagcccccaaaacgucccugccccucuagacaaugaagacacagggagaaggcauaccugugaaccagcaagugccucucaccagguuccaaagcuauaggcaccaaucuacuaagcuccuuguacaaacaccaggugugcugaaugccaaaccagcaggaggccaugcacaggaugagugagagugguccugagccucuguccucuccucccuuagcugucagcucucugagcagguagauuccuuggcagaacccaugagaggcugaacaguuccuggcacccucuuugacuuccagggcugccuggacaagggcuuugaagaaauaacaggguuagccacugaucacuaggaaaaccagugagccuuccucucuucugugccucaguuucccaucuguguaggaggggaggacugaauugauccaguucugcagcaaagucccacagaugaugcccagcucuucccagugggagcuagacccugcgcuagagggugcugcuggacucugagacaaacccuugugaaugggcaagaagccugugauugggcuagcccuuugaucaaccugggcagaggaaucaucugcaggcccaggcaugguccuggaugagucucccacccugaggggccuccccucccuccuugacucccccugugcuggagggagguucuguguacccagugacccuucuaggcuuagcccagugcugacucugacagcuugugagaccacagugggacacagguccauagagcccagucacccauggguuagcaaucuccaggaggcuucugccacucugugcagcuugucuucauagcccaagccccuggccagggcacagagggcugauccuuaggcacaggccaaccccagcucuuguuugcuuguuuuuugagacaggguuucucuguguagcccuggcuguccugaaacgaacucuguagacuaggcuggccucggacucagaaaucugccugccucugccucccaagugcugggauuaaagguggcaccaccacugcccggcccaaccccagcucuugacuccccugauacauuauuuuguucaagcuuccccucuuccugggccucaguuuccccauuuuuaagauagaucugggacuuaaaucuuguuccuaaaggugacaugucuccacguaagcaggcaaacaacaggaaauuuuaacuaaaaaaugguugaugagaaggaagagaggaggggugggaaggugaagggaagaggguggaaaacccagaaaguagagaguaagagaaacacgguacacuugcuuaaugugggcaaugcccggugccauccugagugggggcggagcagguaagauguguuccaggacccuagccccgucuaaacagcaggagccaugucuguucugggauccucuagccccccccccaagugcccacagacaggcauuccacccagcaaggcacucguuggaauucagcccuuguuccuauuggaaaguuuuuaucaucuuuaaaucugauuccaggagucucaaagaccacgguuuaggcugcgugacucacaaaccgugggcagggaauguuguuggggcuugaguuugggcaggcaaggauucccaaagguggguggguuucuugaaaccucucagaggucucuguuucauaagcagguagccaaggcaaggcagacagucucaaacaccauuaauccaacaucacgcccugcuauccugccuguccccuccuggugaccaaguuguuuccuuggcuuccuaucaagaagcuauagagccauugauucucuuggccacuucuaaggucaaaacaugcugagaagccuuggggacaggggccggaaaguaguaaugggcaccaggcuccagaagugcagucaaccacuccaggguucuuauggauaaccaaguuaguagugagagcugcuaccgcuccaguccaacaaguuccccacaggccaugucugcggcaaaggccugacacaucacaccaguuugccacccacaaggacgcuucaugcacacauccucacaccaauuuuacagaugagaaaacugaggcugagaggggugagauaauaugcccaaaauaugaaagucgggauuugaauucacauccgucuauuccuggcaccugucccuuaccauuccucugccuccucagcuuguugccagaacuuacugucaacc

SEQ ID NO: 4244 - RNA, 8661 nt, Mus musculus
aguacuuggcuagccugcugcccgugggucagcaaacucggagucccaggagaagaucucuacgaagggaacucggaggaucaggacagccacagguagcacucugggacccagggacuaggggagggagaccagggacaggggcuucaggaucaggaucaggggcuguagggugaaggcuggacagggcaagcaauugagauuggcagccucaaggcagggaaauggccacugccaugacaggcagcuugcagaagucccaccucucugagcacagagccaugaaacccuagagugaagcuguucccaucuagaagaccuguuccacucuucccacaggucugaguaucccagggauauaggaggcuuuaagagucccccucuuguguugcaucuccugauccccuacucagaugacacccuaccucuaccucuagccccaagacauccuccaauuccagcccccaucuuguccuccugagggugggggcucccuauccuuccuucaaccuuacauccaagccggguuucuggaagaguuugaagggaacacccagugggcgaugguccaagugcagaguucugguucucauugcucagggaugccgcuggccaugaggacagcagugggcaacucuguugggggcauuuggggacuagcaacacaaggucagacaacugauagucucagcuucuuccccuccagccaggucuggugcugguguuggcuucacaugaagcuguuugccagagaguucuguucccccucagagaaagucuucugucaaguugugagcaaaggcuugagucuuaggcagaaacacaggcuuucuguguaucccggacagcagcagacuggccaaugcccaggccgggucauagcuaaggcaugaggagagagacugggguaugguguaguagaagugaaaugaccaagacagcucccuuagggcuggucuguccaacugucaaucuaagaagguaaacagguggcccacuaucgguuuggaggggaggagccaggggugcagacaugggagccuuuuccaugggcuuuagugaaguggguucugucauggcucagauccugcccagagcacacacauccccauacacacauccucauacacgucucucucucucucacacacacacacacacacacacacacacacacacacacacacacacacacacacaucuuuaauauggcccaucugggguccacuuggcuucuggaucucucugugugagugaauaacuuugcaaauaaucuggaguaggacagggaccguggauagagaccaaaccagucauagaguugaccugggagcauauucaucugucccacggggcaugugucuaguuggagguucagccugguggcaugaaagguccccugagucaggacaucacugagggggaaagcugggaguagcaaguaucagaaagaguggcaucaguagaggaugcuggggguguagguaccuagaaaaccugggcuugcuuccuucuauagcuacaaaugacgccuggugggagggggcauacuuugcagcaccagcaguuugcaaccucucugcacaaacaucacucaugccuacguauucgggacacccaagcaggucccacaaugagccacucuuagucgguguacaccagaaggagcaaacagguagcggguggaggggguagauagccagggcggaaaugggcucuguacacugguuaggagcgugucugugggccuaggaacaccauccaauagaaaugaaggguugggguguggcuuaaguccccaacauccucccacccccgccccuccagccgaaugaggccuggaguuaaggagggggcgugacacuugcgcugaccggacagccaauggguggacgcagcugccagggccacauauccaggaggaggcaagggccaugcucguggcggcuggggauccgcccuucuugaggaaggaauuucugaggaguggagcagugugcugcccacgucccuguucagggagaggagggucuggcagccuguagccaggccguguccugagucacagcuucagaccucccacuugcucuaugugcaggcagaaagcaggccgcggauggggcucaauuccaaggagacccaggguggauauauuaaugagcuguugccugcuaggguggaccagucucaagcaggguccaccucucucuagcuugucacgcaacacaucuccaggccuccagauuggcugaaugagacugaguccuacacccagccuggaaccagggccaccacagcaacuucuugguuugccaccucuaagugaagcuuacaggagacagccacugacaguacacagaucuucaaaguuucauuaggugcaccaucuaaaacaaaugaagugcuggggguguggcuuaguugguagaugauugcggagcaugcucaacguccgugguuugauaaagcaagacccagcaaaggccuccuccuccaggaagccccucugcuguaaagaaucuguccugugucacucauuucuaggacugauugccgaacucucuauccaaacacaagggaggugcuccauguguagaugcaagggaacccaccaugcacguugaagaaacauucuggcccagacuccuugcaguccaaugagaagagaaaggagagagagaguuuucccuagggaguggcaguggggcucugggagccaggcaggguccgaucaugagccuacaggcaggaggagcagggaggguacaaaguuucugucucagagagagcuaggguagccuuuccucugugguaagaaccacaagccugaaaggccuagggggcuggggcugagcugggaggucaaaugauucugagcggggaaccagggcugauucuacucuacccucucucuaggcuuuugcuaggcaggaacacauacugcugagcucccaacaggagccuggacuccucacuccuggagauggccggaaacuguucaugggaagcucacuccaccaaccagaacaaggcaaguaucauggacaggggguccuuagucugugggagcaugugguugagagggccacacaguccagcaucuccugcacucacuguccaggucugcccuccaacccugagugaguagcaggcacaucuggacuuugugacuagguuaacugguuccucugaggccagugccaucaucagagcuggcacugagcgucccaggagucccuuaccaugcugucuuugagucaguuuuaucagucuugaaaggucucacuuccucccccuuuucuuccagagaugggaugaucacuguucacuguucauggucagaccaggucagacagccucugccaguuccauaguggcacagugucuguugugugugccauggaauugugccacacugggccacccaagggguguguguugcuccaagucuggaagcaugagccacggauggaaaucugcagcuggcucuaaccccaccuaaagcucacacaguacucuaggaugacccaucacuuuucugcccagcccuugcuucuuugcccuggaaaaguguggauuucccuuuuuaaguugggaaccccucuggcuuacuuccucauccccgccuccccuagacuugagaaaacuaaggcucaugccaggaugauaccuggaggcagggacugggcaugcuaggaggcaucccagagucccuagagaagacaaggcccuggaugggagcagacucuggaguggugauucacaauguaguguggggcugcaaauaguaacuccugcccagaaccucaccagucccucccaucccucaugccugucucccagccccagcccacccccacucccccacccaggcuaccaacacccauugagggacugcagacuuuucuagcuaggugauacacaaagggcuuugcccagucccagcaggccagcuucuacugcugagcugguccacaaaggacaaaguucugcaucugggucugguccagugagucagaggccuggggcagcaacagagcagcuccaggaaaggggagcagagaaagagcuaggcagcuugguuuagggguggacaaaagauguuagccaaugaauucuuagaauuagucagguagggaccaaaacugcauaaagaacuuguucuggcaacccagugucucccuaaauuuacacagcauccauaguuccugcuuguaaauuccuauggacacagccaggccagaggauacuucucuguaucuggucuuugcuacuuuguggguucuucucuucucacccuuuauuuuccccaccucauuucacccccuaacacuaggcaggagauaaugaaaaauaaagggggagagaaagagaucuccaaauauaaucuauuuccuuuaguuucuucuuugagcauuauuauuaacaaacugcaaccaacucccuugaacacccagcaaccaccaaccccaccuagcggggcccuaccauuuacacaaccucuaaaaauuucccagaauuccaaacauuacaaaaucacaaaaacuaucugcagcaugaaaaaccaugccucuucuagagcacgaggcaaaucauagucagcugcugugaagcagacuuacauuccuauaccugggguuaaaaugaaagugcauuuuauauuucuguguguuuuuuaagaaaccuaaauuccagaauccucacuaaacuucccuuuauuagagaaugucagcauagagcauuuucucagggcccagcuuucugccaaggccauuuggaagguggcagcaaagaucuugccccuagaacuuccuacuucccugagccaugaaagcagacaccagacauaggaagaaaauccugggauagauuggugaugucuacaaggaggagggaagcaauaugcauagggcaaccuuugugugugggggggggggaggcucuaaacaaccuggagaacagaguagcacacagcuggcucauuggcucaugguauuggcucacacaauuguuuuaaaauguuaauccagaaauaucaaacuauuucacguuaccauccauagacgcagguucucuggaauugaaggaagagccaccccucugcccacagguccuccaaacccucuggcuggaguagagcaacugcucacuuggcuaggaaggcaugcccuugguuuugcuacugugucccugcucccaguuucugacaccuagcccaggguccugagucagcucagcccucagugcuaggccuggugcucaguagggcugagcuccucugcccugcccagcuguaaaauucugagccucuucuagaagcuuaaacacugaccaccacuagaagccucucccggguacccccuaaccuucucauuauucagaaccccaaaagguagcccuggccuagcagagggcagcugccucuccuccccaguacucucuaguacaacuguggcauagaagccaacuccagcuagaagcaaggucuuuuguucccacucacaucccuuucuaauaauuuuauuucuuuaggaauaaauacuuucaugauuuaaauuugaaacauuaucagaacaauucaugcacacaucugcuauccuguccaugaucuccgugaucauuugguacugggaauugaacccuuagaccuccacaugccgggcaagcucugcccccaagcuuuaucuccaguccucuauuaaaaagugugugugugugugugugugugugugugugugugugugugugugucgcacacgaguauacagugcucuuggaggccauaagagggagucagauccccuggagcuggaguuacaagcaguugccagccacucaaaguggguucugggaacuaaacuugaguccucugcaagagcagauguucugccacgccuguuugaaggcuuuuaucuugagacuggguuucauuacuuuucccagcuuaggcuugaacuuacaaucuuccuuccucuaagacgacagugucacauuaccaagaccagccuuccaucuguuuauuggggcuuuuuaaugauuuuuuaauucuuugugugugaguguguguguguguguguguguguguguguauguguguaugugugugauauguggguauaugaguauguguguauguguguuuguguguguguacauguggugugaguguguggugagugaguauauuugauguguguguguguguguguguguuguguaugagagucuaugugugagugagugaguguguggugugaguguguucaaauguguacaggcccauguguuuuauauuucugugguugguacauguggaggccuaagguuaacacgguuuccuaaucacuucccccacuuuauucuccgagacuggaucucucaauuaaaaucagagcaggcugauguaggcucaucucccuggcuugcucagggaacucuccucuuucugccuuuuaaauuacagaggggccacugugcccgccuggcagagacuggggaucugaacucugcuccgaauacuugcucagcaagcacuccccaccccucugccguggacugccuucacuuggcuauuuggaccuggcugaccugugaguagcccagagcucaggucacccuguggauaugcuguccugcuggcuauagacucugagaaccaguguuagccucagcugggaucgggacuccuucugcucuggcuucugcuggguucaucauuccauagccagggacccagggacccagcagacuccaccuccuggguagcuaauugaaacaggcccagaaacaggucugcugagggccagagaagggcagguaggcuuacauauguguccccuuugcaccugcgcagauguguccugguaugagcgaggcucgggagcucuacagcagaggauuucugaccauugagcagauugcuacgcucccuccgccagcugucacaaacuauaucuuccugcugcuuugccuguguggccuggugggaaacgggcugguccucugguuuuucggcuucuccaucaagaggaccccuuucuccaucuacuuccugcaccuggccagcgccgaugggauguaccucuucagcaaggccgugauugcucuccugaacauggggaccuuccugggcuccuuccccgacuacauucgaagagugucccggaucguggggcucugcacauucuucacaggugugagccuccugccagccauuagcaucgaacgcugugugucugucaucuuccccaccugguacuggcgucggaggcccaagcgccugucagcuggggucugugcccugcucuggaugcuaucauuccugguuaccaguauccacaauuacuucuguauguuccugggccacgaggccccugguacagucugccgcaacauggacaucgcccugggcaucuugcuguucuuucucuucugcccacucaugguacuucccugccuggcgcucauccugcacguagagugccgagcacggcgccgccaacgcucugccaagcucaaucacgugguccuggcgaucgucucugucuuccucguaucauccaucuacuuggggaucgacugguuccucuucugggucuuccagaucccagcccccuuccccgaguacgucacugacuuguguaucugcaucaacagcagugccaaacccaucgucuacuuccuggcugggagagacaagucacagcgccugugggaaccucucaggguggucuuccagcgggcucuccgggauggugcggagccgggggacgcugcuagcagcacacccaacacggucaccauggaaaugcagugccccucugggaacgcauccugagaggccaacuucuggggcaaggcugcagcagagagcggccaguagcuuccagagacacucugcccgagggcaggaguagggcagcugccccugugcugccagggagaagaccugccuuaacacucuugucagggguggccaggaggcugagcagccaccucuggacagacccuguggccucugcuccccaaccauucugcuucugugacucaguguaccaaaguugcccucaccagcaugguagggucccuucuuaacagaagcucaagagcgaaggcaagaaggaggucaccuccucaaacgugacucaucgagcaucacccucccugggccagcagccucagccccacccccagggaguuguucagccucccaaggcugcaucagaacaaacccuagagaacggugcuaucuggaacuggguccuguccacuggcauugcacucugcaaacaagccccugccccuuugaugagucaccuagugacuuuaaugggaugggaucuggccuuggcaagccaugugagacagaaaggaccuucugucaccauggguagcugacugcuuuucugaccccacccacccaccccaaccagccagcucuggguagcugacugcacucagcaucuuccaggccacuguaguccacugcuaaguccucaaucuccuguacccauuucaaaguggacucuggcccccuggaggcugccaccacgaugucacucaucauccagcacaguggccuguguagccaaaggaaguuuuauaaaagauaauaaaguauauaucaauacacauuuuuuuaaacuuugcagugaagcaggc

SEQ ID NO: 4245 - RNA, 940 nt, Mus musculus
guaaaagggaauuagacuuuaauugguagcccggaggacaggccaaggaaguggagucagccagggagguggguaaacacaaaaccaauacauucauucugaugugacuuuuuuuuccccugucagucacuuccugaagaacuuccgugcugaggcucaggggcacugagcuggggucugcugcucuuuccucugcacuugacaucuuacucaacccucaguaaucccgcugagccgauugccucauagauagggugacgauuauguucaggcuuugaaucaggccugccaaaggaauuauguuauuugcuuuuugaaaggaauuauuuaggcaugguugcuuuacagggagagccauucaucggggcuggcuuaagaguuugaaaugcagagcccacaaugggugaccacaaagcuggcacugucccuaauuguagcuuuccccaucuuggauugggcagagggcugucugcauaguaggcaggggccucuaccucugaaccauugccccaucuccucccucacuggggaauucuaugaagggcuauguacccucacugggagaucuaggcagggguucuacagcugaacaguguccuccugugacacagguuaucuuuaaacucauaauccuccugccucagccucuuuaucaauggaguuuaaguggucaccaugccuagcacaucauauaucauuaucugucauccacaguuagggcaauggcugguaucauaaagacaagaaguaacaaauacuagugagaauauuaaggaaggggagcguuuacauacuguuaacaaccaggaagauugaaaaggaguccuaguucuuuuucuuccucaagucuuuugguugacuuauagacgaauggguuucacgcgaugucaucuuaugugcaucgaucguaccuuguuuaucaccucugcugcauuuucug

SEQ ID NO: 4246 - RNA, 1464 nt, Mus musculus
ggagagggccagagggcauuguaucuugacaguagagcacacaagucauccaucccuaguagggagggggagaaagggaaagaaaagacauugcuguacuuaggaaggagccuugccugugcagcaggacugucucaagacaaacacaaaagguuggaucauauaaaguucaagggccacugucuccuaggcugggcucagagucucgcagacaugcuuagcuuucagaucaaaaacgaugcaugugaacaggugaaggccccaugaguacuggcgccugcagccaagccuaacaaaccaagcucaaucucuaggacguggauggugagagccgugacacacacgugcacacacacacacacaaauguaauaaacacucaaacugcuuaagaagaaaaggcacaaucuaccauggucucuuugauagaggacacaaauccaucuacacaucuucagagaggccgacaaccauggccuggccccagcuuaaaugggaacacugcagcccuugaggucccucauuuaaggguggccuuccuggaggcagugaccaacaguuucccucugagaaccacaggaagugcagagcgugauccuaguccugggcucagugggcagaggucagucagauucugaggccaguaggcugggggguagaacagagaugagugguuucccacucguguucagugcacuugugagagcaaaccuugugacauaggcccagaggagggaaggccagagugagacugcucuaaucaccucaugcacacacuggcaccauaccaagagauuuuaauagacauuccuauauuccagcuuugccgaagcccgaccugaggcaugugucucucccacucaccuuuaggcaagccagcagguaggaggcucuagcaguguccuccugggacuuugcaaaccuugcccuuggcucugagaguccugaaguucucaugugccccccucuucccaagaaagcagcuuccccugaaacccuggcuggggccugagaagaucucauuucagccccuuucccacccugcccaggggccagcaccggaguacacacuuauggaugcaccaguggccagugauucccacucugggaaucugaguccuguugagcaccacaguguccuccaccugccacuucagggccucaucaagggcugucugccucggccugucugccagcccugacagcuuggcaugugcugaggauggaggagauggugcccaugagacccaccagccaaggagggaagcggccagcccacaggacaccucggggcaaccagugcacagcauuugccaggucagccagguugcugaguagaguuaaaaccucugagcauauccuugccuccauggcccuccgcuugcuccugggcagcuggcugugggagagaaggagaaggaggagagccacucuuguugccugcauuuccauaucccccagaagaa

SEQ ID NO: 4247 - RNA, 4139 nt, Mus musculus
cgggggcagcgauggcgccggccgcggagggcucgagcgaacuacaagucccagcagcucccgcagcggcccucggccggccccucucgcuccccgggagugccuggcggggccgcugggccgagggggccgccagcgggucuggcgaucggugggguuuccugcaagccuggggcggggagacaccggcuggccagcgcgagugcagccaggccgggcaggggcgaggggcaucgggugagugaccccgaaagcggaucgggcuggauuggggaaggcuggacaaaagggggaggugguugggaggagaccccucaacacuaagagcagggugcggggcgcggccccaggcuaucucuacgcaccccuugcagaguacauggugccagcgcucuacuuggggggucaagguggcggacgcggugggaaggggguccggaggagcucaggccuaguacguuuauccggccaacggcgggaccacccccuaaucuacagugaaucugagauccggauggguggaggcgcccgcuagcucggaacccacagaacagaacaccuccuuguuucagaaggggguucuuuuuuucuggaaaccaagagaagcuuggggcauuguucuuccuaugugggacuuuauacuccauaguguguguguguucagaagggaggugucguguuaccucaagaaucccaagaaaaaucccaguuauuguuaucuuccacauucagucuuaggauguagagcucuggaagcucauuuucccaagagaugaucggggugcaccugcccucugcacaucuacgagacagaugugaguuuccauucaagaugggaguucaugaggcugcuuccuucgaaggcaaucuaaaaauaccuugucuccagaaaucugggcggagaccccgggguacugcccacuaaucuccagcaguugggccuagguagagaaacuguugggggaaacucagcgccccucuguguacuaucuccugacugugagguuggggucagguaggucucccuaguccccuggagcccagcccaacaaagaguucacuuagccccaagguagagagguguuacucuuucuccacaucugccucuuucccuaaaacagucuucauacccuaaucaaggagugugugguucaggaacucccuucccuugaagacauuccuccucagcccucugugccccaccccccaguucucucuguaaccccccagaggcccccccccaagcuauaguuaucaccggcucuucaccaagggguuaaaauccacaaucuuauaagccaauuggaaaauugcuauauuaacugcucucuccacccucuggcuguggaguucuuagugauccuucugccccuuuccccagaagggggccauguaugcaccccuccuuaguuuugaaaaacguuauuauuuuguagcccaggcugaucagaucugccagccucauccucaaaagaugcugggauaacagaugugugccaccacugcuagcucagguuuccacucccuguccucugguuuaagacagaacauaucucacucaagcuagaauucuagagaggucuagaauucuuuccuggaagcaaacaaggagcccugcaguuuucaccgugacagagaaggacuacuagguauccuuaacuucccauccuuaccacuacccauucuacuucgguaagacaagucacacacauuccccucuuuaucagggacccccagaucuaccaguuugcaggguggggcaagaauucagaccaugaccucaugaaaaaagaaccacaacacccuuucccccagauuuaggguaucagaucugagaaccgccuuccauaacacccaaguccacguacuacauagagcucgggaugggggucugggaugccgcucagaggguggagugcucaucuaccauucaggaaaccaguaccacauaagcugaauaugcuugugcacucccuguacuuccgcacaggagguugaggcaggaguauaaguaguuuaacauccuccuugauuacgaguugagagacagcuggagcuaugcaagccccuguucaaaaaaaagaacaagaucccaagauggcccccauccagguuugaggugaaaagugagagucccagcacuaggauccuucucuuccaaauccuagcugggacaccgguuaggacucuuccugugguuaaagucaagaacaagaacuguauauguucaccagggacuuugguguggcauggccaguccucucuccccaagaaccucccuccaccaaccuccuguccucauacugcagguccuguuccagaagcugcaagcaguucuacuuucaggaugaggcgcucaguucugguuaggaauccgggccauaagaaucuuaggccccuuuauggagaccuucacucagacccagaagaccuggacuccagucccaaagauccugauccuauuucugaaagcccugagccagagccagaagaccucaacacugucucagaagauggagacgccagcuuagaagaucuggacccugaagcagacgaagcuccacgauccaucuuggggaagccagacuuggauucccaagaucuggaucccaugucuucgaguuucgaccucgauccugauccugacgugauuggcccggugccacuaguucucgacccaagcaaugacacccccagcccugcugcuccagauguggauucccuuccuucuggccucacugccacccccgaaaucuuggccaccaguccagcggugcuuccugccccugccaguccaccucguccguucucuuguccugauugugggcgagccuuccgucgcagcucugggcugagccagcaccgacgcacacacaguggagagaagccuuaccgcugucccgacuguggcaagucauucagccauggcgccacacuggcccagcaucguggcauccacacaggugcacggcccuaccagugugcugccugcggcaaggccuuuggcuggcgauccacacugcucaagcaucgaagcagccacaguggggagaagccacaccacugucccguguguggcaaggccuucggucauggcucguugcuggcccaacaccugcgcacgcacggcggcccucguccccacaagugcccagugugugccaaaggcuuugggcagggcucugcgcuacuuaaacaccugcgcacccacacaggcgagcgucccuacccaugcccgcagugcggcaaggccuuugggcagagcucagcguugcuccagcaucagcgcacccacacugcugagcgucccuaccgcuguccccacuguggcaaagccuuugggcagagcuccaacuugcagcaccaccuccgaauccacacuggugagcgaccuuaugccugcccacacugcuccaaggccuuugggcagaguucagcacuccuacaacaccuccacgugcauucuggcgagcgccccuaccguugucagcucuguggcaaagccuuuggccaagccuccagccucaccaaacauaagcgugugcaugagggagcugcagcagccgccgccgcugcugcugcugccgccgcugcagcggccgcagcagcugggcugggccucgggucugguuugagcccaguaucuaugaugaggccagggcagaucucuuuccuggguccugaugcuguuucugugcuggaaucuggccugggccucaguucuggagccagcucugcccgaaguucugccccuacuucuguacuggguucacuccaaaaucccauccuucagacccacucaggaucuaucucuagucccgaucuuguuuugucuucugacccuaagccaggccauguugcugauccugaugugguacccaguccugaccaagaaucugaucccagcccuaaccccgaucuuguccccaguccugaccccaaacccaagucccaaacugaccccugcucuccgacucacgacaguuccagcccagcccuuccaacuggagaaagucccaaguggguaaaggaggaaggggcauugcuggggccugauggauaaagggggcacuggcaucuauggugaugugaggaaaguguguguuauauucacaguaaaauccuccugccuccuggcu

SEQ ID NO: 4248 - RNA, 4139 nt, Mus musculus
agccaggaggcaggaggauuuuacugugaauauaacacacacuuuccucacaucaccauagaugccagugcccccuuuauccaucaggccccagcaaugccccuuccuccuuuacccacuugggacuuucuccaguuggaagggcugggcuggaacugucgugagucggagagcaggggucaguuugggacuuggguuuggggucaggacuggggacaagaucgggguuagggcugggaucagauucuuggucaggacuggguaccacaucaggaucagcaacauggccuggcuuagggucagaagacaaaacaagaucgggacuagagauagauccugagugggucugaaggaugggauuuuggagugaacccaguacagaaguaggggcagaacuucgggcagagcuggcuccagaacugaggcccaggccagauuccagcacagaaacagcaucaggacccaggaaagagaucugcccuggccucaucauagauacugggcucaaaccagacccgaggcccagcccagcugcugcggccgcugcagcggcggcagcagcagcagcggcggcggcugcugcagcucccucaugcacacgcuuauguuuggugaggcuggaggcuuggccaaaggcuuugccacagagcugacaacgguaggggcgcucgccagaaugcacguggagguguuguaggagugcugaacucugcccaaaggccuuggagcagugugggcaggcauaaggucgcucaccaguguggauucggagguggugcugcaaguuggagcucugcccaaaggcuuugccacaguggggacagcgguagggacgcucagcagugugggugcgcugaugcuggagcaacgcugagcucugcccaaaggccuugccgcacugcgggcauggguagggacgcucgccugugugggugcgcagguguuuaaguagcgcagagcccugcccaaagccuuuggcacacacugggcacuuguggggacgagggccgccgugcgugcgcagguguugggccagcaacgagccaugaccgaaggccuugccacacacgggacagugguguggcuucuccccacuguggcugcuucgaugcuugagcaguguggaucgccagccaaaggccuugccgcaggcagcacacugguagggccgugcaccuguguggaugccacgaugcugggccaguguggcgccauggcugaaugacuugccacagucgggacagcgguaaggcuucucuccacugugugugcgucggugcuggcucagcccagagcugcgacggaaggcucgcccacaaucaggacaagagaacggacgagguggacuggcaggggcaggaagcaccgcuggacugguggccaagauuucggggguggcagugaggccagaaggaagggaauccacaucuggagcagcagggcugggggugucauugcuugggucgagaacuaguggcaccgggccaaucacgucaggaucaggaucgaggucgaaacucgaagacaugggauccagaucuugggaauccaagucuggcuuccccaagauggaucguggagcuucgucugcuucaggguccagaucuucuaagcuggcgucuccaucuucugagacaguguugaggucuucuggcucuggcucagggcuuucagaaauaggaucaggaucuuugggacuggaguccaggucuucugggucugagugaaggucuccauaaaggggccuaagauucuuauggcccggauuccuaaccagaacugagcgccucauccugaaaguagaacugcuugcagcuucuggaacaggaccugcaguaugaggacaggagguugguggagggagguucuuggggagagaggacuggccaugccacaccaaagucccuggugaacauauacaguucuuguucuugacuuuaaccacaggaagaguccuaaccggugucccagcuaggauuuggaagagaaggauccuagugcugggacucucacuuuucaccucaaaccuggaugggggccaucuugggaucuuguucuuuuuuuugaacaggggcuugcauagcuccagcugucucucaacucguaaucaaggaggauguuaaacuacuuauacuccugccucaaccuccugugcggaaguacagggagugcacaagcauauucagcuuaugugguacugguuuccugaaugguagaugagcacuccacccucugagcggcaucccagacccccaucccgagcucuauguaguacguggacuuggguguuauggaaggcgguucucagaucugauacccuaaaucugggggaaaggguguugugguucuuuuuucaugaggucauggucugaauucuugccccacccugcaaacugguagaucugggggucccugauaaagaggggaaugugugugacuugucuuaccgaaguagaauggguagugguaaggaugggaaguuaaggauaccuaguaguccuucucugucacggugaaaacugcagggcuccuuguuugcuuccaggaaagaauucuagaccucucuagaauucuagcuugagugagauauguucugucuuaaaccagaggacagggaguggaaaccugagcuagcagugguggcacacaucuguuaucccagcaucuuuugaggaugaggcuggcagaucugaucagccugggcuacaaaauaauaacguuuuucaaaacuaaggaggggugcauacauggcccccuucuggggaaaggggcagaaggaucacuaagaacuccacagccagaggguggagagagcaguuaauauagcaauuuuccaauuggcuuauaagauuguggauuuuaaccccuuggugaagagccggugauaacuauagcuugggggggggccucugggggguuacagagagaacugggggguggggcacagagggcugaggaggaaugucuucaagggaagggaguuccugaaccacacacuccuugauuaggguaugaagacuguuuuagggaaagaggcagauguggagaaagaguaacaccucucuaccuuggggcuaagugaacucuuuguugggcugggcuccaggggacuagggagaccuaccugaccccaaccucacagucaggagauaguacacagaggggcgcugaguuucccccaacaguuucucuaccuaggcccaacugcuggagauuagugggcaguaccccggggucuccgcccagauuucuggagacaagguauuuuuagauugccuucgaaggaagcagccucaugaacucccaucuugaauggaaacucacaucugucucguagaugugcagagggcaggugcaccccgaucaucucuugggaaaaugagcuuccagagcucuacauccuaagacugaauguggaagauaacaauaacugggauuuuucuugggauucuugagguaacacgacaccucccuucugaacacacacacacuauggaguauaaagucccacauaggaagaacaaugccccaagcuucucuugguuuccagaaaaaaagaacccccuucugaaacaaggagguguucuguucuguggguuccgagcuagcgggcgccuccacccauccggaucucagauucacuguagauuaggggguggucccgccguuggccggauaaacguacuaggccugagcuccuccggacccccuucccaccgcguccgccaccuugaccccccaaguagagcgcuggcaccauguacucugcaaggggugcguagagauagccuggggccgcgccccgcacccugcucuuaguguugaggggucuccucccaaccaccucccccuuuuguccagccuuccccaauccagcccgauccgcuuucggggucacucacccgaugccccucgccccugcccggccuggcugcacucgcgcuggccagccggugucuccccgccccaggcuugcaggaaaccccaccgaucgccagacccgcuggcggcccccucggcccagcggccccgccaggcacucccggggagcgagaggggccggccgagggccgcugcgggagcugcugggacuuguaguucgcucgagcccuccgcggccggcgccaucgcugcccccg

SEQ ID NO: 4249 - RNA, 28902 nt, Mus musculus
cugcagcggaauaauuuaaaggugccgcgucugaggcagcgggcagaaaacuagggguguuggccgaagcuggguggaccugguugcagcuccugaaugguacgaguuuccaucgaccgagcaaaggugucccuucgaggacuguuagagagcuucagcuuugccccggaucgauuuguccugauuccggguaggucccgacuuuuugaugcuccaauaccaccccacccccauuccuaaguuccuugucccgguguuuccgcaucgguagucagaugcgaccuggaguacggaauggaaguagucaaucuaacaauuuuccagguaacaucucagggcccugcgauccuucuaaauucccauuaauaauagucuaaaggcaucagaaagaucuccagcgucccaggagagucccgguagcguuccuaccuuccccgguaucuuccuggaagcuccuagacuccuaaguaguuauguguaucuccggaucucaguaacuuuccagugcgucguuccuccuacccucccccaauuccggcgucccugguuacacauccugcaucauuucacuaaucccagggaugcuccgcaccgcgagacccgguaacuuuccuuuuacgugacaguuaaaucuccaagcccgagccuauaacacuuugggagcucaucuuacuccgauggcccuagagcccccuuuucaauagauugcacagcagugcuuccagugcacgccccagcuuccuugaugggcccaggcuugggucaggagcccaaaguccaauugucccucagccuccuggcuuacagguccugguuucuucuggagugagacaucgcgucuuuacaggguguaggaaggggucucgccuaaggguugguuaaucaagaguagucagacauacggaaggccaggcuaaggaaggaaccacugccagaagagaucauggcuuaagggcaccugccagcgagcugcugacugugggugccaggacggcuacccuuuuggccacagggugcagaugaaaacguuacggagucugguccgccuuaugcauaagugaaguaggacaaagagcugggggcuggucucaucccuugaucugggcggggaaaucaacuugccccuauccuucugucuagcaguaccccucuagacgcucucaccccaaccccggcgaauggaggagucacuccagccaaagguaucuagggggcguggcuugugagacgagcuagggguaaggagccuguaggcgcugcuggguaggcuugauugacaucuuguucuggucccuuuugcuccucgauuuccaggacugcaggcuacaagaccugcuaccuaguccgaaacaaucgauggaggccccacugcaaaccggaaugguaagaguuggggaauuuuuguaccggacuacaacucccggcggucuugccgugcaccacgcgauucucucuccgagaaccaggcaugugcaggugaaacuacguuucccggcaugcauagcgggagaccuagucucucggaaggcuuaguugcuccccccacguagggggaugggaaggaaaccgcauugacccauucugcagauggggacaccgagucacgaacugaauacaaccuccuccggggcagaggugauucaaaagacccuggaggagggcuuggggagacggauaugcguugcccagccugugccguucguuccgcaggugcugggcgugaugaucggggccggaguggcggugcuggucaccgccgugcucauccucuugguggugcgaaggcugcgggugcagagugaggauucggggggaaccuuugagggaauacuauagggauggaggggaagcugcaaaaccuggagaaaccaagcggcugggguggggauuuguugaagccugcguggagcucaaagcaccaucuucccuccacccccuuccccguccccaauccccagaaacuccagccccggaggguccccgguaucgguuccggaagcgggacaaagugcuuuucuauggccggaagauuaugcggaaggugaguuccaagaccuacugcuggucuggcugaccacagcagcccagcccuuuccuauuuacacguuagugacccucucugccuucuuagaucuccuuagagcucuccuuccucucccuccaauugacucaauauucuaaauucucccaggugucacaguccacuucuucccugguggacacaucagucuccaccacuucccggccccgcaugaagaagaaacugaagaugcuuaacauugccaagaaguaaggcagacucugaguguauuggguaugagacgggucagcucacaccggaguuuuugcauuucuaaguucuugaaacauacugauugucugggaaauauucccauaguagagggacaucucaaggcccucaguuggcaggggcuaucucaggguucugccaucucagacaugacacuuccggugugggcgugcuggucgcuuaaggcuugucucauaauguuucccaguuucuggaagcuaucugccguauauuuaggaaucuacaccuauuggagaguuuauucaacgcggcauguugcaguuaucucagauauuugcaugacuagguggaggggcuguuucgaaauucuguucuccagggaaaucauucuauccacacaggaaagcaucucucuuggaguugucuguguuguucacccuguauaguucuuugcccugugggggcuagcucacauaguguguguguguguguguguguguguguuguuguuguuguuguuguuguuguuguuguuguguguuguugucaucgucgucauuguuguuauuugcuuggguuuguuuugauuuugggcuucaaguccuccuucauguugggauuauagguaugugucaguaugccuaguuuauaugauccugaggauuaaauucaaggcuuuuugcaugccaggcaaucaugcugcuaacugagccacaucccuauucauucacucauuuuuugcagaaagcauucugccacugaacuaucacuaaccccuacuuuacuugaauuuuuuauuacuuagaauguauuuacuguguauguguuuguaugugggcauguacucuuuuuguuguuguuguuuuguuuuguuuuucgagacaggguuucucuguauagcccuggcuguccuggaacucacuuuguagaccaggcuggccucaaacucagaaauccgccugccucugccuccugagggcugggauaaaaggcgagcgucaccacgcccugcuuggcaucuccuagcaugugcauggcaguuggcucucuccuuccacuguguggaugucagauugaacucaguuugucaugcuugggagaaaguaccuuuacccacaagccauuuugcuggcucuacuguuuuguuuuuccaauuuauuuaacuuacuuugcaguauacaguguuaaacucagagacugaccaugguaggcagacguuuuugccagugagcuaaacuuaagcccuauauuauuuuuuugagacaaggucuugcuuaguuauccagguuggccuugaacuuucucuauagcccaggcaggcuuugaacgugugauucuucuuucucagcuuccuggguaacuggaaugacagccuaugcccgucaugcuucccuuuuuaagaauuccuuugugugccaguaagauggcacagugguuaaacacacuugcuaucaagccuggagauaugagcuccaucucuaggacccauauggggaaaggagaaaacuuaccuucaaguuguccucugaccugcacaacacacacacauacacacacacuagauaaacagauauaaauuugaauuuuuaagaaaauaauuccuggggcuggugagauggcucagggguugagagcaccgacugcucuuccgaaggucgugaguucaaaucccagcaaccacaugguggcucacaaccauccauaacaagaucugacggccucuucuggagugucugaagauagcuacaguguacucauauauaauaaaauaaaauaaauaaaucuaaaaaaaaaaggaaagaaaauaauuccuuugcauuagaaacuuaggaacauuaucucagauguuuaucagugucuuugagaaggcucuuccagggaucucuguaaguuaagagaugguucugggaucuucuugcaucaugaggucuacccuaaggucuuuuucaagaguguauuuaucacagaccuuuuuaugauuuugguagaaagacuguugguaaacuauuugcuuugcaaauaucaguaucuggggcuaaucuugagaaccauauuuaggaaaauaucuggguaugauagcuuacuugccaucucagcccuggggagcuggacacaggcagaucccugggucucacugacuggccagcagugaguuccacaccacggagagacccugucucaaacagauaagguagagagcaucugagcacucacacacauacagacacacacaucacacacuacauacaccacacacauacacaucacacacaaacacaaacauacacacauaccaugcacacacagauacacagcacauaacacacacacaagugcaucucuagcuugucugaaccaugaauuagcugugguaaucacaugauguuaagacgcuacccugaagucuuucugagaucaggaugauuaucucagaacagugagccaggaaaaggcuugcuugguuaagaucuccuccauagagcauucuuccaagccugguauggcacacaccugccaucucuauacucaagaaguagaagcaggaacaucaggaguucaaggucaucaugggauacuuauccaaguuuuaagccagcuuggguuacaagaaacauugccuaaaaauaccaacaaaacaauaagaacaaaauggaagaguucuaucuagguuucuccguaucacugaauuuaauucauaugagagggucuaucucaggacucuugugcuagugaaggggccugccccacagccccacagccacuuugacucacaggaaggaguuuucccugaguucuuagcugaacagcuguaccuaaauucuccacauuagaagagggguagcucagguuaucuguccagaucagaaaaguuacagugggguucacugagaccugagaggaagcuaucucauggaccuuuuguuucucucucucucucuuugcuuuaacuuuuucuuuucuucccucuguuucccuuucuugccuuuuuuuuuuuguuguuaauuaauuuaguuuaugugugauguaugugcccgugugugggggugcacagaggauugcaucagacguacuguuuuuuuguuuguuuguuuguuuguuuuugagacaggguuucucuguguagcccuggcuguccuggaacucacuuuguagaccaggcuggccucgaacucagaaauccaccugccucugccucugccucccgagugcugggauuaaaggcgugcaccaccacgcccagcuuguacuguucuuuugcucucagccuuauucccuugaggcagagucucucacugaacuugcaggugaugguuuuagcuagauuggcugaaaugaccaaagggaaggauuaaaugggugucuuaguucugcgugagccuucuguuacccagcaguucucagccugugaguuaugaccucuugggggccgaacaccccuuuuaaagaggucaccuaaggccaucugcaugucagauacuugcauuacaguuuauaacaguagcaaaaugacaguugugaaguagcaaugaagauaauuuugugguuaggggucaccacagcauaagaaacuguauguaugaaagggucgcagcauuaggaagguugagaaccacuguucuaaccuccucccaucaggaucuuacguauccaaaaggagacuccgacccuacaacggaaggagcccccaccuucagugcuggaggcugaccucacagagggagaccuggccaauucccaccuacccucugagguacucuacaugcuuaagaauguucgguaagugucggggacuggguguuuucaggguuccuucagagucugggacugcuuugaccuccuucgucccuuucccacugcccaucuucuagggugcuaggucacuuugagaagccgcucuuccuggagcucugccggcacauggucuuccagcgucucgggcagggggacuauguuuuucggcccggucaaccagaugccagcaucuaugugguucaagaugggcugcuggagcucugccuaccagggccugugaguggaccuugcggggccacugugggaggcugggcacuagaguuagauaccgcuuuuagguauauguaaucagaagucugguuaaugauggcuuaguguagagccuagugguagagccuuugcccagugagggacagcagguggggcucagugguagggccucugucuagaaucccccaucaaagugcuuacuguccaguacuugccuguuauguguagggcucuggguucuaauucuaauaauauagaaauaucagaggaccgaguggccauuugggaagauccaacagaugggcagagagugaugugcaggaaacagcaacugguuaggagguuugugaauucgguuauuacuggcaugagucggaggugagguccaguggcagccacccggaggaggcuggcauuggucuguggccccuugucucaggaugggaaggaguguguggugaaggaggugguuccuggagacagcgucaacagccuucugagcauccuugaugucaucacggugagugacaguuuuaagcuggguagaaagguggggcccugaugcuguucuugucacuugaacucaucucuuccuccugaacguaugucucccagggucaccagcauccccagcggacugugucagccagggcugcacgggacuccacagugcugagacucccaguagaagccuucucugcugucuucaccaaguacccugagaguuuggugcgagugguacaggucagcuggccuuucaccuucuccaugguggcaaagcuuaucccggguaucagcuuaguggugggccaggcaguucuuauugcuuaucaccucugagcagccagaccucuguggaggcugcuggcacugacugcucacucgccugaccacaccucucuccugguccugcccuucuccugcagaucaucaugguaaggcugcagagagucaccuuccuggcgcuucacaauuaccugggucugaccaaugaacucuucagucaugugaguuggacagcaacacgagaggauguggagacucaaugaggggcauuuggauaugcuauaaaggacucugccuccacuccaccacaggagauccagccccuacgccuuuuccccagccccggccucccgacccgaaccagcccuguccguggcucuaaacggguagucagcaccucagguacugaggacaccucaaaggagaccucuggccggccccuggacuccauuggagcuccucugccuggaccugcagguaugugaggugacugccacucucugccaggaacuugcagcccgcuuagcccagucuuggccucugugcucucuaguuccucaguuuggugcauuuuuccuaacauuuauuuauuucauggccguagaaagcagugagggucagauggcaacuugaaguucucugucccuaccucagagcuagaacucggucagcauauuuacucgcugagucuaguuuugcagacuuaaauugauccuagauccccagauuccuucuguuccucacucuccuaguccuggcuugaggccuaggaauuugcgggcaggauccugagcauucgucucuccccaggggaucccgugaagcccacauccuuagaagcacccccagccccguuacugagccgcugcaucuccaugccaguagacaucucagguuuggagcccuggugggcgggaaggaaaggauggauaguacgggaaggaccaucaagggucuagauuugaaucugggacgugcugguuucaguccugauuuuguauccuuaucuacaaaaugaguguauagauccuacuuccuugguucuugguuuuuuugguggauaugcucugcaauuguucuccucccaacuguguuaagaugcagagguaaagugcagucauuggcuagucaugucugucauggucgcagcauuaaauggaguuaauauugguauagcuguggucacuaaccugucuuuuuuacuuauuuacuuuggagcuggggguagaacccuggacauguucuagccaaagacuucaucguugaucuccaccccagcuacaucuuuauuuccucuccuccacgcauaggcuugcaagguggcccucguucugauuuugacauggccuaugaacguggacggauaucuguuucucuucaagaagaggcaucugggggaccucagacagcauccccuagggugaggccuucucucuucuccagucuuaccacaaccccccuuucagaacucuggccuuggccaguugucaagucacuugaaaaggucaguugggagggcacaugggaaaucacuaguccugccuuacccagacccccacucaggagcuccgggagcagccagcgggugccugugaauauagcuacugugaggaugagucagccacaggcggaugucccuuugggcccuaccagggccgccagacaagcagcaucuuugaggcugcaaagagagagcuagccaagcugaugcggauugaggugagcagacuguggagggaugcagggugugagggagacaguggaaggccuggcuggacccaucucagcuccucucucuccccaggaccccucucuacugaacagcagagucuugcuacaucaugccaaagccggcaccaucauagcccgccaaggggaccagguaaggcugacccuugaacugugguacccagauguuauccucugaccucugaucccugaccuuuauguagugauugcugcuuuccuucaccagugaccaacuuaucauccccauaguuuuuggccucuuacccugggagguuaugauguguuguuuugaaacagggucucacuggguauccuuggcuugccuggaacucacucuuuaggccaagcuagccuuggacucacagagaucuaccugccucugccccugacugcuaggauugaaagugugcaccaccauguauggccuauccauacaggguucuaucaucuuuacccucucccuuugccucaagugcuauugggcugcuaagccuucaccacucaucccugaauuuucucucuuuacauucccaaccucuaacucucuccuauggcucccaugauccuguggugcaccuccacguucuguccuuggugccugccugcuuggauagguaugcaugaaauagguaggaauagggcuaggacuaggguccaacuggaagagugaucuccuagcaugcaugaagcuuugggucucacccccagcacaacauaagcuaagugucauggugcaugcuugucauccuagcacuugggagguagaagcaggaggauccugauucagagucguccucagcuauauaauaaguucaucauacucagucugagcuacaugagaccugcucuucaaaagccaagaaaaaaaucuguuuauauaaaaauagagaucaaggacuggagagauggcucagugguuaagagcacugacugcuccuccaaagguucaauucccagcaaccacauggugguucacaaccaucuguaaugggaucggaugcccucuucuggugugucugaagagagcuauaguguacucauauauauaaaauaaauaaaucuuuaaaaaaaauagaguguguguguguguguguguguguguguguaaaguugauccagagacuauaaauucucaccuguguuaagaaaacagaggaaggguacaguagucaucaauuaauugugucugccuugguuguggcacuuggcauggaguuagguuggucuuucgucuuuauaauuaggauugcuacuucuaguaauucuggcacugggauggaacccagcacuucacacaugcuaggcagugcuuugccacugaacuauacuccaacuccaucuguauuguuucuguugucugcauccauucgcauacuuguaggaugguucuguguaguccugaggcaccauuuuggagccuccugauagcauccaggguguggcagugugucucccaucccuccauucucuuuaugaggaaucugaggcccaguaagggaagaaacugugaggcuaggaucucacuuucagauguggaagagggaaaucagguggaugggugagacgugaaaucuacauuuuuuucauauauauacguauauguguguguaaaaaguguguguguauauguauauauauauauauauguguguauauauauauguguauauauguguguauguauguauauauauauauauauauauguaacacacuuuuuggcuuacacuaaccuauuugcugucaggacaggaacucaaacagggcaggauucugaaggcaggagcugauguagaggccaugaaagggugcugcuuacuggcucgauuuugcucacccugucuuuuuuuuuuugguuguuuuuguuguuguuguuguuguuguuuuucgagaccggguuugucuguauagcccuggcuuuccuggaacucacuuuguagacuaggcuggccucaaacucagaaaucugccugccucugccuaccgagugcuggaauuaaaggcgugcgccaccacacccggcucacccugucuucuuauagaacccaggaucaccagcccaaggauggcuccacccacaaugaaccaagcccucugccacugaucacuaauugagaaaaugccuuacagcuggaucucauggaggcauuucuucaagggaggcucuuuuuucccugaugacuuuagcuugugugauugugacacaaaaugaggcaguacaguacacaagaaucuucccagcugagguuucuguaucaucucuaaggcucagcauccgaaauggaaauuuucaaauccacagugcucccagaucuaaaaccuugugccgacauaauaucgacaguccacaccuggccuguuugaugacuauagucaaacagaagcaguaaccauaguguaugaaauuaccuggagcaggagagauggcucagcaguuaagagcucuggcugcucuuccagauguccugaguucaauucccagcaaccacaugguggcucacaaccaucuguaauggaauccagugcccucuucuggugugucugaggacagcucaguguacucauacauaaaagaaauaagucuuuaaaaagaggaaagaaaugauauuuaaggggauggaaggauggcuuaguugguaaggugugugcuuuguaaacacagggguacucguuugaucccuaggaccauguuaaaaugcaaugccuauaaucccagcuguaggacgguagaggcaggaggauugggagaguucaagguccuauucaacuauguagcaagagugaggccagcuugggcuaugaaagacaaugucucuaaaaaguaagcuaaaaagaauuauccuagcugggcaugguggugcaggccuuuaaucccagcaauugggaggcagaggcaggcggauuucugaguucgaggccaccauggucuacaaagugaguuccaggacagccagggcuauacagagaaaccuugucuugaaaaaccaaaaaaaaaaaaaaaaaaaauuauccuaagguuaugcauauaagguguauaugagacaaaaauaacaccuguuuagaccuguauccugucaccaagauaccucauuuuucuucugcaaauauuccaaaauccaggggaaaaauucaaaauacaaaacacuucuagucccaagcacuuggcuguauuauaacaagcgaucuggugaaacaaguuuugagaaaggcuguuuuauccuuucuuggacauucugagugaauucauuagcuuguucaagucccccaagaaguucugcacugaaauguuacuaaucuagggcuggcaaucaauggcagcucauugguaaagcacuugauauacaaucccaaggaccggaguucgaaucccuagcacccgcaugaaaaaccaggguaauguuuguuuguaaccugagagagcagcagacaugagacuugcuagucauuugccuaaccuaagcaagcacugggucccagcguuaaaccuugucucaaaaaccaaaagacaaagugagccaggugcagaagcacaugccuuuaaucccagcauucuggaggcaaaggcaauagaucucugugaguuugaggacaaccuggccuucacagugaguucuaggauagccaaggacagauaaugagacccugucuuaaacagaaaaacaacaaaaagaugaacagcaccugaggaauaacaccugaggcuauuccguuggcuuucauaugcacacauacaccugugcacacacacaccugugcacacacaugcucccaauuuaguaacgagugauagccugguauuaguaaugcuuaugucauccauacacuaccuggaaauugucuuagaaaguuauaugcauguauguauauuucacuuugcucccucagcacuguugguucuuuugcaucagacugguuggugugguugacauagaaagcuuucucauuuauaaagggguggggcuagggugcgucuugauggccaggccagccacaaaagagagacacguucacugagcagaugccaugucgaagauccuguccuacuugcuagauagagucaagaaaaaguuguaugucuuugguauacaauuagucagcaguucugauggacgucauucaaaggugcauauaaauccuguaaacucaggggacuuaagagcaucaagaagcucagucuuggcaccaugaagacuggauuaagcagggaagugccucuaaggaugugaccgacagcggagauaggguaggaaauuaguuauguauacauggagcagaguucagucuagguagaaagcaaauugugcaaacguucuggggugacacugccuagcuuuuguauguccaggaaucuuuuaaucuuucuucccacauauugugugugugugugugugugugugugugugagagagagagagagagagagagagagagagagagagagagaggacaacuugggggaaccuauucuuuccuuucaccaugugagaucugggauugaaaucaaguugucaggcuuuaccacaugagccaucuugcccaucccugcugaggccccaaguagcucaggcaguggguaggaggggaggugaaagaagaaaaauauuuuaaaguaucuccggauggaaagaaauaugcuccauguagaaaacagaagggaucaaauggaauacacaagagcaacagaaacuuauugcuuuaaagauuuuuauuccuuguuuugguaugugauuauauaugugggcauauaugccacaccauauaugugcugaucagaagacaaccuuugaaagucaauucucucuuuccacuauguuggggcccagggauugaauuuggcugucaagcuugggaacagcaagggccuuuacucugagucauggcagaagccccaaagaggaucuuuucaaaggggauuccauuauugaauaguaguucauaacucauauaguuugccuauuuaaaguguacacuuuucugaguucuuguacauuuaaugaguuguggggucaguuucaaaacauuugaucaccuugaaaaaaucucauuccuuuagcuaccaaccucucaccacaggccaggcaaucacuaaucugucugucuccauaaaugcaucuguuuuauuuuugugagaugggaucucacauuguaagccuggccuagagcucuuucauguggcugaguguagcacugaauucucuauguggcuaacaguggccuuucucauccuccuuucucugccucuaaagugcugggauuauaggcaucugccccaggauuggcucuguguaugcuuuugcagccuccaguuggguuucuuuucaaaagaauucauaggccuuaaucggggcuaagaguucagugauccccuagcaaucugucuguccuagguugggauucuggugucaguacauagaugggauuauccugucugcagacuucaaccaacaaggacugauuuagugauggacugauuuaaugauuuaguguggcuggacagauggcucaggagcacuugcugcucuucuaaaggacacagauucaacucccagcucccauauaacuuacaccuucuuguaauucuggauccaagagauccauugcccucucuccucuggacugugaaggcaccaggcagauacauggugugcauauaugcacacaagcaaacacucuuacacauaaaacaaaaauacaucuuaaaaaaaaaaaaggcugggcaugguagcacaugacuuuaaucucagcacucuaggggcagagauagguggauuucuagaguucaaggcaagcuaggucuacguagcacuuccaacauuuccuaagcaauacaguguagcaauuuuuacaugguauugaaguauaaaucauugcccagaaagaguuuaaaguccgcaggagacugcaggagucuccugugauauagacagauucuauacaaaucuggcaccauuuuguccaggugaauugagcuuugagaauuuuggaacccaccaggugucccugggaacaauuauguuggacaucaaacaaagggugauugcucauaauauccagucuuucccuuuucccacuuuugcauucucuggucauggggauuacugauaugcaccaaggcaccuguauauuugaugcugggauggaacucuaggcuucaucuguuaugaaaucgcucgaaugagcuacauuauaaauuauggcaggguuucacauaucccaggcugaucuugaacuggguuuguagcugaggaugaccuugaguuuuugggacuggagucaugaaucaccugauuaaauggugguaggaauugaaucuggggccucugacaugccaagcaagcacuccaucaacugugcuacauccucuuuuguuuuacgccaucuuauuuccgagacaaggucuuacuauguggaucuggcuugcuucaaacucacuuguguccucagccucacagugcuagaauuguaggugugacaccacacugacuguucuuccagagguccucuucugaugugucugaagacaaugacaguauacucauauaaaauaaaugaaucuuuaaaaauaaacaaauaaauaaaucuugaaagcaagcaagcaagcuagggcuucuugaacccuaggccagcucuuuaccauaggagcuauaugcauagucuuuucuucuuaacccuuugaaaagcuuucuugugggguacacuagccugaguuuaggagagaaaugaugugacuggcucaucucauuucccaaccucugucucccacaggaugugagccugcacuuugugcucuggggcugccugcacguguaccagcgcaugauugacaaggcugaggaagugugccuauuuguggcacagccaggggagcugguggggcaacuggcggugcucacuggggaaccucucaucuucacacuacgugcccagagagacugcaccuuccugcggaucuccaaaucccacuucuaugaguaaggcuuggauaugggguaggauuggcaccuagaugaccaaagcccagcuaguuuuuuccaagggcaaaagaccaaaacauagucccccaccccauucuagaagguagaauguagcccccaaaucggaccucccaacaccuucuagggcagaugugauuucuuucuguuucacucccaaaccaacacccauuuucuuccuuccuuucaauguacuccaagaaggccuggucacacacacacaucccguuuugcuuucaggaucaugcgugcacaacccagugugguacugagugcagcucacacgguggcugcuagaaugucccccuucgugcgccagauggacuuugccauugacuggacagcuguggaggcuggucgugcgcucuacaggugccacccuuguccugcuucacugcucaaacccuagauacaauucugucugacucuccacuuuucacccaccccaggcagggagaccgcuccgacugcaccuacauuguacucaauggacgucuccguagugucauccaacgaggcaguggcaagaaggagcuaguuggggaguauggucgaggggaucucauuggcgugguaagggcagcccccauaucucucuaagcauaguuggcccuucacccacaugcacaucaucggagaaaucugauggaauuggagacccaaccccaacuuuagugccaacccagaccucuucccuggcuccuuccugugagucagaaacaaucaguaaagugggcgagaagccuggacuccacucucugugccucuucaggcccccauuaucaccugggugaguucuuauuuugcaucccagguggaggcacugacccggcagccacgagccaccacuguacacgcagugcgagacacugagcuggccaagcuucccgagggcaccuuaggccacaucaaacgucgguacccacaggugcaucuucuggcuggggaccgcaggggccguggcuuguguguguguuugcgccuaugcgugugcgcgugugugugugugugugugugcgcgugcgcaugcgcgccuggcuuuucuagucagguugcagcccaaguaaugguauuucuagccucccaggugaaggaaacaaaggugagaccuuucagucucacugaacaccauucucuuccaccucuccaacccucugccuuagguugugacccgccuuauucaucugcuaagccagaaaauucuaggcaaucugcagcaguugcaaggacccuuuccaggugagaguuugacagccucagggcguagugagggacuuagucuggcggccacgaacaagcuaucaaauggcaugaugggaaaccgaguucaacccuaaaucuuacuggaacuggaaguuggauuuaguguuugcuggaaaauguaguccuuguuucuaggcaguuuguuaauuugucuaaagucuuagcagauuuuuuuuuuaaguaagggcaacauuuuuacggcuuauuuaucgugaguacacgcucaagugcaacugcacacacauaugugaaggucagaggaauccguuuucucccuucucuuuggaucuuggggaucaacucaggaugccaggcuucacagcagcaccuuaccugcugagccaucucucaaguccaugggguagauucuucagcaggggggaugcuucccccaguggaaucacaugagcauucugggaaagaaucauaauacgauuacaaaugagcucgugcguggcauacggcacuaggggcacauugggaaauggcuucugaaguuaaacuggccugcuaggaaaugugguuauuuauacuggagaguacuuucugugagcuagaauauaucauguuacagucuguucaagccaugccaccaaacgcaccugaacuuccacauuuuugcuaaccuuuccuccacauaaccuucacauucaggaaauaaaggucgaagucauauaaguaggaaagacauaauuuuaaaaacacacauaaagaccccaaugucaggagcugguaaguauggagggaaaugaagcaagguaauuacgcagggcugcaggcagaaagcuggagaaaaggauggauggauggaaggaagaucuuuggggacugugggcugagccaucccaggguuaccuaaagcuggauguggaagagaaguaggaagguccacacaagguuucaugguuuggagcuuuguuucauguugcucaggcuggccuugaacccacuguguagccaaggauggccuugaguuuauaccuucugagugcauaggugacaagcauaugguacaacauggcuuauguugugaauggagcccagagcuuugugcaugcuaagucaugcuuuggaccuauagccccaguccagggauuagugcuuuugaaccacaacaaggaguaaccuuagagggaaagaagggccuugggaaguguuugaguucacuaaggugaacucaacuaaggugaacucaauaugggagagacgaaccaaccagcaaguaaagucugaagucugaagugaggccuuggcaagagauggaaaugacaacuccaucuaggcugguagcugagaaacugaaaagucacaaguauauucuugucuuagucgguguugggacauaguagccugagucaggaugggaugugcucugcguaggcacaguggauuugaaugguucuaacauugcaugguggguagcuggguauaguagcacacaucuguuaucucagcccuuagagguuggaugcaggaggcaggauuucaaggucauucccagccaugugagaccacauaucagaaaagaacugcaacaaaguuguguaaugggucucacugagauuaaggcccagaguaaagggugcuggccaugucuuaacaagaaacacccaaggauggaauuguauguggggcacuacacccauggccucuguaugguguuaucauagcuuagaauagugaggaucgggcuggugagaugguucagcagguaagagcaccugacugcucuuccgaagguccugaguucaaaucccagcaaccacaugguggcucacaaccauccguaacgagaucugacucccucuucuggugugucugaagacagcuacaguauacuuacauauaauaaauaaauaaaucuuaaaaaaaaaaaaagaauagugaggaucugggggggaggaugacaaaaggcagggauagaggggaaugaaaaggaagugggggggggugaggagaagugggggaagaagaggagggggaaagggagauagguagaagaggaggugguggggagaaggaagauaccucucugaacacagaguugcucagccgaucccugauuggugucucaacaggcuccgggcucaguguuccgcagcacucggaacugaccaacccagccagcaaucugucuacuguagcuauccucccugugugugcugaggugcccaugauggccuuuacucuggaacugcagcaugcucugcaagcuauuggugagcgauagggaaucuguucaguggaacggugugucuauacuccagucacccguacuaaguggugggugaguggguggugggugcgagggaaacggagccuaagccguggggaugggugacaagcgcucugucuaacuuccauuccucaaccccacuaggucccacgcuccuccuuaacagugacgucauccgggcacuccugggggcuucagcacuggauagguguguggggguuggggaguggggcuggaagggcagaaggccuguguuggacauucuuucagauugggcuggagaacuaggcuucugaaucgaggagucuugccugucggaucaauagggagacgauguggggcaaaucccuuuugguagcaggggugucaaauuggaaacccaggggccauaugcagcucuuauaguugugagauacuguggcucaaagcaaacuuaaaauauuaugaggauuuuaaaaaaauuguuuggguuuuuuuuuuucuuuguaacuugcuuaugugguucuugagcauuaacauuguugauuucauguggcaaaguaaugcaaaacaaauauaugugaaaauaaauauauauauauacauauauauauaugccuuugcaacaccugaguccccauuucaaccccacucccugccuuggcgugcauuuuaauuguugggaccuggaauuaucuaaauauucccagcaguagaauugcacuaucucuauauugggagagguugugggacuccaggccggcuccaggaugacccucccucauuauaucucagcauucaagaauuccggcugucagggugguuggcccagcaggaagaugcccaucgcauugugcucuaccaaacugacacaucccugacgccuuggaccguccguugucugcgccaggccgacugcauccucauugugggccugggggaccaggaacccacuguuggccaggucuggagacuguaugcacugauuacccacacauacaccucagucuuccccucaggaucucaucccuuguccuuccgugccuguggaaggccauguacacucaugcugcuguucugugagggagcugagcuuugccggguguggguagagaagguaucaaugaccuccaccugucucugucuuccauagcuggagcaaauguuagagaacacugcuguccgugccuugaagcaacugguuuugcugcaccgggaggaaggcccuggucccacgcgcacuguagaguggcucaacaugcgcagcuggugcucagggcaccugcaccugcgcuguccucgccgccucuucucacggcgcagcccagcgaaacuuguaaggggugggaaccuaaaaaaggaacccaggggaacaaucugucuucuaccucaggggucggguuuggguguaauaugaagaagagccuuaggaaacacaccuaaugcuuagguguauaauuugagggauacucuccuccaguggggguuggggccagagaauaacuguucuuccaucugggaccgaggcuugggcguggcuugaagaaaggcccugaguggcacgccucugcugcuuccuguuccaguuuggggacacaccccuuugccugugggcguggcuuggugucacgcccucuuccaccuugaguggcauuugguacaucugccaaagguuguaguuuagggguacagcaugccccacagucgggcaggaccagggcuugggcaggaccagagagcugagacagagccugaaccaauugcgggaguggaggugagggguagguagcaaagaugaguaugugccugagugguccccuagacuuguucuuuguuaccucagucuaacacaucuuuauucucuccuggaucccagcaugagcuguaugagaagguuuucuccaggcgugcagaccgucacagcgacuucucccgcuuggcacgaguacucacaggaaacacuauugcucuggugcugggugggggcggagccagguaagagacaggcuaaguagaagacacagcuuccuuacuguguccuaaggauguguaagggguggagcuuauuacccgggagacacccccacagccugguuaguguguuuuuuuuuuucaggaggggaagugagaagagaauuccuggggguagguccccagagauccccagcuugucaccgacuccccucuauucuacagaggcugcucgcauauuggggugcugaaggcauuagaggaggcaggagucccagucgaccuugugggaggcacauccauagguuccuucauuggggccuuguaugccgaggaacgcagcgccagccgaacuaaacaacgagcccgggagugggccaagguguguuuuguggggggugugaggagaugggguugcagggcccaagaaacgcagggggaugugugaagaugccauagccugauccgguaguauggguagggcacugggacuuuggacuagagcaaucauuguauugacugacacucuccagcccuguguguauguggauauuccuggagccacgaucucucugugacuaagcaacugcuuuugaccauuugauuccuagagcaugacuucuguacuggagccuguauuggaccucacauauccugucaccuccauguuuacuggcucagccuuuaacagaaguauccaccgugucuuccaggauaagcagauugagguauguccguccccuaccccuggcccugcugccucuuccccgggguuuuccaccaucuuccacuuugguucucaccccuucccaggaccuguggcugccuuacuucaaugugaccacagacaucacugccucugccaugcgcguccacaaagauggugggugccauccugccaagcccugcuacaaccuuguuggccggcuguguggggauggguuguaaggggaggggcagcugagcaucugggacguuguuaacacaagugaccguccaccugggcccguccaccgaucacuaaccaucacccacuaaugucccgaaggccccagguauguccgcucucuggggguggggagccgggaggcuugucggacaccucacccccucccgccaucccccacaggcugcguguggcguuacguccgggccagugccuccuacugucccuaccugcccccacucugcgaccccaaggacgggcaccugcugguggacggguguuacguuaacaacguuccaggucagcgagcccacaggcuggccgggccuccgagugugucugagcgugucugugcgugucugugucuguguaucccaccgggcaggcucccuguggcgguauguacgugccagcaugacgcucucgggcuaccuacccccgcugugcgacccaaaggaugggcaccugcucauggaugguggcuacaucaacaaccugccaggcaaguggcugcccacucacaucugcauggacacuuaucaccagacacaugcccacacugacuucugcacaugccgacuggaagggacaggucuauaugaauggagaagcucaagaggacacacacagcuuugcacagaguuauagacugacacacaugcaugcaugcaugcauauauucaugcauacagauauacgaguguauguggacaguaacaugaacauuugaaaaguacaaacaucagacacgguagcacacacugugaucacagcucuugggaggcagaggcagguggauuauugaguucaaggccagccuggucuacagagugaguuccagaacacccaggggcuaaacagagaaacccugucugaaaaacaaacaaacaaacaaguucaaggcuuucuuuagcuacaugauggauuuaaggccauccugggcugcaugagacccuaucucaaaauauauauuauuuuuaauuaaaaguaagauaugcucauuugguagagaauuugccuaguaugagcagaggucuacauucuauauccucugcucacacaaagccaggcaugaugcugcucacccauuaucccaggauucagauugaagcagcaggauugggaauccaaggccauuuuaagcuacagagcaaguuccagacaagccugagcuacaggaaaugaagugccuuuccauucucaugugucacaguggacacagagaggcuggcauaugagggacaagagcuggagccuaguuacacgugcacaugcauagagaucacgcuucuacaugugcacaccagcucccuaugcacaccuguucucucgggugcuuacauaggcagaacacaugaacaugugugaauacacacauacuugagauggaauuaaccacacuggccacaccuucccugaacagucuauggaauaugccuguauagaccugaagauugaauaaggugccuaugugaccaagauaagcauuuuuucacacccaccaacuuaaagguucuuuuuuguuuguguuuuagacaggaucuaguguaguucaugguagccucaaacuugauagguaaucagagaugaucuugaauuucugauccuccugccuccacgucugggcugcugggaugacaaaugugcuccaccaugccccguuugcauggugcuagggauggaauccagggcucuugugcugcacagacacucuacuaacugagcuacauucccauccugcugcugacgucacacacauaggugggaggucgaugcaagugcagcucugagaaaaccucauucucuuuguggcugcacaaccuuuaaugccagcacuccagagaucucugaguucgaggccagccucaucuacguagugagcuucagaacagccagggcuacacagagaaacccuguuucaaaaaacaaccaacaaaccaaaagaacucggucucagaaguguaugcuccagaaacauaaguuaguuacacacagacacacaugcuugaucucauagaccaggaucuggccagcuauagcacacugugugcaucugggccugugcuugacuuuaugaauaaaggauuucuuuauauuuacauauguauuugugaccacaacacauggagguugaaggacaauuaauaggaguuuucucauucuaaaauaaccaguugaacucugguuauaaugguuugguaagugcuccaccugcugagucaccuacaugaccauguuuaguuaguuaguuaguuaguuaguuaguuguuaaacccgaacugaccucuagcuuccuacguagcugagguuggucuugaauuuauuccuccucuguccacuucccaaguguugggauucuaggccugagccuggcuuagaaauaacgauucacugggauagccaugcccaugacccaccucucaucuacugucucuguugcagaacaacaggggugaaaacucagagcagaacuaaaagcguuuucuaaugguccugcaagcacuggaaauguacuauacauguaaacacugccacagucccucauauggcguucacauaaguguucacagaccuacagauagacaccauacuugguuaugcaaacguaaccugagcuccaucccaguacccauguaaagauggucacagcggaggacauccauagcccagcacuuuggauggguggggggaguagacuuuaggauccccagggcucacuggccagccagucuaguggaacggaugaacuccagguucaguggguaccuuuucuaauuuaaaaaaaaaaaaaagggugcagucaggcugcaggcaguuaagaaugugcacugcucuugaagaagacuuaaauucuguucucagcaccuacaucuucacaacuaccuguaacuccaucuccagagacaucuaaugccucucuuggccucugcagacauugugcacauaugcacauaagcacaugcaggcacacaacuauguacacagaaauaaaucuauuauuuguuuuguuuuguguuuugagacaggauaucucuguguguaguccucaagguccuggaauucauucuguagaccaggcuggccuugaacucagaaauccaccugccucugcauccugagugcuaggauuaaaaguguacaucacuuaauuuuuauuuuuauuauuuuuauuuuuaaggugucaggugauagaggaagacacucaguguuaaccuccagccugcacacaauacacacacaaauacacgcauacacacacauacggguggauauuuccuggcaugcauuuagaccggcugagcgagagagaugcagucauaggaagacauggugcuucccauggggucucagagaagagagauguaaacagacaaucacaggcaugugcagcugacaugcauacccagcaacauaaacucaaggauaacuacacaaaguugaauaggcagucagguauuuccuugggcugggguuggcucuguaguacacagacauacagacauacaaacauaacugccauucucacuggaccaucuuaucuuggcuuguuugcauaaauuuccaugucauuugcaugcuugucauuugugguguuugcaugcuccccaccccccaacccucaugugcccauuugcauugugguaucugugggucguuuguguaucccuguccugcugggaggggcugcugaccucccggcuccacagcggauauugcccgaagcaugggagccaaaacggucauugccaucgacguuggaagccaggaugagacagaucucagcaccuauggggacagccugucuggcuggugguugcuguggaaaaggcuaaaccccugggcagacaagguaaagguuccagacauggcugagauccagucccgcuuggcguacguguccugugugcggcagcuagaagucgucaaguccagcuccuauugcgaguaccuucguccauccauugacugcuucaagaccauggacuuuggaaaguuugaccagaucuaugugaguaggcaggcugugggaaguagaucggugaucaaacaguaacguuugcaguagauacaauauggauauggcuguauguauucuauauuugcacuacauuuguugugugcauugccugaagcccuguguaguaguuucuaccaucaugucuaauaaguaaagagugaaagcagugaucagcuaguaaugucugccacaggucuggagcgggauguagcaauauguuguaugcaacugacccugaaaaacaugucauagcccacaucaacugaaauugaucaguaguugcugcccagaggcuccaaguuaaaaugucugcuguccuucuuugauuaacggaaggauguaucauaauagacuaaugucuacuguagacauggucaugacacuauucacaaauacauaguuucaggccuugaaaauaauuuugcacauuaccaucuuauguuaguugguacuugaaauaccucaugggacugagugggaaagagauuugaagagauugauuaauaaugucuggcagggacaacaacuggaaaucugugggcaguuaugcuacauaucacucggaaauagauuuaauucagaugucugcucucccagaagucaagcacuuaaauggggagauugaaggaagcuguguguaaaugcaagggcagguggugcugucaggcaucgucccagccucguuguuucuugcaggauguggguuaccaguaugggaaggcugucuuuggaggcuggacccguggugaagucauugagaaaaugcucacagaccggagaucuacagaccuuaaugagagucgccgugcagauguaagccugugaugcuucugcugggaccagacuuagucagagauuccagaaccccaagcccuucuauucuggaaaacccagaugauccaauauaucccuggguuuuauugagccccccaggucucaggcaccaccucagaguccccuaugaacucuuuauuuuuguuuuuuuuuggggggggguuguuuguuuguuuguuuuuguuuuuuguuuuuuucgagacaggguuuuucuguguagcccuggcuguccuggaacucacucuguagaccagcuagccuugaacucagaaauccacccgccucugccucuugagugcugggauuaaaggcgugcaccaccacgccuggcucccuaugagcucuuaaaacccuucagaccaucccuacucccaaagucucacccaccccaccccaccccaccccacagauacuugccuucccaaguucuggguucacugacuuggcugagauugugucccggaucgagccaccaacaagcuacgucucugauggcugugcugauggugaggagcugaagggacccuugagaguugcgggugcuggaccuggagaugggggggcaugugugacuggaaauaccagcccagacccaugucucucaccugcaccuugauacuuccuaucccaggggaggagucggauugcuugacagaguaugaggaagaugcaggaccagacugcucaagagaugaagggggcuccccugagggugccagcccuagcacugccucagaggugguaagaauggacagcccaaagaucacauggccccagcagaucacaugugcagugggaaggaacuaaauaaagucuuggggcgggggcagugcuggaugguauucgaacacaaguuuagagaugggagauucaugucuccccaucuuaggacuaugaacuaaauccacauugguuuacuucuguugcugugacaaaauacucuucagaacaccucaggagagaaaggguuuauuuaucucauacuuuaaaguuacacucaaucuuuguaagagagucaaggagucaggagcuugagagaacuggugacauuaggucuacagucagaaaauagcaauacgugcauguaugccucuacucagaucucuuucuccacucuacagccccguguagggaauggugccacccacaguaggcaggucuucccacuacaauuaacugcauaaagucaccccuccccaccacaugcucccagaacaacuugauuuaggcacuacuucauugagacuccacuccuaggguauuccagauuaugucagguugacaauuaaaauuaaccaucacaguguguuaauggcccuggggcaggaaguaugucacaauguacaaacugguuguuucuaaagugacauuuaucaagcaaggcuugagaugaaacuaguuuugaguggugaggguuuggcagcucuauuuguggcuaucauguagaugucacgaaguggauacauggcugacguucacccugucuggauaacacacauguauugccugucccuauaggaagaagagaaguccacacuccggcaacgacgcuuucugccucaggagacucccagcucagucgcagaugccugaggaucuugacagggaagcccuguuccuagacuggguuaugggugagcuugugggggagcucacacuauuauucccacugcugcuauacuucaacacucccugggcccuucccccuuggcuccaaggaccacacacuggacugacuugcccugucccuaaggggagggcagaacugcacugauaaccuuugaccaacuaugugaccuucccccaaauaaacucuuaccccuuucgaagcag

SEQ ID NO: 4250 - RNA, 21780 nt, Mus musculus
gggaucaaaagccuacauggacauccaugacaaagggucccuaagccucuccaggguccgggagugagcaggaacacacgcgcgcgcgcgcacacacacacacacacacacacacacacacacacacacacacgagaacgcauacagggacaugcguucuucugcagcccuucccucauccgccaucacugccgcccuuugcagcaggaggaccuauggaagcuuuaaugucaguggggacccauguggacccaggagccagagagaacugaguccaaucugggggcggggcgcaccuggguuccgccuuggggcggggucgacgccgcgucgccagcgcgcucgaccgcaccugguucagcggcgccucagcagcuuuauuaguaacagcagcagccgcggcggcaacccgauucgggguggcggaggcucggcagcagcgcagcgcagcgcagcgcacgcagcccagcccaucagagcgcgcggacccgggcggccguaaccccggcgucgccaugguggaagcggcgcccgcaggguccgggccacugcggaggacuuuccugguccccgagaucaagucuuuggaccaguacgauuucucucgagccaaggcggcggcgagucuggcgugggugcugcgggccgcauucgggggagcagguaacccgagggccuuuggggaggggaccgggggagccaggcuggggcgcggcaggugcggggggcggggcgccaagccggggccgugggaacaauagcuucggggcugccuaggguccccgagcuuuuggucuuugcuaagcugggccuccaagcuuccugcucggacggggcccuuggacuuugcccgcccgggucgcuggaacgcagucggggguggggcccgccaagaggcugugcgccuugggaccccgggaucagagcccccaggugagcagggguggggucugcagaccaauuuuguguguggugggggaagggucuccugguaguccucugcuucccgccucccaccccacuccucagaccccagggccuaacugcauggccaacuccccuuucacacacaucagaagccugugaugguuccuccuacccccaccuucccuaucuacccucacaacguguacgcgguggcuuggaccccgcaaggagcguuuuaagagaucagagcuacagcucagugacugggacacaaacccugccuugccgguggccagcguguguguguguguguguguguguguguguguguguguguguggugugucugggaccacucuuucgucucgauggccccguaaaggcuggcaguugugacuuauugccacauuuuccugaggauucagguaggcauaaauggcucauucaccagcuguucuaggguggcagcucgggcggccaggccuucucuuauugaagccaccccuuuucuccucccuuccgcaugcccacaggccugaaggacuagggccauuccuacugggcaaaugaggaagguggauuaucagaccugggaaggcucuccaaguccuggcuuugggcagcuucagccaccacaggauagaacugggaggccaggcuuggccuugggaaaaacagagguucauuaaggucuaggccuuacugggaguagaagaacgagacauacaugcacagagacagaaaaagauagagacaguaggaacagauagagauagagagaaggagagggggagagacagaaacagagaugcaaagaugcagagagagagagaaggcaggaacagagugugaguguaugugaauguguguguguguguguguguguguguguguguguguguguauguggugguggugggaaaugcccugcccuccuacugaucuuggcacuaaguaggugcagccccucccccacuccauugccuucccagaccagccuguuccgggugugggucuccugugacagcuguccaucaguugcuucugcacaguccugucuuucccacuuucuaguagucucucuuaccgcucuccucccuguguggcuggccagcugccucugacaccugcacacccccagggaccuggggccugagaaagaaaagauuugggaguugggaccucugucccagccccucacaaggccgagauaauuagauuagaaaggcuggcuuccugagcuuuuuaauuuugauuuuuuuaucauugccuguguauguaagcaugggcaugcaccacaacauguggauggaggucagagaaccaccacaaaacaucauccuugucaccugaacacuucaucgggucuucugaaauagguaccucuacccacugggcaaucuugccagccaggagcccaacucuguuaagucaugguugaguuugaggcccagcccugaccaggacagcugguguggaagaauaauucagguucucugaacuucuguuucuuuuuuuauuuaagaaaaagaaaaaagaaaaagguguuuguccacuuacauaucugugccugaaaucacauagaaguugcuugccuguggugucaugcaguggguuuucaacuccauuacuuguuuuaaaguuauauuuauuuucuuauugguguguguguggggggcaccuauguggaggucagagaacagcaugggcccugggggucaaucucagauuguuagacuugcuggcaagcaccuuucucugcugaacuagguuguugagaggugacuugauugucugauguggcacaagacacagcuuggucaguguucacuauggcagcugcuguggcuggugagaguauuuuaucagugccucccagugucucuuaggcagaggaccgugcagaaguuacucuguaaguuugcagaagggaagccccuggaggggaccuucaugcucagauucacacauuucucuucuguugacccagccccuugcaccaugcagcacuacucaguggcugcagcuggcucaggaucagauucagcucucagcuaccugugucucccucccagacaaggaggugggggcuggggggagaugcugaggaacagaucaaggccaggucaucuuuaaaauauaguuaugugugugugugugugugugugugugugugugugugugugugugugugugugugugugccugccucugggugucccagggcuuguguggcagucagacagguuaggguuuuuuguucuugcuccuugguuguguaggugucagggauagaauucagguuaucgggcuugguggcaagugccuuuaccagccaaaaauccucucuuccuggugcaguuuuauuguuguuuguuuguuuguuuguuuguuuuugauugguaauugccagcacuuggguugcagccuagggcccuaugcuagggagugucuaccagcugagcugugaccccagccccucauugggggaugcuagggagccacuguaccacggagccacaccuccagccccucucugauuugcuggguaaauagguucauaccaccaggcccugccacuuggguuucuuuacagacaccuuucuacagggagccaaugcuuggugcuuaggguguggaggagaugcugggagagauccaggagaauggggaugggcaccaaauuagguccuggauaccuacugugguaagacccagugugguccaagcagcugggucugcaggagaaaguucccaagauuuuccagaggggggugggugaggaagggggguuccccugagaagcugucuugagaccaccaaggggagcagccuauggcugcaagcugcuuagaggagagcaugaagcuccccauggugccuggaggucagagcaagagggugcagagugggcuucagaaggaggaccucucagauuaagauccaagggagggcacuggggagccagagaaggugucugggcaccaaggagcucacacagacuuaggaagggguaguucuggugucccccaaggcaaggugugaggaaugcaagcuggugggcucaggagagacagacuuggagauaagaaaggcuucuguguaaauguguggaauaccaacugccauuccuuaggccuugcaaauaggagagaggugugugagggaaacugguuucauuugggcuccgccauuuucuggcugugugauuuuggguaagcuaccuuagcugugugagcugugguuuccuuaucuguacaaugguguuagaauaaguguuuuggggguuaaggauguaggucagucauacaggagacaagaaagaccuuauuugccaggucaauaacaaaaguguguuguaggguuaaaggcacagacggucauggaaugaguaaauauuagcuguguuauggaaauuuccugucuagugggguugggauuagccccuaugugguuauugaaugcuuauaacugguauaauccugaugugcaguuaauauaaacacuggaucaaaguguggugguccacacuaguuaucccaauacaggggaggcauaggcagaaggaucauggguucaaagccacccuaggcuguauaaaaaaucuucuauccaaagaagagaaaacaaaagcagcauaauacaacauaauacagguuggggauguggcucccugaaggaguucuuucccaguguaggaagcugugcguuccaugcccaggaacacagaaaccgggcauggcagggcacagcugucaucuggauaguugagugguagagguagaaagaucaaaaguucaaggucaucuucagcuucugugagcauuugaagccacccuaggcuacaaaagacuuuaccucaaaaacaaaaacaaaaccacaaaucaaaucaucagucaaugauuugcuacuccuuguauauugcagugguuuuugaacaggauugggcugaguaaacugucaccaaauuaauaguucuuuuuucugcuuuuaaguuuuuacuuuuaguauuuuuuacccuuuuauucauuugauuuuuguuuguuuaagauuuauuuauuuuauguauaugaguacacuguuguugucuucacacacaggagaagaggaaggccauuggaucccauuacagaugguugugggccaccaugugguugcugggaauugaacucagggccucauaaacgcugaaucaucucuuacuuuggguuuuuugagacaggguuucuacauauagccuugacugucuugaaucuagcucuguagaacaggcucgccuugaacucacagagacccaccugucucuaccucucuaauccgagugcugggauuaauugugugugccaucgcugcucagcucagcauuuuaguuuuuaauaaaucuuaucgcuuuuacuuagcgugugugugugugugcgugugugcgugugugugcgcgcgcgcacgccauggguauacauuuuguuuuguuuagauagccugaacuauaacagaguauaauacugucucagaauacccuauauagauagaucaagcugacauugaaccuguucuccugcuucagccuucaaaauguugggguuguuggcaugaguuaccucaucuggcaauuuugccuuuuuggaaugaucucauuauauagcccaggguggccuugaacucucccgaguguggcugcugaccaugcccugcugacuaucucuacauugaaggaaaaugcuacugacagucaugaguagugacucaugguuuugcucaaccucacacaauacuacccuuauccccucaucccagauguagaccaaguacuugaugcacgucugagaugauggcuguagauguaacucaguugauggaguugcugccuagcaugcccgcggcccggcauuuaaucuccagcauggcauaaacuaggugugguggcaguuagacggcugucauucuagcacuggugagggagaggcagauuggauguuggaguucguccuuggcuauggagcaaguuugaggcuggccugggccccaaaagacccuguuucaaaacaaaaugaagcagaagucagugagaaggggcucuaggccauuuuucuuccucagagaaaguccuaacguuuugcucuugggaacaggaagggcucaugacugagccuuagaggagacuggguauaggagaagggucagagugaugucaggagguuggaugcaucguggggcagggaaaggcaggaaaagauggugauuaucaucacuaggauguagauugggggaggguagugggcaaugccaggguggaggagcaggacgacacaucccagucugcagcaggaggcaaucagauggacucccgagccuccacaagguggggugggacuugucccuuuggaguaagauagcaggaggaaggauucuggaaggagguacugggcacagagcccaggugcauugugggccaguggguguguguuuggcuggcugcuguuggccuuggggaggcuaggaacaggagagcagaagcugggucuaggauggaagccagggccaugagguuuaggcagggggaaguggcaguggaggcaaggggcaggaggaggugagggagaggaaagacaggaccgccaagaccaaguucucagcacaaaggauauguauuugucccagaggaacagagcacaggaauaaaggacaaagacaggagauaaggagggagaaggggaagggucaagggagagagaggggagagaaggggaaagggagaaggggaagggguauuugucccaguggggaacaaaggacugccucuggauuuagagaacacagauguggcccauaggcaaaugguuuauaaagguaaagggggaaacccugcgauaagaugaggcuuaauuuuaauuagacagguuaauuagggcagccacgaggggcuuuugacuguuguacuucaauauuuugauaacuggacguugguagucagcccuaaggaagaggaaguggccaaauaagggaauagaccuuaggggcuagcuucaggaaugcaauccaggggauuuuuagcuaggcagagagaaugggggagaaaggcaagccacgaucgagcuggacagagucccuucagugaauguucaaauucuucaucuuucuuuaaaauuuuaaaaauuucauuaaagaagugugugugugugugugugugugugugugugugacaaugcugugccuguugcggcacacauaugaaagucagaggacaacuuguuagaaguugguucuccccuccgucacauguggccuggacaucaagcucagguuuagagaguagauggcaagugccuuuacuugccgagccaucuagccaacuugaaaucucucauccuucaaagagcaaagcuaaggcagguaguugcacucagcucuccauaggagugcaguccuuagugggaaggucaaguguggauuuuggagguguggaaggagauguggcaagaagggguuccuguuaaugaugucagguccuaugucaaguggucucuugggagccugauuaugaagaauuguaggggguuguucuggcauugcuuguauucaaaugcuaaauucuguaccccaagaucugguugcuucaagagaaaugaauccucauauauaccagucguuguugugugaaccuugcccuccaaguuaucccugacuaguuaauaaagaugcugucuuagucaggguuucuauuccugcacaaacauuaugacuaagaagcaaguuggggaggaaggaaaggguuuauucagcuuacacuuccacauugcuguucaucuuuaaaggaagucaggacuggaacucaagcaggucaggaagcaggagcugaugcagaggccauggagggauguucuuuacuggcuugcuuccccuggcuugcucaaguugcuuucuuauagaacccaagauuaccaacccagggauggcaccacccaccaugggcccuccucccuugaucacuaauugagaaaaugccuuacagcuggaucucauggaggcauuuccucaagggaggcuccuuucucugugaaaacuccagcuugugucaaguugacacacaaaaccagccggcacagaugccuucagccugggcugggcagaagagaagggauggugggaagguuccagggcucggggucugaggcaguguccaggauggagagggaggggaaagaagaaguugccauggggucuucauggccacgaggcccagcuguuggaacaggcacggcccagguggaacauggcaagugauaucuuggaguuaauauagacaaaauagcuuagagggcggauaucuguccaucucuaaugcuuuaagaguuauuauaaauauaaaagccuuugugucuuuuacuugggaacuauauggucuaagugggauaaaauuccucaaguaauauuuaccacaaccaaguaugaauggucuaauguaucuuuuucuacccuggaguccuugcuucagugcuucucuuacgguuuuuacacacaugcaacagcugggcuaauugaaacaggaauuaaggcagucccugaccaagugaucuuaauuagucacaucuacccuaaccucaggaguucuuccugguuuucuccucuuuuuaaaagauacuuuguucuuugacaauuucauacacauauguauacaauguauuuuuaugccauccacuaucaacuuccuccuggacucuuuuuuucuuuuuuuuuuuccccuuuuucucguuuuuuaagauagagccucucuuuguagucuaggauggccagggaguuaauguaccgcggccuggccuugagcuuucagcaguuuuucugccucagcuucccaagugcugaauguacagguguugccugccacaccuagcugguucccccagccccccaguaaguuuauuauaguaugcaugugaggagacugcuuccucugcugcauguguggggguuagcggcuaacacgguggaguuggguuuuucuucccaccuucacguggguucuggaggcugaccuuuggguuguuacuuaacagcaagcaccuuuucccacuuauccauccucugccccccccuucauauuuuauuuguguguguguugagggggcuauucaggcuacgguguauauaugaaggucagaggguaacuuguugggguugguucuuuccuuccacugugugggucuuggagauggaacucagguugucuggcuuuauggcaauguugagccauguuauugaccacuuuucuuuuuuuuuuuuuuucuuuuuuuuuuuuuuuuuaaagaugagggccucccaguagcccuggcuagcuuugacagcaaucacaugggccaccauacucagcuuuuggugggcauuuugaaucaggguguccuagcacucacuggcuuguuacugcuucuagccugggcuggugugaagcuccuuucucaguuucccaaggcgaggauuacagcuguacauguugggccuggcuaaguacccuuuaaguauggcugaacucaguauucucuuaagacccuacuccuuaugcccucugcuuugagaguacccccaaggccuggcacacaccaaacuuaacucccucaauuuccucaaaguacuugcucucugccugacuuuggcaucuuuauccuguaggugacuucacacucaucccagccacuaagaugacagaggggauagaguuugcuuaaggccugaguuugagucucaguccuggcacuggagacccacguagccuuaggcuggucacuuuccgucccuguacauuuucugugaaguuuguucccaucuguaaaacgaaguuuccagggauaaggauggugcucgaugaggcuacagaagcaugggggaagcccugaguucugucccuagucgggcaugcccuaaacuaggcacgguggugcaugccuguaaucuuaggccucuggagguuaaagugggaggauccgaaauucaaggucauucuuagcuaccaggcaguuuugaggcuaccuugggauacaugaaacucaaccucugaaaucuagccaaauagaugcagaggagaugagaaaccucagugguacaggggcucgcugggaaagcuggagggcuugaguucagaaccccgguaucuagggaaaaggagaacuggacagacuguaaccuaagcucuggagagguagagaugcauggaucccagggggcucauggaucagcuaguucagcuggaauggcaaagccaauguuuagggagagauucugucucaaaaccucaguggaugugcucagcugucgagagcucugccuacucuccuagagaacacagccauauuucccagaacccaugucugguggcucacaacuaucuguaacuuuagcuucuggaggucugacugguacccacccucuucuggccucugagggcacucguauggcacaugugugugcacaugcgcguacacacacacacacagcccuggcuuguaccuauaugccugacucuguaguuccuaguccagaccauuccuucuuuucgaucauguacuuuguagaagagugagcagauggguuauguguugaucugaccugcugugccccuccccaaugcagagcaugugccuccggagcugugggaacccuucuacaccgaucaguacgcacaggagcacgugaagcccccagugacgcggcugcugcucucugcggaacuauacugucgggccuggcgccaggcacugccacagcucgagccaucccccagucccucugcucuguuggccuugcuggcgaggaggggcacggugccuucacugccugagcacccagugcgcgaggcugaccugaaacaccagccaauucucaugguaggcucugcuccugaccuaugaagcccugccuaccaggcuuggcuccuccccuuugcacuuuccugcaaaguuucuagcuugugcuugaaccucccuucaggcucuacccacuaauucucguuacacuccccaaaugguuccucuagccaugcccucaagcucagcccauuagguguagcuccuccaaccaguuuuagccccucccacaaagcuuagcucccccuaucaagccuaccuccauuuuccaagccuagcuuuuccaucaagcuaagggugucacacucaguucugcagaucauaccuggcuccucccucaaguugcuauacccuuccacuccucagguuccuccaguucuggccuugguuucucuagaugggcuacucuauuguaaauccuggugucuuagcucaaaacccagcccaugugugaccucuuucauaacuguagcucucaaggucccacccagcaaucccugaccccacaccauucccuggccccacuccucccacuucucugggauuggaggcagaaagaguagcucccugcccagucuucuggucucaucuuccagccuuugccccaacagggagcccaccuagcugucaucgaugcucucaugguugccuucucauuugaguggacaaagacacuaccuggucccuuggcucugagcagcuuggagcacaaacuccuuuucuggguagacacaguaaguagggugggccaggccauguggaguggagacaaugacguuagccaagugaccaggcacugacuucucucugaccccuagacuguucggcggcugcaggagaagacagaacaagaagcagcccagcgugcaucuccugcagccccucuggauggggccucuccugcccagcccucggugaggcuaggacaagggauggauggauggauggauggauggauggacagguggauggauggacagguggauggaugguuaugaggcaggugggaagggaugggcugcaccuccuggccauugcugagauugagggugggccuggaggugacucucuuuuccucuuuuucucugcacuuuuuauugcaccggccccugcuguccccuucucugucccucuggcaauagugccccacacgcugguacuggaagcugguuccuguaagugaggcugucuguuuugucuugucugccuguccugcuuguuucugucuugucugugucauuucugcuugauugccugcacaccccaacccccagcugugagcaauggagguagcacuccagcccuggggacugagagaacucuuuggaacuugagauggggggaggggaggaccucugucauuagcagggguagagcugggcauguuugugcaugucuguaauccugcugaggcaggaggauugcaaauuucaggccagccuagggcauaucuagagucccugucuuaaaagaaccacaaacagacugagagauaagaggauugaagcugaagagaugccuguaccuccagcuccaggggauccagcacccucuucuguccuccaucggcacuauaugcacaugcacguaccccauauacagacauguacauacacacauacaauaaaaauaaaucuuaaaacauucaaaaacaaaaaagcccaaaccagaaaguagaugagcuuuucauuaacuaagaagggaggaccugagccuguacuuagcuugagaagagggagcccccuugccuaccccguacguaggcagugaccucaaauugcagagacauagaaggaaucuuccuagccaagaggaagauccccagcuucccuaguuggguagaauuuugaggucuagaagauuuuaaauugucuuucuuccccuaauuagcuguaugauauuacaccauggucuaaaccucuccuugcuucacauaacuuacuccugaaguguauaaauacagggaccauguggauuggauagggguccccaccuuugcucacugcuccucccuaccuggggucuggguugggggguggauuauuuuaccuaccugcuucuuuugcauccucucccuaagccagggccuggggcuugucaagggaggcugcuuuugugggguuccucagggcugggaggagcugggguccccgaagccggccagaguaugauuagggagcuagauggccaaggcucaggacaggggucaguacuccuccuuuuuccagagggggcuuugggggcccagcaggccuugcugacggccgcuccuuccccccccagcacgcaauugccuucuguuugaaggagucggggaacaaacccccuaugguaauguaucccccuuccccggggucucaggaggccuugucccuaaccccugcugcuggccuggcugcucacagacaagucuucugccucuugcuucugucccucccuugcuccaggcuggccuccccuucccucccauucuggcucuggggaucugagcuucccaccccuucauggcagaaaucccaguuuucccuauuccagccugcaugacugccaacccggauauggccagccugacugcuaaccucacucucuuccuguccacagauucgauaucgcaaggaccgugccauugcccgaagggcucccugcuuuccaaaugugacuacccuucaggaccuggccaguggggcagcacuggcugccaccauccacugcuauuguccccagcuauuacgacuugagggugaguaguggauaagccagaccugauccuggaaaggcaucuccagucugcaagaccaguaugauucaguauugagcuaaggccuuacauagccuaggucagccuuggccucacuuugaaccucucugagugcuggggugacaggugcauaccaccauaucugguuuaggcagugugggggauggaacccagugcucaugcaugcuaggcaagaacuaccaacucagccacagugugugucuguauguguguguguguguaucaaaggauagccuugaacuccuauaauacucuugucucuaccuucuaaguauugauauuuacagucauguuccccaggccaaauuuaugggauccuggggauggaacccaggcuuuguauauuauauuauauuauauuauauuauauuauauuauauuauauuaugggcaggcacccuucuaacugaccuguauucccagcccuucaggaggauguuuuuauuugguuuuuauuuuuuagauuuuuuuuuuaguuuuaaaauauguauguauuguggggucugugcaugugugagugcaggugaccuuggagaaugcgauggauccccuguagcugggcucaucugaugugguauuugaaacuaaacucaagucaucugcaagagcaguauaugcucuuaacugccaagccaugucuccgaaaaaaggauuuugaggaagcugggagauggcuuaguugauaagcugcaaaaacauuaugaccugaguuuggguucuuagcaucuguauaaaguucucuguacagcagugagugccuauaaucccagggccagggagguggagacagagaggcucuggggacuugcuggccaacuaguagaaucaguaaauaucaguuucagugagagacccuaucuuggaaucuaagguagagagcacaugggaaggaagauaccuacuguugaccucuggucugcagacauguacacacaggugcacacauauacagaggacaagaagaaaacaauucuugcguuaagucuuagagggccaauacacuguaguaugcaccuuacaaaagguacacgacuuggcucaaaggagggcuucccuggaacucccaucuucuuuuccauugaguuggagacccauauauucuguccccacagaggugugccucaaggaccccaugucuguggcagacagucuauacaaccuccagcuggugcaagacuucugugccucccaucuuccucgaggcugcccccugucccuugaagacuugcuguaugucccaccaccccucaagguaaagccauccugguggugugggggugagacucaggaccugagguccauauccagggcugauuucccuuuggccugcaggucaaccugguggugcuguuggcugagauguauaugugcuuugagguucugaagccugauuuugugcaggccaaagacuugccugauggacauggugagcccuggggaccuggacuugccuuggggucuagaagaggguaaaggaacccugcucugcaugaccuuuuucuuugugcaccuaguagcugucuccccccggaauacagagacuguuccaucucagaacaacaguggcagcagguaugggucccuguuggaguggaguuucuccuucauggggcuucuuccugaccacuggcugcagggcuagggcugggacuaccugugagaggugacugaagguugaugaguaucuaucuguuuggcaguucuccugucuucaacuuccgucacccacuucugucaccuggugguccccagucuccacuccgaggauccacagguaaagagagaauauggcuucuauuaccaggaaacuucaacuacaagaauucuccagcugacuucauguugaguccuccaguggccuucauggggucuuucugacuuccuuuauggcuaggcuuugagaccccuugcaucagucaggugugaugguggauaccuuuaauccuagaacuaaggaggcagagauuggcagaguucucuguggguuggaggccaaccugagcuacauagagaauuccaguccagccaggauuacacagugagacccagucucaaacaaaacaaaacaaaacaaagaagacuccuuggaugauaccaagaaguagcaccaacugcuaauauuuggucauuucauuuuaauuuuuaaauucaaguuaucauucuuauauguacgggagcacauuugccuuaaugcauguguagagguccagagagaacaacuugcagaagcuaguucucucugguuaccgugcagguccccaguacugaacgcaggucaucaggcuuggaggcaagugcccuuaaccuguugagccaucucauugguccaaaagaaacugcaaacuguauucacaguacuggcaauugaacccaaggccucacauaugcuaggcaaguagugcauugcugagccaucccagaaguucagccagccauuucuggaaaccuagcauaaccagacacauaaugacccaucagugacucacuugaugacauuguagagguugucucagacaccagccaacccccagaucaguggcuucccccugcacagugaccauuuacugucccuccacaggcucccugaaguccucuccaucaaugucucacauggaggcucuuggcaaagccuggaaccgucagcuuaggugagugccucaucggggcccuguggccuuggaagagggauugagcugaucagggcauggcagaggccugucccaggggcugaccccucccucuggccgcccagccguccccucucccaggcugugucguucagcacucccuuuggccuggacagcgauguggaugucgucaugggagauccuguccugcuccgcuccgucagcucagacagucuggguccuccacguccugugucaacaucaucccggaauucugcucagccagccccagaaucuggagaccuacccacgauugaagaggcccugcagaucauucacagugcugagccccgacugcucccugauggggcugcugauggcaguuucuaccuccauucuccugagggucucuccaaaccaccacucucccccuacccucccgaaggagccucaaagccgcugucugauaggcucaacaaggcgccuaucuauauaucacacccugagaacccuucaaaaucaucucccugcucaacaggagagauacugaaaccaccacccccauccgaggguucccccaaagcuguggcuucauccccagcagccaacaacuccgaagugaagaugaccaguuuugcugaacgcaagaaacagcuggugaaggcugaggcugagucaggauuggggucuccaacauccacccccguagcaccugaggccuugagcucagagaugagugagcugggagccaggcuggaggagaagcgccgagccauagaggcacagaaacgacgcauugaggcaaucuuugccaagcauaggcagaggcugggcaagagcgcuuuccugcaggugcagccucgggaggcugcaggggaggccgaggaggaagcugagcugggcucaguuccugguggggaacggccagcaggugagggccagggugagccguccuuacggcacaagucaguuaccuucucuccagaccugggcccagugcccccagagggacuuggggauuacaauagagcagucaguaagcugagugccgcucugagcucucugcagcgggacaugcagaggcucacagaccagcaacagcggcuucuagccccuccagaagcuccuggaccugccccaccaccugcagccugggucauuccuggacccgccacugggccuaaagcagcaucccccagcccugcccgucgugccccagcugcccgacgcagcccugggccaggccccagcccaacaccccguaguccaaaacaugcaaggccggcagagcugaagcuugcaccuuugacaaggguacucacaccaccccaugauguagacagccucccucaccuacgcaaguuuucacccagccaggugccuguacagacucgcuccucuauccuccugucggaggggacaccucccgaggagcccaccaccaagccugcccucauugagaucccucuagccagccugggggagccugcugcugaugaggaaggagaugggagccccccuggggcugaggauuccuuagaggaagaggcaucuucugagggagagccccgaucagggcuuggauucuuuuauaaggugagucaccuuggcgggucagagggaaaaggugagccaguagguagauguaugaauggauggguaauggggaugccccuaggggguaguaagggagcugggaagugguggauauucagggauagagcuuuacuguugaguggguaaauugacauguauugccugauggauggauggauggauggauggauggauggauggauggauagcuggcugacuagggaguggcuggcuugcuggcuuucuuggauggauggauggauggauggauggauggauggauggauggauggguuggaaggguaguuagauggguggauaaguuaaaugggugagugagugguagguaugugauuaguuuggcuagguggauggaaagguagguggacaggcuggaugagugaugguagguugaaaggaagguggauaggugguugguuagauggauggaaggugguuugauagguggauagagggaagguuaauugguagauggacaaguaguaguugggcauauggaugggugagugggugauagacaggauggacagguguggguggguggauaagcagggcuagggugauccucuuuccugauguauccuguuugguaauccuccaucuucaugccacuuacggccugggccccugugcauacuguuguaacugagcagcgcacacucugcuccaguuggucauuacugcugcaaacccacuuuguuuguuuuuccugagcaguggagauuuugacugcucuucuuugcccugaggacaaaaugcccguccacugccuugggcccugcucccuugugacuuuaaccuggaucauuguccccaacucagugucucggcuacauggguuuguucuggccucaaggccuuugaacuuucuaaccccucugccuggagagugccccuaggcugggaguacuucuaagaagaccccagaauaggauagccugcagugcagcuuggcacacuucaagcaucuucauagcauugaaggucugugugucacuugcuagccuucccccuuugugcauuguguacacagcucccagggcugcucauaaaguagucacuaacuaaguacuccgaggauuuuagaaaggucaggagagcuuggcuaaugcuaaaagucagacuccaguuggcagaguggcuaguuaaacuccuaugacauccuccaggacgaagacaagccugaggaugagauggcucagaagcgagcuagccugcuggagcgucagcagaggcggguagaggaagcccggcggcgcaaacaguggcaggaggcagagaaggagcagaaacgggaggaggccgccaggugaggcuagaacuggaaugaggggccuggccuuugguauugcugccccagugcucccauauucuauccugcuugcuaccuucugucuaaucugcaggcuggcucaggaggcuccaggcuuggccuuuacaacuccuguuguagccucugcggcuccaguggccaccuuggcuccuacuaccagagccauggccccagcugaggaggaggugggcccccggcggggggacuucacaagacuugaguaugaacgccgggcacaacugaaacugauggaugaccuugauaaggugcuacggccccgggccucagggaccgggggaccagggcggggcgggcgcagggccacccggccacgcucugguugcugugaugacucggccuuggcacgaagcccagcccgcggccugcugggugaggacccuguuggaggggcccuaugauuguggagagagggagugucugguggcaugcagugauggggcaggaauuuggagugggcaugaguuccaguguggugaggguaacuuccuuccuuggcuggauagugaggaacucucuuggauauuugaggaugcuacuaaacagugcucccuucccuguagguauguggacaagaaugccaaacucagggcuggguuugucuggaauggaugaggcccuggguuaaaucccagagcuguauaagaaaaauugccauauuaagguagacagguuggcacaugccugucauugcgauacucaggagucugaagcaggaggauuuugaguuugguccuaaacuggcuguugagcagcuucucugcccauuuaggcuacaccuugagguccugcaccaaacacugaaacuaaggacacauaaacacacacacacacacacacacacacacacacacgaauaaguucagagugguggugguggcucuugguagaguacuugccuacccuagcguacacgaaacuucagguuccauccccaguuuuaaccaggaauggcaguuauaggccuauaacuccagcacugagaaaguagagacuggagacuuggucauccucaacaaauaggaaguuugaggccagccugggcuauagaagacccaucuuuaaaaaguaaaagccagacuggagaaacgacucagugguuaagagcaccuauugcucuuccagaggucccgaguucaguucuuagcaaccacaugugaccgacucacaaccaucuguaauugaguccagugccccccucugcugucauaagacagauacucguauaaauaaacaaaacuuagcaggcaaucacgaaaggcugagagggucucgggaaugcccaugggcguuaauggagguaaaggccuuagggauaacugacugguacugucuauccuagguucacggcucagcaaggucuauucccaguccacgcugucccuaucuacgguggccaacgaggcucccaauaaccuuggugugaagaggcccaccucucggugagucuaucuggaaccuagagcaagauauggcgggaccgcugggauguguagauggaaggaaguacaggaacacagaugggauuugggggaaacugacucaagucuggaggaugugcccacaugcaauguaggagguugagcauauggagcagcugucuauggacuuguggcagcaugcaauauacaugccccucuccucugcagugcacugggcuugccucgucccuaauccuguuguacccugggaggcuucacacacuacugaccccagcuucaccccuccccuccccugcagggccccuucuccaucaggccucaugucuccaagccgccugccuggcagucgagaacgugacugggagaauggaagcaaugcauccuccccagcaucagugccugaguacacagguaagugagaccggguaauguuagaagcuacgcguucucuaccugccuuuccccaacccacgcccagucucugcugacugacugcccuccagguccccggcuauacaaggaacccagcgccaagucuaacaaguuuaucauccacaaugccuugucacacugcugccuggcaggcaaggugaaugagccccagaagaacagaauucuagaggugagucccacagcugucuggguggguaagacuagcggguagagcaguaguccagccugaccagcuucuugccaccaucccucaggaaaucgagaaaagcaaggccaaccacuuccugauucucuuucgggacucaagcugccaguuccgggcccucuacacucugucuggggagacagaggagcuaucgaggcuggcaggcuaugggccucggaccgucacuccugccauggucgaaggcaucuauaaguacaacucggaucgcaaacgguucacccagaucccugcuaaaaccaugucuaugaguguagacgccuucacuauccagggacaccuuuggcaaagcaagaagcccaccacgcccaagaaggguggcgguacccccaaauagugcccaccuugggcagugcacuccuggguccugucuggucaugcuguggggggcugagcugggagcuucagugacucagggcucagcucaguccccuugucuguccuccacuuucuugaauaaaauaacugaaaagagaagcugagacacggugucuccucccuaagccugac

SEQ ID NO: 4251 - RNA, 21780 nt, Mus musculus
gucaggcuuagggaggagacaccgugucucagcuucucuuuucaguuauuuuauucaagaaaguggaggacagacaaggggacugagcugagcccugagucacugaagcucccagcucagccccccacagcaugaccagacaggacccaggagugcacugcccaaggugggcacuauuuggggguaccgccacccuucuugggcguggugggcuucuugcuuugccaaaggugucccuggauagugaaggcgucuacacucauagacaugguuuuagcagggaucugggugaaccguuugcgauccgaguuguacuuauagaugccuucgaccauggcaggagugacgguccgaggcccauagccugccagccucgauagcuccucugucuccccagacagaguguagagggcccggaacuggcagcuugagucccgaaagagaaucaggaagugguuggccuugcuuuucucgauuuccugagggaugguggcaagaagcuggucaggcuggacuacugcucuacccgcuagucuuacccacccagacagcugugggacucaccucuagaauucuguucuucuggggcucauucaccuugccugccaggcagcagugugacaaggcauuguggaugauaaacuuguuagacuuggcgcuggguuccuuguauagccggggaccuggagggcagucagucagcagagacugggcguggguuggggaaaggcagguagagaacgcguagcuucuaacauuacccggucucacuuaccuguguacucaggcacugaugcuggggaggaugcauugcuuccauucucccagucacguucucgacugccaggcaggcggcuuggagacaugaggccugauggagaaggggcccugcaggggaggggaggggugaagcuggggucaguagugugugaagccucccaggguacaacaggauuagggacgaggcaagcccagugcacugcagaggagaggggcauguauauugcaugcugccacaaguccauagacagcugcuccauaugcucaaccuccuacauugcaugugggcacauccuccagacuugagucaguuucccccaaaucccaucuguguuccuguacuuccuuccaucuacacaucccagcggucccgccauaucuugcucuagguuccagauagacucaccgagaggugggccucuucacaccaagguuauugggagccucguuggccaccguagauagggacagcguggacugggaauagaccuugcugagccgugaaccuaggauagacaguaccagucaguuaucccuaaggccuuuaccuccauuaacgcccaugggcauucccgagacccucucagccuuucgugauugccugcuaaguuuuguuuauuuauacgaguaucugucuuaugacagcagaggggggcacuggacucaauuacagaugguugugagucggucacaugugguugcuaagaacugaacucgggaccucuggaagagcaauaggugcucuuaaccacugagucguuucuccagucuggcuuuuacuuuuuaaagaugggucuucuauagcccaggcuggccucaaacuuccuauuuguugaggaugaccaagucuccagucucuacuuucucagugcuggaguuauaggccuauaacugccauuccugguuaaaacuggggauggaaccugaaguuucguguacgcuaggguaggcaaguacucuaccaagagccaccaccaccacucugaacuuauucguguguguguguguguguguguguguguguguguuuauguguccuuaguuucaguguuuggugcaggaccucaagguguagccuaaaugggcagagaagcugcucaacagccaguuuaggaccaaacucaaaauccuccugcuucagacuccugaguaucgcaaugacaggcaugugccaaccugucuaccuuaauauggcaauuuuucuuauacagcucugggauuuaacccagggccucauccauuccagacaaacccagcccugaguuuggcauucuuguccacauaccuacagggaagggagcacuguuuaguagcauccucaaauauccaagagaguuccucacuauccagccaaggaaggaaguuacccucaccacacuggaacucaugcccacuccaaauuccugccccaucacugcaugccaccagacacucccucucuccacaaucauagggccccuccaacaggguccucacccagcaggccgcgggcugggcuucgugccaaggccgagucaucacagcaaccagagcguggccggguggcccugcgcccgccccgcccuggucccccggucccugaggcccggggccguagcaccuuaucaaggucauccaucaguuucaguugugcccggcguucauacucaagucuugugaaguccccccgccgggggcccaccuccuccucagcuggggccauggcucugguaguaggagccaagguggccacuggagccgcagaggcuacaacaggaguuguaaaggccaagccuggagccuccugagccagccugcagauuagacagaagguagcaagcaggauagaauaugggagcacuggggcagcaauaccaaaggccaggccccucauuccaguucuagccucaccuggcggccuccucccguuucugcuccuucucugccuccugccacuguuugcgccgccgggcuuccucuacccgccucugcugacgcuccagcaggcuagcucgcuucugagccaucucauccucaggcuugucuucguccuggaggaugucauaggaguuuaacuagccacucugccaacuggagucugacuuuuagcauuagccaagcucuccugaccuuucuaaaauccucggaguacuuaguuagugacuacuuuaugagcagcccugggagcuguguacacaaugcacaaagggggaaggcuagcaagugacacacagaccuucaaugcuaugaagaugcuugaagugugccaagcugcacugcaggcuauccuauucuggggucuucuuagaaguacucccagccuaggggcacucuccaggcagagggguuagaaaguucaaaggccuugaggccagaacaaacccauguagccgagacacugaguuggggacaaugauccagguuaaagucacaagggagcagggcccaaggcaguggacgggcauuuuguccucagggcaaagaagagcagucaaaaucuccacugcucaggaaaaacaaacaaaguggguuugcagcaguaaugaccaacuggagcagagugugcgcugcucaguuacaacaguaugcacaggggcccaggccguaaguggcaugaagauggaggauuaccaaacaggauacaucaggaaagaggaucacccuagcccugcuuauccacccacccacaccuguccauccugucuaucacccacucacccauccauaugcccaacuacuacuuguccaucuaccaauuaaccuucccucuauccaccuaucaaaccaccuuccauccaucuaaccaaccaccuauccaccuuccuuucaaccuaccaucacucauccagccuguccaccuaccuuuccauccaccuagccaaacuaaucacauaccuaccacucacucacccauuuaacuuauccacccaucuaacuacccuuccaacccauccauccauccauccauccauccauccauccauccauccauccaagaaagccagcaagccagccacucccuagucagccagcuauccauccauccauccauccauccauccauccauccauccaucaggcaauacaugucaauuuacccacucaacaguaaagcucuaucccugaauauccaccacuucccagcucccuuacuacccccuaggggcauccccauuacccauccauucauacaucuaccuacuggcucaccuuuucccucugacccgccaaggugacucaccuuauaaaagaauccaagcccugaucggggcucucccucagaagaugccucuuccucuaaggaauccucagccccaggggggcucccaucuccuuccucaucagcagcaggcucccccaggcuggcuagagggaucucaaugagggcaggcuugguggugggcuccucgggagguguccccuccgacaggaggauagaggagcgagucuguacaggcaccuggcugggugaaaacuugcguaggugagggaggcugucuacaucaugggguggugugaguacccuugucaaaggugcaagcuucagcucugccggccuugcauguuuuggacuacgggguguugggcuggggccuggcccagggcugcgucgggcagcuggggcacgacgggcagggcugggggaugcugcuuuaggcccaguggcggguccaggaaugacccaggcugcaggugguggggcagguccaggagcuucuggaggggcuagaagccgcuguugcuggucugugagccucugcaugucccgcugcagagagcucagagcggcacucagcuuacugacugcucuauuguaauccccaagucccucugggggcacugggcccaggucuggagagaagguaacugacuugugccguaaggacggcucacccuggcccucaccugcuggccguuccccaccaggaacugagcccagcucagcuuccuccucggccuccccugcagccucccgaggcugcaccugcaggaaagcgcucuugcccagccucugccuaugcuuggcaaagauugccucaaugcgucguuucugugccucuauggcucggcgcuucuccuccagccuggcucccagcucacucaucucugagcucaaggccucaggugcuacggggguggauguuggagaccccaauccugacucagccucagccuucaccagcuguuucuugcguucagcaaaacuggucaucuucacuucggaguuguuggcugcuggggaugaagccacagcuuugggggaacccucggauggggguggugguuucaguaucucuccuguugagcagggagaugauuuugaaggguucucagggugugauauauagauaggcgccuuguugagccuaucagacagcggcuuugaggcuccuucgggaggguagggggagaguggugguuuggagagacccucaggagaauggagguagaaacugccaucagcagccccaucagggagcagucggggcucagcacugugaaugaucugcagggccucuucaaucguggguaggucuccagauucuggggcuggcugagcagaauuccgggaugauguugacacaggacguggaggacccagacugucugagcugacggagcggagcaggacaggaucucccaugacgacauccacaucgcuguccaggccaaagggagugcugaacgacacagccugggagaggggacggcugggcggccagagggaggggucagccccugggacaggccucugccaugcccugaucagcucaaucccucuuccaaggccacagggccccgaugaggcacucaccuaagcugacgguuccaggcuuugccaagagccuccaugugagacauugauggagaggacuucagggagccuguggagggacaguaaauggucacugugcagggggaagccacugaucuggggguuggcuggugucugagacaaccucuacaaugucaucaagugagucacugaugggucauuaugugucugguuaugcuagguuuccagaaauggcuggcugaacuucugggauggcucagcaaugcacuacuugccuagcauaugugaggccuuggguucaauugccaguacugugaauacaguuugcaguuucuuuuggaccaaugagauggcucaacagguuaagggcacuugccuccaagccugaugaccugcguucaguacuggggaccugcacgguaaccagagagaacuagcuucugcaaguuguucucucuggaccucuacacaugcauuaaggcaaaugugcucccguacauauaagaaugauaacuugaauuuaaaaauuaaaaugaaaugaccaaauauuagcaguuggugcuacuucuugguaucauccaaggagucuucuuuguuuuguuuuguuuuguuugagacugggucucacuguguaauccuggcuggacuggaauucucuauguagcucagguuggccuccaacccacagagaacucugccaaucucugccuccuuaguucuaggauuaaagguauccaccaucacaccugacugaugcaaggggucucaaagccuagccauaaaggaagucagaaagaccccaugaaggccacuggaggacucaacaugaagucagcuggagaauucuuguaguugaaguuuccugguaauagaagccauauucucucuuuaccuguggauccucggaguggagacuggggaccaccaggugacagaagugggugacggaaguugaagacaggagaacugccaaacagauagauacucaucaaccuucagucaccucucacagguagucccagcccuagcccugcagccaguggucaggaagaagccccaugaaggagaaacuccacuccaacagggacccauaccugcugccacuguuguucugagauggaacagucucuguauuccggggggagacagcuacuaggugcacaaagaaaaaggucaugcagagcaggguuccuuuacccucuucuagaccccaaggcaaguccagguccccagggcucaccauguccaucaggcaagucuuuggccugcacaaaaucaggcuucagaaccucaaagcacauauacaucucagccaacagcaccaccagguugaccugcaggccaaagggaaaucagcccuggauauggaccucagguccugagucucacccccacaccaccaggauggcuuuaccuugagggguggugggacauacagcaagucuucaagggacagggggcagccucgaggaagaugggaggcacagaagucuugcaccagcuggagguuguauagacugucugccacagacaugggguccuugaggcacaccucuguggggacagaauauaugggucuccaacucaauggaaaagaagaugggaguuccagggaagcccuccuuugagccaagucguguaccuuuuguaaggugcauacuacaguguauuggcccucuaagacuuaacgcaagaauuguuuucuucuuguccucuguauaugugugcaccuguguguacaugucugcagaccagaggucaacaguagguaucuuccuucccaugugcucucuaccuuagauuccaagauagggucucucacugaaacugauauuuacugauucuacuaguuggccagcaaguccccagagccucucugucuccaccucccuggcccugggauuauaggcacucacugcuguacagagaacuuuauacagaugcuaagaacccaaacucaggucauaauguuuuugcagcuuaucaacuaagccaucucccagcuuccucaaaauccuuuuuucggagacauggcuuggcaguuaagagcauauacugcucuugcagaugacuugaguuuaguuucaaauaccacaucagaugagcccagcuacaggggauccaucgcauucuccaaggucaccugcacucacacaugcacagaccccacaauacauacauauuuuaaaacuaaaaaaaaaaucuaaaaaauaaaaaccaaauaaaaacauccuccugaagggcugggaauacaggucaguuagaagggugccugcccauaauauaauauaauauaauauaauauaauauaauauaauauaauauacaaagccuggguuccauccccaggaucccauaaauuuggccuggggaacaugacuguaaauaucaauacuuagaagguagagacaagaguauuauaggaguucaaggcuauccuuugauacacacacacacacauacagacacacacuguggcugaguugguaguucuugccuagcaugcaugagcacuggguuccaucccccacacugccuaaaccagauauggugguaugcaccugucaccccagcacucagagagguucaaagugaggccaaggcugaccuaggcuauguaaggccuuagcucaauacugaaucauacuggucuugcagacuggagaugccuuuccaggaucaggucuggcuuauccacuacucacccucaagucguaauagcuggggacaauagcaguggaugguggcagccagugcugccccacuggccagguccugaaggguagucacauuuggaaagcagggagcccuucgggcaauggcacgguccuugcgauaucgaaucuguggacaggaagagagugagguuagcagucaggcuggccauauccggguuggcagucaugcaggcuggaauagggaaaacugggauuucugccaugaaggggugggaagcucagauccccagagccagaaugggagggaaggggaggccagccuggagcaagggagggacagaagcaagaggcagaagacuugucugugagcagccaggccagcagcagggguuagggacaaggccuccugagaccccggggaagggggauacauuaccauaggggguuuguuccccgacuccuucaaacagaaggcaauugcgugcuggggggggaaggagcggccgucagcaaggccugcugggcccccaaagcccccucuggaaaaaggaggaguacugaccccuguccugagccuuggccaucuagcucccuaaucauacucuggccggcuucggggaccccagcuccucccagcccugaggaaccccacaaaagcagccucccuugacaagccccaggcccuggcuuagggagaggaugcaaaagaagcagguagguaaaauaauccaccccccaacccagaccccagguagggaggagcagugagcaaagguggggaccccuauccaauccacauggucccuguauuuauacacuucaggaguaaguuaugugaagcaaggagagguuuagaccaugguguaauaucauacagcuaauuaggggaagaaagacaauuuaaaaucuucuagaccucaaaauucuacccaacuagggaagcuggggaucuuccucuuggcuaggaagauuccuucuaugucucugcaauuugaggucacugccuacguacgggguaggcaagggggcucccucuucucaagcuaaguacaggcucagguccucccuucuuaguuaaugaaaagcucaucuacuuucugguuugggcuuuuuuguuuuugaauguuuuaagauuuauuuuuauuguauguguguauguacaugucuguauaugggguacgugcaugugcauauagugccgauggaggacagaagagggugcuggauccccuggagcuggagguacaggcaucucuucagcuucaauccucuuaucucucagucuguuugugguucuuuuaagacagggacucuagauaugcccuaggcuggccugaaauuugcaauccuccugccucagcaggauuacagacaugcacaaacaugcccagcucuaccccugcuaaugacagagguccuccccuccccccaucucaaguuccaaagaguucucucaguccccagggcuggagugcuaccuccauugcucacagcuggggguuggggugugcaggcaaucaagcagaaaugacacagacaagacagaaacaagcaggacaggcagacaagacaaaacagacagccucacuuacaggaaccagcuuccaguaccagcguguggggcacuauugccagagggacagagaaggggacagcaggggccggugcaauaaaaagugcagagaaaaagaggaaaagagagucaccuccaggcccacccucaaucucagcaauggccaggaggugcagcccaucccuucccaccugccucauaaccauccauccaccuguccauccauccaccuguccauccauccauccauccauccauccaucccuuguccuagccucaccgagggcugggcaggagaggccccauccagaggggcugcaggagaugcacgcugggcugcuucuuguucugucuucuccugcagccgccgaacagucuaggggucagagagaagucagugccuggucacuuggcuaacgucauugucuccacuccacauggccuggcccacccuacuuacugugucuacccagaaaaggaguuugugcuccaagcugcucagagccaagggaccagguagugucuuuguccacucaaaugagaaggcaaccaugagagcaucgaugacagcuaggugggcucccuguuggggcaaaggcuggaagaugagaccagaagacugggcagggagcuacucuuucugccuccaaucccagagaagugggaggaguggggccagggaaugguguggggucagggauugcugggugggaccuugagagcuacaguuaugaaagaggucacacaugggcuggguuuugagcuaagacaccaggauuuacaauagaguagcccaucuagagaaaccaaggccagaacuggaggaaccugaggaguggaaggguauagcaacuugagggaggagccagguaugaucugcagaacugagugugacacccuuagcuugauggaaaagcuaggcuuggaaaauggagguaggcuugauagggggagcuaagcuuugugggaggggcuaaaacugguuggaggagcuacaccuaaugggcugagcuugagggcauggcuagaggaaccauuuggggaguguaacgagaauuaguggguagagccugaagggagguucaagcacaagcuagaaacuuugcaggaaagugcaaaggggaggagccaagccugguaggcagggcuucauaggucaggagcagagccuaccaugagaauuggcugguguuucaggucagccucgcgcacugggugcucaggcagugaaggcaccgugccccuccucgccagcaaggccaacagagcagagggacugggggauggcucgagcuguggcagugccuggcgccaggcccgacaguauaguuccgcagagagcagcagccgcgucacugggggcuucacgugcuccugugcguacugaucgguguagaaggguucccacagcuccggaggcacaugcucugcauuggggaggggcacagcaggucagaucaacacauaacccaucugcucacucuucuacaaaguacaugaucgaaaagaaggaauggucuggacuaggaacuacagagucaggcauauagguacaagccagggcuguguguguguguguacgcgcaugugcacacacaugugccauacgagugcccucagaggccagaagaggguggguaccagucagaccuccagaagcuaaaguuacagauaguugugagccaccagacauggguucugggaaauauggcuguguucucuaggagaguaggcagagcucucgacagcugagcacauccacugagguuuugagacagaaucucucccuaaacauuggcuuugccauuccagcugaacuagcugauccaugagcccccugggauccaugcaucucuaccucuccagagcuuagguuacagucuguccaguucuccuuuucccuagauaccgggguucugaacucaagcccuccagcuuucccagcgagccccuguaccacugagguuucucaucuccucugcaucuauuuggcuagauuucagagguugaguuucauguaucccaagguagccucaaaacugccugguagcuaagaaugaccuugaauuucggauccucccacuuuaaccuccagaggccuaagauuacaggcaugcaccaccgugccuaguuuagggcaugcccgacuagggacagaacucagggcuucccccaugcuucuguagccucaucgagcaccauccuuaucccuggaaacuucguuuuacagaugggaacaaacuucacagaaaauguacagggacggaaagugaccagccuaaggcuacgugggucuccagugccaggacugagacucaaacucaggccuuaagcaaacucuauccccucugucaucuuaguggcugggaugagugugaagucaccuacaggauaaagaugccaaagucaggcagagagcaaguacuuugaggaaauugagggaguuaaguuuggugugugccaggccuuggggguacucucaaagcagagggcauaaggaguagggucuuaagagaauacugaguucagccauacuuaaaggguacuuagccaggcccaacauguacagcuguaauccucgccuugggaaacugagaaaggagcuucacaccagcccaggcuagaagcaguaacaagccagugagugcuaggacacccugauucaaaaugcccaccaaaagcugaguaugguggcccaugugauugcugucaaagcuagccagggcuacugggaggcccucaucuuuaaaaaaaaaaaaaaaaagaaaaaaaaaaaaaaagaaaaguggucaauaacauggcucaacauugccauaaagccagacaaccugaguuccaucuccaagacccacacaguggaaggaaagaaccaaccccaacaaguuacccucugaccuucauauauacaccguagccugaauagcccccucaacacacacacaaauaaaauaugaaggggggggcagaggauggauaagugggaaaaggugcuugcuguuaaguaacaacccaaaggucagccuccagaacccacgugaaggugggaagaaaaacccaacuccaccguguuagccgcuaacccccacacaugcagcagaggaagcagucuccucacaugcauacuauaauaaacuuacuggggggcugggggaaccagcuagguguggcaggcaacaccuguacauucagcacuugggaagcugaggcagaaaaacugcugaaagcucaaggccaggccgcgguacauuaacucccuggccauccuagacuacaaagagaggcucuaucuuaaaaaacgagaaaaaggggaaaaaaaaaaagaaaaaaagaguccaggaggaaguugauaguggauggcauaaaaauacauuguauacauauguguaugaaauugucaaagaacaaaguaucuuuuaaaaagaggagaaaaccaggaagaacuccugagguuaggguagaugugacuaauuaagaucacuuggucagggacugccuuaauuccuguuucaauuagcccagcuguugcauguguguaaaaaccguaagagaagcacugaagcaaggacuccaggguagaaaaagauacauuagaccauucauacuugguugugguaaauauuacuugaggaauuuuaucccacuuagaccauauaguucccaaguaaaagacacaaaggcuuuuauauuuauaauaacucuuaaagcauuagagauggacagauauccgcccucuaagcuauuuugucuauauuaacuccaagauaucacuugccauguuccaccugggccgugccuguuccaacagcugggccucguggccaugaagaccccauggcaacuucuucuuuccccucccucuccauccuggacacugccucagaccccgagcccuggaaccuucccaccaucccuucucuucugcccagcccaggcugaaggcaucugugccggcugguuuugugugucaacuugacacaagcuggaguuuucacagagaaaggagccucccuugaggaaaugccuccaugagauccagcuguaaggcauuuucucaauuagugaucaagggaggagggcccaugguggguggugccaucccuggguugguaaucuuggguucuauaagaaagcaacuugagcaagccaggggaagcaagccaguaaagaacaucccuccauggccucugcaucagcuccugcuuccugaccugcuugaguuccaguccugacuuccuuuaaagaugaacagcaauguggaaguguaagcugaauaaacccuuuccuuccuccccaacuugcuucuuagucauaauguuugugcaggaauagaaacccugacuaagacagcaucuuuauuaacuagucagggauaacuuggagggcaagguucacacaacaacgacugguauauaugaggauucauuucucuugaagcaaccagaucuugggguacagaauuuagcauuugaauacaagcaaugccagaacaacccccuacaauucuucauaaucaggcucccaagagaccacuugacauaggaccugacaucauuaacaggaaccccuucuugccacaucuccuuccacaccuccaaaauccacacuugaccuucccacuaaggacugcacuccuauggagagcugagugcaacuaccugccuuagcuuugcucuuugaaggaugagagauuucaaguuggcuagauggcucggcaaguaaaggcacuugccaucuacucucuaaaccugagcuugauguccaggccacaugugacggaggggagaaccaacuucuaacaaguuguccucugacuuucauaugugugccgcaacaggcacagcauugucacacacacacacacacacacacacacacacacuucuuuaaugaaauuuuuaaaauuuuaaagaaagaugaagaauuugaacauucacugaagggacucuguccagcucgaucguggcuugccuuucucccccauucucucugccuagcuaaaaauccccuggauugcauuccugaagcuagccccuaaggucuauucccuuauuuggccacuuccucuuccuuagggcugacuaccaacguccaguuaucaaaauauugaaguacaacagucaaaagccccucguggcugcccuaauuaaccugucuaauuaaaauuaagccucaucuuaucgcaggguuucccccuuuaccuuuauaaaccauuugccuaugggccacaucuguguucucuaaauccagaggcaguccuuuguuccccacugggacaaauaccccuuccccuucucccuuuccccuucucuccccucucucucccuugacccuuccccuucucccuccuuaucuccugucuuuguccuuuauuccugugcucuguuccucugggacaaauacauauccuuugugcugagaacuuggucuuggcgguccugucuuuccucucccucaccuccuccugccccuugccuccacugccacuucccccugccuaaaccucauggcccuggcuuccauccuagacccagcuucugcucuccuguuccuagccuccccaaggccaacagcagccagccaaacacacacccacuggcccacaaugcaccugggcucugugcccaguaccuccuuccagaauccuuccuccugcuaucuuacuccaaagggacaagucccaccccaccuuguggaggcucgggaguccaucugauugccuccugcugcagacugggaugugucguccugcuccuccacccuggcauugcccacuacccucccccaaucuacauccuagugaugauaaucaccaucuuuuccugccuuucccugccccacgaugcauccaaccuccugacaucacucugacccuucuccuauacccagucuccucuaaggcucagucaugagcccuuccuguucccaagagcaaaacguuaggacuuucucugaggaagaaaaauggccuagagccccuucucacugacuucugcuucauuuuguuuugaaacagggucuuuuggggcccaggccagccucaaacuugcuccauagccaaggacgaacuccaacauccaaucugccucucccucaccagugcuagaaugacagccgucuaacugccaccacaccuaguuuaugccaugcuggagauuaaaugccgggccgcgggcaugcuaggcagcaacuccaucaacugaguuacaucuacagccaucaucucagacgugcaucaaguacuuggucuacaucugggaugaggggauaaggguaguauugugugagguugagcaaaaccaugagucacuacucaugacugucaguagcauuuuccuucaauguagagauagucagcagggcauggucagcagccacacucgggagaguucaaggccacccugggcuauauaaugagaucauuccaaaaaggcaaaauugccagaugagguaacucaugccaacaaccccaacauuuugaaggcugaagcaggagaacagguucaaugucagcuugaucuaucuauauaggguauucugagacaguauuauacucuguuauaguucaggcuaucuaaacaaaacaaaauguauacccauggcgugcgcgcgcgcacacacacgcacacacgcacacacacacacacgcuaaguaaaagcgauaagauuuauuaaaaacuaaaaugcugagcugagcagcgauggcacacacaauuaaucccagcacucggauuagagagguagagacaggugggucucugugaguucaaggcgagccuguucuacagagcuagauucaagacagucaaggcuauauguagaaacccugucucaaaaaacccaaaguaagagaugauucagcguuuaugaggcccugaguucaauucccagcaaccacaugguggcccacaaccaucuguaaugggauccaauggccuuccucuucuccugugugugaagacaacaacaguguacucauauacauaaaauaaauaaaucuuaaacaaacaaaaaucaaaugaauaaaaggguaaaaaauacuaaaaguaaaaacuuaaaagcagaaaaaagaacuauuaauuuggugacaguuuacucagcccaauccuguucaaaaaccacugcaauauacaaggaguagcaaaucauugacugaugauuugauuugugguuuuguuuuuguuuuugagguaaagucuuuuguagccuaggguggcuucaaaugcucacagaagcugaagaugaccuugaacuuuugaucuuucuaccucuaccacucaacuauccagaugacagcugugcccugccaugcccgguuucuguguuccugggcauggaacgcacagcuuccuacacugggaaagaacuccuucagggagccacauccccaaccuguauuauguuguauuaugcugcuuuuguuuucucuucuuuggauagaagauuuuuuauacagccuaggguggcuuugaacccaugauccuucugccuaugccuccccuguauugggauaacuaguguggaccaccacacuuugauccaguguuuauauuaacugcacaucaggauuauaccaguuauaagcauucaauaaccacauaggggcuaaucccaaccccacuagacaggaaauuuccauaacacagcuaauauuuacucauuccaugaccgucugugccuuuaacccuacaacacacuuuuguuauugaccuggcaaauaaggucuuucuugucuccuguaugacugaccuacauccuuaacccccaaaacacuuauucuaacaccauuguacagauaaggaaaccacagcucacacagcuaagguagcuuacccaaaaucacacagccagaaaauggcggagcccaaaugaaaccaguuucccucacacaccucucuccuauuugcaaggccuaaggaauggcaguugguauuccacacauuuacacagaagccuuucuuaucuccaagucugucucuccugagcccaccagcuugcauuccucacaccuugccuugggggacaccagaacuaccccuuccuaagucugugugagcuccuuggugcccagacaccuucucuggcuccccagugcccucccuuggaucuuaaucugagagguccuccuucugaagcccacucugcacccucuugcucugaccuccaggcaccauggggagcuucaugcucuccucuaagcagcuugcagccauaggcugcuccccuugguggucucaagacagcuucucaggggaaccccccuuccucacccaccccccucuggaaaaucuugggaacuuucuccugcagacccagcugcuuggaccacacugggucuuaccacaguagguauccaggaccuaauuuggugcccauccccauucuccuggaucucucccagcaucuccuccacacccuaagcaccaagcauuggcucccuguagaaaggugucuguaaagaaacccaaguggcagggccuggugguaugaaccuauuuacccagcaaaucagagaggggcuggagguguggcuccgugguacaguggcucccuagcaucccccaaugaggggcuggggucacagcucagcugguagacacucccuagcauagggcccuaggcugcaacccaagugcuggcaauuaccaaucaaaaacaaacaaacaaacaaacaaacaacaauaaaacugcaccaggaagagaggauuuuuggcugguaaaggcacuugccaccaagcccgauaaccugaauucuaucccugacaccuacacaaccaaggagcaagaacaaaaaacccuaaccugucugacugccacacaagcccugggacacccagaggcaggcacacacacacacacacacacacacacacacacacacacacacacacacacacacacauaacuauauuuuaaagaugaccuggccuugaucuguuccucagcaucuccccccagcccccaccuccuugucugggagggagacacagguagcugagagcugaaucugauccugagccagcugcagccacugaguagugcugcauggugcaaggggcugggucaacagaagagaaaugugugaaucugagcaugaagguccccuccaggggcuucccuucugcaaacuuacagaguaacuucugcacgguccucugccuaagagacacugggaggcacugauaaaauacucucaccagccacagcagcugccauagugaacacugaccaagcugugucuugugccacaucagacaaucaagucaccucucaacaaccuaguucagcagagaaaggugcuugccagcaagucuaacaaucugagauugacccccagggcccaugcuguucucugaccuccacauaggugccccccacacacacaccaauaagaaaauaaauauaacuuuaaaacaaguaauggaguugaaaacccacugcaugacaccacaggcaagcaacuucuaugugauuucaggcacagauauguaaguggacaaacaccuuuuucuuuuuucuuuuucuuaaauaaaaaaagaaacagaaguucagagaaccugaauuauucuuccacaccagcuguccuggucagggcugggccucaaacucaaccaugacuuaacagaguugggcuccuggcuggcaagauugcccaguggguagagguaccuauuucagaagacccgaugaaguguucaggugacaaggaugauguuuuguggugguucucugaccuccauccacauguuguggugcaugcccaugcuuacauacacaggcaaugauaaaaaaaucaaaauuaaaaagcucaggaagccagccuuucuaaucuaauuaucucggccuugugaggggcugggacagaggucccaacucccaaaucuuuucuuucucaggccccaggucccugggggugugcaggugucagaggcagcuggccagccacacagggaggagagcgguaagagagacuacuagaaagugggaaagacaggacugugcagaagcaacugauggacagcugucacaggagacccacacccggaacaggcuggucugggaaggcaauggagugggggaggggcugcaccuacuuagugccaagaucaguaggagggcagggcauuucccaccaccaccacauacacacacacacacacacacacacacacacacacacacacauucacauacacucacacucuguuccugccuucucucucucucugcaucuuugcaucucuguuucugucucucccccucuccuucucucuaucucuaucuguuccuacugucucuaucuuuuucugucucugugcauguaugucucguucuucuacucccaguaaggccuagaccuuaaugaaccucuguuuuucccaaggccaagccuggccucccaguucuauccugugguggcugaagcugcccaaagccaggacuuggagagccuucccaggucugauaauccaccuuccucauuugcccaguaggaauggcccuaguccuucaggccugugggcaugcggaagggaggagaaaagggguggcuucaauaagagaaggccuggccgcccgagcugccacccuagaacagcuggugaaugagccauuuaugccuaccugaauccucaggaaaauguggcaauaagucacaacugccagccuuuacggggccaucgagacgaaagaguggucccagacacaccacacacacacacacacacacacacacacacacacacacacacgcuggccaccggcaaggcaggguuugugucccagucacugagcuguagcucugaucucuuaaaacgcuccuugcgggguccaagccaccgcguacacguugugaggguagauagggaagguggggguaggaggaaccaucacaggcuucugaugugugugaaaggggaguuggccaugcaguuaggcccuggggucugaggaguggggugggaggcgggaagcagaggacuaccaggagacccuucccccaccacacacaaaauuggucugcagaccccaccccugcucaccugggggcucugaucccggggucccaaggcgcacagccucuuggcgggccccacccccgacugcguuccagcgacccgggcgggcaaaguccaagggccccguccgagcaggaagcuuggaggcccagcuuagcaaagaccaaaagcucggggacccuaggcagccccgaagcuauuguucccacggccccggcuuggcgccccgccccccgcaccugccgcgccccagccuggcucccccgguccccuccccaaaggcccucggguuaccugcucccccgaaugcggcccgcagcacccacgccagacucgccgccgccuuggcucgagagaaaucguacugguccaaagacuugaucucggggaccaggaaaguccuccgcaguggcccggacccugcgggcgccgcuuccaccauggcgacgccgggguuacggccgcccggguccgcgcgcucugaugggcugggcugcgugcgcugcgcugcgcugcgcugcugccgagccuccgccaccccgaaucggguugccgccgcggcugcugcuguuacuaauaaagcugcugaggcgccgcugaaccaggugcggucgagcgcgcuggcgacgcggcgucgaccccgccccaaggcggaacccaggugcgccccgcccccagauuggacucaguucucucuggcuccuggguccacauggguccccacugacauuaaagcuuccauagguccuccugcugcaaagggcggcagugauggcggaugagggaagggcugcagaagaacgcaugucccuguaugcguucucgugugugugugugugugugugugugugugugugugugugugugcgcgcgcgcgcguguguuccugcucacucccggacccuggagaggcuuagggacccuuugucauggauguccauguaggcuuuugauccc

SEQ ID NO: 4252 - RNA, 12898 nt, Mus musculus
gccaagucuaacaaguuuaucauccacaaugccuugucacacugcugccuggcaggcaaggugaaugagccccagaagaacagaauucuagaggugagucccacagcugucuggguggguaagacuagcggguagagcaguaguccagccugaccagcuucuugccaccaucccucaggaaaucgagaaaagcaaggccaaccacuuccugauucucuuucgggacucaagcugccaguuccgggcccucuacacucugucuggggagacagaggagcuaucgaggcuggcaggcuaugggccucggaccgucacuccugccauggucgaaggcaucuauaaguacaacucggaucgcaaacgguucacccagaucccugcuaaaaccaugucuaugaguguagacgccuucacuauccagggacaccuuuggcaaagcaagaagcccaccacgcccaagaaggguggcgguacccccaaauagugcccaccuugggcagugcacuccuggguccugucuggucaugcuguggggggcugagcugggagcuucagugacucagggcucagcucaguccccuugucuguccuccacuuucuugaauaaaauaacugaaaagagaagcugagacacggugucuccucccuaagccugaccaaguuuacgucucguguuuucacaagcccuaccuugucgucuuugcccuuuugcuggcccuguggcagcuccugccaacaucuguggugaccuuccuguugacacucccuccucuagauguucucagccaccucugaucugaccuggcaagagauuccagaccagcucuccucuccugggccuccuccacccccacauuuuccuccuccgugugguugcauuuggugugcagccaacuucuaacccgaucccuguuuccuguugccaaccugccuucauuucugagcccaguuacagucucugagcuggggauucuguguccuuccucagagccccuuaucagaggaucuaguugccacuguaggugcagaguucagauguuaggcucacuacagccuugcuucccagauacugccaaauuguauagaacucaccccuccagcuaucccaugguccaagccaauagccugucuccaacugcgcccugcucacacggcagccugcgugaccggcucaaacacaaaucugauuaugucuccugaugccaaaagccccuuaaugaucuagaggccacuaauggcuucccagagcuuaagcuagaagggcuccacccuggauguggccuguacaccaggccugguguuuggccuuuagccagggauacaagcaccuugcuaguagguccacggagccuauuacuacauggagacacaaggguuugugaacucccggaucuaugacacccacguaaguagggccaggugucccucgguuuggggcucaaggagguuucuuacugggcaagccugacaagaggccugggauggggcaggggaacuggcccugcagcguccagaacuggcucugcagggugagggcagguuguccacaugccauauccccugacuacuccaccuccugucccagccaaucagugcugagagccaggcaguucuaagcuagcacgcccugaggcaccuggacggcaggaaggaggucaagaccgggauguacaaagaggggauguauuagaaggguaguuaugggggagugaccauggaagaaaaaguguggagggagucagucuuccuuuaggcucccgaacacagcagcugguacacucugcuguuccagucggacuucugugggggaaaagaaguggggucaagguggggguggaugggggguggcccaccucugcucuuaacccuggccccugggcuggccacugaccauugggcuccagguccaucucguccucguccucauccucgcccagcuggaucuccucaggguuggccugcugagccagcucugccaauuccucccuggaugcaucacuccuaggguuucgagagggaagcugguagcugccagcugcuucaguggacccccuccagcccccagcagcuucucuggaauaccccuuuccuaagaaggacuggcccaccccccaccugcucucaccucacaaagaagaucuugcucugggcccuggggggcuggucccgcuccgccucagcugccagcuguucugcucucuguuccagcagcuucaugucauccaugccacucugcccaggagccaggucagacacuggaggugcagggccaaugagggagagaagguuaagguuagaccucaagcccucuccaaaugcugccaggccuaggaagccuaggcugggccgugagugcucugggacagggcagacauugcuccauguggccuagccaugaaaaggaaaggggggguuaaagaagcucaccggugccuguggcacugcccgacaccuugagcaucugugaagccaugaaguugaccugaguauuguauguggccugcacacuccgccguauccucagcaucucccugaugguauccucauugccgugccgaaccucaaaguccuuccauguuugccagaaugccccaguugucugugguggggcgcaggcaugugguugagccaggugcuuggcacagcauccccacugcccacccucaccucuccaacacuaggcacaacccguacccggggaucacagaucugggagcagaagcuguagauggcccgggcgcggucgauuucaccgagcuugcacuccaugucugcaaaccgcaggcacaucucacgggcaugcucaucagacagcaccuggcaccauggggucagggagagcaggggugaaggaaaggggucccagugccugccuguaggaaagccuucugccauccucuccacaggcaggcuuucugggauccuucugucugcauggaccccaaccccauaccaggucacuagugguggguaccucaauggccuucugguagaugccacgagugugggugacgccauagaucucagcagcucgcuugauguagauguuaaacaugucguacugcugugcuggcuccacugcccuggucgcacggucauacacagccauggcauggcgggcaaggccccacuccuccuccagcugugcguagagcagguauaaagcugcacacacaaggguccaguuagcagcgcgccacucagcacaugcuacucauccccacgucccaugacagcccacagacuccucacucuuggcauauuuuggugggcagccaucgagugccugcucaaagagaucccgugcacgcuccagcuuucggcccccauagcgcgagaugaauuuggucagguaggugcuccagaugucugaaacauugggccacuugaacagugagaugccacgcucauaugccuguuuccaaggaagccagguauuagcacccagaugcccuugcccaccccuccaucuuggcaaaguuaagcaugucacccuguuuccccccaccaacuacaggagcuaaggcaggggugcaauagggacuuucuaaacacagucugauaccucauggacaagguagcuccuaagcucuacagacacaggugcccagguccugggcagagguuagggacacaagaacagaugcagccucccuaucuguguaccugccuauggccacacugugcugacccacacacuauuaccugaacagaaaccaaggggagcugcacacauagcucccaccuuuguccuauuucccccaaggccuugcaguagcuggcuaugggagaagaacccauaucccacaguguucacaugcugagacccugaugcccagggccuuaugcaagcacuuauuuuggaaaugaggaaaaggacuuaaaaugaccucguuagcauggaccuuaccagccacaacuaguggcuuuacaagagaucaaaggcugagauguugcucagugguaagagccccugcuuugaaugcccaaaguucuggguuccauauauaccacugccaaaaggaaaagaaauuacccccgugacaguuacuauugucaaccuaacaggauguagaauaaccuaagggacaaacuuuagcuaugucugcgaaggauuaucucgauccuaugaacugaagcagacugauccaucuuaaaugggggugggcgccaucucaugggcugagauccuagacuacaaaaggagaaaacgagccaguucccaacauucauccuccugugcaucccucugcaggugcagcacagucagccacagguuuucugcugccaugccuugccuugcccaccagugauuguauccucugugagccagaacgaagucuucucccuuaacuugcuuccgucagagguuugguuucauguucccaaacacacauguacacaggcagugacagugagaggacagugaagacaguggagacacauggacaccugcagaccaugagggagugccuucccugcagaccaugaaugaggaagugccuugccgugccuuugaccugcaccucggggcuugccucaccuugaagcucuccucaaaguacuugugcuccuccaggaacauggcauaguuaauaacgaucuguggcguggcuaugcgcagguccaggauucggucauacacggccuugguugacugugggaacaaacgggucagggcacacucugcucugaagccgagaaccagcuccacuucaccccugucuacgguagcugaccuggaaagugcccaggcuuuccuccaagucggcaagcauggaccacaccuucagcgacuuauauacacgguucugcacagguucugaaccaucaaaguacucagcucggcgggcaggcaaagccguggcuuucuguggagaggcagaggcagaggcacugagggcugucccggcccacugcacaucccuggcuguccucacauccuuacccgcagcagcuuuaaggccucaucguaauucucgugccugagcucuagcuccccacacuggcaccacacacuugccaggucauccaccugcuugaaguucaccuugguggccuucucuaggaugacacgagccugugguaaugggcagagacuagcugaggucuugccacuuggccaccccaagucccguggugaaauguaauacacacaccgcacacucacaucauccagcuguccauugucuucguaaaacuuggcgaaugcaacccacaguguguggggcuugccuguggcuuugaaggggucuacuguuugcacagccucuguguauguguugauaaucuagagcaggaaggucacacaagugagggcaggguugggccauggcagcucuauggggcagaaggagacggguuggaaccaucacacaccucccgagggcggcccugauggagggcuacacgcuugugccacucguggacgugguguggguucuggcgcagaaggacacuauugagaagcaggggccgucggcugaugagcuguucgaagcgggccaggcgcagcucuagguccacaucgucuagaagccagauauguucaugaagccagggagacuggaggugauggauggcacaggcccugucuacuucuguuccuagcuucccuuccuccaagcccaguguuguagaccuaaagagccacgcugaccuccacgaaccuagcaccagcccuccugccaugccuguacucaauugagacuacgccaggauuucuuggcccaguguccauccagccccucuccuugacagccuguuccacaccaguggcuaggaacucaacccucuccucccgaguccauagaccuacgucguacccuccuccucacgccccaguucagaggcagucuccaucuucgcugcaaucaugcucuccucaaacugggcguagcugucgaacaccugggugaagucccgcacggucaucaccgugcggauggccuccucauacacaucccgagccugugggguucagguccagugugaggaaaaguccagaggagaggcgugagagcccgcccacaaggacccacugccagcauccccagcugaccaaugcugagcgaaggauagaagccugcuggccuguuccugcccugcacugccugucagucugaagcugaagggccaccuuuguaagcuggguagugucuuguguagcauggacgcaagauugaagugagaagaggugagcagccagacuucagcucccacagaacccugagcucagccugcugugaagcuuuuucuuccuaaucccaacaauccguucuggagggagggagucagucucugaaggcucagaaaguaaaugagacguguaagagucacaagaccuccccccaccccaaguuaugcaaacaguaacaacugcuaggggagacucuccaagcaacccccaaggcccagccugucuccaagucagaaggaaggucuaaggacgcagcuuuugugaauguucucccaacugugcugggucuucauugaugcagcuacuucugagucacccucacccauguucauguaaggaagcccaguaaguucacugguuugcuaugugcacacacuuggaaaaugaaauaaaucaccuaucuguggugaagagacauuuguucaugucucgucaggaaaagucauauaacacagccugucucuggaggcucccacucuccuccaauggcugccugaccccuucacaaccuuguguucucuagacucuuuccaucccuagaaagcacagcccugucucccuaucccauguuuucaugcaggcacucgggaaaggggcuuaugagcuuugcaauucucuugcugcagcccccuaccuugcccagcccaacagugcaaaucgcaacccccuaagcuacucacaauggccuccuacccaguuuccuuagaccacaguacccccaguuuaguccuauggagguucucagagucccauccaaacccugaucccagcauguuucuagaaagcaagauggaaggacagacaguggaaacuaucugagggcacuaggugaguacucggccuuugucgaugcaccaguuccuuacagguaaagcguggccacacccccauuuugcaaauaggaauauuggggacaucugugagggcagucugguugagacaucugucaccccacuaaugcuagagcugauucagcugaucagacuggacaggcagguguccccuuccccuccucacugccccauguacaucucucccaaagcugcacacuacaucacuaagucggaaaggacaacuuuccugaguagagaagcuagguuuuugguuaaggguacacaaguggcugcacuccuccacacaagcuuacaaguucccaggcuacacagcuaggaugugagaggaccagacacugagucaggcugucccgaagguucaccugucuacaggacuccuguucccaucaccaccacugggauggcaaaugugugcauguaugugauaugucucacacagcauaucuguacuuguguccugcccaugcacuguguguccuucagagacccaccuaacagcagaggucuaggcacccacauaccuuuucgaaguggccacugcggauauaguagucugccaaagagcaccacagcuugcccagcuggucagugaaacgggugagcccaccacggauuauggcauccacauugagagacuguaccuuguccggauucugggagauaaggucacacagcucgugccacagcugcaggacacaggguguugggggaacaucucagucucgguccaugagggaagacaccucucacccagucuccacauuccagggaacccaccugguaguuggauuuaccagccuuggauacaaagcgcucaucauucaccacgguggccaggcgcugugcagccucgucuagccggucacuggauuugagauacucgauguauuccucagcgcucucaggacucagcuggagaaugaauacccaccccacugaaggugacuggggaugcaggagaugauaucucucuucugacuaaguggcuaucgucacucccaccaccaccaguuuuagcaaacagucagccccacuaacccggccucagugcuauggugguccagccugaagucaauacuccagcauuaggccuuacugguuuggucuuggcuccuuugggucagucuugauaccacaggccuaacacggcuacaguacuuauggugguuagugcuaacugucaacuugacagacucuagaaucacuucugagacaagccuuaggguauaugugugagagacuaucuggaugagaagacucguguugauuaugaaagggaucauuuccugggcagggauccuguauggugcuguauaagaagcaugugugcauagcuguuuucugaucauggauucauagcuguuucaaacucccaucgccuucuaugaaggacugcaccccuaaacugugagccaaaaaagccgauugcuucaggguguuucuuacagcaagaggaagagaaacuaagacaguaaucuugucuggaccuucagucuugguccugaguguccacccuuggcaccucccuuagccuugacaccucccugccacaaccccaauacuguccaaugcuaauucuaggcagaccaacuuaagacacugguagucagggaaggaucugcuucugucacaaacugucauccaagcaguaccaugcuaagaaauuacaauaccgggcuggugagauggcucaguggguaagagcacccuacuguucucccgaagguccggaguucaaaucccagcaaccacaugguggcucacaaccaucuguaacaagaucugacucccucuucuggacagcuacaguguacuuacauauaauaaauaaauaaaucuuuaaaaaaaaaaaaaaauuaaaaaaaaaaaagaaauuacaauaccaauaucacaagcaugagcuacaacgcucugcuugcaaugcagcccaccauccagauaucuuacucccaccucuuacuguggcucugguuuuauucuacuucacauagcugggucaugcauguguuuacccuguuagacugaaaguccugggcaagugguggugagagccccauguauggugcuccuggcucucaucucugugcccacugggaagugggcauaagcuaaaagcuaaagacuugaaaacuaaagauaauaaguuacagugcuuagcucaggguauaaagggaguuagcucaggguauaaagcauuugccuugcaaguguggggacuggaguuuggaucuguagagcccacauaaacauuggguaacuaugacagcacuggaaaggggaucuguggggcuagcuagaacuggcuaaaucuagucuggguucacuaaaagaucuugccucaauaaaguaaagauugaucgaggaagacaucagugucaacguugggccuccacauacauggguguacacacacacacauaaauacacaacacacacucacaaagaaagaaaccaugaauaaacuguaccuauucaucggagccucuuccugcagccuauuuauugcauauugggaaggucccuaucccagugagccauguuuggaagccuaccuaggaacuggucacuucaauggugcucaccuugaggaagcgacgguagccucgcacagcagucucaggcagugggugggagcgcaggaaacguagauacaggggccagaugcgagaguguugugugaugggcagugcccugagggcacggucaaaggugcggcggguauguguuacccuucccugguccaugagaaacuggcaguagucuaaccacaggcguggcaucugaaaauaauggagugaggggucugaggcacaggcuccauagcuuccuuacacuucauaucuagggcacaggggcagcagggaagcaauaggggucaucaccugccacccaggcucuguaaauaagcccaagagagucauuauuuccucaagcugauaaaacacuuugguggaccugugcccuguuuugcuggagcacuaugaggaagaggaagauaccccuuuacaucucacuggggaaauaguugccaggagugcgccugcccgcacaccccucuccagaucccuaccuugugcaugaacacaaaggcccucucauggcaguuguugacaucuucauaggcaggaucagucacacagcgauguuucaccugugcccggcgugccuucagauaucgguaccagaguuuguagcuaaagagcaggaaaggcagauaagauggguuuauggaaccccagaacccuuucuuuguucuagaggcaacuguggugaaaaagggacugaggaggggcaagagaucucacagggaagggacaggcuuggacaugagggaaggugugaccuaucaggggcugugcuucaguaaaggaauacacagcauucaccugggacacacagucacuuguauugugacuggguguagaggggugggagcugaugagcaggguagcacagggagggccauuugcaccugcagggaagcaguuugagugcccgcucauacaacugguugagucggggcuugggggcccccuguuugaacucgauguagcggagccagcauuugacggagaacugguuccucaugauuucuuccucauagggaagguccucuuccuccugccagggccagggaaggggagacgagaagccugucuuuagucucaguagagucacaacccauccuggggcuuagccccaaacucuaggcuucuacaaaaacuccauacccuuucaaaaggcaguggugcaagucuauacucccaccaucucagaggcaaagaauaaaacaaaugggagguuggugagaugcccaguggguagagucaccugccacugagacugagucccaugguaggaaggaaucaacuccuuacguuguccucuaccuuccacaugcacacaguggcaggcacaugacuugccucuuacacauguuaaaauuaaaaacaaacaaacaaauaaacaaaaagaaguagaaagauggcucaguugguacgcacaagcaugauugccugaguucagaucuccaacacucacguaaaugccaggcauggcaguauguaucuaaaaaccccaaugcugggcaaugccaggcaucgcguuauguaucuauacaccccagugcugggcaaacacaaacaggucccuagaucccuagggcucacuggccagccauuuagcccgccagugagcuucaaguucagugagaagacuuugucucaaaagucagauggagagcaacggaaagucagcucaugucuauuucuggucaaugcgcauucauacacacacagcccaugcacuuacaauacacgcuauaguuaaaaacaaacagggcuggagacauggcucaacagugaagaguauguacugcucuugcaaaggacugcacucauuccaggcagcucauaauuaccuauaacucuagacuagggccuguguggacaccugacucacaugcacauacccacacaaagacauccacauaaacauaauuuuaaaaauacaucuuuaacaagcaaacggacacaacacaacaaggucccagacaugauuucuuccucuauugaagcuggaucaccagauauuagcuaaagcagugguucucaaucuacggccacuaugccuuugaggaccaaaaaaaucccuuucacaugggcugccuaaaaacaccagaaaacacagauauuuacauuaugauucauaacaguagcaaaaguacaauuaugaaguagcaaugaaaacgauuuuauuguuggcaguuacacaacaugaggaacuguauugaaggaucacacauuaggaagguuucaaacuacugugcuagauagaguguuaguuuagaccucuggcucucagcacucaacugcccacacagaucucuuaguuguuaaggagacucugcccagauaucagcuuuguucaguaaaucucacucccuggccccaauccucacacucuuaagaagucuuugacaauuucauacauauauacaaggaguuuuggauaucuucaccauccauuauuuucucuuaugcccuucccauaaucccuagcgucucacagcacuagggccagaggccuggccgcugucauggacagcugguuguauccaggcaccacacacuuccucccggacaucaggcuuuugauccuucacgcuuacacuaucaccaccgcaccuaucuucauaccuggccuguauaauaacauuuuaaaguuuuguuuuguugcucuugagacaggggucucacuauuuguucuagcuguccuggaauucacuauauagaccacacuggccgcaaacucacagagauccaccugccucugucucccaaguucugggaucaagggcauucaccaccacacccaacccaaaguuuuaaaguuuuuaacuuauuauuuuccccagccucuucucagguggcagauaccggugaucuccaugagugcaucaagccguuauccagaauccagaacacuagccggucacuaugccuaucaaaauccacgucgauucacucucauuccccuccuggccucuuaaccucaacagcagcuccucacucgagccaugaggguacguacgguucuuuauucccggucugaucaguguuuugacaugucgccccauggacuggggucuaguccccccccgcccuccccccccgagagccagacuccgauccuguaagguauccagcuuuggaucuucccuagcgaaucacccuccaccucgcugcagacuuacaaaaacaagguccggccgcucggaacgcggaacucgcgccaucaccaccaucuuccuggcucuccagguacagacgagagucgcgcucua

SEQ ID NO: 4253 - RNA, 12898 nt, Mus musculus
uagagcgcgacucucgucuguaccuggagagccaggaagaugguggugauggcgcgaguuccgcguuccgagcggccggaccuuguuuuuguaagucugcagcgagguggagggugauucgcuagggaagauccaaagcuggauaccuuacaggaucggagucuggcucucggggggggagggcggggggggacuagaccccaguccauggggcgacaugucaaaacacugaucagaccgggaauaaagaaccguacguacccucauggcucgagugaggagcugcuguugagguuaagaggccaggaggggaaugagagugaaucgacguggauuuugauaggcauagugaccggcuaguguucuggauucuggauaacggcuugaugcacucauggagaucaccgguaucugccaccugagaagaggcuggggaaaauaauaaguuaaaaacuuuaaaacuuuggguugggugugguggugaaugcccuugaucccagaacuugggagacagaggcagguggaucucugugaguuugcggccaguguggucuauauagugaauuccaggacagcuagaacaaauagugagaccccugucucaagagcaacaaaacaaaacuuuaaaauguuauuauacaggccagguaugaagauaggugcgguggugauaguguaagcgugaaggaucaaaagccugauguccgggaggaaguguguggugccuggauacaaccagcuguccaugacagcggccaggccucuggcccuagugcugugagacgcuagggauuaugggaagggcauaagagaaaauaauggauggugaagauauccaaaacuccuuguauauauguaugaaauugucaaagacuucuuaagagugugaggauuggggccagggagugagauuuacugaacaaagcugauaucugggcagagucuccuuaacaacuaagagaucugugugggcaguugagugcugagagccagaggucuaaacuaacacucuaucuagcacaguaguuugaaaccuuccuaaugugugauccuucaauacaguuccucauguuguguaacugccaacaauaaaaucguuuucauugcuacuucauaauuguacuuuugcuacuguuaugaaucauaauguaaauaucuguguuuucugguguuuuuaggcagcccaugugaaagggauuuuuuugguccucaaaggcauaguggccguagauugagaaccacugcuuuagcuaauaucuggugauccagcuucaauagaggaagaaaucaugucugggaccuuguuguguuguguccguuugcuuguuaaagauguauuuuuaaaauuauguuuauguggaugucuuuguguggguaugugcaugugagucagguguccacacaggcccuagucuagaguuauagguaauuaugagcugccuggaaugagugcaguccuuugcaagagcaguacauacucuucacuguugagccaugucuccagcccuguuuguuuuuaacuauagcguguauuguaagugcaugggcuguguguguaugaaugcgcauugaccagaaauagacaugagcugacuuuccguugcucuccaucugacuuuugagacaaagucuucucacugaacuugaagcucacuggcgggcuaaauggcuggccagugagcccuagggaucuagggaccuguuuguguuugcccagcacugggguguauagauacauaacgcgaugccuggcauugcccagcauugggguuuuuagauacauacugccaugccuggcauuuacgugaguguuggagaucugaacucaggcaaucaugcuugugcguaccaacugagccaucuuucuacuucuuuuuguuuauuuguuuguuuguuuuuaauuuuaacauguguaagaggcaagucaugugccugccacugugugcauguggaagguagaggacaacguaaggaguugauuccuuccuaccaugggacucagucucaguggcaggugacucuacccacugggcaucucaccaaccucccauuuguuuuauucuuugccucugagauggugggaguauagacuugcaccacugccuuuugaaaggguauggaguuuuuguagaagccuagaguuuggggcuaagccccaggauggguugugacucuacugagacuaaagacaggcuucucgucuccccuucccuggcccuggcaggaggaagaggaccuucccuaugaggaagaaaucaugaggaaccaguucuccgucaaaugcuggcuccgcuacaucgaguucaaacagggggcccccaagccccgacucaaccaguuguaugagcgggcacucaaacugcuucccugcaggugcaaauggcccucccugugcuacccugcucaucagcucccaccccucuacacccagucacaauacaagugacugugugucccaggugaaugcuguguauuccuuuacugaagcacagccccugauaggucacaccuucccucauguccaagccugucccuucccugugagaucucuugccccuccucagucccuuuuucaccacaguugccucuagaacaaagaaaggguucugggguuccauaaacccaucuuaucugccuuuccugcucuuuagcuacaaacucugguaccgauaucugaaggcacgccgggcacaggugaaacaucgcugugugacugauccugccuaugaagaugucaacaacugccaugagagggccuuuguguucaugcacaagguagggaucuggagaggggugugcgggcaggcgcacuccuggcaacuauuuccccagugagauguaaagggguaucuuccucuuccucauagugcuccagcaaaacagggcacagguccaccaaaguguuuuaucagcuugaggaaauaaugacucucuugggcuuauuuacagagccuggguggcaggugaugaccccuauugcuucccugcugccccugugcccuagauaugaaguguaaggaagcuauggagccugugccucagaccccucacuccauuauuuucagaugccacgccugugguuagacuacugccaguuucucauggaccagggaaggguaacacauacccgccgcaccuuugaccgugcccucagggcacugcccaucacacaacacucucgcaucuggccccuguaucuacguuuccugcgcucccacccacugccugagacugcugugcgaggcuaccgucgcuuccucaaggugagcaccauugaagugaccaguuccuagguaggcuuccaaacauggcucacugggauagggaccuucccaauaugcaauaaauaggcugcaggaagaggcuccgaugaauagguacaguuuauucaugguuucuuucuuugugaguguguguuguguauuuauguguguguguguacacccauguauguggaggcccaacguugacacugaugucuuccucgaucaaucuuuacuuuauugaggcaagaucuuuuagugaacccagacuagauuuagccaguucuagcuagccccacagauccccuuuccagugcugucauaguuacccaauguuuaugugggcucuacagauccaaacuccaguccccacacuugcaaggcaaaugcuuuauacccugagcuaacucccuuuauacccugagcuaagcacuguaacuuauuaucuuuaguuuucaagucuuuagcuuuuagcuuaugcccacuucccagugggcacagagaugagagccaggagcaccauacauggggcucucaccaccacuugcccaggacuuucagucuaacaggguaaacacaugcaugacccagcuaugugaaguagaauaaaaccagagccacaguaagaggugggaguaagauaucuggauggugggcugcauugcaagcagagcguuguagcucaugcuugugauauugguauuguaauuucuuuuuuuuuuuuaauuuuuuuuuuuuuuuaaagauuuauuuauuuauuauauguaaguacacuguagcuguccagaagagggagucagaucuuguuacagaugguugugagccaccaugugguugcugggauuugaacuccggaccuucgggagaacaguagggugcucuuacccacugagccaucucaccagcccgguauuguaauuucuuagcaugguacugcuuggaugacaguuugugacagaagcagauccuucccugacuaccagugucuuaaguuggucugccuagaauuagcauuggacaguauugggguuguggcagggaggugucaaggcuaagggaggugccaaggguggacacucaggaccaagacugaagguccagacaagauuacugucuuaguuucucuuccucuugcuguaagaaacacccugaagcaaucggcuuuuuuggcucacaguuuaggggugcaguccuucauagaaggcgaugggaguuugaaacagcuaugaauccaugaucagaaaacagcuaugcacacaugcuucuuauacagcaccauacaggaucccugcccaggaaaugaucccuuucauaaucaacacgagucuucucauccagauagucucucacacauauacccuaaggcuugucucagaagugauucuagagucugucaaguugacaguuagcacuaaccaccauaaguacuguagccguguuaggccugugguaucaagacugacccaaaggagccaagaccaaaccaguaaggccuaaugcuggaguauugacuucaggcuggaccaccauagcacugaggccggguuaguggggcugacuguuugcuaaaacuggugguggugggagugacgauagccacuuagucagaagagagauaucaucuccugcauccccagucaccuucagugggguggguauucauucuccagcugaguccugagagcgcugaggaauacaucgaguaucucaaauccagugaccggcuagacgaggcugcacagcgccuggccaccguggugaaugaugagcgcuuuguauccaaggcugguaaauccaacuaccagguggguucccuggaauguggagacugggugagaggugucuucccucauggaccgagacugagauguucccccaacacccuguguccugcagcuguggcacgagcugugugaccuuaucucccagaauccggacaagguacagucucucaauguggaugccauaauccguggugggcucacccguuucacugaccagcugggcaagcuguggugcucuuuggcagacuacuauauccgcaguggccacuucgaaaagguaugugggugccuagaccucugcuguuaggugggucucugaaggacacacagugcaugggcaggacacaaguacagauaugcugugugagacauaucacauacaugcacacauuugccaucccagugguggugaugggaacaggaguccuguagacaggugaaccuucgggacagccugacucagugucugguccucucacauccuagcuguguagccugggaacuuguaagcuuguguggaggagugcagccacuuguguacccuuaaccaaaaaccuagcuucucuacucaggaaaguuguccuuuccgacuuagugauguagugugcagcuuugggagagauguacauggggcagugaggaggggaaggggacaccugccuguccagucugaucagcugaaucagcucuagcauuaguggggugacagaugucucaaccagacugcccucacagauguccccaauauuccuauuugcaaaauggggguguggccacgcuuuaccuguaaggaacuggugcaucgacaaaggccgaguacucaccuagugcccucagauaguuuccacugucuguccuuccaucuugcuuucuagaaacaugcugggaucaggguuuggaugggacucugagaaccuccauaggacuaaacuggggguacuguggucuaaggaaacuggguaggaggccauugugaguagcuuaggggguugcgauuugcacuguugggcugggcaagguagggggcugcagcaagagaauugcaaagcucauaagccccuuucccgagugccugcaugaaaacaugggauagggagacagggcugugcuuucuagggauggaaagagucuagagaacacaagguugugaaggggucaggcagccauuggaggagagugggagccuccagagacaggcuguguuauaugacuuuuccugacgagacaugaacaaaugucucuucaccacagauaggugauuuauuucauuuuccaagugugugcacauagcaaaccagugaacuuacugggcuuccuuacaugaacaugggugagggugacucagaaguagcugcaucaaugaagacccagcacaguugggagaacauucacaaaagcugcguccuuagaccuuccuucugacuuggagacaggcugggccuuggggguugcuuggagagucuccccuagcaguuguuacuguuugcauaacuugggguggggggaggucuugugacucuuacacgucucauuuacuuucugagccuucagagacugacucccucccuccagaacggauuguugggauuaggaagaaaaagcuucacagcaggcugagcucaggguucugugggagcugaagucuggcugcucaccucuucucacuucaaucuugcguccaugcuacacaagacacuacccagcuuacaaagguggcccuucagcuucagacugacaggcagugcagggcaggaacaggccagcaggcuucuauccuucgcucagcauuggucagcuggggaugcuggcaguggguccuugugggcgggcucucacgccucuccucuggacuuuuccucacacuggaccugaaccccacaggcucgggauguguaugaggaggccauccgcacggugaugaccgugcgggacuucacccagguguucgacagcuacgcccaguuugaggagagcaugauugcagcgaagauggagacugccucugaacuggggcgugaggaggaggguacgacguaggucuauggacucgggaggagaggguugaguuccuagccacugguguggaacaggcugucaaggagaggggcuggauggacacugggccaagaaauccuggcguagucucaauugaguacaggcauggcaggagggcuggugcuagguucguggaggucagcguggcucuuuaggucuacaacacugggcuuggaggaagggaagcuaggaacagaaguagacagggccugugccauccaucaccuccagucucccuggcuucaugaacauaucuggcuucuagacgauguggaccuagagcugcgccuggcccgcuucgaacagcucaucagccgacggccccugcuucucaauaguguccuucugcgccagaacccacaccacguccacgaguggcacaagcguguagcccuccaucagggccgcccucgggaggugugugaugguuccaacccgucuccuucugccccauagagcugccauggcccaacccugcccucacuugugugaccuuccugcucuagauuaucaacacauacacagaggcugugcaaacaguagaccccuucaaagccacaggcaagccccacacacuguggguugcauucgccaaguuuuacgaagacaauggacagcuggaugaugugagugugcgguguguguauuacauuucaccacgggacuugggguggccaaguggcaagaccucagcuagucucugcccauuaccacaggcucgugucauccuagagaaggccaccaaggugaacuucaagcagguggaugaccuggcaaguguguggugccaguguggggagcuagagcucaggcacgagaauuacgaugaggccuuaaagcugcugcggguaaggaugugaggacagccagggaugugcagugggccgggacagcccucagugccucugccucugccucuccacagaaagccacggcuuugccugcccgccgagcugaguacuuugaugguucagaaccugugcagaaccguguauauaagucgcugaaggugugguccaugcuugccgacuuggaggaaagccugggcacuuuccaggucagcuaccguagacaggggugaaguggagcugguucucggcuucagagcagagugugcccugacccguuuguucccacagucaaccaaggccguguaugaccgaauccuggaccugcgcauagccacgccacagaucguuauuaacuaugccauguuccuggaggagcacaaguacuuugaggagagcuucaaggugaggcaagccccgaggugcaggucaaaggcacggcaaggcacuuccucauucauggucugcagggaaggcacucccucauggucugcagguguccaugugucuccacugucuucacuguccucucacugucacugccuguguacauguguguuugggaacaugaaaccaaaccucugacggaagcaaguuaagggagaagacuucguucuggcucacagaggauacaaucacuggugggcaaggcaaggcauggcagcagaaaaccuguggcugacugugcugcaccugcagagggaugcacaggaggaugaauguugggaacuggcucguuuucuccuuuuguagucuaggaucucagcccaugagauggcgcccacccccauuuaagauggaucagucugcuucaguucauaggaucgagauaauccuucgcagacauagcuaaaguuugucccuuagguuauucuacauccuguuagguugacaauaguaacugucacggggguaauuucuuuuccuuuuggcagugguauauauggaacccagaacuuugggcauucaaagcaggggcucuuaccacugagcaacaucucagccuuugaucucuuguaaagccacuaguuguggcugguaagguccaugcuaacgaggucauuuuaaguccuuuuccucauuuccaaaauaagugcuugcauaaggcccugggcaucagggucucagcaugugaacacugugggauauggguucuucucccauagccagcuacugcaaggccuugggggaaauaggacaaaggugggagcuaugugugcagcuccccuugguuucuguucagguaauagugugugggucagcacaguguggccauaggcagguacacagauagggaggcugcaucuguucuugugucccuaaccucugcccaggaccugggcaccugugucuguagagcuuaggagcuaccuuguccaugagguaucagacuguguuuagaaagucccuauugcaccccugccuuagcuccuguaguugguggggggaaacagggugacaugcuuaacuuugccaagauggaggggugggcaagggcaucugggugcuaauaccuggcuuccuuggaaacaggcauaugagcguggcaucucacuguucaaguggcccaauguuucagacaucuggagcaccuaccugaccaaauucaucucgcgcuaugggggccgaaagcuggagcgugcacgggaucucuuugagcaggcacucgauggcugcccaccaaaauaugccaagagugaggagucugugggcugucaugggacguggggaugaguagcaugugcugaguggcgcgcugcuaacuggacccuugugugugcagcuuuauaccugcucuacgcacagcuggaggaggaguggggccuugcccgccaugccauggcuguguaugaccgugcgaccagggcaguggagccagcacagcaguacgacauguuuaacaucuacaucaagcgagcugcugagaucuauggcgucacccacacucguggcaucuaccagaaggccauugagguacccaccacuagugaccugguaugggguugggguccaugcagacagaaggaucccagaaagccugccuguggagaggauggcagaaggcuuuccuacaggcaggcacugggaccccuuuccuucaccccugcucucccugaccccauggugccaggugcugucugaugagcaugcccgugagaugugccugcgguuugcagacauggagugcaagcucggugaaaucgaccgcgcccgggccaucuacagcuucugcucccagaucugugauccccggguacggguugugccuaguguuggagaggugagggugggcaguggggaugcugugccaagcaccuggcucaaccacaugccugcgccccaccacagacaacuggggcauucuggcaaacauggaaggacuuugagguucggcacggcaaugaggauaccaucagggagaugcugaggauacggcggagugugcaggccacauacaauacucaggucaacuucauggcuucacagaugcucaaggugucgggcagugccacaggcaccggugagcuucuuuaacccccccuuuccuuuucauggcuaggccacauggagcaaugucugcccugucccagagcacucacggcccagccuaggcuuccuaggccuggcagcauuuggagagggcuugaggucuaaccuuaaccuucucucccucauuggcccugcaccuccagugucugaccuggcuccugggcagaguggcauggaugacaugaagcugcuggaacagagagcagaacagcuggcagcugaggcggagcgggaccagccccccagggcccagagcaagaucuucuuugugaggugagagcagguggggggugggccaguccuucuuaggaaagggguauuccagagaagcugcugggggcuggaggggguccacugaagcagcuggcagcuaccagcuucccucucgaaacccuaggagugaugcauccagggaggaauuggcagagcuggcucagcaggccaacccugaggagauccagcugggcgaggaugaggacgaggacgagauggaccuggagcccaauggucaguggccagcccaggggccaggguuaagagcagaggugggccaccccccauccacccccaccuugaccccacuucuuuucccccacagaaguccgacuggaacagcagaguguaccagcugcuguguucgggagccuaaaggaagacugacucccuccacacuuuuucuuccauggucacucccccauaacuacccuucuaauacauccccucuuuguacaucccggucuugaccuccuuccugccguccaggugccucagggcgugcuagcuuagaacugccuggcucucagcacugauuggcugggacaggagguggaguagucaggggauauggcauguggacaaccugcccucacccugcagagccaguucuggacgcugcagggccaguuccccugccccaucccaggccucuugucaggcuugcccaguaagaaaccuccuugagccccaaaccgagggacaccuggcccuacuuacgugggugucauagauccgggaguucacaaacccuugugucuccauguaguaauaggcuccguggaccuacuagcaaggugcuuguaucccuggcuaaaggccaaacaccaggccugguguacaggccacauccaggguggagcccuucuagcuuaagcucugggaagccauuaguggccucuagaucauuaaggggcuuuuggcaucaggagacauaaucagauuuguguuugagccggucacgcaggcugccgugugagcagggcgcaguuggagacaggcuauuggcuuggaccaugggauagcuggaggggugaguucuauacaauuuggcaguaucugggaagcaaggcuguagugagccuaacaucugaacucugcaccuacaguggcaacuagauccucugauaaggggcucugaggaaggacacagaauccccagcucagagacuguaacugggcucagaaaugaaggcagguuggcaacaggaaacagggaucggguuagaaguuggcugcacaccaaaugcaaccacacggaggaggaaaauguggggguggaggaggcccaggagaggagagcuggucuggaaucucuugccaggucagaucagagguggcugagaacaucuagaggagggagugucaacaggaaggucaccacagauguuggcaggagcugccacagggccagcaaaagggcaaagacgacaagguagggcuugugaaaacacgagacguaaacuuggucaggcuuagggaggagacaccgugucucagcuucucuuuucaguuauuuuauucaagaaaguggaggacagacaaggggacugagcugagcccugagucacugaagcucccagcucagccccccacagcaugaccagacaggacccaggagugcacugcccaaggugggcacuauuuggggguaccgccacccuucuugggcguggugggcuucuugcuuugccaaaggugucccuggauagugaaggcgucuacacucauagacaugguuuuagcagggaucugggugaaccguuugcgauccgaguuguacuuauagaugccuucgaccauggcaggagugacgguccgaggcccauagccugccagccucgauagcuccucugucuccccagacagaguguagagggcccggaacuggcagcuugagucccgaaagagaaucaggaagugguuggccuugcuuuucucgauuuccugagggaugguggcaagaagcuggucaggcuggacuacugcucuacccgcuagucuuacccacccagacagcugugggacucaccucuagaauucuguucuucuggggcucauucaccuugccugccaggcagcagugugacaaggcauuguggaugauaaacuuguuagacuuggc

SEQ ID NO: 4254 - RNA, 3075 nt, Mus musculus
gguaugaagcaccaacuugcuauugagauccauugucugccucucaugagucaacccuguuguggauguggggcucuggauucuccugccuuguguucucaccugugacuuuguuccacagagggagcuguggccaagagagaaggagggucaggucaguaaccuguuuuccccaaggagcugagucacucuuaccuaguugggcuuggaauaaagauuucacccucagccauagguaggaaaguggaagcagcagacugaguaggaauuccagacuagccugggcuagagaccuugucuccauaaagguuucuuguuguuugugaugguguauaccuacggacacuuggaaggaggaguaggaggaguaucagauugaagcuagccugggcugcauggggauagagagagggagacaggagaggaagcuguaauuccagcauuccagcacucaggagauggaugcaagaggauugagaauucuggcuauucucugccgccuggugagcucaaggcuagccuguaguauaugagaccccaucuuaaaaagaggggagggcacaaauggugucacauauuaccuuuuccccgagggaugaagcugaacucacuuguacagugauugugauuggcauggggcucccaguguggauacugaacucugaagccaaagggaggauagugugagugaguccaggcugugaggccuguacucuuccuuccuucccaucacaccccuuuccccauuccagcgccaggagcuagaagaauuuaagcagaagauccggaagcagaaagaagagagacuucuucaagcugcccagcagagcuccugagaccuucaguuccucaagucccagcucccuuccccaccacagaaaauaacacacacucaacucuuuguugcuagugccaaguguuuuauuguuuucaggggccagugggaggcccaggauggcuagaacucucaaggagcuugugucuggggcugggggcugcuguuccugcggaagcugagugcagcaggauccugaggggugagcagggguugagggcugagggucccaggucguuucugcauuccauccuggggaugaagaagggucagacggagggaggggaccaaggaaagugcaagucagaagugccuccaaacaauguuuuuuuuucgucugcuaauuaggguggugguauuuggucagacauuggccuguuaguguauaccuguaaucccaguacucaagaaacaggcaggaggauuauuuugaguucaaagcuaaauacuaaaacaaacaaacaaacaguugaguugagaagauagcucagucauugaaauccuugcuaugcucauuugaagaccugaguuuaagccagguguggguuuaugcacuuguaaucucagugcuuaagagucaggaggaucccaagggcuuccuagcuagagagccugaucuaccuggaguuccagggcacugaaagcucccagggcaggagauugacuucuggccuccaccugcgugugcacacgugugcccggagcucuaaacauguaugcuaauguacacagacauagggcuggggcuggagcucaguugauagagacugcaucaaagcccuggguucuaucccuacccacauacaucacucauggugacucacaccuguuaucccagaacccaggaugcacauguaggagaacaugccagccagagcuacaugaaacccugucucaaaaacaauaaagcaaaacacucccaaacagaagcccuacucuucauugauuuauagggguaugcauucauaugccuuccaggaaaacugccuguuuucucccuguggccucucccaaauauacagauguuggagcaggaacuguaauuuccagccauaguucugcacuagcaugaguccugccaccugaccuuaagcccauagcacuuuacguguucauaggguccucuccuuuccugccuagagacaggucauagauuuagagagcuauguggagucucacagguaaucuggacaucaccuaccuuggggccgauagguuggaagccaggcagggaauuaacuguuacacgcuggucguccaugcggcggcccuggguguugaccagcauauccaugagauuguccaucucuggagcagggccacccucugcuuggagcagagacaggcaggcaugaauacagaccccauccugagucccaagauccacaagaucccagaaccccagcacuccugccacacacacacacacacacacacacacacacacacacacacacggcccaaucacgcccugcuuacggcuuucuggguucuggccuggcccagccugcaaggaacagcgcugcuccuccauccgaucgcccugcacgugggucagcagguugaagaagccuuccugguccggugaaccugccuuggggacagacgugauugguuuaguuuggucugugccuucccugucuuccagacagcauccacccgaaacagugccugccuucccaucucugcucucaccauaguccucacgggucugcagaauuucucuaaaugaaaccugagucuccuucccugaccugccccugacucccccaacccccaccucccagccuggggccccugccugcagcacaauuucacaugguacugacucuagggacagcauucuaccacuguccuagauugagaccaggcuuggguugauuugggggguugggacacuuaccagggaaauggggcucagaagugccccuaaauccuaguaccuacuaucucuugggggacaguacuaagaauccauucauuugcccugaggaggggcucuuauacucuccuaccuauacccccuguguguuauaguaacugggucaggggacuccagagacuugcuugcuaauuagaugcccuauaaaugaauuaaucuugucaauuacaggugccgagaccucaagaagcggaugguggagucagccagagcccucuuaccuugucuagaaggucugagccucccucucccuuuucuucuuccugguccauuguguaucucuccuauacuuuucucc

SEQ ID NO: 4255 - RNA, 1154 nt, Mus musculus
aggaagagggcucugcggaaugcuuaggaggcccuuccaccagagcugcuccagggccgggacuucgagacuuccacuucaccaccgcaggaccauccaaagcagauagacugggagacgcagcgcagauacacagagaaaggaugagaccggugcagguagggcugggaacugcaccggaucuuagcaaaaugcucugaaggggaguccuaaaaggggagcuuuucgugcagguacgggggaggagcagggguguacggaaaacugccacaagggggagcgcgugucuaccaggaucgugccugacacuagcuggcacugggcuaugaucucuugcuuuucuagggcaguuagccucuggucucaggauaaugugcaugcccuagggcacauguucuuuuauguauauccaagaaucugaggcuuggugaauuuccuuuuaaaaaaaaaaaaaaaagauuuauugggcuagagagaugucuccguuauuaagagcacuuaaauggugaauccugagguccugaguucaaugucuagcauacacaucaggcaauucauaaaugccuguaacuccagcuccagacgaccucccgaaagcaccuguauacauguggcauacacacagacaugcacacaaauacaucuaaauaaacauaaauuuauuaaaauaaagaaaugugugcgugcaugcuaggagguaacaucagaucuucugaagcuagcuacaaacaguugugagcugcccaaaaggggagcugagaacugaacucaggguccugggaauugcaggaagcacuccuaaccucugagccauuucuccagccuugcaugguauauuuccaugucauucaucgugaggagugauuuuucuauuaauaaauaauacacacugaaacuaggguaaaaagauaacccccacuuucuuuuucuuucuuuuuuaguguggugaugguaguggugagagagucuuucuacagagcccuggcucuauuggaacucuauauaucaggcuggacuugaacucacaaagauccaccugcugcugccuccuaaaugcugggacuaaaggcaugugcuagcaugcauagccuaauguaacucccccgccuucuaccuucacuagcaaggacaauacagagucaucugagucugau

SEQ ID NO: 4256 - RNA, 1062 nt, Mus musculus
auggaauuuucggggcaauuuauucgaguuuaaaauggaaaguccagggcaggcaaccuguagucucagggcaagcaagccaaggagaaugaagaagauccgcugucauggaggucagccacacuugaugggacuggagcucuagaaaaaggacuaaggaaaacccaagccagacuguuaggaaguuuaaaagcauacucaggccagcauccaaaggggaaaggaaaagcgaagggggauggauagaguagccuacaccguauuagcccaaccuauacuaggggaaagaagaggaauuauggaagagaaaaguauaucaccugccuucuccggugguccuuugccaggacccugaccugccucgcuacauuaacccuuuaggaaggagacagaggccaucucuccuagaggagacuaugaagccacagcagaccaaagagcgagaugguagcagaagguuccuggaaaggacggugaacuggagccuaggacgccucucugggugaagcaagaacacucuugugaaauggaauuggagccgagcccuuccccgcugugcacgcaccagaccccggguuugcaaggauggaugggaaugggcgguccuacacgccgccaucaggaagagggcucugcggaaugcuuaggaggcccuuccaccagagcugcuccagggccgggacuucgagacuuccacuucaccaccgcaggaccauccaaagcagauagacugggagacgcagcgcagauacacagagaaaggaugagaccggugcagguagggcugggaacugcaccggaucuuagcaaaaugcucugaaggggaguccuaaaaggggagcuuuucgugcagguacgggggaggagcagggguguacggaaaacugccacaagggggagcgcgugucuaccaggaucgugccugacacuagcuggcacugggcuaugaucucuugcuuuucuagggcaguuagccucuggucucaggauaaugugcaugcccuagggcacauguucuuuuauguauauccaagaaucugaggcuuggugaauuuccuuuua

SEQ ID NO: 4257 - RNA, 2922 nt, Mus musculus
ccauuauuaacauuucuuuauuguaguagucaggguucacuagagucacagaacuuauggguagucucuauauaguaaagggaugaaccacugagccaucucuccagcacuaaaauguacuaaagcauuuaaaaaauaguauuuugggccaggggaugaccucgucuguaaagugcuugcugcacaaggauuagggucuugcuucaauucccaaaacccacauguaaggccagacauauaggcgcacaaccguaaucccagagcugaggagacaaagacaggggaggggaacucugaggcucauggucugccaucucaguugaauuagggcgcuccaagacccagaaagagaccauauuucaaaaugaagccaacaccaggugugguggugcacgccuuucaucccagcacucaggcagcagaggaaggcagggugugaguucgaugucagccuggucugaacauucaagguugucuucuggccuccacaggcacauagcccccuccucuuucuucuccuuuucuuuucugagacaggaucucauuauguagacauggcugguguggaccucccuguggagaccagguuguccuuaaacucauagagagccacuugccucugccuauugaaugcugguauuuauucguuuauuuuuaaaauuuugaauucuuuagcuagaaagccccacauuguuuucauuucuucucauaguucuuuuaauucuucucucagauaucacgcccugauagcagccccgccucccuccucuccuccagcucccucccuuucaccaucccucucccccagauccacuccuucagaaaagggcaggccucccagggaucucagccaaucaaguugcaaugagacuagguacauccucuuauauuuagccuggacaaggcaacucaauaggagaaaaagagucccaaaagcaugcuaaagagucagagauagccccugcucccacuguuaggaauccuacaggaagaucaagcuacaaaacauaauauguagucagaggaucuaugucugacccacgcaggcucccugacugauugggaagggaggagagagagagagagagagagagagagagagagagagagagagaggcggagagaagaggagaggccagccaggaaccuguggagagagggggagggggaugaggagagagggagaaaggggucagggagggaagagagucagagagaguaagaaugucuuccuguggggucaugcucuccccuucagcuucuucaauccuuccccuaauucaaacauagggguccccgacuucaguccaaugguuggguguaaguaucugcaucugucucagucaaugcuaugaauuuuuaaauuaagcauauggggcaguggcaugguucaucuguaaagcacuugccuagccauugugaggcccuggguuucaucugcagcauuguaaaagacauaauuaaaccugcaccugacuuaugcagguuggagauaugaauagacuccaggagaaaaugaccuacauucuuucugccgcuuguguuuccucuuaaaaagaucagcuaaacacgggaagcucugggcacauauaucaccuuaauuuuguugucaucuuggucuacauagcaagacuguuucaaacaaccaccaaccaaccaauauacagcacaaaaaauuaaggggcuggggaggugucuuaauagauaaaguacaauuguaaagaucugaguuugauccugaguaccuacauuaaaaaaaaaaaauugcuggguguguuggucacaccuguaaccccagaacugccagccagugagguguuuguggggcagacagaaggauuuucugagaugcuugacagcuagcagaaaugguuaccccagguccaguaguuagacccugucuuaaaauaaguuccagagcaauagagauagacucagugucaaccucuggucucugcacacaggaguguugggcacaugagacacacugacacacaaagggaggauaaggauggucagacgccuccgcagguaaaacuacuacuacuucuaaaacacugcagcuacaccaucugugaaagauggaaaaacacccccagaucaagcguucuccuucacccacugguaaaaaaaaaaucacgugucaggggaaauugcguguaaauacaucacgucuacaguucacguacuuacauacuuaagaagauacgugcccgagggcaugcacgugcuccugggauagaauacuuugcauacuacacucuugcucaaaagccagcuuuuauagcaagaucucauagcccagugcccaccagcguucugcgccgcggggcuuggacacgggcgcccccuugcggccccucucggucaccgcauugccccgcccuccgugcgcaaacgagcuagcccgcgcacgccugcgcacucacaggccuuuuacgacgccaucaaggaguuccgcugacccgcccgcagcacaguuccgguugagaccuuuccccgcccgagaaccuucuccggcgcgcucgggccucgucuuuuuuucugugcguccggagcagcguucccgggucagucugcuuuggguuuccccugggggugaugcggguuccgcggucccggccgggcguccuagagcagcccagucgagcauucugcacgguuccuuuccccagcuggggagccggacgguccauccuaaucucccaagaccuggcccgugggacaugcuuuguaggggaggguugucggcuccaauccauucuccagaagccaugaaggcuucaccugguggucuccauucacuguugugacucccggcugccggcacgggaggcccagaggcucucaccgcuuccuccugccuccuccacuaguguccccaucauccgugcaguuuucuagagacuuugugggaguaug

SEQ ID NO: 4258 - RNA, 4959 nt, Mus musculus
aaagauguuuaagguugggugcaacugaggaagacaucucacaucaaucucuggcucuacaugcacacacaaaauaaacauuuuuagaaauaagguggagggcuagagggccauggcucagcaguuaacagcacacugcucuuucuuaggauggggggggugggugucagauggcaacccucauaccagauggcucacagcuaccuacaaaagcucuaaaucugaugcccccuucugaccuccggucaccuguguuuaaguucacaaacguacacacagacacacacacacacacacacacauaaacagucuuaaacaauaauaauagccaagggugguggugcucaaguuuaaucucagcacuagggagguagaccucuugaguauagggccagccuggucuacauagugcgcuccaggucagccaggaaaacauaauucagacucugcguaaaauaguaaaugugauaagccacuaaguuaaacacucaaccucaugcagagucagaaggguugggauucacagucacccuuaaauauacagcaaggcugaagccagccugggcggccggaacccugucucagaacaaacuuuguaaauauuaaccuuaaaacccucaaguuuccagaugguucugggcucuucccccuuugagaggcuggugugccacuggucucggugugaucccuggggcacccagcagcucuccagaauguaccaaaaacaaauucuuaugcacaccccaaaccuacagaaucugacuguaggggugaaacuuacaguucuguucuguucugaaaccagcugaguuucuuggucccucgggugacucugaugcccugaaauaagagucccagggagaccucugagaaaggggcuggaauacacacuucugguccaggagguauagggguggaccagugauccugcaugugggacgaggauggugacguugguguugcugcugguagugauaaugcugauacugaugcugacaguccacaagccacuuugaguagccgaugucuaaagggcgaauaaccacucuacauuuauuuuaggcacauagccacacccuccccuuuacuaccuggcuuuuggguuuuuuguuuuuuagaacaaauggagacuugaagaaaacaguuucaaaggaagaguacaccugccugacacuuaagaggcugugcugccagagcuggucucaaacuugcuaaguagcagaggauggccuugaacuuaccaucuuucucucucuaccuuccuagugcugggauaagacaauuuguacccacuuuauguggcauaaggaaucaaacccacggcacucuacaaacugggcuauagcacuggcagucugccaggucccggucccucuuaaccucauauccccgcccucaccucuccagacugcagguuccaacaauaauucuguaagugcccuaucuccccgauacauccaagccuccaaccuuaacugaaagccagaagccaagucggccauugcccacuuccuuacucuccaucuaugccugacaagcuugccuucagacucccuuagucugggacucaggaccaggaucaggaucugggcagaucugacgccccuacacaagacacaacacaagcuugggaacaggaucugcucguccuuuaucuccuguggggucagcgucccuccagggcccgaucucgggcaaucacagccucuucaaauuugaucaugagugugguccccuugugccagugcgccguaaccuuggcagggaagccgcugugcgugagcacagccuccacgaugcccgcugugaagcuggcacaguucagugugcuguucuccuugggcacggagauguagguguuaaugagcggcucccucucgaugauguagaaagugcgggcgucaucauuggccugcuccagcuuguccgccuccuugccgaacagugccuuccacaccgcacccuugacgaagagcaaugcgcccagcaccuuagucucacgccgggcacccuucucacgggccaccagggcaucuaggacucgggcgcccaccugucggcccagggcagccaagcgugcuugaagcucggccacagagaaaacgcggcucugacagugcugcaccagcucggagaagagaagggcaaaggcgcucaggcucaccucggugcggggccgcaccagugcgcgcucuagcagcgccgacuucccgcgugugaaacgcgccuccaugaugcaguccugcagggagaccagaagucagggcaauggguggaugaggccuggcaccacggagaaccaggauaccuauacaacccaucuggacuagcgcugagaacuuuagugccaaacagaccagaagggaagcggacauuaaacugcugguaaaacacaccccauaacauuuagcaagcaaagcacaaauacuagagugagagcuuuauaaucuugccugucaaaggggaaacgaagaggacuagagaagagggcucggcaggucaaagcacauacuguucuugcaaagcacguuaagucaguucccagcacccacuccacauggcucacaaccacuuguaacuccaguuccaggaagaaucaaugccucuggucccugcccugcaccacacgcacaaacccauacucagacacacaugcauauaaauaaaaacaauuaaaauuaaaaagaaaucuuucaagggaaauaaaagggagugauagaaacuaccccaaaguuggagacucaagagauuucuuauucaugaaaagcacuugcggguaaggcucagucgguacagugcacuccgagcauacaucaguaauccccgaacucaggaggugaaggcagaggcaagaggaucuggagucugaggucauccucugcuacauagggaauuugagaccaaccuaggcuacaugagacccuuucuuacugaaaggaaaaaaaaaaaaaaaaaaaaagcuggagcgaaagaagaucauuuguugcucuuauagagagaccgaguuugaauuccagcacccacauggugacucacaacaaccuguaacuagaucuaguagauccucuaaccacuuagggcaccaggcacacacacauuacacauacauauaugcaggcugaacacacauacacauaaaaucaagcucaaacaaauaagaagucuucccaaagaacuaucaguggaacuggcaagauggcucagaagguaaagacacuugccugauaagccccauuugaucccagaacccacagaguacaaggagagaacucacucucaaaaguugcccuuuacccccaugcacacucacaaauacacacaugugcacacaaacaugcaaugaauaaauuuuuuaaauguaaauaaauaaaucuaaaaaaaauuuuaauguaauuuuuaagaagcuggcauguggcaggggaaugguuaaaacuuaaggugccacacaugaugaaugcacaccuuuaaucccagcacucaggaagcagaggcaucucugugagacugaggacagccagagcuguuacacagagaaacugucucaaaaaaauuuaauuagucaaucaaucaaucaaaaagguggaauacagagaggccacaaaacuggaggagcacaccugcagccccagcacuccagagacugaggcaguaagauggcagaaaguggccagcccgggugaguuccaggacugccuagagcacagugagacccugugcaaugguucgucuucacgaccuagauuuagaaucaccaugaaaacacgucucuggauuuccagagggaagacccaguaugaauacaggcaucaccacccuaagguaaaaagaaggaagugaucuuggcgccagcauucgacuguggaugcaaugccagcggccucaugcuccugaaaccaugugucaauagccgaauaaacagaccuuuccuucuucugguugcuuuugucggguauauaugaccacaacaagaaggagaaaagcacuaauacacucugucuuuaaagcgggggcgggacauuggugaauggagaggggacaaaggacagucaauuauguuuucccuagccggcaugugcuccagcucugacuacccuagagaccuuccugcccaaccccuccaggaaagcuagaaaaguaugugacaguaagggacaccggugagccaaggccaagccaggagggggugcaaaaaauucccaacccuguaacaugagguuggggagcggcggaagugucuauuugucaugaaggaagccguuuccacggugacccuuaacucuaaaagagaucccgucggaacucauacucccacaaagucucuagaaaacugcacggaugauggggacacuaguggaggaggcaggaggaagcggugagagccucugggccucccgugccggcagccgggagucacaacagugaauggagaccaccaggugaagccuucauggcuucuggagaauggauuggagccgacaacccuccccuacaaagcaugucccacgggccaggucuugggagauuaggauggaccguccggcuccccagcuggggaaaggaaccgugcagaaugcucgacugggcugcucuaggacgcccggccgggaccgcggaacccgcaucacccccaggggaaacccaaagcagacugacccgggaacgcugcuccggacgcacagaaaaaaagacgaggcccgagcgcgccggagaagguucucgggcggggaaaggucucaaccggaacugugcugcgggcgggucagcggaacuccuugauggcgucguaaaaggccugugagugcgcaggcgugcgcgggcuagcucguuugcgcacggagggcggggcaaugcggugaccgagaggggccgcaagggggcgcccguguccaagccccgcggcgcagaacgcuggugggcacugggcuaugagaucuugcuauaaaagcuggcuuuugagca

SEQ ID NO: 4259 - RNA, 9189 nt, Mus musculus
uaaaagcuguagucuccagcauucccaugcaccaggggacagcggcaaccaugagugacuccacagaagccaagaugcagccucuuagcuccaugggugaggcugggcuggguucugggagcauggugagggaagucagaggguucugcucagaggugagcccgcccagcugacuggugcuugacuggugcucucuucccucagacgaugaugaguugauggucagcggcagcagguauucuauuaaaagcuccagacuacgaccaaauucuggaaucaaguguuuggcagguacaacaugguggggggcugagaaaaaaaugggucuuuuccucaaaguggguuuucgggaguugaaggcuaggacucugaacuuccucuucuugggaagauagaggcgggacaaggaauggagcgcuacgggaaggcugggguagauggcuaggggagacaucacagguuguggaaggaggaggcuagggaaggaaaucaugguccaugggaaaggggaugguaggacacgaaaacuugggcuaugauacuguggaaguugggacagggaauugaggguccuggaaaauggagggugaugcaaggaauuaagagucuuggggaaguagaagcugggguagggaacugaggguguggguagauggaggauggagcagaaaaucagaagcuuugagaagauugaggccagggaacaaaaccauggcccauggggagguagaaucugagucuagauucacaugccaggugggagggggacgcuguucuggaaccaggcuacuaaaaaguccacuuuuucccuggaaggaugcucgggacacagccaaguccccuugguccugcagcugcucuccuuccuguucuuggcugggcuccugcugaucauucuuuuccaaggucaggcacaaugaagggcuuagcucuugcaggaccuucaccuagggccauuuuaggucugggagggaaauggacagugcagguggauggcauaucuuuaaaggacgucccugacucugguauaggacagaaugagaaaaagaagcauggguggauccuggauucauuucuccuuauggcucagcaucuucugaguggcagguuuucuaaucuucaaacagaauuaaggaagauauuaaugagcaacugccucagacucuggaguacugccaugugccuauagucccagcuacuggggaagcugaggcacaaugauaauuugugccaaagaauaugagagaagccuugacaacauaaugagaccuaucuuuaaaaaaaaaaagaaagaaagaaagaaagaaagaaagaaagaaagaaagaaaaguugacaguguaucugagugcaggacuugacacacaggaaguauuuaauaaugaaauuauuuuuccccuuccucacagucuccaaaaccccaaauaccgagaggcagaaggaacaagagaagauccuccaggaacugacccagcugacagaugagcuuagugagugaccaauacucggaaguaucauggacucaggaaggcucuagggaaaggggucaauuuuccuaaauugucagaucucuuagagccucaauuuucucaagucugugaauucauaccacaagauuaacaacaacaaaaaaugguacuugguaucaauaugaguuguuacacaguagguucugagugucuucaggggcuauguucauaguaaguacucaauauccacaaggaucauauacacaguagacauucaauguucccagaagacaugcacauacuuggcacacaacauguacugugcaugcagcagauacuacauauucauuggggccauaaacacauguaauauucacaggccucacauacacagucaguacucaauugaauaguucucuuggguuuuguucugauugcuaggcaucaaauucucccagucaagaggauaauacuggggacuccagcagguucagguugugggugggagguguugggaagugaauaagggaauguuucccuaggaugcugugucacucuggagggccugagguuaaguagacaacaaacauaaucauguaaggguggguuuauccugaccugccucuccugggauuagaugcucuucucaguguucuguuucccagucuucaaaggagauaaaacaaaacaucaaucagaaacuguccuagaugcuggaauggcagcacccaccuguagucugagcuacuggggaagguaagggagggauaaccacuuaugugcaggaguuugauagaagcauagaugccaacugaaauuuaucuaaaaaguaaaauaacacaugagccggugagauagcuuagcagacaaaagugcuugcuuccaagccuaaugaccugaauucaaucccuugaacucaccuggcaggaggagaacuccuacaagucuuccucugaccuccauucacacaaacauguaugcccccuggucccacauacaauaaauaaaugcuuuuuuuuuuggagaccagugauacaugguagauauuuaauaauggcacuuuguuuuucuugacacagcguccaggauccccaucucccaagggaagaaugaguccaugcaggcgaagaucacugagcaacugaugcagcugaaaacugaacucugugagugagaaagcagcaguccaagcugcugggucuguaggggccaguuuugagccaucagaccucuuugagccuugguuuccucaucuguaaauugaaaacacaaaguaacagcaaggaugauauuugcuccuuacagggacuguacaugcaaaagaacucacauccccagggguuguucacaguguaggcacucagugcuccaaaggaccaugcauacauaccuucaacgucuaauguucacaguggucauauguacagaguaaacucaauguucacagugcuguacacagaguagauauucaauucaaugucuugacuccuauucugaacucucucucuauuucaccuaucagaggaguggacaggaacuccugggcuuuccugggguugaggagggauuuaggaggcagaguagggaguaguucuccaguguguugugucaagggaggaccuucacucuggagggccugaagauuugaagagaaaaggaacauagguauucauucaagugugggcucauucuaacccccaaccccagcuccaggauuagaucccuucugaauguugacucucccagucuccaggaaaguaaacauggcaucaaucagaaaccaucccauaaacugggguggcaaccucugccugcaguccuagccacuggggaacuggaaaggggauguuuauuugugccugaauuuguaacaagcugugucauagugugguucaaaaaauaugacaugagaucucccagggauaggcaauggcacacaguagcuauuuaauaauggcaguucuuuacuuuuuucuccauuuuucuuggcacaguguccaggauucccaucuuccaggggcagaaugaguccauacaagagaagaucucugagcaacugaugcagcugaaggcugaacuucgugagugauaaaaaaccagagguucugaggccuccagacacuauaggggucaauuuucuugagucauuugacuuauuuaugccucaguuucuucaucugugaauugaggccacaaguggcagcaaggacaacacuugauguuuacagaggcacccaguaggcauucaguguugauagggaccauacacacauuagauacuugguguuuauaagcaccaugcauacauuagguacucaguauucacagggccaugcacacaguagguacuauguguucauaggguccauauauacacuaggcacucaacauuuacaaagccuguauugguuagguucucugagagaacaaauucuauagaaugaauauuuaucaaaaggcucuacuagauuaguuuacacaauauggucuaacaaguccacaguagcugucuacaugcugcagaggaugagaacauaguagaugcccaguccuugagucuggaugccacagaguccugaucuggggccuggaggauuccuggaaagcacagaucaucaggccacaaugaaaaucugaagguguaaggaucaacaucagcagagaauagaugcaccagagacagcaauaggguagaugggaagauggacagacaacagcagcccugccaucacuggcagguguuccuuacccuguuaaucuuuccuagaaauacccucauagcccugcccuaaggugugucucuugguugucauucuagauacaaucauauuaacaucaauugugcugugaacacaguagggacucaauuuucacugaauuuguacacauaguaggcagucagugaucacagggauugugcacagagucaucacacaguguucuugaaguuaugcacagaguaggaacucaauauucagagguaacaugcacauguuuggcucucaguuaagucagucuacuggccucuguucucaccacacaggagaggaaguggaggcaagauuccuggguguuaggucucugaaucuuuauaggaaaaaacugucccugauccuggguugugguacuugccugaaauccaagcuccucaggaggccaagggauguuguauccuuuugccuaggaguuugagauguuccgacaacagggugagcuccaucucaaaagagaaaugacaugucccuggggauguaguucaagucaguguacucagcugcaguuccccaucuuuuuuucuugguccaguuuccaagaucuccagcuucccgguaaaggaugauucuaagcaggagaagaucuaccaacagcugguacagaugaagacugaacucugugagugaacagaaaccagaggccucaggagccucaggcagccauuacuuugggucaaauucuuugaguuuucagacaucuuugaucuucaguucccucucuaaauugggccuauaauguagcagcaaggauagcaauugguauuuauaggaguucugcaaacagcaggcacucaauauuaacaggggcugugcacaaugaacacugagugugcauaguugugcacacuucaggaacucaguguucacaaacaccauaagcucaucuucuauccucuguucugaacuuuaaccccuacuccuuccaaacuaaagaaagaagagcuaggacucaggagucuuccugaguuccccuagaguuucaaagggauguagaaagcagaaaagaaaugguuccccaggaugcugugucaagggagggcccugacucaggagaguuugaaggcuaaucaggcacaagaucacaggcauccuaacccacuuccccaacaguccgccugugucgacucugccccugggacuggacauuccuccuaggaaauuguuacuucuucuccaagucccagcggaacuggaaugacgccgucacagcuugcaaagaagugaaggcucaacuagucaucaucaauagugaugaagagcagguacauuuagugggacuccauccuugucuggucugugcaccuggcuccugaucacauaagcuuaagauaauuugccagaguuaugugaggaaaagaagagacggggguccugagcccuuuagauagaacauuugugagugcuuuggggacaccuaaaaugcaguagauaucaucuuuguacuggucacuauuuagccaucuccucuuggagagauaaaagucuuggugugccugcuaauuaaauagcacagcagacaaagugcuugccucuaagccucacacccugaguucaauuccuaggacccccgugguaauaggagagaaucaacucuuuaagaugcccucugacagacauaccugcacuguggcauaugcccauccagacauagaaguagacauaauuauaagaaaaaaugaaguccugacaugggucugcuucacaagcuugaagaccuugaguucaaauccaaagauaaagaggaauggggugagauggcucaguagaugaaggcgcuugcugccaagccugacaauuuauccucugaaccuacaugguucagagaaccaaccccuauaaauuguccuuugaccucuauguacaggcauauuaauauccauaagacauauacauagauaagcaugcauacacgcauaaccugauaugauauguaauucuccugguguaaauauucucaccaugaacagcuucaaguuuauaaugggaugccacugaagaacugaaaagaaaggguauguuucuuagguaaccaugaauuagcaucauuugcuucuaucacauuaaagccagccaugaggaaauucuauagacucauucuauagacucagaauucuuaagagccauccagcaacauuagcagaauuggggagggaugaacagcuguguaauucgugugugugcguguguguguguguguguguguguguguguguguguguguguguguguugcuaucuuucagacagggucucacucuaguucuaucuggccuggaacucacagaaauccuguggguuucugagauuaaaggcauguaccgucauguccaugcagcuagguaccacccuaugccaagugaauguacugccauaggcuacagauguaaaaauagcugacaccaucuaagcacacaugaguacucauggccugauauagcauaaggggaaaagauaauguuguaaguagaaguuucugccugagguuggggagacaagcugaaaguaggaaacucuccccugacuguccuccucuuuaccuccagaccuuccugcagcagacuucuaaggcuaaaggaccaaccuggaugggccugucagaccugaagaaggaggccacguggcucuggguagaugguucuacucugucauccagguagauccagugaacaaccaguaguguaguccagacaggucucugauguucugauagcuaccugugagucucauccucuucuuccucaccucuuagaaauaagagccacccauauuagcugauggaaggaaguuuuccuacccaugcacagauagaauaucagcaaaucccaccaucaaagcaacaagaaaaacuucccccugagggguguuaauuuuaauguaggcuauuaguagaaaauacaaaauaaaguaaggccacaggguaaggggacuauuaacauugaaagauauauuauuggguuggggauauaaauauguucauuaaguagcauaagguuugauccccccauugcauagucugauauggugguccaugccuauaacaccagcaguuggaagguagagggagaagaaucaguucaauguuaucuucagcuacaaaauggguucugagacagccugagcuacacaggaaggaagggggagagagaaagagaaaagcagguagggaaggaaauguaaagaaggggaagaggacaacaguagcuuaaagggaguuuauauggauguucaccgaucccacagcacaacacagagaacauggggaagaaccacaacaaaucagaauaaaaaggaaggacacacugugggaaagaaccuuuacuuuguuguccaugcauaagaacaggagagacuggcuuggcaucuauuaguuuaccauuuuaacuuucugaucccuaauugucuuacacaugcuuggcauguggcagauguauuguggaccagaaugcaagaacccaguaaggaaggcaaaauccagauugauugguuuacaccacaaaaauaaaauaaaauaaaauaaaauaaaauaaaauaaaauaaaauaaaauaaaauaaaauaaaauagaaaaacccacaccacuccuucaauguaggauauaacaagagucauuuuccaaagccagcagacccaggcaugcccccaucuccagaggaaggcccaucuacaauaugcauucuggaaggagguaaagacauugaguuucagaaagcuaaaaauauggcaugguucacagcaugccacuggagcagacuaacguuuuucuggcugacuuuccagauuccagaaauauuggaauagaggggagccuaacaacaucggugaggaagacugugucgaauuugcuggggauggcuggaaugacucuaaaugugaacucaaaaaguucuggaucugcaagaagucugcaaccccaugcacugaaggcuagcucaucuccgcuccuaccuucaugccauucugccaggcacauggaugugccucacuuucgugccagcuccuucuuccugccuguuggccucaggaucgugaaaaaggcucugggauucuucuuuuuaucagauuuuucauccucugcauuuaucauaguuucauuucuguugaugugauaaaacucucuaaccaaaaacaacuaaggcagaaagggguuuauuuuaccuuacauuccagaugagagcagggaggucaggauggcaggaacuuaagacaauuggucacaucacaucaacagccaggaggagacagaaguaugugcaagcuaacgcacacauuugcuuauucucaguuccauuuuccuauuccuauaguuuaggaccccugccuaggaaauggugccauucauaguuggcuagauguucccaccucuguuaacuucaauaagacaagcccccacagacaugcucacuggccaacccaaugcaggcaauacaccauugagccucuucccaggugacuauacgcugugucaggcugacuaucacaaagggacucacuauuguccuuuugcuuucagguuucucugggcuuagggcucacuguuguccccccacuucagugcaguuaccugauguaggaugcuuucagaaucuggguguuuuccauuaaccuacuccaucuuccuugcugagacacauacacucaaaggucagaagaagacauugguguucucuuugauagcucuuuacucccuugagacaggaguuggaguucauuauuuuuuuagcaaggcuggugaucugaaagauccaacauuuuucugucuccacucaccuccuaaaugaaguuacagucacauguggccaugucuggccucuaacaauuacuagggcuucaaggucaggcccucuuucuugcacaucagcacucuuauccacuaagcaucuccccagccauuugucuauugucagguagucuaguuuacuguugcuguaauaaaguccugacaaaaugcaag

SEQ ID NO: 4260 - RNA, 554 nt, Mus musculus
aaugaaaacauuaaauguugauaaaucuaugaagagaggaagcauugguucaggaaaggagcugacacauacuuauccuucagggguuagcuuuguuaaaagggcuuccagacuauggucaggccuccauuaugacaccuuccacgugauuugcuaugucaagaggcaucugaugauaaugauggauauugauggcaaacaugaguggagggacugcauugagaugcccgggauccggcucccccagggcuauuacuucugcacuuccuccaucacuggggaucucucugcuaaccaugaugucauuucccucaaguuguuugagcugacuggagugaggaccccagaagaagaaaagcuacaucaagauguauuccugcccucgguggauaaucugaagcugccagagaugacauuaccaccaacgccccugaguggccuggcucucuuccuuauugucuuuuucuccuugguguuuucuguauuugccauugucaucgggaucauacucuacaacaaauggcaagaccagagccggaaacgcuucuacugag

SEQ ID NO: 4261 - RNA, 733 nt, Mus musculus
ugccaacgccccgucggagaagcugaggucaacauuuaauuugaaauauuaaaagugcaugcaaaacuauuuccaaaaugcagacaauuaaguguguuguugguagugauggugcuguugguaaaauaugucuccugauauccuacacaacaaacaaguucccauuggaauauguaccaacuguuuuugacaacuaugcagucacaguuaugauugguggagagccauacauucuuggacuuuuugauacugcagggcaagaggauuaugacagacuaugaccgccaacuuauccacagacagauguuuuucuagacaguggucucuccauccucauuugaaaaugugaaagaaaaaugggcgccugagauaacucaccacuguccaaagacuccuuucuugcuuguugggacccaaauugaucucaaagaugaccccucuacuaucgagaaacuugccaugaacaaacagaagcauauuacuccagagacugcugaaaagcuggcgcaggaucugaaggcugucaaguauguggagugcuccgcucucacacagaaaggccuaaagaauguauuugaugaagcaauauuggcugcccuggagcuuccagaaccgaagaagagccacagguaugugcugcuaugaaugcaucuccagagcccuuucugcacagcugguguugucaucauacuaaaagcaauguuuaaaucaaacuaaaauuaaaaauuaaaaa

SEQ ID NO: 4262 - RNA, 2701 nt, Mus musculus
aggagaccgcaccaucugcggaggcggccaagcgugucucugaggggcgagccccguugguucucuccuucucccuacccucucuaaacuucgucugcucuuaccucucgagcuucugucugggcccuagagauguagccugggguccccaaaccaaggccgaaugccacuguagcuauggcgccccgaggauuggggcggucucaaccuaacuggggcguguuuugggggcguggccucggcagggcggcugccuuggagcugcaaaguuuggcuguggcggcaaauggguuugggcggcuccucggcggguggcggugguggccuuagcgguuccuccuggcccuguuaaugucagggccaagcccggggaggauggcgccuuagagccuggccuugcugggguaggggcgggaggggggccggggcggggaccggccaugucggaggugaccuggagucugcugcagcgcuggggcgccagucuuaggagaggcgccgacuucgacucuuggggccagcuguuggaggcgauagacgaguaucagauauuagcaagacacuuacagaaggaggcccaagcucaacacaauaauucugaauuuacagaagaacaaaagaaaaccauaggcaaaauugcgacauguuuggaauugcgaagugcagcauuacaggccacacagucccaagaagaguuuaaacuggaggaccugaagaagcuagaaccaauccugaagaauauucuuacauauaauaaagaauucccauuugauguucagccuauuccauuaagacguauuuuagcaccuggugaagaagagaauuuggaauuugaagaagaugaagaagguggugcuggagcaggaccuccugauucuuucucugcuagaguuccugguacuuuauugccacgguugccaucggaaccagggaugacguuacucaccaucaggauugagaaaauugguuugaaagaugcggggcagugcaucgaucccuacaucacagucagcgugaaagauuugaauggcauagauuuaacucccguacaagacacuccuguggcuucaagaaaagaagauacuuacguucacuuuaauguggacauugagcuccagaaacacguugaaaaguuaaccaaaggugcggccauuuucuuugaauucaaacauuacaagccuaaaaagagguuuaccagcacuaaguguuuugccuucauggagauggaugaaauuaaaccugggccaaucguaauagaacuauacaagaaacccacugacuuuaaaagaaagaaauugcaauuguugaccaagaaaccacuuuaucuucaucuacaucaaaguuugcacaaagaaugauccugauacaaauaaccaagaacuugugugaauuuuaccacucagaacccaucauagcucuguguagcauaaucacccuucaacaggcaggaagugagcccuacccaugccagcugaccgagccagucuauugcacaacaggcaggaaguaagcccuacccaugccagcugaccaagcaagucuauugcacaacaggcaggaagugagcccuacccacgccagcugaccaagccagucuauugcacaacaggcaggaagugagcccuacccacgccagcugaccaagccagucuauugcacaacaggcaggaagugagcccuacccaugccagcugaccaagccagucuauugcacaacaggcaggaagugagcccuacccaugccagcugaccaagccagucuauugcacaacaggcaggaagugagcccuacccaugccagcugaccaagcaagucuauugcacagccgaaccccagaacaaaaguucagcacaucacugaccuaucacuccuuuggauacagguuuauuguagauuuggaaacguuuucacuuuucuauuaauugugcaaugaauagucuauuuucucauugccacuacuccccuguuucccggacagcacuguuguagaugugcagaacuucagacaaugcagcaauaagaaugugcaagagucuacgucucugcucacuucugcuccaguaugcucuucugguuucaaugccacgcugugaguugaaguggguagaacugcucugagaggaacuggacuaguuacauugccuagcaaagucuccuuagaagagaccuagccuggugccgugggucuccugcauagaaagugugaccuggccagaugagcaucccacccugaguguuccccagaugaccagacugauuuccugaagagagcacauguaucgucagguggauuaucuguucuucucuauuguacugcuaauucuuucugguaguucuaggguuaacguuggaaccaucucagaauaacuauggauuugaaaacguguuuacagugucuuuuaaacuaucauuuaggaacaguugagucagaugucaagauguuucgggauaacugcugcuuuccugaccacccguugugagaccuuaagaccccguaccucuccuuaguaugcaaaaaucuggaaagacugucuauuuuuuaauauagguagauaggauugccauuuauuuccuauuuagauauacagucauucauccauaugaaaauaugcaggucacuaguuuauuuugaauggacuauuuacuuuugguguaacaaggcauaaauaaaacuuugaaagcaaaaaaaaaaaaaaaaau

SEQ ID NO: 4263 - RNA, 2701 nt, Mus musculus
auuuuuuuuuuuuuuuuugcuuucaaaguuuuauuuaugccuuguuacaccaaaaguaaauaguccauucaaaauaaacuagugaccugcauauuuucauauggaugaaugacuguauaucuaaauaggaaauaaauggcaauccuaucuaccuauauuaaaaaauagacagucuuuccagauuuuugcauacuaaggagagguacggggucuuaaggucucacaacggguggucaggaaagcagcaguuaucccgaaacaucuugacaucugacucaacuguuccuaaaugauaguuuaaaagacacuguaaacacguuuucaaauccauaguuauucugagaugguuccaacguuaacccuagaacuaccagaaagaauuagcaguacaauagagaagaacagauaauccaccugacgauacaugugcucucuucaggaaaucagucuggucaucuggggaacacucagggugggaugcucaucuggccaggucacacuuucuaugcaggagacccacggcaccaggcuaggucucuucuaaggagacuuugcuaggcaauguaacuaguccaguuccucucagagcaguucuacccacuucaacucacagcguggcauugaaaccagaagagcauacuggagcagaagugagcagagacguagacucuugcacauucuuauugcugcauugucugaaguucugcacaucuacaacagugcuguccgggaaacaggggaguaguggcaaugagaaaauagacuauucauugcacaauuaauagaaaagugaaaacguuuccaaaucuacaauaaaccuguauccaaaggagugauaggucagugaugugcugaacuuuuguucugggguucggcugugcaauagacuugcuuggucagcuggcauggguagggcucacuuccugccuguugugcaauagacuggcuuggucagcuggcauggguagggcucacuuccugccuguugugcaauagacuggcuuggucagcuggcauggguagggcucacuuccugccuguugugcaauagacuggcuuggucagcuggcguggguagggcucacuuccugccuguugugcaauagacuggcuuggucagcuggcguggguagggcucacuuccugccuguugugcaauagacuugcuuggucagcuggcauggguagggcuuacuuccugccuguugugcaauagacuggcucggucagcuggcauggguagggcucacuuccugccuguugaagggugauuaugcuacacagagcuaugauggguucugagugguaaaauucacacaaguucuugguuauuuguaucaggaucauucuuugugcaaacuuugauguagaugaagauaaagugguuucuuggucaacaauugcaauuucuuucuuuuaaagucaguggguuucuuguauaguucuauuacgauuggcccagguuuaauuucauccaucuccaugaaggcaaaacacuuagugcugguaaaccucuuuuuaggcuuguaauguuugaauucaaagaaaauggccgcaccuuugguuaacuuuucaacguguuucuggagcucaauguccacauuaaagugaacguaaguaucuucuuuucuugaagccacaggagugucuuguacgggaguuaaaucuaugccauucaaaucuuucacgcugacugugauguagggaucgaugcacugccccgcaucuuucaaaccaauuuucucaauccugauggugaguaacgucaucccugguuccgauggcaaccguggcaauaaaguaccaggaacucuagcagagaaagaaucaggagguccugcuccagcaccaccuucuucaucuucuucaaauuccaaauucucuucuucaccaggugcuaaaauacgucuuaauggaauaggcugaacaucaaaugggaauucuuuauuauauguaagaauauucuucaggauugguucuagcuucuucagguccuccaguuuaaacucuucuugggacuguguggccuguaaugcugcacuucgcaauuccaaacaugucgcaauuuugccuaugguuuucuuuuguucuucuguaaauucagaauuauuguguugagcuugggccuccuucuguaagugucuugcuaauaucugauacucgucuaucgccuccaacagcuggccccaagagucgaagucggcgccucuccuaagacuggcgccccagcgcugcagcagacuccaggucaccuccgacauggccgguccccgccccggccccccucccgccccuaccccagcaaggccaggcucuaaggcgccauccuccccgggcuuggcccugacauuaacagggccaggaggaaccgcuaaggccaccaccgccacccgccgaggagccgcccaaacccauuugccgccacagccaaacuuugcagcuccaaggcagccgcccugccgaggccacgcccccaaaacacgccccaguuagguugagaccgccccaauccucggggcgccauagcuacaguggcauucggccuugguuuggggaccccaggcuacaucucuagggcccagacagaagcucgagagguaagagcagacgaaguuuagagaggguagggagaaggagagaaccaacggggcucgccccucagagacacgcuuggccgccuccgcagauggugcggucuccu

SEQ ID NO: 4264 - RNA, 3052 nt, Mus musculus
agaaucgaccucacagagggugcugcagagggccaugggguuauauaaaucccagggcagagggaagguggagaggagggagucaagagaagcagaggauggcaggagagccagaguuccaucagucaaagaaucauggugaggcuggguaccaacuaggggaagcaggguccaggauccaggauccaggauccagagagaucugguccuggccuccagcuugggagagguggugaugagggagguggcugagcuuugaaggucagcugcguaucuucugccccauucagaggaggaggucacaucuggagagcagggauuugcugagcaugaccccgagggucucauuugcagcuccaagaguuuacaagguaccaggaugacucaggggcagaggugucagggauucucugcagaaggaacacggcagagcaggaucugcucccugggagcucagcucugcccaucugucgguugugcagggcaucugacccaaguccccuggcuucugcugcuucucaucucuuugggccucuuuuugcuuauguuggccacccugguucaagguaagucagagcagggcugggagagggugacaggaguacagaaugcuuuuagguugacuuguuugcuuuuuuuugggggggggaggggaguucuguuuuuauuuuauuuauuauuuuauuuuugcacuuguuaagcaagaacuccagcaugggacaguagcugagcucuuagauuuucccucuguggugaucauugccuagccccaaauucaccacagcugggacaucuaaaguccacaucccuccuuucaucugugaccaccagcagcuuacuguccuucucugaaauggggaucaucuuucccuugcaacugaacuuggcacagccagguacugucauguucauaagagggcaugggugugcucuucucucuugcagucuccaggauucgugcauacucacagggacagacccaggaucagcaggguagcuccagcuuggacaaggguaacuggggcucuaggugggagaggacucugagguuguacgaggcggguaaccaugggcacaggcgugcuggaugcauggcaugaugggggaggccagagaccuguugggccuaacagagucugagacucagugcuguggucugugaaaugggguccuggggucaauaugaccaccagugugauuucauggguccagcucuggagcaggcacgcaguugaugcuuaauuguugccaaccucuccuuguaguugccguuccucgggagcagacacacuccggcuuggagcagauccagcagauucagcagcagcugacucaguucaacgccucgcugggugagacuccaaggccugaguuaggacagagcagaggggucaucagauggguuggcauccaccuuccagggcuuccacugaggcaggcaggacagagcacaugcauugaggucuggguuuggggagcucugaguugauaacugaaaaaauaagagaccagcucugggcucuaagguccaaggcagaagggagaagagaagccagccacugaacucagugucugcuccguagcuggccugugccggcccugucccugggacugggagcucuuccagggaagcugcuaccucuucuccagaacccugggcagcugggaaaccucugccuccuccugcgaggaucucggggcccaccuggugauugucaacaguguuucagagcaggugaguggguccaucuguccugggcauuggacucuagaugauaggaagcugugggaugugaaggagaugcugucugggagggcuuccuguaggaggaagcacaauggagugaggagguccucugggggaagagcagagggaaagcaguuggaccugcagggaguagagaaagucugagucaucggguaacccuccagaaauacacuugugaacugagaugugugcacuuuauucuguauccuuguaugcauauguaugacaauguauacaacucaauagagugccucuagacuugagugcagagugaaguugugcgcgaggcugagaagagugggaagcagagaaucgcagaccuuucucugugcagagauucaugaaauauuggaaugugaggaaaaaccaacgcuccuggaucggccucagugaccauauacaugaagguuccuggcaguggguggacggcagcgcccucaaguucaggugaacacugagauuccauggcucagaaagcagcuggcaggggaaucauucuaaauacaaccuucacugcugagaagaacucagagagcauuauaacuacaacccuacauuaccuggguauuuucacauccugcccccagcuuaaguccaaaguccagagaccuuugaaagagaccuuuuccuuugcugugcugauucucuuaggggucauguuagaacucacuuauauuuuaauagcucugccacgaaccccugcccacugcuuggaggguucuuggucuuuuaccauaaaagaguguauagcuuuucuuugcuagcuacugguggguucuggguggaauggcucugucugacagccagugauguuugcagcuuuuggaaagagggggaaccuaacaaugacggagaugaggacugcguggagcuguucauggaugauuggaaugauaauaagugcacugaacagaacuuuugggucugugagcagcccucugcucccugcccucaucacugaagaucugugcuccccuagucacacaggcaacuugggggcacuuugcucccauuccagcugccuuauucaucccagugccccuguucugagaccuuugagauccugagagaguuccugaggcacccuacccugcagugcuucccucuuccucuguaggugauuucaguuccacaaauccugagcucaggaguccccucaguagaaucauacauauaaggaguugggguguagcucgauauacuagaguuugccuagcaugggugacucucugauuccauucucagcacccaaauaaaaaauaaaauauuaaauucacacauggu

SEQ ID NO: 4265 - RNA, 44359 nt, Mus musculus
uccagaagacccaaauuuauuucccaacacccacaggucagcucaucuguacacccaguccaaagaauccagugcuuucuuguggccgcucuggguaccagguacacacaaggugcacagauauacaugcagacaaaacacccauacacaugaaauaaaaauaaaaaccaaacaacaaagagcguggggaucuuagcgagugaaucguacguagaugguacagggccugagaguauagaaauaacccccuugucacacagccguuuccacccuccaggaaagaggaaggagguuuucaagacucaggaaguaagagaacaagucugggaaaggugaaauggaacaaguuucaccagggucccuccuccaaggucacgauaacaccugcugcugcagacggagaauagggcucugacccacuuacagcacugccuacaaguccugcagagagcucucagguggcagcuuccuggaguccucagccauacugggguguuguucugguaacacagcugccucugagucguccuggcuccuguaaguaaccccaagaaaaccucaaugguucaccaagcugacuugagucaaauuguuacuuuggucuguuguggauucccuauuuggggugagucaagucaggaaaggccucaguguggaugcaaugaucugcuaagagaaaacaguguuccugauacaagugacuauguacauggagaguaccaugacacaugccuaaagcccugcuguuuggaagguugaacccaaaggauccccugagcccuggaguuucaggccagccugaggaacagacaccaccaccccaucucaaaacaauaaaaauuaacuaggcugggggugugguuuaguugguauagugcuugccuagcaugcaugaagcugugaguucaagcccagcaccauauaaaaccuaacugguggcacugccuguauuuaaagcucuuaagagguggacacgggagagucagaagaucaaagguauccuuggcuacugaguguaugaccacccugagcuaaaugaggucuugucccaaaaggggggaaaaaacuuuuuuguggcacuggggaugaaggcuuuggucucauauaugcuuagcaaguuuucaacuauugagcuacauccucagauuucccaaaauuucuuuuuagcaauuaaagagguggcucggugauuaagaguacuugcuguauuccacagaaccuguuugcuucacagccuucagguaggguagcucacagcagcuuguccaacugcagaggggccaauuacuucuucuggccucuucaggugacaugaagacaaacugaacuaauuuaaaaaaauuuuuuuaaaauaaaagcuggauugcgguggugcauucguuuaaucacaucacuugggaggcagagucaggcagaucccugugaguucaaucccagccugguauauagaacaagcuucaggacagccugggcuacauaguaagacccugucucaaaaaaaaaaaaaaaagauagauagauagauagauagaaacauauagauaagaaauuuuuaauuuuuuuuucaaaauaauuucacuguacuaagaggccaaaagaggcauaagaggauauccuagaacuggaguuacagguaguugucagccaccagaugugggugcugggaagugaacucagguccucuguaagagcaauuaucaaucuuaacucccgacugaacuguucaggugccuauccuccucuuuugagccaugcuuccauguaaccuaggcuggccucagagucacuguggagcugagaacggccucgaacuugucuuccugccuucaccucccugagcuggggacuacagguguuuacuacuauaucuuuuuuuaccaacgugcuaggaucaaaccuggggcuucgugcauguuaguuagguaggcacucuaccaacugagcugcauccuccgcaggagguugauuucaacuugaugcuguuaaauagcacagcacacaaacgggcuguagaagaacuuuucuuuccuuuucuuuucuuuucuucucuuuuuuuuuuuuagaugagggaaaggaauacagaaauguggauggaaugagguuuucaaucaccugaguauuuaguaauagucuaguuuuucuuaacaguuucaaaauuuuaauggggcaauauagauaaaagagggagaguguaugagaucaacacuauaauacacauccaugcacucuggaaacuaagguaggaaaauucugaguuugacaccagucaaaugcgcugcgaguuggaagccagcuugagcuguggugagacccuaucucauaaauuuuaagccgggcgugguggcgcuugccuuuaaucccagcacucaggaggcagaggcaggcagauuucugaguuccaggacagccuggucuacagagugaguuccaggacagccagggcuauacagagaaacccugucucaaaaaacaaaacaaaacaaaacaaaaacaaaaacaaaauuaaaaauuuaaaaauccaugugacugucaacuguuaguaucaaauagaagcccugacuauacaaaagguuaagaucucaaaccuuagaaauccugacagucccuauucugaauagacuccucuguuuccccucgugucccccccccccccccccgaucuucagccaucaugcugaacuuuuuuguagccuuuugugaaucaggcuguacuccacuacucaucagucuccuccagaggggaaccacucccccugcugaaccuaugaucucagcuuuccuucuaugacacauccuuccuugccccacccuguccaaggcccauaacccacacccuggagucauccucuucucaagucuuguagcugucaaugaugggucauacaugcucucugcccucacuuacuuauuaaaagaaucuaggaucuggccaagguggugaguggaaggugaaaagugggaggaucuggaguucaaagucacccucugcuacacagaaaauuuugaggucauccuaagacuacaauagacucugucucaaaaauuaaaauaaaaaaaaaauaaaaacaaaguggaaggagaaaggggaggaggaaaaaaacgaggacaagggggagucggcaaaagaaccaaggucccauucauucauucauucuucaagccuuuaaagcagcucucacgugugcggcucuggacccaaaggagaccugacacccccuccgccgcucuauaccccauccccgccccgccccgccccgucccaggagagauaaugguuggggcaaaugaaggaugcaaucggcguuuugaugccagauucacccagcaaggguaggaccugaccuaaccacccggccaccacagagaugcuggcucugaagagaggccuucugcauacgcccgaucuaaaacccaagccaggagcccggcccuugucuggucccgccuauccuugcaccgagacacgccuccucauuaacuccuccauuucauucagcccauggccuuaaguccuaccgcccaggacgccaaccucauucccagucucacgacuccauuggucaaauacaagagcccgccuuccaucagugucgcugacugcuuagaagucaggaucucuuucacagcacaccccucccaucucaacaguuaccagggacgagguuugaagagcagauaguaauggacggcucagaaccucucaugauuggguagaauuccagcucugggcggggcuuagugcuuucagcuaaggguugcucaaggccucagcuuuccuuccgaggcacaccucucgcccaucacuauuaguaguuuaggugucgaucaauauuauuacuuauuuugauagguaaaauuagauguccaucacagauucucucauuucaauucgcuccucuccucagagaaccguagccaggguccgccucacgggguggcuauggauuggucaggucuuaugucauucuucuacagugggcggagccaaaggccuaagggggcggugaauugguugacugggcuggggggcggggggcggggcagcggcuccugucagcgggugaaauggcaguggcggagccagcgacggccgcgguccccggggguggcugauugaaaggggccgggccgcgggguuugcgggacccucgagcagacgugaccgugggucggggcaucggacgacacagcgcagggacagcgaggcucggcgcggcgauggaggcgcucucggcgcagguagggcggcccgaaccgggccucuucuccuugggggcgucagugcugcggggccccgcggggaagccaaaccaggagcgugaccuggggucgccucgccuccagaauccacgcugggagccuuggcauucccagucccggacccuggaacuccggccuccgcccacccuccuucccgauccccucaggaucccucccagggcuccuaagacccagugucucuucgcgacgucccccacaggcucaggaccucuguacaucuuucccaagacuccucuguuagaaucuguccagggcuuccccaucccccagucugcagaccugcccccccccacacacacacaccaugagcgucuccuuuccaauccacaaccaccaccaccaccaccccgagucccaggaccccucccaucugcacaucucuugccuuuacaucccccuaaaccucccacuuggcuuccugucuucugugucuggccuacacccucauccucuccaaggagaccaagaucagagcccuauacucuuucuuucugacuccacagaaacccaugccucaccucuuaaacggaaagauucccaacugaauccagagacaucagcucagccugcucacuuggcaccccuccugcucaagggcuccaauaaaaacaaaaacaaaaaaaacaucacuucuagucuucugagaagacuauacacuguugcugaucuugagccaucuagauggcaucuuccugaagaaaugaacacucaggacuucccaaaagaccaaaagauagugcugaaucccaucccccauagacacacccuccccauccaucuuucugauacagaguggggucauuuagauaccccuaaauauacaggaaccuaagggcccaacccagacccaggcccaugagugcucucccccccccaucucucucucucucucucucucucucucucacacacacacacacacacacacacacacacaugagaacuucuauacaccuucuugagcccaguacccucaacagaccuccuaacucagacaaaagacagaagauugugagguggcaagcucuguccccagcaccuagccugucccuuccaccccauucucuuugaguugggacuccagggcgugucagggccuaagaucuaccuaccacaaaucucuccccccccucucucuuucuuauccuuuuuaauaggaaggacauucuuuccuacaccagugucccaaaaggaaccagugcccaucuccaaaucaauggcaccucccuauacauaccauggggagugagaucuuccagcggcuccuggccccaauccuaaagucugaccagacugguaggaccagcauccuugagccuauggcaucuguuggccucagaugauauagacagugcugccaucuaaggugcucaucaaggccaguuucugagagcccugugaguucuuuuacccaccaccaauguuuggucaaaauaaaacagcuuccuccuagcaugugggaucugcucagacugggucagaccugccaaaagcaagcaccucuuuaaggaauauuuucagaaggguuaaaaugugaagaagacagggggggugugugugaaaggaugagugcucugauugacaacccccucugcuugacacccccacucccauauacaccacucccagccaaucugucauuaagccagacuccccacaucccucacucuucaugguuguauuguauugguucucccuaccaauucugccccacagcucccauccuagggucccaccuguggguucccucuggauuccugcgguugacuguggugguuuggaagggaucacagguagcuuggccccggcacaagacagagaggaaagaagagauugcagaacuggcuguaguuguagaacuagggaguguaaaggagaauccagaacaaaccagcuccuaacaagcauuugguuaugccuggaaagacccagauaaaaagccuagguuuccuuguagaauauuuacaaacaaauucugaacagauuugaauaaaaaaaaaaaacucaucuuggcuuagaacuucaacuucuccaucuggaaaauggggguugggggaaaaagcccuuagaauaguaguauucugcugcagucaagccaguuagauuaggguguggccuaauguguuuccugggagcagugagguuuagcagaacagugggguuuagcagaacagaccccacacacaccuagcaaaguugguauugucacuggcccugaugaucccugucuucaguggauaguagccauaucugaaggacuuagccaucuugcaggaagcuggcuuaaaucagggcugaaagaaugaagaaaaaagaugaucuguugugggacuuguagucaugcaggcaucuucuggaaggacugaggacauggggaacuaacuacuggcagcccuccugauggacacaagauagaaguuuaucauguccauuugagagcaagagugcaugaaaagacuugaaggucauguggcacaugagaagcugcaagaccuccccccacuccccaggggacuuugcacagauggacacagcggguuagaaagggccccugggauagacugugaacucuguagaaaguacaagaaggcuuuaagucuuugaguagagccaacacagcuuugcuguagccuggggauauagauacauugucuuuugugucugugcuuugauagguacuaguagaucagaaacaagucuuguagaaugucaagucaguguuuaugggugauaaccccacugugcccagggaauugacucagauggccuguaucuaaagccugcacagccagcuugaggaagaguuagacccagaagcacacauugauugagcucuugucuuguguucacuaugccaaacaucauuugcauaucaucucauuuaauccucugagcgaccgaccgaaaggagccaguguuccaguguguuccuuugcuaucacaugcugcugcugcugcugcugcugcaguaggaaugcaggagacagaguuacuuacacugccguaagagcucugagaaaggacguccaggaaggugugacagggaugacuuauggaugcagucaccaggcaggcguggcagguuagggugucccagaaguacuuggacaggggcugggcaccagcauaguucuuucaugggaugcgugagugacuucuagggauggacagauggauggaugagcuuuacccuuuaggccagcgucuaccaaaugugauccauaugacaguacagaccaucaggcacucauggucaaaaagggaucugagauugggaaaauugggagaagguacaaaccauaccaucuccaggaaagccaaagucaagcacuagaaagaaggaaguuguugagagcuaacaugcucccuguguccacaccccaguuggagaagauaccaucccucagaggaacguuuccaaugcuccuuuggcauauuuugccugcacuuuaaugucuguucuuaacauguauccaugugcuugugaaacauuuuguuuguaggggacaugguagguguauguguuaauauuucacauaugagugaacgcaugugugugcguguacauguggaguccaggggucagccgugagugucauuccucagaauauguauuaagcugucauguagguacugggaaucaagcccugguucucugcaagagcugccagugcucuuaaccacugagccauaucuccagacucuguccaccuuguuuuuugaaagaggucucucagcuggguggugguuggugcaugcugguuugucccagaacucaggaagcagaggcaggaguucaaggccagccuguucuacagagccaguuuaaggacagccagggcuacauagagaaacccucucuuggccggggcaaggggggguuaaaaaaagaaaucagucucucacuaggccccagggacccucuugccccugcuucccuggcacugguauuacaagcauacaccacugugcaugacuuuuuacauggaugcuaggccuccaacucaaguccucaugcuuuuauggaaaguacuggccuaucucccuggcccuaugaaauaauauuaaguaguugguuuuugccuguguguauguaugauguacuuguauguucuguacaugugcacaauugucugugaagaugcacuucccuguggagggcagagugucuuccucuauugcucuccacuuucaucuaguagcacaggaucucuugcugagccugcagcucuccaguuugucuaguuagccagcuugccuagagaucuccagucucugucucccgaaucuugaauuacagaugacugccaucccuucucugcuuuuuuauuuuuaauaauuuuuaugugugucccuguuugaccuacauguaugucuaugcauuuugugcaaugcccacagcuaaaagaggacauuagacccucugaaauuagaguuacagacaguugugagucucaguguggcugcugggauuugaaccugagaccugugcaagagcacaagugcucuuaacuacugaaccauuucugcagccccuccugcucaucuuugaccuggcuucugugaguccaaacacuacuuuuacaaccaacacuuuaucuauggagcauuuccacagacccccucccaaugaaauccuuucacugguaccugucucccacacaaccuguaagcaagucucaugaaaggagggugccuaucuauucuccaguaucuguaucuauucacaggugaaucccagauucacauagcaguuucucaguaaaauguguuugauuuuacaagcuaaugggcuucccucccucagccauuucugaaacagaaagaggucagaucugucugccuuagguaaagguaaugcuuuguaaggccuaucugccucacauguguccaccauccaauccagcucaacaagcccagaaagcuggcacagaugacagagaaacaucuccaccugugcaccugccacaggaagcccuuguaaaagggcuuugauguucuuccucugucauuuucaaggacauuuaaauagagaaaaugaagaaauuugcccccaagugaaccuguuacaguggcagaaaauaagcugguaaggacacacaacauaagccuauuuuuuugggucagaugagaauuuguaggucauaaugguccacccuuagguuuucaccugaagguguguugcuguuacugcuccuguuacuaccaauaagggugauuauaguuuuauaguguuuaguccuuaaagaucaucaccauuaaggggcaauuugcacuggacuguaggguccacacaguggccuugacagcccuuaccuucaaggaacuguccauccagcagggaauaaauacaggcuacugcugauucuaaacacaggacaaaagucugagugguaauaauacagaguggggaggagggagggagggagagagggggggaagggggagaaagaguguuggucggguacuauaucauuagcccuguuuacagauugaaaugucaugauacccuggaucacaaggggggaguauaggaggagguuucaacuguaagccaaaagauuuagaauaacuguccacacugcaagaauauggaaaauuccagaacaucuuggagaauuggguaaaacugacagcguauguauguagcaccauugguagaaugcuugcuuggcaugcacaaagcccuggauucaauccccagcacuauaaaaaccagauuuaguggcuguucuagcuccauuuucuauugcugggauaaaguacccuggccagaaguuugaaagauaguucagcaauuacaguaccuucugcucugcacaggaacagaguucacuucccagcauccguguugggggacucacgacucaucaacucugggaucugacgcccucuucugguacccuccaggaguaccuguauucacauacauacacccacacagagacacaaguacauguaauuaaaaauaaaaugucacugggcaugguagcacaugccuuuaaucugaacacuuuaagacccaaaaauaaauuuuaaaaguuuuuuggguuuuuuuuuuuuuuuuaagacaggauuucucuguguagcccugaccauucugcaacuuuguagacaagacuggucuugaacuuagagauacuucugccucccaaggacugggauuaaaggcuguaccaccaccaccuggcaauaaaaugaaauuuugaaaaauaucccaaucaaaaaucucaagggaagaagggcuuauuggcuuaccauuccaggcuacagcccaucauuuuuggggaaguugaagcaggaacuuagaugacuaucaagagcagagaguauccauugcugccuacuugcuuaauuaacuuuugcucagaaagauuucuuuucucucauacauuccagaagcuagcauagagaauggugucauccacaaugggcucugucauuuaacagucaagacaguccccaacagauaagcccauaggcugacuugauuuagacaauuuugcaauugagacccucccugaugauucuagguuacagcaaacugacauuuaaaacuaaccuguuugguagucuauaucugucuucucagcacucaguaaaugggagcaggcagaucaggaguucaaggucauccucauuuaccuaucagguuugaaaccagccagggcuacauaugauuucuaucucaaaaagaagaggaggaggagaaggaagaugaagaugagcagaagaaauuuaaaauagcuaaaaaugcaagggagaagaaagcaauccucgguguuuuccuuguuaccccaggaacuauauacccuuugccaaacaaaagaaccuagaacccagccauacuauugccccaggacuuggggacagccacagcaaugauggucugcugaccaguuuggggacauuggggacaaguagcaccauuccaagcuucagauccugaucugaaucuauguuugugguaaucauaggagggaggagaucugaaaugugacuuuuuucaauuuuucaauucaauucuauucaaauuuuucaaaaagaauuuggggucuuuauuccucuucauaaugucaugcccuccauagaaguugcccauauaggcuggcugguucacugugcugaaaaacaaugauugugaauuaucaagugcucacuaagauuuaccagcugcacucaguguuuuaugucuaucauuucuggcuggauuguuuuguuuuguuuuggguuuugagacaguuucuuuguguagcccuggccauucuagaccaugcuugugggacaguggaccaugccaggaaacuugguagguugagcggguucagagucccuggcucccaggcacccaccugagacaguaggcggcuguucccugccagauuccuguccuggaacaccuguccauacuugccacaguagucacacagcccagaacagagcucucuaugcuaaugagguaccuagagacccugaggguuuaaccaguaagcuucccuucucagacauuccucccuguaaaauguauuuaaucucugguccacccucaggaauugauaugcauccauuuuccacaaugaagagucaauaaagccuacuccuacagagcugcagccuaagucuccuguagaaggccucucugcacuuccagaaaaccaccaccaagcuaagccuaaguucccauuaucccccagccccaggcuaguccucagccugugggccccugacucugcucucaauuccucgaaacucagaggaccuggauguccaaaaguuuggagcacccagucccaaccucaucauggguccauggaccccaauccuucauucccaacucuucuguguagcaccccaguggcaacuagaugcucaggagucagggaaccccagcuucagccucccccauuuuagacuguauuuucucacccccugagccauaucucagugcuuugcuaaagccugguacccuauggcaucagccauaccccagcugccagguagaacauggacccacacaugcuggccucaaacucagagauucuccuggaacugccuccugagugcugggauuaaaggugugcaucaccaugcccaacuuuguuuuuggguuggguuugguuggguuuuuguuuuauugguuuuuuuuuuuguuuguuuguuuuuguuuuuuguuuguuuguuuuuguuuuucugcuuuuuguuguuuuugagauaggagagggucuuauguuagcaucaaucucccuauauagcugaaacuggccuugaacccuggucuuccugucucuaauuccugaguauugaaaugacagacauaaaccacuaugucugauuuuguggaagggggacauuuaugcaagugcacacaccuguacauguucacaaaggccagagaaaggaaucuuccucuaucacucucugacuuauuccuuugaggcagggucucucccugaacuuggaucucauaauuuuagacuagacuaacaacuagcaaguccagcaauaaucuuauuucuggcccuuacaacacugggguuacugcagcaccacucugguuuauuauaugggugcuaggaucagaaugcagguccucaugguuaagcagcaaguacucuuaaccaccaagccuucuuucuagcccacacgccugguuuuauaugguguuggggauggaacccagggcuucauauaugcuaagcaagcaugcugccaacugagccacaucccuggcccauauacauauauaauaacauguuauauauuaaacauaauguauauuuuuaacuacauguuuuuaaaauaaaaauauagaaaaggcagaagcaucauggguaaaauguagggcagaguggagagaagaaaccaaguucaaauccucuucugaugucagaauugggguaccaaccaaugacccucucccuaucaguguggugcuucuuuauuuucuaauauucuuuauucugcucuuuauuuuucuaacuacccuuguacacaauauuuuuugaacaauauucugugagguuggggauguaguucaguaguagauaacuugucuagcaugaagucuugauuugaccaugaguaccacaaauaaaaguauauuagcgcaugugcgcgcgcacacacacacacacacacacacacacacauauauauguauguauuauguguauaauuuauuuuuauaauaugggguaggguuuuuuuugauauagaaacucuuauagcccaggauagauuuggauucauuaugugaccaaagauggccuuauuacauuuuuauuuauuuuauuuaguuuuauucauuuugugugcaagugugaauaugucuguaagagcaguacauguuauuaacuacugaaccaucucuccagucccuaaagauuuuuauuuuuuauucauguguaugugagucuguuuaaauugugugcaugagaauguucauaugguuacuaaagaggccagaagaggacaucaggucccauagagcuggaguuguaagcuguugagaggugaccgaucuggguucuaggaaccuaacucguguccucugcaagagcagcaaggguucuuaacugcugagcaaacucuccaguuuaacacccuaauuuuuuaauauacauuuuuauuggaucaauguauguauaugucuguauuacauuugugucuaagcauacaggugcauaucacuuugugcauguggaagucaaaagacagccugcagcaucugaccacaccguccauguuguuugagacauggucucuuguuaggcuggcugagccugaaagcucccauggauucucucuuucuaccuccugucuugccacuggaaugcugggauuacagacaugcacuacuucuccagcuuuauauaaggguucaggggacucaaacccagguccucaaauauacacaguaaggacuuuacccacugauccaucuccccaaccucuagugucuauuuuuaccccuaugauguuuaguuauuacauguccuccagcucccaugggcuauggcacuuccuuguaaugcccuuuuuucugaugaccuucacagacaagauauuucaugcaguaccccuucaucaggaccucucuggcauucuucucauagaguaagacaaugaccucaauggagaaacaccacagaauuaaagcacccuuccccaucaccuccugucaagggcuuaugagguuacuguugcugcugacccugauuaccucuuugaaccacaugggaauuuuugucuugauucacucaacaaauguuuauugagcaccugccaaauuuuaauagugcauuaagggauuagagcauaaauuaagauacugcuuuguccucaaaucauaaugaagcaagcaaggacagaagccauugguacaaaauguauguagggggcuggggaaacagcuuggugguuaagacaugugccaugugugaggacuggaagucagauccuugguacccacuuagugucugacggguguuagggcccaccuucugccuagguaugcuagcaauguaaaugaacucagggauucucagcuagaccaggacuguagcuugacuggcagaaugcuuacccagaauagaugauaaugucagcaauugaagaagaugcugcauaucaaccucugcucucugcaugaauccaaguacauauauguuaauccuccuccccaugugcaaacacacacacauauguagggggaagcauguauauugggcuaagguguggauuuucagggggaaaauucaggauaguagaacaagauugaaagaaagacuucaugguaaucaugcuugugguggggcuagagagauguuucagugacuaagagcacuuaucacucuuuccaaguucaguucccagcacucaugugauggcuuacaaucauccuuaacuccaguuccagagaauacaacacccucuucuaagaucugaggacaccagguacacauacauacauccaggccaagcacucauacacauaaaaugaaucuaagaaaugaaaaaagaauguucaaagcuggaggaugacucgguagguaaaagcacuuaccagcaaaugugacagacagccuuaguucaauccuaggaauguacaugauggagcacagaacugaucucaugaaugguucucacaccuucacaugcaugcuguggggcacaaacauccacaccacuacuaauuaauuaauuaauuaauuauaguuucauugaaaaaaaagggauucucagcuagaccaggacugcagcuugacuggcagaaugcucacccagaaugcuccaggcucuggguucuauccucaguaccguauaaaauugaacauggugaugauaccuguaaacaaagcacaaagaauagaaacggaaggaggaagaaagcauguguuggauucaacugcauacauuaggccaaaggggccuuuccaaaaucucacccucguucacaagcccucaaagagaaggcuuugauuacugcaggaugguuugacuuccuuugguguuccaucccucucccaacuuuguuuuguuuuguuaguuuguuuuucucaguacugggaauuuuauuuuugaguacagaacacuugcaucauuuguacuuuguauacacugugaguuaugaacacuaacauguacauuuacaugggugaauacuucaauugucucggguaaacgucuagugagaaacugcuagauccuacuguaacuuauuacuuccagagauucucugacugcuccauucugagcacucaucuggaucuaucauauacauucugggugacuguuucuuaccaggaagauccagagugacuccugccuuaaagugagaggucaucaagucuuguggaggagcugcgaagggccagcuggcaaucguggcuaaccacugguagaaagaaaaggcaagagaugaacgcuucacuuacacuagcuuguuuagacugagaauagggcugaagggaugcuccuuuggaugcucuugcagaggacucagguucucuucccagcacccacaugguagcuuacaaccauccuuaacuccaguucgaaagauccaggagcuucuuuuggcccucaugggcaccaggcacgcauaugguauacuuacguacaagcagugaacauuuauauacagaaaaaaaauuuaaauaaaaauaaaauaaacccuaaaaaugcacugaggauuuaucagucuggcgggcacacaaucuuggauucugucucucuuagacaagauuacagaggccuguuaucacagcauuuagaagauggaggcagagagaucaggaguucaaaggcauccuuggcuacuuagugagucugaggccagcccaggcuacaagacacccgugcaaggcuuuagagggagaggugacacacaggugacuaagaugcccugcccaaagagauaggaagagaagcaggaggcucuccuuauugacuauauaggagagggcuucaagaaaaagaaacaauggccagcagugcccaaaucccagagagggaaaaggaagagaauucagagacgcuuaauguuggcuuuucuaucccucacaaucguuggacaccagcaccaucuuugcucggccgugagccagacagaugugguggcucauaauugugaaucccagcucucaggaggcugaaggaggaucgcaagcuugagacuaaccuacgugacugucuuaguuucuuuucugcuguugugauacaguguccugacaaaagcaccuucagggaaaaggguuuauuuuggcucacaauuuugugucauuccaucaugucaggguggucacagcagcagaaauuguggggacacauugaguucacaaucuggaagcagagagcaauaggcucacuuucuuugagucccacagugagucuucccaccucuauuaaacuagucaagagaacccuaccagccaugccacaggcccacaacgcugaugaguuagagugugaauaucgaugaaccucaagagaauauguuugggugacuaguaccuguguggaugugguaugucugaaugugaaggaguacauauguacccccaagagcauaaaucugacaauguguguauguguuguauauguguuucagaauauauguauauaugcccaaguaggcguaggugaaacuguaugugcaugaaugugugugaauguguauauaucagaguauguaugcguaugaaaguguaugaauaaggagagguggguggaguccauccuaaagcuggguccucucuccuuaucagguacuagguagucccaggcuaccucauuauccauaggugccuuugcccugagcucucaaugcucuccaaauucagcaguaguucuggaacccucauccugccucuacuaucuuuucuuuccauguucucccaguucuggagacuagcuuugccuaggaagaucauucugcuuuagcacuuugugaccacagcccugucuagccacagauugacacugcaggagauccuguagcagccccacucucugucucugucucugucucuaugucucucucugacucucucuuucucccucccucucucccucucucccuccuucucccucccuccuucccuuuccccacccaaaccccccccaaaugauuaacuccuaguucagcaguuuauaacugcugauaaaccuuugggacuggucauccucagccagccuggcacucaccgaaaucuauaacccugggcuggggugggauuaaagugccugcuauacaagguuuaggacuaguguuccacauaaauaucuuuagaacccacauaaauaucaggugguggcagucugccuguacuucuagcucacaagcucuggguuuugcuugacagaccccacuucaaugaauaagguggaaggguggucaagaaugauuccugacaaggcuaauucaaccucaggacuccacauugcaaguaaacacacacacacacacacacacacacacacacacacacacgaaaaccaaaauccagaguuuucugcucccaaauagaguuggggaagcccucagagcuguccuuguccuaaagggauagagguuccugaggagcaaggauucugagauucucaaaagcugaaaugagagcugugaagccccaagauccaccugcaauaaggcaucaguggagagaggcccagaacuaagcucaggacuaaggugaaauccagcuuaccugggaauccuggaauugauuggacacuauaaaaaggugcuuacugcagacagguaaacaguguucucucacauugugucuguuccccacuaccuaaggaaucagauguucccuuugcagggaccaugugaggcccuuucuguggccaugagucagaacugggucaaguuggguucaggcacaaggaacagacuucuggaauagagcacagaaggaggugggcaagugugaagguaccaugcuauguaaucagaaaucaggagcagagauuucuuucugccucuacagccugagguucucaaccccugcauauggccuagguucaccaagaggaacuauagcuagacaaaaggaacaugcuccccaggcuccaccuucccccccagagccuuuccuuuuucuauuuuaauguguguuucuguggguaugggcauguucaugugugugaguacaaguauguguguaccaugcugugcauauggaagucuuaagaauaaccuugggugucagugucugcuguugguagccacucuguacaccaagcuaauuggccuacaaguuucuagggauucuccugugucuaucucccaucucacugaaggaggggugagauuacaaagugugugugcuacuauguccagcuuagguagaccgucagaauccaagcucaugccuucauuggcauguguuuuauccacuaagccauuuuuuucagcccauuccaaagcauuuuaugauccuagaaauguucccuaccaggaaaaugccaacuccaccuccaauccucuacaugccucaacagaccccaggaaccucaacucucagcaagaccuacagcucuagccccaggauagaucauaauggccuacauugguggacaaacaugucauaugcuauauguaauaugcuugguucacaaccuucccuuugaaggacccuagucucuagagaccagagaaguucagugacuacccuaaaauucacacaacucauuggcagagagccaggcuuuaaauacaucauucuacaucaacacacaccuuuuuuucccccacacaacccccaccuugguuuuucgagacaggguuucucuguauagcacuggcuguccuggaacucacuuuguauaccaggcuggccucgaacucagaaguccaccugccucugccucgugagugcugggauuaaaggcgugcgccaccacgcccggcuaacacacaccuuuugguuugcuuuauuucuguaugugugcagaguugcacauaugugaguaagugcucuuguggagaugggaggauagccacagcugcuguucuuaguugcuguucacuuugcuuuguauaugucuuauaucuuuauuuuaggugugucugucugaauguacggcaugugauuuccuuaaagaggagucuaauccccuggaucugaagucacaggcuguugugagccaccuaauggggaugcuggaaaccaaacuuggaaaggagcacuaagugcucuuaaccacugagccauagcugagguuauccccuugguuuuuaguuguuuuggguuuuuuuauguuauuguuguugcggguauuauuguuguugucuauuuaagacagggccucucaauggucugaaauuuaccaguuuagcuaggcugauugguuaguacacucaaggacccuucugucuuuaccuccccagcauugagauaaagcacacacuaccacaccagcauuuucacaugaguuuucgagauugaacuuggguccucaugcuuauauggcaaauccuuuacagaccgagccaucucccagccuucagccuuuguuuuugucaccggacaggcaaaaaucaagcggucagugucuucaaaaguccccagaaggcuaggcagauggccccaggaaaaguaguaaagaaggcuuggcaugugaauauuggaaccaggaugcccccucugaaccucagcccacccccacccccaugcauucccuaggguaccaauuccuggcacuuugauguggccuuggcuuuccaggccaaggagacauuacugcuccagccuuugacagcaccagacaacaauagagaauaacugcuuggucugugccaguaacauacuguucuugagacagggcaagucaaaugcuaccaugaggcacccagggcaagccacagcagaggacagaacacuguccaaaagaggugaccagaacagggguuucugugccccccugaaguuucacauuagauccuuaggcccuccagugacaggaaaccucuggcacaggccuugcugcuggauuugagccuugguuguugguuguagcacauagaaucuauaguacaaguagggguggaccaggaauggaaagucugcaaugauggaguauucucaggguaagcagacagacuuugcuggcucagagcugacaggucaagguagacaucuaccuagugcuaacgauauguaucucccuagacagagcuguaaccuggcaucccccuggcugaugagccugcccaccauggcaagccccacucugagcccggacuccucaucucaagaggcccugucagcacccaccugcuccccaaccucugacuccgagaaucucagcccagaugagcuagaacuacuggccaagcucgaggagcagaaccggugagugggggagggagcugauuccuggcuuccugggaccauucacacucaaagcuagaccugggcuacacagaauaacagcuaccacaagauguuuaaagaaugguuucucgccgggcagugguggcgcaugccuuuuaucccagcacuuaggaggcagaagcagguggauuucuguguuccaggccagccuggucuacauagugaguuccaggacagccagggcuauacagagaaauccugucucgaaaaaccaaaaaaaaaaaaacaaaaaaaaacaaaaaaaaaaaagaaugguuucucuuugauccuccccaugugggcuggauaaauugauuucuucauucagaagaggaaaucuucauuucaaaaggucagauaaaucuagcuuuccuuuacaaggccauuuuuugaaggaagauguuaaagcgcccaccugccccuaucuuauagguguuggauuuugggguuggggaggucuuugaguuuucuaccuguagaaucuccuuacugggaauucuaggcagaaccucuacugccuaaccgcacuuccagccccucacugugggauucuagggaaugcuauaccacagagucaugcucucagccccucaaugagguauucgaggcaggggcucuacuaauccaacagaucgggagacacuggccacuaagaaaaaaggaauuacuuaccauucccaaaaggagaagaggcagaccugucagucaagaggcagacaagagccugggggaaaaacacuggcaagaaccuuuauauugguucccaugggcagcaguggaugaaacagggcaagcaagcauucaagucacugacuugaagcauuucagucuggccccagaugcuggguacucagcccugaggugauaugagcagauggauagugagcaucaagcaaaagcuugauggaggaaguggucagggugugggcucuggauugguuuauuuguauaugggaaaguucacucacaggcagacagcccauuccuaucuuuaauaacugccuagcccuaggaagagccaucccaggcccuccaucucuccagaguauauaaagcugucaaaaguaucugaaagcaucucagcauguagaaggcuacagcaggaggauaaagagggugaggccagccugagcuuuguagcaagauccuguuuuagaauaaaguuaucagugguagaacacucaccaagaauguuccggucccuaaauucaauccccauuucaaaaaacaauuaaagggaaggaugcuggaaagaugucuuagugguuaaaagcuaauugcucuuccagaagaccuggauucaacucccaguacucacacacucccaguacucacacggugucucauggccauucguaacuccagugccagcggauuugaugcccuguucugucuuuggggcaccaggcacauacugguacucagacauuaauacagacaaaacaauuagaauacaaacaaaauaaaauauucaaaaauauaaaugccaggcaacggugguauaugucuuuaaucucagcucuuaggaagcagaggcaggcagaucucugaguuugaagcuagccuggucuacagagugaguuccaggacagccagggcuacauagugagaugcugucuaaaacaaaaacaagggcuggugagauggcucaguggguaagagcacccgacugcucuuccgaagguccagaguucaaaucccagcaaccacaugguggcucacaaccaucccuaaugaaaucugaugcucucuucuggagugucugaagacagcuacaguguacuuacauauaaucaauaaauaaaucuuuaaaaaaaaaaaaaacaaacaaacccccuccaaaaaacaauaacaacauaaaacacaagucaaguaauuccagcaacagagagguaggggcaggcagauccgcaagacucacugaccagccauccuugcuuaaauuggagagaugcaaguucauaagaugcccugucucaaaaauaaaauggaguccuuaacaguaucaaagguugaucacuagucuccacaugcauguacaaacacauacauaugcaaacaaaaaaagagaaggaaaaauggaaggaagaagagaggagggaggaagauaaaggacaugguuaauaugaccccacaguguccuugguacucuauacgugcccucagcuagaacuugcauucugagccccucucuauagaccaucccuaaauguguuuugcagaguuggucugagaaugagcugguacacucacuacucuucuugccuaggcuccuggaagccgacuccaaguccaugcgcuccaugaauggcucccggaggaacaguggcuccucacugguauccagcuccucagccuccuccaaccugagccaccuggaggaggacacguggauucucuggggccgaauugccaacgagugggaggaguggcggcgcaggaaggaaaaacuacucaaggugaccugaggcagaugugggauggccaugaaucuggccagccuggucauucauccaccagccagggccagguagcccacucuaggcagaagggccaaagugaaaaaguacagauaggacaugggaauggagggcagcgggaugagaaguccuugugccuguuugcuuugugcucugauguaaugguguguauaccuaugaccccuauaaucaggacaugaggcaagauaagggccaguuuggacugcauagugaaacuuugugucaaaaaguuugcuuacaaagaaugugggggcugggaaaacaccucccugugcagugcuugccgcacaaacuugaagaccuaagguccauccccaguaccuauauauauaaagcugagcaugcuggcacaugcuuauaaucccagcacuauggaggcagagacagacaguucccuggagcaccuagccagucagcuuagcccuguggguaagccacagccuaguaaagagacccugccucaaaauauaaguggauaggccagcaagauagcucagcaaauaaagguacuugcuguaaagacuaacaaccugacuuuuguccucaggucccacauaguaggagagauucaacucuuucaaaugcaggugcaaguuaucaucugguacauacauacauacacacacacacacacacgcacaccuacacacacgauaaauaauuuaacugcaauuuaaaauauaacagcaaaacaaaaacaagcaacaacaaaauccaagguggaaacaucugaggaauaacaaccaaggcugaccucugaccuccuauauacacacauaucugugcauauaugugcauauguaugcauacauggauaugcacacaaacacagagcaugagaauugggauuauagcuuagugguagaggagucacugcaggauaggggaugcagauguccucuguaccacguguaaccauguguacuguguguuaccaugcguaagccauaucugaaaugcugagcuggguuggccuugggauggcugcagugccuggggcagacuccaguccuagcuucccuucccccaccucacccuccccaugcaggagcugauccggaagggcaucccacaccacuuucgggccaucgucuggcagcuccugugcagugccacagauaugcccgucaaaaaccaguacucugagcuccucaagauguccuccccaugugagaaacucaucaggagggauauugcccgcaccuacccagagcaugaauucuucaaaggccaggacagccugggccaggaaguccucuucaaugucaugaagguaaggcccuccaguauuggcuccagccaccucagcaacaauccccacuggagauggcuccauaggggcuggugggaauccuguguucacccagccuccuuccuuucuaggcauacucccugguugaucgggaggugggcuacugccagggcagugccuucauugugggcuuacuccucaugcagguaaguggcuacccugggcuccauccccaagaggugaacauaggaagauccccugagucuagugaccccuagggccagagccuacucagcagccagcucacugcacccucugacagaggccagacucagcucucaauggauggauauggaagagcuaggcugccauuuaugcugccuagguccagauacuauaccaugcaggacaggaacaggacuuaaggagcagugggacagcgaagaaccacaggucaacaauuuagguguuuauagggguuuacagagauguucuuccagagaaaccagaaggcuuacaacagggagaaaggagauagcugggugucaacagggaugucuuaaccggguagaugagauuggggugcuaucaagguuuaaguacagcuccauuaguguuaguggcucuuagcaaauaacuucagucacagaucuuccauuaauaaauaguacugaccauauuuaugguuuguuggaugagucacaguagccaaguacaguuacaauaaaugaaaaugggacagaaacaugccccuguguaccaugacauugcccagagcccacucauggccuucccccucuuucugucacacauacacacacacacauugcuggucccuccagaugccugaggaagaggccuucuguguauucgugcgacugaugcaggaguaccggcuacgggagcucuucaagcccagcauggccgagcugggacucuguaucuaccaguuugaauacaugcuacagguaagaagacuaggggugaccauccugagguuaucuccagaaagccccugaacuggaaauucuaggccugagaaaugacccuugggagcugagauguggcucaguuaggaggauccuugcccaucaugcacaaagcccuggauaccaucccuagaccuucauaaacuggcaugguaguacacaucugucauccuacaacuuaugagguagauguagaagggucagaaauucaaggucagucucagcuacauaggaagccugaguuacagccugaguuacaugaaacccucucuggaaaguagugguauaacaugccuggagccuggcaaggugguacacauucaugaucacagugcaugagacaggaagauaacaaguucaaggccacccuagggcuacuuaguaaggccuguuucaauaucuaagagcuggggggcagggagguuacaguauaggucagugguagagggcuuacauggcacauaagaguccuggguucaaugugaaguucuguggagaaggaagaguaggaagugagaggaaauggaaggagaaaggaggaagagcagaagagagagaaggaagaaaggagugagagggggcaaagggaaggagaaagggagagaggaaggauagggggaguccuagaaagggcccauuccuguccuuuccugugagaugaaagcacacaacuuuggagcaugcugggagggacaaggcuagccaggacaggggccucucggcucccaagggggcucccagagccacuaaggcagaaagguaggaggagggcuggcuccaagugcuaaggguguggugggaggaggagacaguguugucugccugccucugcugauuaccggggagcuacagacagagccauuuauaauagcaacccccacagggcucacuccuggcuggcaggcagaacauaaguguuuaugcuguguguguguguguguguguguguguguguguguguguguguguguagguguguagguacacacacaugcaagcauaccauucguguacucuuguacacauucuuauacucucuggccagcuucagaagcccauggcaagagaacugugccagcagugaguggucagugaaggcuccucuuucaggcucugaggacagggaggcagagcuccacacaggcuggaaguugaacaaacaggagguccaggcaccuacaaaaaugaaggcaggggguugggguagugugcuugccuaguauuugugagguccugguuugauccccaauauccuucccuacccucaaaaaaaaaaagaaagaaagaaagaaagaaagaaagaaagaaagaaagaaagaaagaaaggaaggaaggaaggaaggaaggaagaaagaaagaaagaaggaaagaaagaaagaaagaaagaaagaaagaaagaaagaaagaaagaaagaaagaaagaaagaaagaaauuucgcugggcagggguggcacacaccuuuaaucccagcacuuggggggcagaggcagauggauuucugaguucgaggccagccuggucuacaaagugaguucuaggacagccagggcuauacagagaaacccugucucgggggaaaaaaaagaaaagaaaagaaaagaaauuucacagcuggacauaacgaugagcaccuuuaacucugacaggcuacagaguaagaccuuauuuuaaaagaaagaauagggugggaacguagcucagucauuugagugccugccaagcaugaacaaaggccugcuucaauucccuccuuugguaguuggcacuuuacaaguagagucaggaggaggaucaggaguucaaggucagcucagcuccauaacaaauugaaugcuacccuaugauauaugagacccucuuccaaaaaguaaacuaugguuugagaagauggcucagucaguaaagugcuugcugcacaaauguaaggaauucuguuugaacccucugcauccauguaaaagccucauaggcucauaggacgauauuccugcuacccucacacggggaggcagaggcagcaagagggcagaguuaaguaaauuccuggaguuuccgggccagccaaaucaaugaacuacagguuccaugagaggcauuguuuuaacaaauagguaaaagacagcuggacaugguaauaaacacuuuuaaucccagcacuugggaggcagaggcaaccagaucacugugaguucauaagccagccugaucuccauagcaaguuccaagccauccagugccacauagugagaugcugccucauaaagaaagguugagauugaaggagacagcagcaucaaccuccgcacagcccccuuacauauaugcauucacauaugaacacauacaaaccuccuacacauacuuacagauaaaaaauaauuugaucccuagcaucugccccccucaaaguuaagaaggaauuacaaugccaagccagaagaccgaagacuuucacaggcuaugauuuacacacccaagcagauguguaaccaaaagcauagagaugcuggcuaaaggggaaacccagaguucugaugcugccuucuccagccucaccuuccccaguggucugcugcuaucuaauagccugaagcugaggucaucgcauuuugacauguauuuucccaggcccugcuuguagccccauggcacucaaaguuccaguaugccucagcuuauccccaaacacaguagcuaaaagaggaccuaggagggaccuuggcugcccaggguaggucagcaaauacuccuuggaggugaggggcacugaggcccaaugcuucccucuccauccccacacaggagcagcuuccggaccugaauacccacuuccgcucacagagcuuccacacguccauguaugcaucguccugguuccuuacgcuuuuccuuaccaccuucccccugccuguugccacccgggucuuugauaucuuuauguaugaggugagugccccacaggacacccuugcccauuccacucugcacguggagagaaucacaucccaaaaggaguccuagcuaacaggacaaaggaggggcuagaaugcaaggagggucugagccuccuggugggagacaggaagcucauuggugagggauuauuaaugggaggacagcaagcucaugggacuaugguugcuuuugcagggacuggagauuguguuccgaguaggccuugcccugcugcaagugaaccagacagaguugaugcaacuggacauggagggcaugucccaggugggucaggauggcugggaagaugaaacugucucuccuggaggugacaggcacuggaaaucccauggcuaguugguagagugcuugccuagcaugcacaaagcccuggguuccauuuuacagcauuauauaagcaggcauaaugauguaugucuuuagucccaacacucaggaggugaaggcaggugaaucagaaguuuaaggcuaaccugagcuauacaagauucuaagcaauaggucuagcagugauggugcauaccuuuaauuccagcaccugagaagcaaagguacgcagaucucugaguuuguuucagucuugaaaaaaagcaaaccaaaacaaaaaacaaacaaagauucuaagugacaagggaggggcuggcuucccaauagaagucacuccugagcaucugggauccuuucuuccgucccuugaggccccugaggaaccccaggcucugucagauacaacccagagccagcaaccuaguacuggggagaagagaaggccaacacucaacugauuuggggaaguccuacucacucuuuccuacccacuuguugcagguccccaaagcuugccugcaaaguaaacccugagaguaaacauuugggagguuuucaguauguuuucaucccagcucucagccugggggacacgggaaggagccaggcaucuugagguagccucauacccugcuccucccugccugcgccuucuccuggcacagucugcuagauccaaagccagcuuuccccucaccaugguuuccccaucacacaggccccuauucccucccagcauccuccagcuggugcuucagaaaagaaugcacaaagaccacaguuguguuugcgaacacggccauacauuguccaagacugccugacuggagcagcugggcagaggaauaggaccuguguccacugagcuugucuacccacuuccuacggaggguucccccaugcucagaccccauucacccagcccugccuucaggagguccucuggccagauugucuuaauuuuauuuauuauuaguguuaaugugggggugggaagagggagagaggaggagggcucauggcacacaguaucucacaauucaauucucuacuuccacucucuuauucuuuccacuguugguuccagggaugggacucaggucaggcuuugcaggccaagcugauccccacucucagccucagccccaguuuucucacgcuucccccaaaagccugcugggaaggcaggccucccuucuagucuagcuguucucucuccugcagucaauucauuugcacaacaaauguuggcugaauaaccaaaaacaaacagccugagugcugagacaaagagaagccucaggcaaaucagaauacaguuagagcucuggcagaccugguggucagggcccaagugaccaugacucccugugucuccacaguacuuccagagagucaucccccaccaguuugacagcugcccagacaagcugguccucaaggcuuaucaggucaaguacaacccuaaaaagaugaagaggucagugcccgggcguggagaacucaaaugggaagcccaccucaaccccagggagacgggacuuugaccgugugccccguccucacaggcuggagaaggaguacgcagcuaugaagaguaaagagauggaggagcagaucgagaucaaagugagugccugaggcgugggggaggggcagagaugggcuccccugaggcuuucccuuacaaauccagagcuggccgcuagagggcgggccuaucuagcgcacggguagaacaggcuggccugggcagacaaucucuggcuucggaugacccucgcucacuugaccuuuccuucaccugccagccccgcgugggagcgcauuccccaguuggcauguccucaaagcuggccacacaacaguaaacaagacagucaaagauccuugccuucauguccccgaagcaccccaagucauggggcgaccuccaauaaaucacugaaauaguguggauuccacagagugcuccggauguagucauacaagaaagagacagucgcgccugggaagacacucuagguccucuaaguccaagaguccaguguaaagggccuaggauagaaguauguaccuggugggcaggaggacaccccgaaggcugggggcacagaggagccucccggaagguugagagcuaaggaguaggguucaggcaagccagauggauauguaggcuaaggauauguagacuacaguaugggcauccacugagagcucugguugugcugguagccagcuugccagcccaucaaagucagugccuugagugcacaaaacgucugaaacuaaacuuaccucucaauagccucuucaccucucuucaugugauuuuagcuguucacccaacaacaucgauugaaacaaagaugagaccuggucuuaagugacaaggaccuggcuuuccagauaaaggcacucuugagcaucuagaguccuucaauaucuuuccaagcagacccagguacuuccagguacaacccagggccaggaugaagaagagaggagaaagaaaagcucauacccaccuacuucagccagccagccagcuauacauucccaaaguccgcuggccaagaauaagggcccugccacacgaaauggaggacaggcaggguuacaaaccuacacauuagccugguuuuguccucuccaguugaugagucaaagugguuagcacuggugucccacagaggaccagcugugugacccgggcaggugaauucaccucucugagccuuggagcuuugcugugcugguccuauuacugccaaccucaugcucauuguuccuaccuccuguaggaagucaggggcagggguaugugccugaaggcugaagcacuuggcccugcuugaaguucccagaaaguuuucuauccuggguuugugagccaucucacaaggaagguagcuugaggguugcacuagaccaaaugugguccuugcugugugcagaugagcagccugcucucaucuggugacuguggggacccaggaauagaaaagaaugucacagaccuugagaccacaggccagauuaaaaauuucuccagagaagagauuuccccagaguguucgaagagucagacagaugucuccucauagggcaucuuacaaguguccugcaguuuggucuuuuacuuuuagacuguuucaaaacauccugguuugaugcugggaggucacagugaugcacgacuuuaaucccagcacucggaggcagaagcaguugaaucucuaguuuugaggucacccuggucuacagaacaaguucugggacagccagggcuacacagagaaacccugucucaaaaaauaaauaaauaaauaaaacaaacaaacaaacaaacaaaaaccaaucccuuauuuguuugcaucaggaaaggcaagaugacaggugcauagacaacugccuuugagagaaguguuuguugaggcugaggcaguagcuuaguggugagcauuugcccagcaugcacaaggccaugggcuccacccuccguauagaacaauagaaaaaaaggaaagaaggggcaaaggauauggcucagugggugaaguauuugcugugcaagcauaagggccugaguucccuagaacacacauaaagagcaguagugcgcuuuucaucccauccacagagacaggcugauagaucccugggggucacuggcaagccagccuagccaaauuggcaaauuccagguuaaaaaaggagggguaagggugaggagaugccucuguaaagugcuugugucucaaucauggaaacuuaaguucggagcucccaaaacccaacaguaaaagcccagcacaaguagugugcauuuaugacccuagcacuugggacugggagagguagcaggcagaucccuggaacucauuagccagccagccuagcucaguccauacacaacaggccugagcuucagccuuaucaagaaacugcauuucagaaacuaacauggaacagggguaguggcaccugccuuaaucccagcugugagguggucgaggcaggcagauuucuguucaaagccacccuugacuacaaguuccagccaaucauggcuacauaaugagauucugucucaacauaaaccaacaaaccuaggcauuguggcacaagucggucauccuagggcugggagguggacuuuggaggaucaggaguacauggucucccucagcuauauggcaaauuagaggucaaccugggcuaccaaaugagacccugucuaaagaacagaacagaacaggagggagccaggcauaguggcacacaccuuuaaucccaacucaugguaggcaaaggcaggccaauuucugugaguuccaggccaaccagggcucaaagugagacacugucucaaaauauaaauaacaaauaauuuugaaguuacuaaguauuuuaaaauaaauaaaggcugaccucuggccuccaugugugugugugcacuggagcaugagcuuauacacacaugccugcauauauacacacaaauaaacacacacagguguauacaaaagagagggaagaaaagggugcugacucuucuguuucaagaggaaaaugcaggucauggucaugucagucagagagcagagaggggcaugguccagaacguuugacaugguuucuacagaaagaauuaaaucagugcagguguaugugagcaggcucaggacccaggcaugaugggcuaguagaacaggcaaugugagugauauccucugcucuggcuucaaggagauucuccauggugucuguaucagcccugggccuuuagaaugaaagugccguucaguuaguaaaccucagauaaaggaaaggugaaggguucuggaguuguugauuuuguacugauaagacagcaacacaccuguugucuaugaguuagcuaguucugggaaggaccaucucuccuaagcuagcaaggccucagguugcuaaagcaucauaaaauacaggaacuuucagagucagcaagcuggcucagugagugaagguacucgccaucagccugaugacuuaagcuugaucccuaggaugaucccuagugauagaaagacaggacugacgucugcauguccuccacagguggaucauggugcgcaugcucaugagcacacacaaacauaaaaaacauacuuacauacaaacauuuuauuuguuuguuuguuuguuuguuugagaauguuaggguguguuguuuuguuuuagacagacuuccuaaacagcccuggcuagucuggaacuuacuauauaaacuagccuggcuuugaauuugacucucucuucuuuccucugacuccccauugcugggauaacaggcacgugcuaacaugccccuccucauuuacauauuuuuuauuguuugguucuuugauuuuuaaccuuagccaaaaaugcugggaagcaacacguuuguuuguuugcugugacaaggucucucuguauaauauaagcuguccucaaaucugcaguccuccuaccucagccuccuaauuacuguaauuaaauuacaggcaugugccaccauccucaucuaagaaaacaaauuuuugaaacaaagucuuauauugaccagauauuuaaccugaaaccuacuuuguagccaagagugaccuugaacuccugauccucugaccugugaauaucgagagcgaggcauuugccaucauacccaguuuaugugauacugaggauuguaaccagggcugaaagcaugcuaggcaagcacucuaugaacuaagcuacaccccccagaccacuacccucaaucuuuuguaaaccaugaccaguguauacccccacauaccccucauucacucugccuccauuuuuuccauuugggauaagcaggaaagauaggacucauuagcuaggcccaaguuccucugugagugguggugcuggauggguucagauuggauagagccaucuagggguuacaguccagggucaagagaccuaguacuccucauccuuaaacaguuuugauccaacuaggaagcucagcugagggccgcuccucuuugacucuguuuccuuacacaugaugugagucaaugaccugaugauccacgguuugcuccaguugcuuucuaucaccgcauccccaagaagcaacccaggagcuggguaacccauaggacguguucuugucucacgucugcugcugugguagaauacugacaagcugaggaaggcuggagauagccuagcaauuaaaagcucugucugcucuuccagaggaccuguguucauaacuguuguucacagcugucucagaucaucucaggcccucuuuuggccucuggagucacuccaaucacauaaaauuaaaauaaauguuuuuuuuaaaaguuuuuuuaaacuuaagacaagaaauuauuuacuuauuguagcuaacaauuccagauuacaguucacugcuaccagggaaguccgagcagaaagagcuugagaucacuggccgcaucacauccagucagaaagaaagagaugcuuccauguuggagcacucccuuguuugugcucaguucuauuuaucaacucaugcaguuuagaauucccugccuuggaaaugcugggcugucuucucucacaucaauuaagccaaucaaaaagaaaaaagaaaaaaaaguucccccagcguuccugaagcagagguagguggauaucugugaguucaagucuagccuggucuaggaaggaaggaaggaaggaaggaaggaaggaaggaaggaaggaaggaaggaaggagagagagagagagagaaaaagaaaauccguauagacaagucuaugagccaacccaauguagacaauccuucauuaagauucucuuccuagacucuagauugugucaaguugacaacuaaaaccaacccucacagccuuguaggccuuuuggucaucuacaacuacaaacaauuucuucauaaccaagaacccugagaaggcuacguacagcaccuuugcauaugucaucagaggguccugagggaaaucaaaaccacagauacuuaccccgauuuccucaucacagagcagaagacagagccaaacaugggguggcauaccucugcagucccuacucaggaggcaauaggaucaaaguucaaagcugccuauacuacauaacaagacuauagggagaaggaaaauaaaaauaaaggcagugugucuggaagcuuagaaaugugguagagauguugccuagugugaagaaaguccugggcugcauccaccccuggcaucacacugcauaaucacagccucauggcacacaccugccaucucaguucucaggacauaaggacagcaacaucacagagugaaaggcauccuuggcugcacagcaaguucuaagccagucugggaugcaugaaauccugucucagagagacugugaugaaagcaaaggccaccuacauguucaacacaagagaccugaauucugagaugggggcuguuccagagagucuuaguggcugcuggaagcaaaggaaaagggggucaggacccccuugagacacaggggaaagacuaggcagaaacagacuucugaggguaguauagaugcugacugcuccuuauaccugcuuacacacgcgaaugcauacacacaggcacacaugcacacgccacagggagcgggagcugaaggguuuuuuuuauuuuuauacuuuuagacagggugucuuuguguaucucuggcuguccugggucuugcuuuguagaccaggcuggucucagacucacagagaucccccugccucugccuccugagugcuggaauuaaaggcauucaacaacacacccagcucagguuuucuuguggguuguuuguuuguuuguuuguuuuuaauaauuuugagccaggcaguggugguacaagccuuuaauccuaggacucaggaggcagaggauuuuguauagcuuuugcuaccccaccuaagcucuggcaccagagaauauugaaucuguggaugaaaaacacagacacacacucauugcucaauuucaacuugacuuaucggcucaauugcugggcauuauuaaucucccgaggcuaguaugcccuccccagugcucuuagcucagcauccucaaucuaaccucaaccuuagcuguucaguuuuuuuagaccccgcucaacaucucacccucccaccuggagagagcaaccacaggccauuccucccaagaucucacauggcugcuugguuuguuuuuugguuuuuuuuuguuuuugguuuuugguuuuuguuuuuuucucuccaaagcagggcaaacuccugcgucugccagcuugccugcuuccccagaaguccugacuauccuuccgcccagcauugccccauggcaucuuuacugauagaucaagaaccaauuggugaacaggaaauuagcaucagaaccaccccuacagcagaggcaggaugaccucugaguuuaaggccacccugaucuacagagugaguuccaggacagccagggcuuuacagagaaaccccguaauucaaaugaaaauaaaagcauuuugagacagaaucucauauagaccaggcugaccuccaguccaauagcuaaggaugaccuugaauuuaugauccuccugccucugccucccaaguacuaggauuacaggcaugugccccaagccagguuuuugcaaaguaagggcuuuuuaugugugcuacaaaagcacucuaccaacugaacaauauuccuagcaccaaaacaguuucauuuuaacuuuuaaaauguguuuuauuuuguguaugcgggugaguguggaaugacaugcauauggaaugucagaggacaacugguaggaguuaguucucuucuaccacaugaauccugggcaucuaagguaggaagucaagcuuggcagcaggcaccuuuauccagugagccaucuuauagggccucgguauuuuuaauaaaccauuuagacagucaugugccucauuuucugaaauuucuggcccagaacauaagcacccucugaggaccuuccuugaccucugugguuggucaguggagauuaagggccuaaagugcuugugggggaggggggcucugaagugcucuucuucuuccucuguagaggcuucgaacagagaaccggcugcucaaacagcggauugagacccuagagaagguaaggaguguggguaccagcuguuggguuccaaauccaaaacacuggcagcuauuaaggcugagggcauugcucugucccgaucuagccgaguuaaggagcauaggcagggcaggcauaguggugguacucuuguaauaucagcauauaggaagaggagacaggaggauuaagaauucaaggccagcuaaucucagccacaugagaccccgucucaaaaaaauaucugaguggccuuucccucagccuccccuaacuccacggagaucugagcugcccuguuguuagggguucucagaagacaucaucccacucuggaucucaacucagcccuaggguuacagcuaaauuacaacucaguggauggcaaucacaaacugcaugggugggagagcaagcuccaucacugggccacaagcaaucccaaccuguaauuuguaaguuucauccuaggaaggaaggaagacagacggggaggggggggggggcucaucccuugagguagagaggcauggacuagguuauggauggggugguuuggguaacuuagcaugacucugggcccuaccuccuguuccuuaguguuccucauuugacuauuugcugaccacaaggaagcaguaggucauggacaggauguuauuaccacaccaaaaccucaauucuuguuuucucucaagauuaaaaugcauccccugucccagcccucucugggaucuccuccucacacacagugaagagacauuccugcugcugaguuuucucagccucgugcaccccagccuccccacucacaugaaccccccuccaggacagaguugguucuggcuuuggucuuucucugggcccucuuccgcugguucucuggucuucacuuuucuauccccugcuucuagagauagcccacugcguuuagugacaagugguucuugucugucucucccccucuccuauccccugccuucugcucugccuccuucccccguugcugggaacccccuucgccugguaggagagcgcggccuuggcugauagguuaauccagguacuguagcuuuuccauauaccucugcacucuccaacccaggcccuucccgcgucccugcacaagacagccaguaaccaccuuuuuccuggccacugccauucugggggcaagagcaacuugcauggaggggcagcuuccaggaagaacaaugccuugagggugggggcaugugagcuggagacaaacacaggaugggaggccuuugugggagugaguuuagaagaaggcuuacccucaggauagacagcagguuuccuccaccgaggagcaagggacgcuaccccaguaggacucaggacuuagagcauuccauuucagguccugacacauuuguuggcuaagcuuacacuaaugugcucacacacaggcauguaugcaugcagacacacacacaacuguucugacuccucucugcuucugcugucacccaucgccaucucucacuugccugcuugugcugcugcuucacucuuggauggcuuuucuagaagcuucugcacagugcccagcggcuccgagccuggaauggggagcagggacuaucaagcugggugggaaggaggaugcaggaggagggaaugccccggggagagucguagagguguaucaccucacacaagccuuuugcuuuguacaacaaucuuuuucuucacuugggacagagguaaacaauccggauuggggauggagccccagcaugggaguugggggcauuugucacugaagccugguagcacauccagacuguccauuacucccuggauccuuuagguggccuguucuugccugucuccacccauucugaggccugcuugggcaccccaucccaggcucugagcacuaaaggccaugccugucucacuuuaacccucccucucucauccucucugagcuuccuagaggccaggccugggaccaaagcagauggucaugguauccuuuccaccccauccucacugugcucaggggcaggugacacgggcacaggaggcugaggagaacuaugucaucaaacgggaguuggcaguagugagacaacaguguagcucgacugcagaggaccuucagaaagcacagaguaccauucggcaguugcaagaacagcagguacccggcgguugaaugggauugacuggcaggaccacaccuucuacaggccuacgugccacccuugccugcuagcccucagggcuuagaucuguaaggugggugagggugccccucacagccagcuccacuccaaucuggccauacugcaggagcacaugccccaccccagcccaugguccugggacugagucuugaagacuuucagaaggcacccugaagucauggaaagucccauccccaacauucccucugugcagcuuucccugaaaagaagccaagccaguuucacggccuucuagugccaugaacuuagcauggguucaacccaggaugccuaacaacugggacccucuuccagcccaggcccacuagcuugaaagcuauccaccaaguaaccgucaccaucaggaaccaaugcaguucuuugccuccaggaaaacccucgccucacagaggacuuuguggcccaccuggagacagaacuggagcagucacgguuacgagaaacagagacucugggggcccuucgagaaaugcaggacaaaguucuggacauggaaaagguauggcuggggaaggagacaaaggucucgagucuuagaagauggagaaaccaagcauggccacauguaaucccaguaccauggcggagaugggaugaucucuggcuugguggucuuuagccuagcuccagguucagugagagacccuaccuaaaggucaagugaugggguaggacacuugacaucaucuucuggccucuucaagcacacacacauacagagagggggaagaaggagagagagaggaagggggagggggagggggagugagggagagggagaagacaaugaacaaaaagagguagccagggcaguugcuccaccugcaugucugucagaucccauagaagaggagaccucugugugcggcuuuagagcccauugccaccuaggcaucgucuccuccaccaccacacagggaucuaggguuauagaaguuggagccucacccacaaagcucuccacacccuugaacugugugggcucauauacacagcagcacagcccugcccugagcacaguguggcagcuucauacgcugccugguugguaucccacugcacugugcaugucuucccaggggcugagguuccaggauauagggaaggaaaguugacaggggaagacccaggccaauuaauucggacuguuuuccuccucuucucucccaugaagauacccuccagaggcaaacuaaggacuacacuuuccgaccuauagcccuagaggggggaccagacuuccugggugccucuccagcugcuuugugcauugacucaacucaggcugaggauguaccugaauugguagaacgcuucccuagcauacauggagucccggaguccaucccuaaugcauacauguaaucccagugcaggugggacucucaggaagggagaacagucauucaagaccauccuuggcuauaucacaagucuaauuucagucuaguuaccugagaucaucuccuaaaaccaacaaacaagcaagcaaacagaucucucagggagcuggcacaaagcccuugaagucgagaaccaucccuccccuaguaccugcuacagcuguguaagagcugcaaaccuuuaagccccaucaacacacaaccuuccacaggaaggaaaugugcccagucuagacccugucuugccuccuauacccagaccuaaacaagggucaguaagggccaggccuacaaguuauauaccaagaaccuagugcaugagcacccuacacacaggacagacuacagguugguuccaguacugucuguuucuagaaagaggggcuucccggccaggccuggggagagugcagggugcuugccacuggucuuccagcaguucucaggacuggucauggguccugaaaggcuuggaucucggaauugugagaaugucagugauauuuauuuacaggaggucucaguucaaaggagucucccaaagacagaccugagacccguuuugcagauaaugaacccuggcuaacacaugagggucuucuuccccugggccuagucucuguucccuuggguaugcuguagucuagggagucuuccucccuucgcucaguugccaaagcagagagaucagagggaaggccagagguguggauccggcagguuaggcuuggagauucagugcuuucccauuuccucacuuacugucucucugcagagaaacagcucacugccagaugagaacaauguagccaggcugcaggaggaacucaaggcacucaaggugcgggagggcgaggccguagccucugcucgggagcuaaagcugcagcugcaggagcucucagacaccuggcaggugagagggugccuccugcaggguaugccugaaacagcugguggaccauacuuagggauucaucgcagaccaacccuggccucuagaacccuuccacccugcuuucuaggcccaucuuucccgcgguggccgcuggaaggaguccccgcggaaguugguccugggcgaguuacaggacgagcucaugacugugcguuugcgcgaggcacaggcccuggccgauggccgcgaauggcggcagcgcgugguggaacuggagacgcagguaggccaggccuacacaaggaccccacgguggacuccuaggccauagcaugaccacccuggucuugcugcugcacccucugauccuccuuuccaggacaacauucaccgcaaccugcugaaccguguggaggcggaacgcgcggcccugcaggagaaguugcaguaccuggcagcacagaacaagggacuccagacucagcucagcgaaagccgccgcaagcaggcagaggcugagugcaaggugcagccccugcccggaccccacgacccuaccugagaucuugccaccuccuugacccgccccuuguguacccccuucccuucagaguaaggaggaagugauggcuguucgacuucgggaggcagacagcauggcugcaguggcagagaugaggcagcgcaucgcagagcuggagauccaggugagccccaggaacugggaggagggugaaccccggggcuggccaagcucugaccgacaguacuccggcccucccggcagagggaggagggccgcauccagggccagcugaaccacucggauucaucgcaguacauccgggagcugaaggaccagaucgaggagcucaagacugaggugagagcaaaggauaucgggcacaggccaaacgcugcugcggggacccagauaaagcaugaagcuaggagggugagggaggaaggcgccugauggcugggguucucuggguaugucgaucuacgucuccaacgcgcgggcgccuccacccucccccgcgcacaccaggugcgguugcugaaaggcccaccgacauucgaggacccgcuggcuuucgaugggcucagccuaacgcggcaccuggaugaggauucgcuaccaucuucugaugaggagcugcugggcgugggugugggcgugggcgcagcccugcaggacccacucuacccucucucuccccgggacgcgcgcuucuucagaagccuggaucggccagccaaggacagcgaagguagcucagacagcgaugcagaugaacuagccacuccuuauagcaaccagggccuggacaacugaagcugggggcccacucacggggagccuggaggcccgcauugcuggcagggagagaucagcaguccgcgagcuugcugcuccacaguacuaaggaauucug

SEQ ID NO: 4266 - RNA, 45086 nt, Mus musculus
cagcggcuccugucagcgggugaaauggcaguggcggagccagcgacggccgcgguccccggggguggcugauugaaaggggccgggccgcgggguuugcgggacccucgagcagacgugaccgugggucggggcaucggacgacacagcgcagggacagcgaggcucggcgcggcgauggaggcgcucucggcgcagguagggcggcccgaaccgggccucuucuccuugggggcgucagugcugcggggccccgcggggaagccaaaccaggagcgugaccuggggucgccucgccuccagaauccacgcugggagccuuggcauucccagucccggacccuggaacuccggccuccgcccacccuccuucccgauccccucaggaucccucccagggcuccuaagacccagugucucuucgcgacgucccccacaggcucaggaccucuguacaucuuucccaagacuccucuguuagaaucuguccagggcuuccccaucccccagucugcagaccugcccccccccacacacacacaccaugagcgucuccuuuccaauccacaaccaccaccaccaccaccccgagucccaggaccccucccaucugcacaucucuugccuuuacaucccccuaaaccucccacuuggcuuccugucuucugugucuggccuacacccucauccucuccaaggagaccaagaucagagcccuauacucuuucuuucugacuccacagaaacccaugccucaccucuuaaacggaaagauucccaacugaauccagagacaucagcucagccugcucacuuggcaccccuccugcucaagggcuccaauaaaaacaaaaacaaaaaaaacaucacuucuagucuucugagaagacuauacacuguugcugaucuugagccaucuagauggcaucuuccugaagaaaugaacacucaggacuucccaaaagaccaaaagauagugcugaaucccaucccccauagacacacccuccccauccaucuuucugauacagaguggggucauuuagauaccccuaaauauacaggaaccuaagggcccaacccagacccaggcccaugagugcucucccccccccaucucucucucucucucucucucucucucucacacacacacacacacacacacacacacacaugagaacuucuauacaccuucuugagcccaguacccucaacagaccuccuaacucagacaaaagacagaagauugugagguggcaagcucuguccccagcaccuagccugucccuuccaccccauucucuuugaguugggacuccagggcgugucagggccuaagaucuaccuaccacaaaucucuccccccccucucucuuucuuauccuuuuuaauaggaaggacauucuuuccuacaccagugucccaaaaggaaccagugcccaucuccaaaucaauggcaccucccuauacauaccauggggagugagaucuuccagcggcuccuggccccaauccuaaagucugaccagacugguaggaccagcauccuugagccuauggcaucuguuggccucagaugauauagacagugcugccaucuaaggugcucaucaaggccaguuucugagagcccugugaguucuuuuacccaccaccaauguuuggucaaaauaaaacagcuuccuccuagcaugugggaucugcucagacugggucagaccugccaaaagcaagcaccucuuuaaggaauauuuucagaaggguuaaaaugugaagaagacagggggggugugugugaaaggaugagugcucugauugacaacccccucugcuugacacccccacucccauauacaccacucccagccaaucugucauuaagccagacuccccacaucccucacucuucaugguuguauuguauugguucucccuaccaauucugccccacagcucccauccuagggucccaccuguggguucccucuggauuccugcgguugacuguggugguuuggaagggaucacagguagcuuggccccggcacaagacagagaggaaagaagagauugcagaacuggcuguaguuguagaacuagggaguguaaaggagaauccagaacaaaccagcuccuaacaagcauuugguuaugccuggaaagacccagauaaaaagccuagguuuccuuguagaauauuuacaaacaaauucugaacagauuugaauaaaaaaaaaaaacucaucuuggcuuagaacuucaacuucuccaucuggaaaauggggguugggggaaaaagcccuuagaauaguaguauucugcugcagucaagccaguuagauuaggguguggccuaauguguuuccugggagcagugagguuuagcagaacagugggguuuagcagaacagaccccacacacaccuagcaaaguugguauugucacuggcccugaugaucccugucuucaguggauaguagccauaucugaaggacuuagccaucuugcaggaagcuggcuuaaaucagggcugaaagaaugaagaaaaaagaugaucuguugugggacuuguagucaugcaggcaucuucuggaaggacugaggacauggggaacuaacuacuggcagcccuccugauggacacaagauagaaguuuaucauguccauuugagagcaagagugcaugaaaagacuugaaggucauguggcacaugagaagcugcaagaccuccccccacuccccaggggacuuugcacagauggacacagcggguuagaaagggccccugggauagacugugaacucuguagaaaguacaagaaggcuuuaagucuuugaguagagccaacacagcuuugcuguagccuggggauauagauacauugucuuuugugucugugcuuugauagguacuaguagaucagaaacaagucuuguagaaugucaagucaguguuuaugggugauaaccccacugugcccagggaauugacucagauggccuguaucuaaagccugcacagccagcuugaggaagaguuagacccagaagcacacauugauugagcucuugucuuguguucacuaugccaaacaucauuugcauaucaucucauuuaauccucugagcgaccgaccgaaaggagccaguguuccaguguguuccuuugcuaucacaugcugcugcugcugcugcugcugcaguaggaaugcaggagacagaguuacuuacacugccguaagagcucugagaaaggacguccaggaaggugugacagggaugacuuauggaugcagucaccaggcaggcguggcagguuagggugucccagaaguacuuggacaggggcugggcaccagcauaguucuuucaugggaugcgugagugacuucuagggauggacagauggauggaugagcuuuacccuuuaggccagcgucuaccaaaugugauccauaugacaguacagaccaucaggcacucauggucaaaaagggaucugagauugggaaaauugggagaagguacaaaccauaccaucuccaggaaagccaaagucaagcacuagaaagaaggaaguuguugagagcuaacaugcucccuguguccacaccccaguuggagaagauaccaucccucagaggaacguuuccaaugcuccuuuggcauauuuugccugcacuuuaaugucuguucuuaacauguauccaugugcuugugaaacauuuuguuuguaggggacaugguagguguauguguuaauauuucacauaugagugaacgcaugugugugcguguacauguggaguccaggggucagccgugagugucauuccucagaauauguauuaagcugucauguagguacugggaaucaagcccugguucucugcaagagcugccagugcucuuaaccacugagccauaucuccagacucuguccaccuuguuuuuugaaagaggucucucagcuggguggugguuggugcaugcugguuugucccagaacucaggaagcagaggcaggaguucaaggccagccuguucuacagagccaguuuaaggacagccagggcuacauagagaaacccucucuuggccggggcaaggggggguuaaaaaaagaaaucagucucucacuaggccccagggacccucuugccccugcuucccuggcacugguauuacaagcauacaccacugugcaugacuuuuuacauggaugcuaggccuccaacucaaguccucaugcuuuuauggaaaguacuggccuaucucccuggcccuaugaaauaauauuaaguaguugguuuuugccuguguguauguaugauguacuuguauguucuguacaugugcacaauugucugugaagaugcacuucccuguggagggcagagugucuuccucuauugcucuccacuuucaucuaguagcacaggaucucuugcugagccugcagcucuccaguuugucuaguuagccagcuugccuagagaucuccagucucugucucccgaaucuugaauuacagaugacugccaucccuucucugcuuuuuuauuuuuaauaauuuuuaugugugucccuguuugaccuacauguaugucuaugcauuuugugcaaugcccacagcuaaaagaggacauuagacccucugaaauuagaguuacagacaguugugagucucaguguggcugcugggauuugaaccugagaccugugcaagagcacaagugcucuuaacuacugaaccauuucugcagccccuccugcucaucuuugaccuggcuucugugaguccaaacacuacuuuuacaaccaacacuuuaucuauggagcauuuccacagacccccucccaaugaaauccuuucacugguaccugucucccacacaaccuguaagcaagucucaugaaaggagggugccuaucuauucuccaguaucuguaucuauucacaggugaaucccagauucacauagcaguuucucaguaaaauguguuugauuuuacaagcuaaugggcuucccucccucagccauuucugaaacagaaagaggucagaucugucugccuuagguaaagguaaugcuuuguaaggccuaucugccucacauguguccaccauccaauccagcucaacaagcccagaaagcuggcacagaugacagagaaacaucuccaccugugcaccugccacaggaagcccuuguaaaagggcuuugauguucuuccucugucauuuucaaggacauuuaaauagagaaaaugaagaaauuugcccccaagugaaccuguuacaguggcagaaaauaagcugguaaggacacacaacauaagccuauuuuuuugggucagaugagaauuuguaggucauaaugguccacccuuagguuuucaccugaagguguguugcuguuacugcuccuguuacuaccaauaagggugauuauaguuuuauaguguuuaguccuuaaagaucaucaccauuaaggggcaauuugcacuggacuguaggguccacacaguggccuugacagcccuuaccuucaaggaacuguccauccagcagggaauaaauacaggcuacugcugauucuaaacacaggacaaaagucugagugguaauaauacagaguggggaggagggagggagggagagagggggggaagggggagaaagaguguuggucggguacuauaucauuagcccuguuuacagauugaaaugucaugauacccuggaucacaaggggggaguauaggaggagguuucaacuguaagccaaaagauuuagaauaacuguccacacugcaagaauauggaaaauuccagaacaucuuggagaauuggguaaaacugacagcguauguauguagcaccauugguagaaugcuugcuuggcaugcacaaagcccuggauucaauccccagcacuauaaaaaccagauuuaguggcuguucuagcuccauuuucuauugcugggauaaaguacccuggccagaaguuugaaagauaguucagcaauuacaguaccuucugcucugcacaggaacagaguucacuucccagcauccguguugggggacucacgacucaucaacucugggaucugacgcccucuucugguacccuccaggaguaccuguauucacauacauacacccacacagagacacaaguacauguaauuaaaaauaaaaugucacugggcaugguagcacaugccuuuaaucugaacacuuuaagacccaaaaauaaauuuuaaaaguuuuuuggguuuuuuuuuuuuuuuuaagacaggauuucucuguguagcccugaccauucugcaacuuuguagacaagacuggucuugaacuuagagauacuucugccucccaaggacugggauuaaaggcuguaccaccaccaccuggcaauaaaaugaaauuuugaaaaauaucccaaucaaaaaucucaagggaagaagggcuuauuggcuuaccauuccaggcuacagcccaucauuuuuggggaaguugaagcaggaacuuagaugacuaucaagagcagagaguauccauugcugccuacuugcuuaauuaacuuuugcucagaaagauuucuuuucucucauacauuccagaagcuagcauagagaauggugucauccacaaugggcucugucauuuaacagucaagacaguccccaacagauaagcccauaggcugacuugauuuagacaauuuugcaauugagacccucccugaugauucuagguuacagcaaacugacauuuaaaacuaaccuguuugguagucuauaucugucuucucagcacucaguaaaugggagcaggcagaucaggaguucaaggucauccucauuuaccuaucagguuugaaaccagccagggcuacauaugauuucuaucucaaaaagaagaggaggaggagaaggaagaugaagaugagcagaagaaauuuaaaauagcuaaaaaugcaagggagaagaaagcaauccucgguguuuuccuuguuaccccaggaacuauauacccuuugccaaacaaaagaaccuagaacccagccauacuauugccccaggacuuggggacagccacagcaaugauggucugcugaccaguuuggggacauuggggacaaguagcaccauuccaagcuucagauccugaucugaaucuauguuugugguaaucauaggagggaggagaucugaaaugugacuuuuuucaauuuuucaauucaauucuauucaaauuuuucaaaaagaauuuggggucuuuauuccucuucauaaugucaugcccuccauagaaguugcccauauaggcuggcugguucacugugcugaaaaacaaugauugugaauuaucaagugcucacuaagauuuaccagcugcacucaguguuuuaugucuaucauuucuggcuggauuguuuuguuuuguuuuggguuuugagacaguuucuuuguguagcccuggccauucuagaccaugcuugugggacaguggaccaugccaggaaacuugguagguugagcggguucagagucccuggcucccaggcacccaccugagacaguaggcggcuguucccugccagauuccuguccuggaacaccuguccauacuugccacaguagucacacagcccagaacagagcucucuaugcuaaugagguaccuagagacccugaggguuuaaccaguaagcuucccuucucagacauuccucccuguaaaauguauuuaaucucugguccacccucaggaauugauaugcauccauuuuccacaaugaagagucaauaaagccuacuccuacagagcugcagccuaagucuccuguagaaggccucucugcacuuccagaaaaccaccaccaagcuaagccuaaguucccauuaucccccagccccaggcuaguccucagccugugggccccugacucugcucucaauuccucgaaacucagaggaccuggauguccaaaaguuuggagcacccagucccaaccucaucauggguccauggaccccaauccuucauucccaacucuucuguguagcaccccaguggcaacuagaugcucaggagucagggaaccccagcuucagccucccccauuuuagacuguauuuucucacccccugagccauaucucagugcuuugcuaaagccugguacccuauggcaucagccauaccccagcugccagguagaacauggacccacacaugcuggccucaaacucagagauucuccuggaacugccuccugagugcugggauuaaaggugugcaucaccaugcccaacuuuguuuuuggguuggguuugguuggguuuuuguuuuauugguuuuuuuuuuuguuuguuuguuuuuguuuuuuguuuguuuguuuuuguuuuucugcuuuuuguuguuuuugagauaggagagggucuuauguuagcaucaaucucccuauauagcugaaacuggccuugaacccuggucuuccugucucuaauuccugaguauugaaaugacagacauaaaccacuaugucugauuuuguggaagggggacauuuaugcaagugcacacaccuguacauguucacaaaggccagagaaaggaaucuuccucuaucacucucugacuuauuccuuugaggcagggucucucccugaacuuggaucucauaauuuuagacuagacuaacaacuagcaaguccagcaauaaucuuauuucuggcccuuacaacacugggguuacugcagcaccacucugguuuauuauaugggugcuaggaucagaaugcagguccucaugguuaagcagcaaguacucuuaaccaccaagccuucuuucuagcccacacgccugguuuuauaugguguuggggauggaacccagggcuucauauaugcuaagcaagcaugcugccaacugagccacaucccuggcccauauacauauauaauaacauguuauauauuaaacauaauguauauuuuuaacuacauguuuuuaaaauaaaaauauagaaaaggcagaagcaucauggguaaaauguagggcagaguggagagaagaaaccaaguucaaauccucuucugaugucagaauugggguaccaaccaaugacccucucccuaucaguguggugcuucuuuauuuucuaauauucuuuauucugcucuuuauuuuucuaacuacccuuguacacaauauuuuuugaacaauauucugugagguuggggauguaguucaguaguagauaacuugucuagcaugaagucuugauuugaccaugaguaccacaaauaaaaguauauuagcgcaugugcgcgcgcacacacacacacacacacacacacacacauauauauguauguauuauguguauaauuuauuuuuauaauaugggguaggguuuuuuuugauauagaaacucuuauagcccaggauagauuuggauucauuaugugaccaaagauggccuuauuacauuuuuauuuauuuuauuuaguuuuauucauuuugugugcaagugugaauaugucuguaagagcaguacauguuauuaacuacugaaccaucucuccagucccuaaagauuuuuauuuuuuauucauguguaugugagucuguuuaaauugugugcaugagaauguucauaugguuacuaaagaggccagaagaggacaucaggucccauagagcuggaguuguaagcuguugagaggugaccgaucuggguucuaggaaccuaacucguguccucugcaagagcagcaaggguucuuaacugcugagcaaacucuccaguuuaacacccuaauuuuuuaauauacauuuuuauuggaucaauguauguauaugucuguauuacauuugugucuaagcauacaggugcauaucacuuugugcauguggaagucaaaagacagccugcagcaucugaccacaccguccauguuguuugagacauggucucuuguuaggcuggcugagccugaaagcucccauggauucucucuuucuaccuccugucuugccacuggaaugcugggauuacagacaugcacuacuucuccagcuuuauauaaggguucaggggacucaaacccagguccucaaauauacacaguaaggacuuuacccacugauccaucuccccaaccucuagugucuauuuuuaccccuaugauguuuaguuauuacauguccuccagcucccaugggcuauggcacuuccuuguaaugcccuuuuuucugaugaccuucacagacaagauauuucaugcaguaccccuucaucaggaccucucuggcauucuucucauagaguaagacaaugaccucaauggagaaacaccacagaauuaaagcacccuuccccaucaccuccugucaagggcuuaugagguuacuguugcugcugacccugauuaccucuuugaaccacaugggaauuuuugucuugauucacucaacaaauguuuauugagcaccugccaaauuuuaauagugcauuaagggauuagagcauaaauuaagauacugcuuuguccucaaaucauaaugaagcaagcaaggacagaagccauugguacaaaauguauguagggggcuggggaaacagcuuggugguuaagacaugugccaugugugaggacuggaagucagauccuugguacccacuuagugucugacggguguuagggcccaccuucugccuagguaugcuagcaauguaaaugaacucagggauucucagcuagaccaggacuguagcuugacuggcagaaugcuuacccagaauagaugauaaugucagcaauugaagaagaugcugcauaucaaccucugcucucugcaugaauccaaguacauauauguuaauccuccuccccaugugcaaacacacacacauauguagggggaagcauguauauugggcuaagguguggauuuucagggggaaaauucaggauaguagaacaagauugaaagaaagacuucaugguaaucaugcuugugguggggcuagagagauguuucagugacuaagagcacuuaucacucuuuccaaguucaguucccagcacucaugugauggcuuacaaucauccuuaacuccaguuccagagaauacaacacccucuucuaagaucugaggacaccagguacacauacauacauccaggccaagcacucauacacauaaaaugaaucuaagaaaugaaaaaagaauguucaaagcuggaggaugacucgguagguaaaagcacuuaccagcaaaugugacagacagccuuaguucaauccuaggaauguacaugauggagcacagaacugaucucaugaaugguucucacaccuucacaugcaugcuguggggcacaaacauccacaccacuacuaauuaauuaauuaauuaauuauaguuucauugaaaaaaaagggauucucagcuagaccaggacugcagcuugacuggcagaaugcucacccagaaugcuccaggcucuggguucuauccucaguaccguauaaaauugaacauggugaugauaccuguaaacaaagcacaaagaauagaaacggaaggaggaagaaagcauguguuggauucaacugcauacauuaggccaaaggggccuuuccaaaaucucacccucguucacaagcccucaaagagaaggcuuugauuacugcaggaugguuugacuuccuuugguguuccaucccucucccaacuuuguuuuguuuuguuaguuuguuuuucucaguacugggaauuuuauuuuugaguacagaacacuugcaucauuuguacuuuguauacacugugaguuaugaacacuaacauguacauuuacaugggugaauacuucaauugucucggguaaacgucuagugagaaacugcuagauccuacuguaacuuauuacuuccagagauucucugacugcuccauucugagcacucaucuggaucuaucauauacauucugggugacuguuucuuaccaggaagauccagagugacuccugccuuaaagugagaggucaucaagucuuguggaggagcugcgaagggccagcuggcaaucguggcuaaccacugguagaaagaaaaggcaagagaugaacgcuucacuuacacuagcuuguuuagacugagaauagggcugaagggaugcuccuuuggaugcucuugcagaggacucagguucucuucccagcacccacaugguagcuuacaaccauccuuaacuccaguucgaaagauccaggagcuucuuuuggcccucaugggcaccaggcacgcauaugguauacuuacguacaagcagugaacauuuauauacagaaaaaaaauuuaaauaaaaauaaaauaaacccuaaaaaugcacugaggauuuaucagucuggcgggcacacaaucuuggauucugucucucuuagacaagauuacagaggccuguuaucacagcauuuagaagauggaggcagagagaucaggaguucaaaggcauccuuggcuacuuagugagucugaggccagcccaggcuacaagacacccgugcaaggcuuuagagggagaggugacacacaggugacuaagaugcccugcccaaagagauaggaagagaagcaggaggcucuccuuauugacuauauaggagagggcuucaagaaaaagaaacaauggccagcagugcccaaaucccagagagggaaaaggaagagaauucagagacgcuuaauguuggcuuuucuaucccucacaaucguuggacaccagcaccaucuuugcucggccgugagccagacagaugugguggcucauaauugugaaucccagcucucaggaggcugaaggaggaucgcaagcuugagacuaaccuacgugacugucuuaguuucuuuucugcuguugugauacaguguccugacaaaagcaccuucagggaaaaggguuuauuuuggcucacaauuuugugucauuccaucaugucaggguggucacagcagcagaaauuguggggacacauugaguucacaaucuggaagcagagagcaauaggcucacuuucuuugagucccacagugagucuucccaccucuauuaaacuagucaagagaacccuaccagccaugccacaggcccacaacgcugaugaguuagagugugaauaucgaugaaccucaagagaauauguuugggugacuaguaccuguguggaugugguaugucugaaugugaaggaguacauauguacccccaagagcauaaaucugacaauguguguauguguuguauauguguuucagaauauauguauauaugcccaaguaggcguaggugaaacuguaugugcaugaaugugugugaauguguauauaucagaguauguaugcguaugaaaguguaugaauaaggagagguggguggaguccauccuaaagcuggguccucucuccuuaucagguacuagguagucccaggcuaccucauuauccauaggugccuuugcccugagcucucaaugcucuccaaauucagcaguaguucuggaacccucauccugccucuacuaucuuuucuuuccauguucucccaguucuggagacuagcuuugccuaggaagaucauucugcuuuagcacuuugugaccacagcccugucuagccacagauugacacugcaggagauccuguagcagccccacucucugucucugucucugucucuaugucucucucugacucucucuuucucccucccucucucccucucucccuccuucucccucccuccuucccuuuccccacccaaaccccccccaaaugauuaacuccuaguucagcaguuuauaacugcugauaaaccuuugggacuggucauccucagccagccuggcacucaccgaaaucuauaacccugggcuggggugggauuaaagugccugcuauacaagguuuaggacuaguguuccacauaaauaucuuuagaacccacauaaauaucaggugguggcagucugccuguacuucuagcucacaagcucuggguuuugcuugacagaccccacuucaaugaauaagguggaaggguggucaagaaugauuccugacaaggcuaauucaaccucaggacuccacauugcaaguaaacacacacacacacacacacacacacacacacacacacacgaaaaccaaaauccagaguuuucugcucccaaauagaguuggggaagcccucagagcuguccuuguccuaaagggauagagguuccugaggagcaaggauucugagauucucaaaagcugaaaugagagcugugaagccccaagauccaccugcaauaaggcaucaguggagagaggcccagaacuaagcucaggacuaaggugaaauccagcuuaccugggaauccuggaauugauuggacacuauaaaaaggugcuuacugcagacagguaaacaguguucucucacauugugucuguuccccacuaccuaaggaaucagauguucccuuugcagggaccaugugaggcccuuucuguggccaugagucagaacugggucaaguuggguucaggcacaaggaacagacuucuggaauagagcacagaaggaggugggcaagugugaagguaccaugcuauguaaucagaaaucaggagcagagauuucuuucugccucuacagccugagguucucaaccccugcauauggccuagguucaccaagaggaacuauagcuagacaaaaggaacaugcuccccaggcuccaccuucccccccagagccuuuccuuuuucuauuuuaauguguguuucuguggguaugggcauguucaugugugugaguacaaguauguguguaccaugcugugcauauggaagucuuaagaauaaccuugggugucagugucugcuguugguagccacucuguacaccaagcuaauuggccuacaaguuucuagggauucuccugugucuaucucccaucucacugaaggaggggugagauuacaaagugugugugcuacuauguccagcuuagguagaccgucagaauccaagcucaugccuucauuggcauguguuuuauccacuaagccauuuuuuucagcccauuccaaagcauuuuaugauccuagaaauguucccuaccaggaaaaugccaacuccaccuccaauccucuacaugccucaacagaccccaggaaccucaacucucagcaagaccuacagcucuagccccaggauagaucauaauggccuacauugguggacaaacaugucauaugcuauauguaauaugcuugguucacaaccuucccuuugaaggacccuagucucuagagaccagagaaguucagugacuacccuaaaauucacacaacucauuggcagagagccaggcuuuaaauacaucauucuacaucaacacacaccuuuuuuucccccacacaacccccaccuugguuuuucgagacaggguuucucuguauagcacuggcuguccuggaacucacuuuguauaccaggcuggccucgaacucagaaguccaccugccucugccucgugagugcugggauuaaaggcgugcgccaccacgcccggcuaacacacaccuuuugguuugcuuuauuucuguaugugugcagaguugcacauaugugaguaagugcucuuguggagaugggaggauagccacagcugcuguucuuaguugcuguucacuuugcuuuguauaugucuuauaucuuuauuuuaggugugucugucugaauguacggcaugugauuuccuuaaagaggagucuaauccccuggaucugaagucacaggcuguugugagccaccuaauggggaugcuggaaaccaaacuuggaaaggagcacuaagugcucuuaaccacugagccauagcugagguuauccccuugguuuuuaguuguuuuggguuuuuuuauguuauuguuguugcggguauuauuguuguugucuauuuaagacagggccucucaauggucugaaauuuaccaguuuagcuaggcugauugguuaguacacucaaggacccuucugucuuuaccuccccagcauugagauaaagcacacacuaccacaccagcauuuucacaugaguuuucgagauugaacuuggguccucaugcuuauauggcaaauccuuuacagaccgagccaucucccagccuucagccuuuguuuuugucaccggacaggcaaaaaucaagcggucagugucuucaaaaguccccagaaggcuaggcagauggccccaggaaaaguaguaaagaaggcuuggcaugugaauauuggaaccaggaugcccccucugaaccucagcccacccccacccccaugcauucccuaggguaccaauuccuggcacuuugauguggccuuggcuuuccaggccaaggagacauuacugcuccagccuuugacagcaccagacaacaauagagaauaacugcuuggucugugccaguaacauacuguucuugagacagggcaagucaaaugcuaccaugaggcacccagggcaagccacagcagaggacagaacacuguccaaaagaggugaccagaacagggguuucugugccccccugaaguuucacauuagauccuuaggcccuccagugacaggaaaccucuggcacaggccuugcugcuggauuugagccuugguuguugguuguagcacauagaaucuauaguacaaguagggguggaccaggaauggaaagucugcaaugauggaguauucucaggguaagcagacagacuuugcuggcucagagcugacaggucaagguagacaucuaccuagugcuaacgauauguaucucccuagacagagcuguaaccuggcaucccccuggcugaugagccugcccaccauggcaagccccacucugagcccggacuccucaucucaagaggcccugucagcacccaccugcuccccaaccucugacuccgagaaucucagcccagaugagcuagaacuacuggccaagcucgaggagcagaaccggugagugggggagggagcugauuccuggcuuccugggaccauucacacucaaagcuagaccugggcuacacagaauaacagcuaccacaagauguuuaaagaaugguuucucgccgggcagugguggcgcaugccuuuuaucccagcacuuaggaggcagaagcagguggauuucuguguuccaggccagccuggucuacauagugaguuccaggacagccagggcuauacagagaaauccugucucgaaaaaccaaaaaaaaaaaaacaaaaaaaaacaaaaaaaaaaaagaaugguuucucuuugauccuccccaugugggcuggauaaauugauuucuucauucagaagaggaaaucuucauuucaaaaggucagauaaaucuagcuuuccuuuacaaggccauuuuuugaaggaagauguuaaagcgcccaccugccccuaucuuauagguguuggauuuugggguuggggaggucuuugaguuuucuaccuguagaaucuccuuacugggaauucuaggcagaaccucuacugccuaaccgcacuuccagccccucacugugggauucuagggaaugcuauaccacagagucaugcucucagccccucaaugagguauucgaggcaggggcucuacuaauccaacagaucgggagacacuggccacuaagaaaaaaggaauuacuuaccauucccaaaaggagaagaggcagaccugucagucaagaggcagacaagagccugggggaaaaacacuggcaagaaccuuuauauugguucccaugggcagcaguggaugaaacagggcaagcaagcauucaagucacugacuugaagcauuucagucuggccccagaugcuggguacucagcccugaggugauaugagcagauggauagugagcaucaagcaaaagcuugauggaggaaguggucagggugugggcucuggauugguuuauuuguauaugggaaaguucacucacaggcagacagcccauuccuaucuuuaauaacugccuagcccuaggaagagccaucccaggcccuccaucucuccagaguauauaaagcugucaaaaguaucugaaagcaucucagcauguagaaggcuacagcaggaggauaaagagggugaggccagccugagcuuuguagcaagauccuguuuuagaauaaaguuaucagugguagaacacucaccaagaauguuccggucccuaaauucaauccccauuucaaaaaacaauuaaagggaaggaugcuggaaagaugucuuagugguuaaaagcuaauugcucuuccagaagaccuggauucaacucccaguacucacacacucccaguacucacacggugucucauggccauucguaacuccagugccagcggauuugaugcccuguucugucuuuggggcaccaggcacauacugguacucagacauuaauacagacaaaacaauuagaauacaaacaaaauaaaauauucaaaaauauaaaugccaggcaacggugguauaugucuuuaaucucagcucuuaggaagcagaggcaggcagaucucugaguuugaagcuagccuggucuacagagugaguuccaggacagccagggcuacauagugagaugcugucuaaaacaaaaacaagggcuggugagauggcucaguggguaagagcacccgacugcucuuccgaagguccagaguucaaaucccagcaaccacaugguggcucacaaccaucccuaaugaaaucugaugcucucuucuggagugucugaagacagcuacaguguacuuacauauaaucaauaaauaaaucuuuaaaaaaaaaaaaaacaaacaaacccccuccaaaaaacaauaacaacauaaaacacaagucaaguaauuccagcaacagagagguaggggcaggcagauccgcaagacucacugaccagccauccuugcuuaaauuggagagaugcaaguucauaagaugcccugucucaaaaauaaaauggaguccuuaacaguaucaaagguugaucacuagucuccacaugcauguacaaacacauacauaugcaaacaaaaaaagagaaggaaaaauggaaggaagaagagaggagggaggaagauaaaggacaugguuaauaugaccccacaguguccuugguacucuauacgugcccucagcuagaacuugcauucugagccccucucuauagaccaucccuaaauguguuuugcagaguuggucugagaaugagcugguacacucacuacucuucuugccuaggcuccuggaagccgacuccaaguccaugcgcuccaugaauggcucccggaggaacaguggcuccucacugguauccagcuccucagccuccuccaaccugagccaccuggaggaggacacguggauucucuggggccgaauugccaacgagugggaggaguggcggcgcaggaaggaaaaacuacucaaggugaccugaggcagaugugggauggccaugaaucuggccagccuggucauucauccaccagccagggccagguagcccacucuaggcagaagggccaaagugaaaaaguacagauaggacaugggaauggagggcagcgggaugagaaguccuugugccuguuugcuuugugcucugauguaaugguguguauaccuaugaccccuauaaucaggacaugaggcaagauaagggccaguuuggacugcauagugaaacuuugugucaaaaaguuugcuuacaaagaaugugggggcugggaaaacaccucccugugcagugcuugccgcacaaacuugaagaccuaagguccauccccaguaccuauauauauaaagcugagcaugcuggcacaugcuuauaaucccagcacuauggaggcagagacagacaguucccuggagcaccuagccagucagcuuagcccuguggguaagccacagccuaguaaagagacccugccucaaaauauaaguggauaggccagcaagauagcucagcaaauaaagguacuugcuguaaagacuaacaaccugacuuuuguccucaggucccacauaguaggagagauucaacucuuucaaaugcaggugcaaguuaucaucugguacauacauacauacacacacacacacacacgcacaccuacacacacgauaaauaauuuaacugcaauuuaaaauauaacagcaaaacaaaaacaagcaacaacaaaauccaagguggaaacaucugaggaauaacaaccaaggcugaccucugaccuccuauauacacacauaucugugcauauaugugcauauguaugcauacauggauaugcacacaaacacagagcaugagaauugggauuauagcuuagugguagaggagucacugcaggauaggggaugcagauguccucuguaccacguguaaccauguguacuguguguuaccaugcguaagccauaucugaaaugcugagcuggguuggccuugggauggcugcagugccuggggcagacuccaguccuagcuucccuucccccaccucacccuccccaugcaggagcugauccggaagggcaucccacaccacuuucgggccaucgucuggcagcuccugugcagugccacagauaugcccgucaaaaaccaguacucugagcuccucaagauguccuccccaugugagaaacucaucaggagggauauugcccgcaccuacccagagcaugaauucuucaaaggccaggacagccugggccaggaaguccucuucaaugucaugaagguaaggcccuccaguauuggcuccagccaccucagcaacaauccccacuggagauggcuccauaggggcuggugggaauccuguguucacccagccuccuuccuuucuaggcauacucccugguugaucgggaggugggcuacugccagggcagugccuucauugugggcuuacuccucaugcagguaaguggcuacccugggcuccauccccaagaggugaacauaggaagauccccugagucuagugaccccuagggccagagccuacucagcagccagcucacugcacccucugacagaggccagacucagcucucaauggauggauauggaagagcuaggcugccauuuaugcugccuagguccagauacuauaccaugcaggacaggaacaggacuuaaggagcagugggacagcgaagaaccacaggucaacaauuuagguguuuauagggguuuacagagauguucuuccagagaaaccagaaggcuuacaacagggagaaaggagauagcugggugucaacagggaugucuuaaccggguagaugagauuggggugcuaucaagguuuaaguacagcuccauuaguguuaguggcucuuagcaaauaacuucagucacagaucuuccauuaauaaauaguacugaccauauuuaugguuuguuggaugagucacaguagccaaguacaguuacaauaaaugaaaaugggacagaaacaugccccuguguaccaugacauugcccagagcccacucauggccuucccccucuuucugucacacauacacacacacacauugcuggucccuccagaugccugaggaagaggccuucuguguauucgugcgacugaugcaggaguaccggcuacgggagcucuucaagcccagcauggccgagcugggacucuguaucuaccaguuugaauacaugcuacagguaagaagacuaggggugaccauccugagguuaucuccagaaagccccugaacuggaaauucuaggccugagaaaugacccuugggagcugagauguggcucaguuaggaggauccuugcccaucaugcacaaagcccuggauaccaucccuagaccuucauaaacuggcaugguaguacacaucugucauccuacaacuuaugagguagauguagaagggucagaaauucaaggucagucucagcuacauaggaagccugaguuacagccugaguuacaugaaacccucucuggaaaguagugguauaacaugccuggagccuggcaaggugguacacauucaugaucacagugcaugagacaggaagauaacaaguucaaggccacccuagggcuacuuaguaaggccuguuucaauaucuaagagcuggggggcagggagguuacaguauaggucagugguagagggcuuacauggcacauaagaguccuggguucaaugugaaguucuguggagaaggaagaguaggaagugagaggaaauggaaggagaaaggaggaagagcagaagagagagaaggaagaaaggagugagagggggcaaagggaaggagaaagggagagaggaaggauagggggaguccuagaaagggcccauuccuguccuuuccugugagaugaaagcacacaacuuuggagcaugcugggagggacaaggcuagccaggacaggggccucucggcucccaagggggcucccagagccacuaaggcagaaagguaggaggagggcuggcuccaagugcuaaggguguggugggaggaggagacaguguugucugccugccucugcugauuaccggggagcuacagacagagccauuuauaauagcaacccccacagggcucacuccuggcuggcaggcagaacauaaguguuuaugcuguguguguguguguguguguguguguguguguguguguguguguguagguguguagguacacacacaugcaagcauaccauucguguacucuuguacacauucuuauacucucuggccagcuucagaagcccauggcaagagaacugugccagcagugaguggucagugaaggcuccucuuucaggcucugaggacagggaggcagagcuccacacaggcuggaaguugaacaaacaggagguccaggcaccuacaaaaaugaaggcaggggguugggguagugugcuugccuaguauuugugagguccugguuugauccccaauauccuucccuacccucaaaaaaaaaaagaaagaaagaaagaaagaaagaaagaaagaaagaaagaaagaaagaaaggaaggaaggaaggaaggaaggaagaaagaaagaaagaaggaaagaaagaaagaaagaaagaaagaaagaaagaaagaaagaaagaaagaaagaaagaaagaaagaaauuucgcugggcagggguggcacacaccuuuaaucccagcacuuggggggcagaggcagauggauuucugaguucgaggccagccuggucuacaaagugaguucuaggacagccagggcuauacagagaaacccugucucgggggaaaaaaaagaaaagaaaagaaaagaaauuucacagcuggacauaacgaugagcaccuuuaacucugacaggcuacagaguaagaccuuauuuuaaaagaaagaauagggugggaacguagcucagucauuugagugccugccaagcaugaacaaaggccugcuucaauucccuccuuugguaguuggcacuuuacaaguagagucaggaggaggaucaggaguucaaggucagcucagcuccauaacaaauugaaugcuacccuaugauauaugagacccucuuccaaaaaguaaacuaugguuugagaagauggcucagucaguaaagugcuugcugcacaaauguaaggaauucuguuugaacccucugcauccauguaaaagccucauaggcucauaggacgauauuccugcuacccucacacggggaggcagaggcagcaagagggcagaguuaaguaaauuccuggaguuuccgggccagccaaaucaaugaacuacagguuccaugagaggcauuguuuuaacaaauagguaaaagacagcuggacaugguaauaaacacuuuuaaucccagcacuugggaggcagaggcaaccagaucacugugaguucauaagccagccugaucuccauagcaaguuccaagccauccagugccacauagugagaugcugccucauaaagaaagguugagauugaaggagacagcagcaucaaccuccgcacagcccccuuacauauaugcauucacauaugaacacauacaaaccuccuacacauacuuacagauaaaaaauaauuugaucccuagcaucugccccccucaaaguuaagaaggaauuacaaugccaagccagaagaccgaagacuuucacaggcuaugauuuacacacccaagcagauguguaaccaaaagcauagagaugcuggcuaaaggggaaacccagaguucugaugcugccuucuccagccucaccuuccccaguggucugcugcuaucuaauagccugaagcugaggucaucgcauuuugacauguauuuucccaggcccugcuuguagccccauggcacucaaaguuccaguaugccucagcuuauccccaaacacaguagcuaaaagaggaccuaggagggaccuuggcugcccaggguaggucagcaaauacuccuuggaggugaggggcacugaggcccaaugcuucccucuccauccccacacaggagcagcuuccggaccugaauacccacuuccgcucacagagcuuccacacguccauguaugcaucguccugguuccuuacgcuuuuccuuaccaccuucccccugccuguugccacccgggucuuugauaucuuuauguaugaggugagugccccacaggacacccuugcccauuccacucugcacguggagagaaucacaucccaaaaggaguccuagcuaacaggacaaaggaggggcuagaaugcaaggagggucugagccuccuggugggagacaggaagcucauuggugagggauuauuaaugggaggacagcaagcucaugggacuaugguugcuuuugcagggacuggagauuguguuccgaguaggccuugcccugcugcaagugaaccagacagaguugaugcaacuggacauggagggcaugucccaggugggucaggauggcugggaagaugaaacugucucuccuggaggugacaggcacuggaaaucccauggcuaguugguagagugcuugccuagcaugcacaaagcccuggguuccauuuuacagcauuauauaagcaggcauaaugauguaugucuuuagucccaacacucaggaggugaaggcaggugaaucagaaguuuaaggcuaaccugagcuauacaagauucuaagcaauaggucuagcagugauggugcauaccuuuaauuccagcaccugagaagcaaagguacgcagaucucugaguuuguuucagucuugaaaaaaagcaaaccaaaacaaaaaacaaacaaagauucuaagugacaagggaggggcuggcuucccaauagaagucacuccugagcaucugggauccuuucuuccgucccuugaggccccugaggaaccccaggcucugucagauacaacccagagccagcaaccuaguacuggggagaagagaaggccaacacucaacugauuuggggaaguccuacucacucuuuccuacccacuuguugcagguccccaaagcuugccugcaaaguaaacccugagaguaaacauuugggagguuuucaguauguuuucaucccagcucucagccugggggacacgggaaggagccaggcaucuugagguagccucauacccugcuccucccugccugcgccuucuccuggcacagucugcuagauccaaagccagcuuuccccucaccaugguuuccccaucacacaggccccuauucccucccagcauccuccagcuggugcuucagaaaagaaugcacaaagaccacaguuguguuugcgaacacggccauacauuguccaagacugccugacuggagcagcugggcagaggaauaggaccuguguccacugagcuugucuacccacuuccuacggaggguucccccaugcucagaccccauucacccagcccugccuucaggagguccucuggccagauugucuuaauuuuauuuauuauuaguguuaaugugggggugggaagagggagagaggaggagggcucauggcacacaguaucucacaauucaauucucuacuuccacucucuuauucuuuccacuguugguuccagggaugggacucaggucaggcuuugcaggccaagcugauccccacucucagccucagccccaguuuucucacgcuucccccaaaagccugcugggaaggcaggccucccuucuagucuagcuguucucucuccugcagucaauucauuugcacaacaaauguuggcugaauaaccaaaaacaaacagccugagugcugagacaaagagaagccucaggcaaaucagaauacaguuagagcucuggcagaccugguggucagggcccaagugaccaugacucccugugucuccacaguacuuccagagagucaucccccaccaguuugacagcugcccagacaagcugguccucaaggcuuaucaggucaaguacaacccuaaaaagaugaagaggucagugcccgggcguggagaacucaaaugggaagcccaccucaaccccagggagacgggacuuugaccgugugccccguccucacaggcuggagaaggaguacgcagcuaugaagaguaaagagauggaggagcagaucgagaucaaagugagugccugaggcgugggggaggggcagagaugggcuccccugaggcuuucccuuacaaauccagagcuggccgcuagagggcgggccuaucuagcgcacggguagaacaggcuggccugggcagacaaucucuggcuucggaugacccucgcucacuugaccuuuccuucaccugccagccccgcgugggagcgcauuccccaguuggcauguccucaaagcuggccacacaacaguaaacaagacagucaaagauccuugccuucauguccccgaagcaccccaagucauggggcgaccuccaauaaaucacugaaauaguguggauuccacagagugcuccggauguagucauacaagaaagagacagucgcgccugggaagacacucuagguccucuaaguccaagaguccaguguaaagggccuaggauagaaguauguaccuggugggcaggaggacaccccgaaggcugggggcacagaggagccucccggaagguugagagcuaaggaguaggguucaggcaagccagauggauauguaggcuaaggauauguagacuacaguaugggcauccacugagagcucugguugugcugguagccagcuugccagcccaucaaagucagugccuugagugcacaaaacgucugaaacuaaacuuaccucucaauagccucuucaccucucuucaugugauuuuagcuguucacccaacaacaucgauugaaacaaagaugagaccuggucuuaagugacaaggaccuggcuuuccagauaaaggcacucuugagcaucuagaguccuucaauaucuuuccaagcagacccagguacuuccagguacaacccagggccaggaugaagaagagaggagaaagaaaagcucauacccaccuacuucagccagccagccagcuauacauucccaaaguccgcuggccaagaauaagggcccugccacacgaaauggaggacaggcaggguuacaaaccuacacauuagccugguuuuguccucuccaguugaugagucaaagugguuagcacuggugucccacagaggaccagcugugugacccgggcaggugaauucaccucucugagccuuggagcuuugcugugcugguccuauuacugccaaccucaugcucauuguuccuaccuccuguaggaagucaggggcagggguaugugccugaaggcugaagcacuuggcccugcuugaaguucccagaaaguuuucuauccuggguuugugagccaucucacaaggaagguagcuugaggguugcacuagaccaaaugugguccuugcugugugcagaugagcagccugcucucaucuggugacuguggggacccaggaauagaaaagaaugucacagaccuugagaccacaggccagauuaaaaauuucuccagagaagagauuuccccagaguguucgaagagucagacagaugucuccucauagggcaucuuacaaguguccugcaguuuggucuuuuacuuuuagacuguuucaaaacauccugguuugaugcugggaggucacagugaugcacgacuuuaaucccagcacucggaggcagaagcaguugaaucucuaguuuugaggucacccuggucuacagaacaaguucugggacagccagggcuacacagagaaacccugucucaaaaaauaaauaaauaaauaaaacaaacaaacaaacaaacaaaaaccaaucccuuauuuguuugcaucaggaaaggcaagaugacaggugcauagacaacugccuuugagagaaguguuuguugaggcugaggcaguagcuuaguggugagcauuugcccagcaugcacaaggccaugggcuccacccuccguauagaacaauagaaaaaaaggaaagaaggggcaaaggauauggcucagugggugaaguauuugcugugcaagcauaagggccugaguucccuagaacacacauaaagagcaguagugcgcuuuucaucccauccacagagacaggcugauagaucccugggggucacuggcaagccagccuagccaaauuggcaaauuccagguuaaaaaaggagggguaagggugaggagaugccucuguaaagugcuugugucucaaucauggaaacuuaaguucggagcucccaaaacccaacaguaaaagcccagcacaaguagugugcauuuaugacccuagcacuugggacugggagagguagcaggcagaucccuggaacucauuagccagccagccuagcucaguccauacacaacaggccugagcuucagccuuaucaagaaacugcauuucagaaacuaacauggaacagggguaguggcaccugccuuaaucccagcugugagguggucgaggcaggcagauuucuguucaaagccacccuugacuacaaguuccagccaaucauggcuacauaaugagauucugucucaacauaaaccaacaaaccuaggcauuguggcacaagucggucauccuagggcugggagguggacuuuggaggaucaggaguacauggucucccucagcuauauggcaaauuagaggucaaccugggcuaccaaaugagacccugucuaaagaacagaacagaacaggagggagccaggcauaguggcacacaccuuuaaucccaacucaugguaggcaaaggcaggccaauuucugugaguuccaggccaaccagggcucaaagugagacacugucucaaaauauaaauaacaaauaauuuugaaguuacuaaguauuuuaaaauaaauaaaggcugaccucuggccuccaugugugugugugcacuggagcaugagcuuauacacacaugccugcauauauacacacaaauaaacacacacagguguauacaaaagagagggaagaaaagggugcugacucuucuguuucaagaggaaaaugcaggucauggucaugucagucagagagcagagaggggcaugguccagaacguuugacaugguuucuacagaaagaauuaaaucagugcagguguaugugagcaggcucaggacccaggcaugaugggcuaguagaacaggcaaugugagugauauccucugcucuggcuucaaggagauucuccauggugucuguaucagcccugggccuuuagaaugaaagugccguucaguuaguaaaccucagauaaaggaaaggugaaggguucuggaguuguugauuuuguacugauaagacagcaacacaccuguugucuaugaguuagcuaguucugggaaggaccaucucuccuaagcuagcaaggccucagguugcuaaagcaucauaaaauacaggaacuuucagagucagcaagcuggcucagugagugaagguacucgccaucagccugaugacuuaagcuugaucccuaggaugaucccuagugauagaaagacaggacugacgucugcauguccuccacagguggaucauggugcgcaugcucaugagcacacacaaacauaaaaaacauacuuacauacaaacauuuuauuuguuuguuuguuuguuuguuugagaauguuaggguguguuguuuuguuuuagacagacuuccuaaacagcccuggcuagucuggaacuuacuauauaaacuagccuggcuuugaauuugacucucucuucuuuccucugacuccccauugcugggauaacaggcacgugcuaacaugccccuccucauuuacauauuuuuuauuguuugguucuuugauuuuuaaccuuagccaaaaaugcugggaagcaacacguuuguuuguuugcugugacaaggucucucuguauaauauaagcuguccucaaaucugcaguccuccuaccucagccuccuaauuacuguaauuaaauuacaggcaugugccaccauccucaucuaagaaaacaaauuuuugaaacaaagucuuauauugaccagauauuuaaccugaaaccuacuuuguagccaagagugaccuugaacuccugauccucugaccugugaauaucgagagcgaggcauuugccaucauacccaguuuaugugauacugaggauuguaaccagggcugaaagcaugcuaggcaagcacucuaugaacuaagcuacaccccccagaccacuacccucaaucuuuuguaaaccaugaccaguguauacccccacauaccccucauucacucugccuccauuuuuuccauuugggauaagcaggaaagauaggacucauuagcuaggcccaaguuccucugugagugguggugcuggauggguucagauuggauagagccaucuagggguuacaguccagggucaagagaccuaguacuccucauccuuaaacaguuuugauccaacuaggaagcucagcugagggccgcuccucuuugacucuguuuccuuacacaugaugugagucaaugaccugaugauccacgguuugcuccaguugcuuucuaucaccgcauccccaagaagcaacccaggagcuggguaacccauaggacguguucuugucucacgucugcugcugugguagaauacugacaagcugaggaaggcuggagauagccuagcaauuaaaagcucugucugcucuuccagaggaccuguguucauaacuguuguucacagcugucucagaucaucucaggcccucuuuuggccucuggagucacuccaaucacauaaaauuaaaauaaauguuuuuuuuaaaaguuuuuuuaaacuuaagacaagaaauuauuuacuuauuguagcuaacaauuccagauuacaguucacugcuaccagggaaguccgagcagaaagagcuugagaucacuggccgcaucacauccagucagaaagaaagagaugcuuccauguuggagcacucccuuguuugugcucaguucuauuuaucaacucaugcaguuuagaauucccugccuuggaaaugcugggcugucuucucucacaucaauuaagccaaucaaaaagaaaaaagaaaaaaaaguucccccagcguuccugaagcagagguagguggauaucugugaguucaagucuagccuggucuaggaaggaaggaaggaaggaaggaaggaaggaaggaaggaaggaaggaaggaaggagagagagagagagagaaaaagaaaauccguauagacaagucuaugagccaacccaauguagacaauccuucauuaagauucucuuccuagacucuagauugugucaaguugacaacuaaaaccaacccucacagccuuguaggccuuuuggucaucuacaacuacaaacaauuucuucauaaccaagaacccugagaaggcuacguacagcaccuuugcauaugucaucagaggguccugagggaaaucaaaaccacagauacuuaccccgauuuccucaucacagagcagaagacagagccaaacaugggguggcauaccucugcagucccuacucaggaggcaauaggaucaaaguucaaagcugccuauacuacauaacaagacuauagggagaaggaaaauaaaaauaaaggcagugugucuggaagcuuagaaaugugguagagauguugccuagugugaagaaaguccugggcugcauccaccccuggcaucacacugcauaaucacagccucauggcacacaccugccaucucaguucucaggacauaaggacagcaacaucacagagugaaaggcauccuuggcugcacagcaaguucuaagccagucugggaugcaugaaauccugucucagagagacugugaugaaagcaaaggccaccuacauguucaacacaagagaccugaauucugagaugggggcuguuccagagagucuuaguggcugcuggaagcaaaggaaaagggggucaggacccccuugagacacaggggaaagacuaggcagaaacagacuucugaggguaguauagaugcugacugcuccuuauaccugcuuacacacgcgaaugcauacacacaggcacacaugcacacgccacagggagcgggagcugaaggguuuuuuuuauuuuuauacuuuuagacagggugucuuuguguaucucuggcuguccugggucuugcuuuguagaccaggcuggucucagacucacagagaucccccugccucugccuccugagugcuggaauuaaaggcauucaacaacacacccagcucagguuuucuuguggguuguuuguuuguuuguuuguuuuuaauaauuuugagccaggcaguggugguacaagccuuuaauccuaggacucaggaggcagaggauuuuguauagcuuuugcuaccccaccuaagcucuggcaccagagaauauugaaucuguggaugaaaaacacagacacacacucauugcucaauuucaacuugacuuaucggcucaauugcugggcauuauuaaucucccgaggcuaguaugcccuccccagugcucuuagcucagcauccucaaucuaaccucaaccuuagcuguucaguuuuuuuagaccccgcucaacaucucacccucccaccuggagagagcaaccacaggccauuccucccaagaucucacauggcugcuugguuuguuuuuugguuuuuuuuuguuuuugguuuuugguuuuuguuuuuuucucuccaaagcagggcaaacuccugcgucugccagcuugccugcuuccccagaaguccugacuauccuuccgcccagcauugccccauggcaucuuuacugauagaucaagaaccaauuggugaacaggaaauuagcaucagaaccaccccuacagcagaggcaggaugaccucugaguuuaaggccacccugaucuacagagugaguuccaggacagccagggcuuuacagagaaaccccguaauucaaaugaaaauaaaagcauuuugagacagaaucucauauagaccaggcugaccuccaguccaauagcuaaggaugaccuugaauuuaugauccuccugccucugccucccaaguacuaggauuacaggcaugugccccaagccagguuuuugcaaaguaagggcuuuuuaugugugcuacaaaagcacucuaccaacugaacaauauuccuagcaccaaaacaguuucauuuuaacuuuuaaaauguguuuuauuuuguguaugcgggugaguguggaaugacaugcauauggaaugucagaggacaacugguaggaguuaguucucuucuaccacaugaauccugggcaucuaagguaggaagucaagcuuggcagcaggcaccuuuauccagugagccaucuuauagggccucgguauuuuuaauaaaccauuuagacagucaugugccucauuuucugaaauuucuggcccagaacauaagcacccucugaggaccuuccuugaccucugugguuggucaguggagauuaagggccuaaagugcuugugggggaggggggcucugaagugcucuucuucuuccucuguagaggcuucgaacagagaaccggcugcucaaacagcggauugagacccuagagaagguaaggaguguggguaccagcuguuggguuccaaauccaaaacacuggcagcuauuaaggcugagggcauugcucugucccgaucuagccgaguuaaggagcauaggcagggcaggcauaguggugguacucuuguaauaucagcauauaggaagaggagacaggaggauuaagaauucaaggccagcuaaucucagccacaugagaccccgucucaaaaaaauaucugaguggccuuucccucagccuccccuaacuccacggagaucugagcugcccuguuguuagggguucucagaagacaucaucccacucuggaucucaacucagcccuaggguuacagcuaaauuacaacucaguggauggcaaucacaaacugcaugggugggagagcaagcuccaucacugggccacaagcaaucccaaccuguaauuuguaaguuucauccuaggaaggaaggaagacagacggggaggggggggggggcucaucccuugagguagagaggcauggacuagguuauggauggggugguuuggguaacuuagcaugacucugggcccuaccuccuguuccuuaguguuccucauuugacuauuugcugaccacaaggaagcaguaggucauggacaggauguuauuaccacaccaaaaccucaauucuuguuuucucucaagauuaaaaugcauccccugucccagcccucucugggaucuccuccucacacacagugaagagacauuccugcugcugaguuuucucagccucgugcaccccagccuccccacucacaugaaccccccuccaggacagaguugguucuggcuuuggucuuucucugggcccucuuccgcugguucucuggucuucacuuuucuauccccugcuucuagagauagcccacugcguuuagugacaagugguucuugucugucucucccccucuccuauccccugccuucugcucugccuccuucccccguugcugggaacccccuucgccugguaggagagcgcggccuuggcugauagguuaauccagguacuguagcuuuuccauauaccucugcacucuccaacccaggcccuucccgcgucccugcacaagacagccaguaaccaccuuuuuccuggccacugccauucugggggcaagagcaacuugcauggaggggcagcuuccaggaagaacaaugccuugagggugggggcaugugagcuggagacaaacacaggaugggaggccuuugugggagugaguuuagaagaaggcuuacccucaggauagacagcagguuuccuccaccgaggagcaagggacgcuaccccaguaggacucaggacuuagagcauuccauuucagguccugacacauuuguuggcuaagcuuacacuaaugugcucacacacaggcauguaugcaugcagacacacacacaacuguucugacuccucucugcuucugcugucacccaucgccaucucucacuugccugcuugugcugcugcuucacucuuggauggcuuuucuagaagcuucugcacagugcccagcggcuccgagccuggaauggggagcagggacuaucaagcugggugggaaggaggaugcaggaggagggaaugccccggggagagucguagagguguaucaccucacacaagccuuuugcuuuguacaacaaucuuuuucuucacuugggacagagguaaacaauccggauuggggauggagccccagcaugggaguugggggcauuugucacugaagccugguagcacauccagacuguccauuacucccuggauccuuuagguggccuguucuugccugucuccacccauucugaggccugcuugggcaccccaucccaggcucugagcacuaaaggccaugccugucucacuuuaacccucccucucucauccucucugagcuuccuagaggccaggccugggaccaaagcagauggucaugguauccuuuccaccccauccucacugugcucaggggcaggugacacgggcacaggaggcugaggagaacuaugucaucaaacgggaguuggcaguagugagacaacaguguagcucgacugcagaggaccuucagaaagcacagaguaccauucggcaguugcaagaacagcagguacccggcgguugaaugggauugacuggcaggaccacaccuucuacaggccuacgugccacccuugccugcuagcccucagggcuuagaucuguaaggugggugagggugccccucacagccagcuccacuccaaucuggccauacugcaggagcacaugccccaccccagcccaugguccugggacugagucuugaagacuuucagaaggcacccugaagucauggaaagucccauccccaacauucccucugugcagcuuucccugaaaagaagccaagccaguuucacggccuucuagugccaugaacuuagcauggguucaacccaggaugccuaacaacugggacccucuuccagcccaggcccacuagcuugaaagcuauccaccaaguaaccgucaccaucaggaaccaaugcaguucuuugccuccaggaaaacccucgccucacagaggacuuuguggcccaccuggagacagaacuggagcagucacgguuacgagaaacagagacucugggggcccuucgagaaaugcaggacaaaguucuggacauggaaaagguauggcuggggaaggagacaaaggucucgagucuuagaagauggagaaaccaagcauggccacauguaaucccaguaccauggcggagaugggaugaucucuggcuugguggucuuuagccuagcuccagguucagugagagacccuaccuaaaggucaagugaugggguaggacacuugacaucaucuucuggccucuucaagcacacacacauacagagagggggaagaaggagagagagaggaagggggagggggagggggagugagggagagggagaagacaaugaacaaaaagagguagccagggcaguugcuccaccugcaugucugucagaucccauagaagaggagaccucugugugcggcuuuagagcccauugccaccuaggcaucgucuccuccaccaccacacagggaucuaggguuauagaaguuggagccucacccacaaagcucuccacacccuugaacugugugggcucauauacacagcagcacagcccugcccugagcacaguguggcagcuucauacgcugccugguugguaucccacugcacugugcaugucuucccaggggcugagguuccaggauauagggaaggaaaguugacaggggaagacccaggccaauuaauucggacuguuuuccuccucuucucucccaugaagauacccuccagaggcaaacuaaggacuacacuuuccgaccuauagcccuagaggggggaccagacuuccugggugccucuccagcugcuuugugcauugacucaacucaggcugaggauguaccugaauugguagaacgcuucccuagcauacauggagucccggaguccaucccuaaugcauacauguaaucccagugcaggugggacucucaggaagggagaacagucauucaagaccauccuuggcuauaucacaagucuaauuucagucuaguuaccugagaucaucuccuaaaaccaacaaacaagcaagcaaacagaucucucagggagcuggcacaaagcccuugaagucgagaaccaucccuccccuaguaccugcuacagcuguguaagagcugcaaaccuuuaagccccaucaacacacaaccuuccacaggaaggaaaugugcccagucuagacccugucuugccuccuauacccagaccuaaacaagggucaguaagggccaggccuacaaguuauauaccaagaaccuagugcaugagcacccuacacacaggacagacuacagguugguuccaguacugucuguuucuagaaagaggggcuucccggccaggccuggggagagugcagggugcuugccacuggucuuccagcaguucucaggacuggucauggguccugaaaggcuuggaucucggaauugugagaaugucagugauauuuauuuacaggaggucucaguucaaaggagucucccaaagacagaccugagacccguuuugcagauaaugaacccuggcuaacacaugagggucuucuuccccugggccuagucucuguucccuuggguaugcuguagucuagggagucuuccucccuucgcucaguugccaaagcagagagaucagagggaaggccagagguguggauccggcagguuaggcuuggagauucagugcuuucccauuuccucacuuacugucucucugcagagaaacagcucacugccagaugagaacaauguagccaggcugcaggaggaacucaaggcacucaaggugcgggagggcgaggccguagccucugcucgggagcuaaagcugcagcugcaggagcucucagacaccuggcaggugagagggugccuccugcaggguaugccugaaacagcugguggaccauacuuagggauucaucgcagaccaacccuggccucuagaacccuuccacccugcuuucuaggcccaucuuucccgcgguggccgcuggaaggaguccccgcggaaguugguccugggcgaguuacaggacgagcucaugacugugcguuugcgcgaggcacaggcccuggccgauggccgcgaauggcggcagcgcgugguggaacuggagacgcagguaggccaggccuacacaaggaccccacgguggacuccuaggccauagcaugaccacccuggucuugcugcugcacccucugauccuccuuuccaggacaacauucaccgcaaccugcugaaccguguggaggcggaacgcgcggcccugcaggagaaguugcaguaccuggcagcacagaacaagggacuccagacucagcucagcgaaagccgccgcaagcaggcagaggcugagugcaaggugcagccccugcccggaccccacgacccuaccugagaucuugccaccuccuugacccgccccuuguguacccccuucccuucagaguaaggaggaagugauggcuguucgacuucgggaggcagacagcauggcugcaguggcagagaugaggcagcgcaucgcagagcuggagauccaggugagccccaggaacugggaggagggugaaccccggggcuggccaagcucugaccgacaguacuccggcccucccggcagagggaggagggccgcauccagggccagcugaaccacucggauucaucgcaguacauccgggagcugaaggaccagaucgaggagcucaagacugaggugagagcaaaggauaucgggcacaggccaaacgcugcugcggggacccagauaaagcaugaagcuaggagggugagggaggaaggcgccugauggcugggguucucuggguaugucgaucuacgucuccaacgcgcgggcgccuccacccucccccgcgcacaccaggugcgguugcugaaaggcccaccgacauucgaggacccgcuggcuuucgaugggcucagccuaacgcggcaccuggaugaggauucgcuaccaucuucugaugaggagcugcugggcgugggugugggcgugggcgcagcccugcaggacccacucuacccucucucuccccgggacgcgcgcuucuucagaagccuggaucggccagccaaggacagcgaagguagcucagacagcgaugcagaugaacuagccacuccuuauagcaaccagggccuggacaacugaagcugggggcccacucacggggagccuggaggcccgcauugcuggcagggagagaucagcaguccgcgagcuugcugcuccacaguacuaaggaauucugugccucuguaacuccugccaacugagggccagguggaggaggcagcacagaggggcagggccuacuggcaggccugcccugcauagcaguguuuauccguguuagaccauauuguccaagcccuccugaguucaaggggugcgugggccaguuaccuggaggguguugcucuccuaacauggacaagggccgaaaguggggaggccccaggacuuguuaauaagcaggaagcuuccuccuccuagucagcuucccuuugggacaagggaggcccugcuggguggggcccaggaacuacaggucugaggaaggaggggcaacuuggacuggauauuagcaccccaggacagguucucuggacacagugauauugagcagccagucccuugccacuggggacagauggccaggcuggacuuuucugccuggugcaggcaucauggccccugcagcagaaaccaaagcccccagcccauccugucugcaggacauaccaccuggggugugagcagucagggggaaccagcucagaccugggaagucucuccccacucucuagggcuauagaagcugcaaagaagaaacccuuucccuagagcacccaucuuccucuggggaguacuaauaucacacguguuggcuggcuguaaaagagagaaccccgcuacuugggaguucucagccucgguccauuuauuccuguggacuuauuccacuuauucuggcuagaguuucccaguccguucccuccccuuaucuccucagaguauucccauggucucugcccagucagaguugagaauggugccaaaguccaucaaugcuccccaggcuccuuuacccuucaccccaccccaacccgcaucuuggaccccugggggcugaccccuucucagugcuccuagagccucaaguagaauggugcccacagcauucccugggugcuuccuggguggggccuccagcuccguuuccauuccugguggccugcucuucaaguguuaaaaaagccugggggcuggagcaggguaccccugaggaggcccucuugugugcuccucaugugccccuccacacugcccaccaccauuuugcacacugccuguucacacuccaugucuccaaggcagaaaagauggaaaauaaaguguauuuacacaguccuaagggaugccgaauagagagccaaagggcuggggaaucacagccagaaguugccaaaccuccauccguguguucuagaaguucaaagauggauccaguggcuagguggugugagaaaugccaaagggaugaagagagggcuugagccuggccuaauccaaaaaugccagccucaggaagagcugggcccagugguaucuguugugugaaaacuguaggaggccacugggguguucugcccuacaccugccucuguggagucucugaugucgugggaauggguacugaggguuaggggagugaauugcauuaauauaaugccaaaguagacaaccagagcagaaaaaucaaagaagccuucauggaggaggcaggugagagguuucccugaagguaacagcacaaaggccaggugccagaaaaugguaggaugaggagaggaggggaggggaggggucgggucgggucgggucguugccuuuggaggaggcagcacguccaggaagaaggaacagaauuuagguguauggugagauggggaagauggugugugacugcuccaaucuggaucagaguuugggcuuugaacugagggcacuaugaagcucuuggagaaggcugaggauagaguccauugaaugggaaauggccuuagggaucaguagccaguccaguacaucaaaugccaaaccgagucaggcaauggcauuggauggagagucaucugggaaagugugcccagguuagccccagcucaugucaguaaggugaaauaaauauagccuagggcacuaaagaaaaccaaaaaacaaacaaacaaacaaacaaaaaaacaaacuacugcccaauggcacagagcaacuggguacaacagauacagggugaauuccuggacagucagggccauaaaaaaaaaauaguuguuuguuuuuuuuguuuuuguuuuuuuuguuuguuuguuuuuucucuuggacuugaagucugggaauaaggaugucugagguucccuucagggcucagcuagagaagaaaucucuggcuuguugcaaaucucagaacuagaguccaggguguacucccucucccaacaauggagguagcagugcuccucagagaggagaguaaaaaaucaagcagagcacugagagugggguagggagagggaggagggaaagggaagggagagggaagaagggaagggagagagggugagaagaaggagaaugugugucagcuugcaaggaugccccugagagugccuagauuagcuaauacauagauuagcauggugucaaccccugaguacucugcccacccuacccccgaccccugcaaguuacagccgggucaguccacuuaaccccuacauuuguggaaguucuuucuucaagccugggcauguuucugcuuuagcacuguagccuccuugauaaaaggaaagggagauugccucaguuuauuuucaacugugauaaaauaccuugacaaaagcaacuuagaggagaaagguuuuauucuggcucacaguucaggguaucaucuaccacuggggaagucaaugcaauaggagcuggaagcagccggucucugagcauccacaauggggguuggggggacugaaggcaugcugcugcccaccucuccgcugacacaauccaguacuccagccagggaauggugggcguuuccgccucagcccaagcaaguuaguucccauaggcaugucaaaaggccccucuuuuggauguuuucuacauuuugucaacuugacacuacuuaucauggagaaguaacagaugaagucaaggacucaccauucuucuacucgaguucaucuuucaggcccaacucucaagcauggaagagaaggggugcacacaggacaacggugcuguagcaagggguacccaggaaagcaaacuacuccauguccgaccgaguaagagcuucgguggcucuccaguucauccacccaggccuuugugagccuaagguuuucauuagaagugagaccggaaaaaucacaaguccguuguagccacugucuuaccauuccccuuuucuguagaaaagucacacaguucagccagaacuccgauuugcucaggcauaaccacuaguaagguguagccuggcccuucgaacuaccucugugguccucuuccagcucgcaagguggcagagcgcauaggugccagcauguaaaccauucagcauguaaacuaucguccacugaacauaaggugugguauugcuccuuggagaagggguguggcuuaggcaaaauaggagaagcucaaauggaaggccauguagguuacagccugggccccaacacgggacucuagagguaaaaaccaauccagccaagugucacaggaagugggaguggagacuaagacaaaagaggcguaaccagaaggguggauucuaaagugguauguguaugguggacaggaaugggaucuggcucaaugaaaagucuccacuuccaccacaguccagucacccuguggggaggccacaucaucuggggagaagcuggugaccgaagugaugcuggcacgagacucguccaagggagacagcaauucggcccagcggcccaauucagcaucgcuaagcggagcccgggauccucccgagacaccacccaccccugagccuccugaacugccuucgcagcccacagcugcaccuucugcagcugcuagcagcaguguccggcuuagcaggugcugcacaacgcucgccugaagggcccccaggggcagcucgccaaggcgagcggacuuugggcuucuugaggaugcuccugcacagucugcagcagucaccuucgcacugccagagccaggcauugguucuggcuccacaucuagggaucccggggugggggccaccgacucugguccuucagauucguagauggugcacaggccaucagaggaaccugggccagcagugggaggccauggcaggggaacuccuguaagagcaaauguggggacuagaaagauugcucccugguuaagaggagcacuugucaccagaccugaaccucaccaccacuguuugaucucuugaaccuacauagugaaggagggaaccaacuccugcaaguugucugccuuccacagcagcgcugugacacucgaguccgcacaaauauucaaagaagcaagugaauaaauaaaacucauugauaugaaaaaaacuaaaggaccaccagggggccagagagaugguucaguggguaagaauacuagcagcacuuuaagaacugaguuugauucucuguacccacguggcugcucacaauggucuucaaguccaguuccagguauuuugacaccauggcaccacauacguggugcacaaacauacauacgggcaaaucacccuuuacauagaauagaauagaauagaauagaauagaauaaaauagggcuguaaagauggcucaguggauaagacaccugccauuaagccugaaggucugaguucaauccacagguaaggugagaacugaauuccauaaguuggcugacuuccacaagugcaccuaaggagugcaugcucacagagugauacaagcauauuc

SEQ ID NO: 4267 - RNA, 8216 nt, Mus musculus
agggagagagggugagaagaaggagaaugugugucagcuugcaaggaugccccugagagugccuagauuagcuaauacauagauuagcauggugucaaccccugaguacucugcccacccuacccccgaccccugcaaguuacagccgggucaguccacuuaaccccuacauuuguggaaguucuuucuucaagccugggcauguuucugcuuuagcacuguagccuccuugauaaaaggaaagggagauugccucaguuuauuuucaacugugauaaaauaccuugacaaaagcaacuuagaggagaaagguuuuauucuggcucacaguucaggguaucaucuaccacuggggaagucaaugcaauaggagcuggaagcagccggucucugagcauccacaauggggguuggggggacugaaggcaugcugcugcccaccucuccgcugacacaauccaguacuccagccagggaauggugggcguuuccgccucagcccaagcaaguuaguucccauaggcaugucaaaaggccccucuuuuggauguuuucuacauuuugucaacuugacacuacuuaucauggagaaguaacagaugaagucaaggacucaccauucuucuacucgaguucaucuuucaggcccaacucucaagcauggaagagaaggggugcacacaggacaacggugcuguagcaagggguacccaggaaagcaaacuacuccauguccgaccgaguaagagcuucgguggcucuccaguucauccacccaggccuuugugagccuaagguuuucauuagaagugagaccggaaaaaucacaaguccguuguagccacugucuuaccauuccccuuuucuguagaaaagucacacaguucagccagaacuccgauuugcucaggcauaaccacuaguaagguguagccuggcccuucgaacuaccucugugguccucuuccagcucgcaagguggcagagcgcauaggugccagcauguaaaccauucagcauguaaacuaucguccacugaacauaaggugugguauugcuccuuggagaagggguguggcuuaggcaaaauaggagaagcucaaauggaaggccauguagguuacagccugggccccaacacgggacucuagagguaaaaaccaauccagccaagugucacaggaagugggaguggagacuaagacaaaagaggcguaaccagaaggguggauucuaaagugguauguguaugguggacaggaaugggaucuggcucaaugaaaagucuccacuuccaccacaguccagucacccuguggggaggccacaucaucuggggagaagcuggugaccgaagugaugcuggcacgagacucguccaagggagacagcaauucggcccagcggcccaauucagcaucgcuaagcggagcccgggauccucccgagacaccacccaccccugagccuccugaacugccuucgcagcccacagcugcaccuucugcagcugcuagcagcaguguccggcuuagcaggugcugcacaacgcucgccugaagggcccccaggggcagcucgccaaggcgagcggacuuugggcuucuugaggaugcuccugcacagucugcagcagucaccuucgcacugccagagccaggcauugguucuggcuccacaucuagggaucccggggugggggccaccgacucugguccuucagauucguagauggugcacaggccaucagaggaaccugggccagcagugggaggccauggcaggggaacuccuguaagagcaaauguggggacuagaaagauugcucccugguuaagaggagcacuugucaccagaccugaaccucaccaccacuguuugaucucuugaaccuacauagugaaggagggaaccaacuccugcaaguugucugccuuccacagcagcgcugugacacucgaguccgcacaaauauucaaagaagcaagugaauaaauaaaacucauugauaugaaaaaaacuaaaggaccaccagggggccagagagaugguucaguggguaagaauacuagcagcacuuuaagaacugaguuugauucucuguacccacguggcugcucacaauggucuucaaguccaguuccagguauuuugacaccauggcaccacauacguggugcacaaacauacauacgggcaaaucacccuuuacauagaauagaauagaauagaauagaauagaauaaaauagggcuguaaagauggcucaguggauaagacaccugccauuaagccugaaggucugaguucaauccacagguaaggugagaacugaauuccauaaguuggcugacuuccacaagugcaccuaaggagugcaugcucacagagugauacaagcauauucaaaaaauuaaauuaaggaggcaggacuggaaaggugacuuggagguaaagaauaaguacagcucuugcaaggaacugaguuugguucucagcaccuauuucagguggcuuaaaaccaguugugacacacauggcacauacauucacacaaacauacauacacaaaaauaaaaguaaaucgcuuuuuaaaagaagagauugugccaggcagugguggcacaugccuuuaaucccagcaccugggaggcagaggcaggcagauuucugaguucgaggccagccuggucuacaggacagccagggcuacacaggaaaacccugucagaaagagagagagagagagagacagagacagagacagagacagagacagacagacagagagagacagagagagacagagaggggaggaggaggggaguugagaaggaggggaggaggaggggagggagagggaggagagggaaggggagaggagaggagaggggagaggagaggaggggagggaagggggagaggagaggagaggagaggagaggagaggggaggggagggaagggaagggggagaagagaggagaggcgaggggaggggaggagaggggagggaaggggagaggagaggagaggagaggagaggagaggagaggagagggagagaggggagagaggggagagagagagcgagagagagagcgagagggagagcgagagggagagggagagggagaggagaggagaggagaggagaggagaggagaggagaggagaggagaggagaggagaggagaggagaggagaggagaggagaggagagggagagaggggagagaggggagagaggggagagagagcgagagggagagcgagagggagagcgagagggagagggagaggagaggagaggagaggagaggagaggagaggagaggagaggagaggagaggagaggagaggagaggagaggagaggaggagagagagaaagaaagagaaagcaaaaugagauuaugagaugaguaaacacaguugcagcucuuccugaccaccugaguucccucccuauaacaugguggaaagagaauucucacacacucacacucacacacacacacacacacacacacacacacacacacacacacacacacacacacacuauggaccaggagcagggcuugacaacuucuugggaagcuccacccccgagucuggaaucucuguucagcauccuuaccuggagugcugcguacugcuaacuguggagcagaacuucgacuccaggaagcgggguggcaggcagcuagguccgcguccggggccggggagauuguaggacagcccucgggcccacuaucguagccgcggagcuccucuggugugcucguggcacuacugcugugaccugccagguccgggccacucagcguacuggacgggcuucgcgaggggggcgggggcggggcaggggccagcgccagggucagccguggaccugugauagggacaucuggacccgggguugggggucgacgaggggcuuguagugguggugaggcaggaggagaaggaggcugaacaaccggcgaggucaggccaggcgggacccccggagggaaaguggucaggggagaaggaggggucuguaaaguagguaaaaccacaaggggaaucuguaggggggguguggcuguggccaauggggaggagggagacugcagggagggcaaggccagagaagguggagucugcggacaggguauugucagaggagaaggagagguuuguagaggaggcaaagccaagagaggacccuguggaaaacauguggcuguguccagggaagagguggaagcuggcagagggggaaaagccagaggugggguuugcggagggggcguggccaggggugaaagagugggugagcccagugaagguggggcuucuggagggggaguugcuaagggagacgagggugaggcugagggagaaagagggcucuccagaggaggugaggcaggaggggagagaagagcgggcagagguggugaggcagggggugaggaaagaggcaagggguauguaacaggaggugccugcaaagaaggcgaggguagagcgcguggcugcauaggggggguaggcaagaaagaaggagaggccugcaaagagggcgagccaguagagaguuggguggauagaggggacaaggccaaaggaggaggcguggccggcuggggugaggaggccagugagggcggcaaggucaacaaagaggccugugaagugggcaaagucugagaaagugggagccucagaggaggcgugaccacggaagagguaggcagagguggugagauggagguagacgaagaaacuggaggagaaauggccagaaacagaggaucuugcaaagacggcgugguucgauuagcgagcguggcccggggaaggggaggagacucagaaaaguuggcccggaaaggaguggagagaggcaacugagaagacgugacaagggaagugggcaaauucugcggggaaauuggcggggaaggaaggaguuguggaggagacgaggcuagagauagaggagcaggugagaaaggcauggccgagagagucuccugagggagcguugcugaagaagccugguuagggggcauauucuguauaaggggagggggcgaugaagagauuacagcucucggugggggugagucagaggccucuucaguauccagagauguggguggagcuagcaauggggguguggcugguguagaggggagguucugcagagaaagaggcggaggugauggugagccuuguccagacugugaauggggcacugccugugaagaggcuugugguuggaguaguugaagagaagcugguagaggcgggguggugggaggagagggaggaagugugguuugcgagggaucaucugggcccuggacagaggaagcaccagguggagugggcgugacuaaagaugaagcaggaaucaggcucuguacagagggcuuguucuuccuugggacuguggucuggguugggugcagagcuugcugcccuuucgacuugagcugcgagguaugcgcaggagcccgugggguuacacguggugagaccccggagcgggauggggagagcugaggaguagcacuggggaucagggaacgugagaccggcuuuugcaggcugccaccagcaacagagcgucuccuaaaggcugggcucagcuccguggcacuggguucagaagcacugcucccagguuuccuggcugccucgguggucagaggacgcugucuggcacugggagcugguugaggaagucccaccucuguagcuggagcccuggaccgacgggugauggcaggggagggggcuccugaggugggcccuaaagaaucugcagacaaaacuaaaguccaaaagaaacauaagcaucucggggcugguugccuucaaagacugauagaaaccuacuugucuccagaucacauaccucuucguguuccagaguucagaguauuccuuuugggcgucucugguguuuuaccucuggccgaggguuccuuagucggagguuggagucucuucuggacaacagggccuggucugggcacaggaagaccaguuguuagcauucccaauuucacauuuucccaucugugaaauagaguugcuugacuuucugugacccaaccaauaauggcuuuugcccaauuuguguccauuaucugcaaguguuccugagcuaucucauauguaauauuuuuguguaugugugugcacauguguauacaguuguacucacccaucgccccccauugccugugcauguggaggccagagauaaacaccaacauuuagcuggacccauuuuucugccuuguuuuauuuucuguuuugcuuauuauuacuauguggacuguguaggcuggccuugaacuuacagagauccacaugccucuggcuucuaagagcugggauuaacagcaagugcuacuacacuuggcuauuuuuugggggacaggaucucucacagaaacugauguuugacacuuccucugcugagcaccagaaacacaccucuuuucuucccacccagagcugagguuacagugauacaucaagaucagcuuuuacauaggugcugaaguuucaaacucaggaccucauauuugugcagcaagcacuuuagcacaccaagcuaccuuuccagcccauucaugucuaagaucaaaagguuccaaauugcuaacccuugcuuggggaauuagggaguugggggaauuaacuuauuaccuggcaaucccacugcuggcacgcccggggcuagaaauagagcccuggccaggggucuucauaggggcccucucuccuuucccagaagcugggggccuguuggcuucagggagaagacaaaaaucagugguacuucugaaaaagaggaguaucuaagaaggaagagagaagguaagcagagugcagauggaggucacaaauaaagcugaguaccugggcuacgaggaccugccccagcacugcgcgcuggugccccgugaauaguggucuguggaagagcugcuuugcuggucuguggaagagcugcuuugcuggucuguggaagagcggcuuugcuggucuguggaagagcggcuuugcuggucuguggaagagcggcuuugcagacgccuggggcucgcuccaccagggaccuucgccccauagcuccguuugcuuccaagacucgaagggcagcaguggucacagggggaggaggucgagcggacccagaaggaggccuaggggucagaaggccagggggucgugaagacggcauucgcggggcaguuccugauuugacgcuaucccucuuguccauaccgcaccuaaugaggaagacaggaggcuugguaucccagguccugaaccaaucacuacaaaccauccugaagccucccugugcuuccuucuagcaucgccacccaugggugccuaaaccucagccuaaagagccucgauuuguuuuucuucuaagcacccacacccgcucaccaaccuggccgcuuucaaguccuacggcuaccuccauccccaaggcuaagacgcccuguucaguccccacccuccgacccccgaccccgccucugcccuauuacaagaacaacauccacuccccuacccccucgccucuugaaaaccuaaaugaccaauccggcaaacagggaaaugccuccggcuuccagauucaggggccucagugugcacgccgauggggcuucgccagcguccuuccucagguuccacaggcaccugcacagagaaaaagaguggccuuguugcccgcgaacgggcucugggagacaaagagcugaccccucccccagucugguccccuaugccaacgauccgcccgauccaccugcucacagcacgcguucaccuccgccucugggcaccagccgcuccacacagggucgcuugggguggggcugggccggagagcaguagcggggagcagcgaaaaggcaaggggagggggcuucaagcgacagagccuagggagcuuggccacggccccgccccccagcuucggguggggagaguagaggaugcgcgcacucgcucucgguccagagccgagagcgugccgagagggcuaagaaaagaggcgcgccuccgagggaggugcgggugcugccucccuguaauaccccagaagaggccgauuucaauggucgugucuagcaaccacagaacucgagaggcucagugggggaauccuugaagaccc

SEQ ID NO: 4268 - RNA, 8216 nt, Mus musculus
gggucuucaaggauucccccacugagccucucgaguucugugguugcuagacacgaccauugaaaucggccucuucugggguauuacagggaggcagcacccgcaccucccucggaggcgcgccucuuuucuuagcccucucggcacgcucucggcucuggaccgagagcgagugcgcgcauccucuacucuccccacccgaagcuggggggcggggccguggccaagcucccuaggcucugucgcuugaagcccccuccccuugccuuuucgcugcuccccgcuacugcucuccggcccagccccaccccaagcgacccuguguggagcggcuggugcccagaggcggaggugaacgcgugcugugagcagguggaucgggcggaucguuggcauaggggaccagacugggggaggggucagcucuuugucucccagagcccguucgcgggcaacaaggccacucuuuuucucugugcaggugccuguggaaccugaggaaggacgcuggcgaagccccaucggcgugcacacugaggccccugaaucuggaagccggaggcauuucccuguuugccggauuggucauuuagguuuucaagaggcgaggggguaggggaguggauguuguucuuguaauagggcagaggcggggucgggggucggaggguggggacugaacagggcgucuuagccuuggggauggagguagccguaggacuugaaagcggccagguuggugagcgggugugggugcuuagaagaaaaacaaaucgaggcucuuuaggcugagguuuaggcacccauggguggcgaugcuagaaggaagcacagggaggcuucaggaugguuuguagugauugguucaggaccugggauaccaagccuccugucuuccucauuaggugcgguauggacaagagggauagcgucaaaucaggaacugccccgcgaaugccgucuucacgacccccuggccuucugaccccuaggccuccuucuggguccgcucgaccuccucccccugugaccacugcugcccuucgagucuuggaagcaaacggagcuauggggcgaaggucccugguggagcgagccccaggcgucugcaaagccgcucuuccacagaccagcaaagccgcucuuccacagaccagcaaagccgcucuuccacagaccagcaaagcagcucuuccacagaccagcaaagcagcucuuccacagaccacuauucacggggcaccagcgcgcagugcuggggcagguccucguagcccagguacucagcuuuauuugugaccuccaucugcacucugcuuaccuucucucuuccuucuuagauacuccucuuuuucagaaguaccacugauuuuugucuucucccugaagccaacaggcccccagcuucugggaaaggagagagggccccuaugaagaccccuggccagggcucuauuucuagccccgggcgugccagcagugggauugccagguaauaaguuaauucccccaacucccuaauuccccaagcaaggguuagcaauuuggaaccuuuugaucuuagacaugaaugggcuggaaagguagcuuggugugcuaaagugcuugcugcacaaauaugagguccugaguuugaaacuucagcaccuauguaaaagcugaucuugauguaucacuguaaccucagcucugggugggaagaaaagagguguguuucuggugcucagcagaggaagugucaaacaucaguuucugugagagauccugucccccaaaaaauagccaaguguaguagcacuugcuguuaaucccagcucuuagaagccagaggcauguggaucucuguaaguucaaggccagccuacacaguccacauaguaauaauaagcaaaacagaaaauaaaacaaggcagaaaaauggguccagcuaaauguugguguuuaucucuggccuccacaugcacaggcaauggggggcgaugggugaguacaacuguauacacaugugcacacacauacacaaaaauauuacauaugagauagcucaggaacacuugcagauaauggacacaaauugggcaaaagccauuauugguugggucacagaaagucaagcaacucuauuucacagaugggaaaaugugaaauugggaaugcuaacaacuggucuuccugugcccagaccaggcccuguuguccagaagagacuccaaccuccgacuaaggaacccucggccagagguaaaacaccagagacgcccaaaaggaauacucugaacucuggaacacgaagagguaugugaucuggagacaaguagguuucuaucagucuuugaaggcaaccagccccgagaugcuuauguuucuuuuggacuuuaguuuugucugcagauucuuuagggcccaccucaggagcccccuccccugccaucacccgucgguccagggcuccagcuacagaggugggacuuccucaaccagcucccagugccagacagcguccucugaccaccgaggcagccaggaaaccugggagcagugcuucugaacccagugccacggagcugagcccagccuuuaggagacgcucuguugcugguggcagccugcaaaagccggucucacguucccugauccccagugcuacuccucagcucuccccaucccgcuccggggucucaccacguguaaccccacgggcuccugcgcauaccucgcagcucaagucgaaagggcagcaagcucugcacccaacccagaccacagucccaaggaagaacaagcccucuguacagagccugauuccugcuucaucuuuagucacgcccacuccaccuggugcuuccucuguccagggcccagaugaucccucgcaaaccacacuuccucccucuccucccaccaccccgccucuaccagcuucucuucaacuacuccaaccacaagccucuucacaggcagugccccauucacagucuggacaaggcucaccaucaccuccgccucuuucucugcagaaccuccccucuacaccagccacacccccauugcuagcuccacccacaucucuggauacugaagaggccucugacucacccccaccgagagcuguaaucucuucaucgcccccuccccuuauacagaauaugcccccuaaccaggcuucuucagcaacgcucccucaggagacucucucggccaugccuuucucaccugcuccucuaucucuagccucgucuccuccacaacuccuuccuuccccgccaauuuccccgcagaauuugcccacuucccuugucacgucuucucaguugccucucuccacuccuuuccgggccaacuuuucugagucuccuccccuuccccgggccacgcucgcuaaucgaaccacgccgucuuugcaagauccucuguuucuggccauuucuccuccaguuucuucgucuaccuccaucucaccaccucugccuaccucuuccguggucacgccuccucugaggcucccacuuucucagacuuugcccacuucacaggccucuuuguugaccuugccgcccucacuggccuccucaccccagccggccacgccuccuccuuuggccuuguccccucuauccacccaacucucuacuggcucgcccucuuugcaggccucuccuucuuucuugccuacccccccuaugcagccacgcgcucuacccucgccuucuuugcaggcaccuccuguuacauaccccuugccucuuuccucacccccugccucaccaccucugcccgcucuucucuccccuccugccucaccuccucuggagagcccucuuucucccucagccucacccucgucucccuuagcaacucccccuccagaagccccaccuucacugggcucacccacucuuucaccccuggccacgcccccuccgcaaaccccaccucuggcuuuucccccucugccagcuuccaccucuucccuggacacagccacauguuuuccacaggguccucucuuggcuuugccuccucuacaaaccucuccuucuccucugacaauacccuguccgcagacuccaccuucucuggccuugcccucccugcagucucccuccuccccauuggccacagccacacccccccuacagauuccccuugugguuuuaccuacuuuacagaccccuccuucuccccugaccacuuucccuccgggggucccgccuggccugaccucgccgguuguucagccuccuucuccuccugccucaccaccacuacaagccccucgucgacccccaaccccggguccagaugucccuaucacagguccacggcugacccuggcgcuggccccugccccgcccccgccccccucgcgaagcccguccaguacgcugaguggcccggaccuggcaggucacagcaguagugccacgagcacaccagaggagcuccgcggcuacgauagugggcccgagggcuguccuacaaucuccccggccccggacgcggaccuagcugccugccaccccgcuuccuggagucgaaguucugcuccacaguuagcaguacgcagcacuccagguaaggaugcugaacagagauuccagacucggggguggagcuucccaagaaguugucaagcccugcuccugguccauagugugugugugugugugugugugugugugugugugugugugugugugugugugugugagugugagugugugagaauucucuuuccaccauguuauagggagggaacucagguggucaggaagagcugcaacuguguuuacucaucucauaaucucauuuugcuuucucuuucuuucucucucuccuccucuccucuccucuccucuccucuccucuccucuccucuccucuccucuccucuccucuccucuccucuccucuccucucccucucccucucgcucucccucucgcucucccucucgcucucucuccccucucuccccucucuccccucucucccucuccucuccucuccucuccucuccucuccucuccucuccucuccucuccucuccucuccucuccucuccucuccucuccucuccucucccucucccucucccucucgcucucccucucgcucucucucucgcucucucucuccccucucuccccucucucccucuccucuccucuccucuccucuccucuccucuccucuccccuucccuccccucuccuccccuccccucgccucuccucucuucucccccuucccuucccuccccuccccucuccucuccucuccucuccucuccucucccccuucccuccccuccucuccucuccccucuccucuccucuccccuucccucuccucccucucccuccccuccuccuccccuccuucucaacuccccuccuccuccccucucugucucucucugucucucucugucugucugucucugucucugucucugucucugucucucucucucucucucuuucugacaggguuuuccuguguagcccuggcuguccuguagaccaggcuggccucgaacucagaaaucugccugccucugccucccaggugcugggauuaaaggcaugugccaccacugccuggcacaaucucuucuuuuaaaaagcgauuuacuuuuauuuuuguguauguauguuugugugaauguaugugccaugugugucacaacugguuuuaagccaccugaaauaggugcugagaaccaaacucaguuccuugcaagagcuguacuuauucuuuaccuccaagucaccuuuccaguccugccuccuuaauuuaauuuuuugaauaugcuuguaucacucugugagcaugcacuccuuaggugcacuuguggaagucagccaacuuauggaauucaguucucaccuuaccuguggauugaacucagaccuucaggcuuaauggcaggugucuuauccacugagccaucuuuacagcccuauuuuauucuauucuauucuauucuauucuauucuauguaaagggugauuugcccguauguauguuugugcaccacguauguggugccauggugucaaaauaccuggaacuggacuugaagaccauugugagcagccacguggguacagagaaucaaacucaguucuuaaagugcugcuaguauucuuacccacugaaccaucucucuggcccccuggugguccuuuaguuuuuuucauaucaaugaguuuuauuuauucacuugcuucuuugaauauuugugcggacucgagugucacagcgcugcuguggaaggcagacaacuugcaggaguugguucccuccuucacuauguagguucaagagaucaaacagugguggugagguucaggucuggugacaagugcuccucuuaaccagggagcaaucuuucuaguccccacauuugcucuuacaggaguuccccugccauggccucccacugcuggcccagguuccucugauggccugugcaccaucuacgaaucugaaggaccagagucgguggcccccaccccgggaucccuagauguggagccagaaccaaugccuggcucuggcagugcgaaggugacugcugcagacugugcaggagcauccucaagaagcccaaaguccgcucgccuuggcgagcugccccugggggcccuucaggcgagcguugugcagcaccugcuaagccggacacugcugcuagcagcugcagaaggugcagcugugggcugcgaaggcaguucaggaggcucagggguggguggugucucgggaggaucccgggcuccgcuuagcgaugcugaauugggccgcugggccgaauugcugucucccuuggacgagucucgugccagcaucacuucggucaccagcuucuccccagaugauguggccuccccacagggugacuggacugugguggaaguggagacuuuucauugagccagaucccauuccuguccaccauacacauaccacuuuagaauccacccuucugguuacgccucuuuugucuuagucuccacucccacuuccugugacacuuggcuggauugguuuuuaccucuagagucccguguuggggcccaggcuguaaccuacauggccuuccauuugagcuucuccuauuuugccuaagccacaccccuucuccaaggagcaauaccacaccuuauguucaguggacgauaguuuacaugcugaaugguuuacaugcuggcaccuaugcgcucugccaccuugcgagcuggaagaggaccacagagguaguucgaagggccaggcuacaccuuacuagugguuaugccugagcaaaucggaguucuggcugaacugugugacuuuucuacagaaaaggggaaugguaagacaguggcuacaacggacuugugauuuuuccggucucacuucuaaugaaaaccuuaggcucacaaaggccuggguggaugaacuggagagccaccgaagcucuuacucggucggacauggaguaguuugcuuuccuggguaccccuugcuacagcaccguuguccugugugcaccccuucucuuccaugcuugagaguugggccugaaagaugaacucgaguagaagaauggugaguccuugacuucaucuguuacuucuccaugauaaguagugucaaguugacaaaauguagaaaacauccaaaagaggggccuuuugacaugccuaugggaacuaacuugcuugggcugaggcggaaacgcccaccauucccuggcuggaguacuggauugugucagcggagaggugggcagcagcaugccuucaguccccccaacccccauuguggaugcucagagaccggcugcuuccagcuccuauugcauugacuuccccagugguagaugauacccugaacugugagccagaauaaaaccuuucuccucuaaguugcuuuugucaagguauuuuaucacaguugaaaauaaacugaggcaaucucccuuuccuuuuaucaaggaggcuacagugcuaaagcagaaacaugcccaggcuugaagaaagaacuuccacaaauguagggguuaaguggacugacccggcuguaacuugcaggggucggggguagggugggcagaguacucagggguugacaccaugcuaaucuauguauuagcuaaucuaggcacucucaggggcauccuugcaagcugacacacauucuccuucuucucacccucucucccu

SEQ ID NO: 4269 - RNA, 10781 nt, Mus musculus
uacuguacaaggagguggaaauuaccguucucguuuauuaagcacccagugguauaugcuccccugcacaggaaacauucaaaagaaaaucccugaaugaacugggaaaaaagguagccuucaccagcacuggacucaggugggaaugugugacaggagacucggcuuacaguuucuucuuuauguuccaugagcauuguccugagaaaacacugcuuaacuugaugggacucccuacggcucgagaaaaggggcuccauagcugacaugucaguauuccauucuuaguuguuuugagaugagcuaugcuccgucucccaggcuaccuccaaccuuucacgccuccucccuccaccuccagaguacuauacaggcaucucuacauuacauagguuccaccacuccuagauuaugaaaugcugaggacgggacccagggcugccugcaugucaagcaagcacucucacaacugagcuucagugccagcccagucuuuaugucaauauuuccauuauguggucucaggaccaccugaaucagaauuaccuggcauucuuacuuaguagcagauuccuggccccacccaauuuuuuuuuuuuuuuuuuuugacaggguuucucuguguagcccuggcuguccuggaacucacuuuguagaccaggcuggccucgaacucagaaauccaccugccucugccuccugagugcuggaauuaaaggcgugugccaccaugcucagcuacccauccaaauucugagucaguauaauuucagggguggggugggaagcauguaaggguuuuguuuucuuccgggccucucagcugauuuuauuacauagcuaaaugugagagccauuguucuaaguacccaucccugucacaaagggcuuauaaaaucaggacuugcaugaaaguugggauauggaacuuuggaacuggacccuguauccucuccuuaggagagaacccuaaguauaugcugauccuuguugggaaagguuggaaaucccacucccauauaggaaacuaauuaagccagaauguucagaggaagggcaagccagccagccaaagacacaggugugguuuugguugaagaaccuaagacugguuaauccuucccuaagggguuacaccucaaaucuaccgccuccuguuucuccuccagaaaaaccagucccaggaucuugucugagcugcacaaaaccgacauguccugccuuccuuccacuccugcuggaccucucucccuuggaauacaauguugggcagaaacauguaaaggccucugugucagccugccccuucccccaccaggcuucauuccuccuccaucuuuucccgaacuucugcaggcagucccucauaaaggguguccuccaccagcagccccgacuucuucagccccuugcagucaccaaguucuucuggcagugucuccaaccuguuacccuugagcuccagacggcugagggccuggagggcagccacgucaggugagagcugaguuaggugguuguagcccaagaguaacguccgcagcuuguggcagaagaacaauucaucgggcagacucucgagugcguuguaggagagggcuagaugcuggaggcucuggagaaggcccaacucagguggcagggaacgaagcccguugugggauaaauccagcaggcggaggccaaagcacuggcccagcugggugggcagagucuccagcuuguugugacugagguagagcugcuccaggcuccggagcuuucucacaugcucgggcacauaggcaaucugguugugccacagccugagagugaccagcuuccgacagugcuggaagcugaggaucuccucgauagaccgaaggugguuguccuuaaggucaaguuccugcagagcccccaggcugaagauugcaugggggauacguuccagcccacaggccaccagcuccagcucccguaacacugccagcuucuugaggcuguuuagggcaagcaaacgagccccaucauugugcaggcugagucgcugaaggugcccggccacaucagucacacuggcuggcaccuucccugcauugcuacguagagacaguaccuugagcuguuuaagcucccggaggcucuccaggguggcaccccgagccauuucugggggaaagaguccuuccaggugcaguucuucuaagccucgaagcccaaacacccagagggguaccucucggagcuccucgaauuuaacacagaucaccuucaggcgaucucgcaggaagaucugugaugaaaagggcagccuggcuggugagugaagcaagcugagcuccugaagguucacaagcugggagagcccagggggaaaggagaugucacagauggccuccagccugagugccuccaccucgcugagcucaaagacggugucagguaguccagggagcaugcagaggcucagcuccagccggccacgcauguuacgcugcagcuucugccucagcuucucagguguccacucaugguugagguugaguugcuuaaggcggcucucacugacuucagagaggaagacugcaaagcguuuggaauagagggagucguacuggucaaugagguggagcaugaaggcaaagucauucuuaacauccgggauaucguucaucccugucuccucacgcacagaacggaaggaguacucuuuuaggggccuauggaagagccaguagaguguauacaggcaggugaugccauagacacacacaaaggaaauauagcagaaggccagcuuagaaaagaggugggccuuggugugguugcagcagaaacuggcauaccccgugaucucugaugucuccacccuacaggccaccagaaagcugaucuucuccacauagaucagguuguaaaccaggauggcaaaaaacuuacacacuuugagcacugucugccggauguacauggaauagaggaugucacccucuuccacgugcacucggaacuuuuugaccuucucgaauagggccuucgcuugcucgcccuccuucuuauccagcagaguaacaacuggaggcucagacaccaccuuuucgggcucaaugagcacuuucuccuucucaccuucacccaccuuccccgacccugccccuguggugguuaccguggucaccauggcccguccagaagcugggcccuugugauuuucuccagacaccucggacaaggcccgagugguccauggagaaucaaagcacuugcccaggauggagaugaaguguucuauuuuggagcugguaccagggaauuugaaccaaaagcugguacagaccauaaagaugagaguauggauaaccaccaaguaggggaaguauuuggcauaccaguggagggcagucucauagcagagcugguugauaaagcuauacugcuggaggucuagguuguuuuugaggccacugagcucucggagaccccccaucugcucagagauuccuugaggcaaaagcugcuggcauggagcccccgauauguucucacgagauucguggcuaggcaagcagaugaucuuguccugugucaccuggggauagggagagagugaaagacagugaggggacuagggaacuguacgggagagaagcaggaugaggugggagacccugauccuagacaguuguaagcuguuugaguguggaagagcuguuaaacuauagcaucaaucuuaaucugaaaagaaguucuaggggagcugagcaugugugguggugcacguggcgcacgccguuaaucccaguacuugggaggcagggccagguggguuucugaguucaaguccagcuuggucuacagagugaguucuaggacagccagggcuacacagagaaacccugucucaagaaacaacaacaauaacaacaacaaaaaccaccaaauaaacaaauuaaaaaaauuaaguuauaucuauaacaaaauucuauaagaaaaaaaguuuagccuggugaugcuagccuauaguccuaguuacuuaggagccugaggcaggagaaucagccucugccugggcuacaaaguagguauaaguucagccuagacaacuucaauagacacuagugaaagggagggaauggacaggauuuagcucagagguagagccccugccuagaaucccccagaggggcuaggguguugcucagugguagagccccuaccuagaauccccccgugaggggcuagcaguuuggcccugcaguagaauccuguuuaacacuggaagccacaaaaaaggaaaaaguaaauguguauggaaacacucuaauauuauuuuagacuuugaccacugcuuguggggauggaggagagaagguaggggacuagacuuggucuguguggaggcuuuggcacugccuuccucuugucuguuucucuuauuuuauugaugauuuuuauugaaccugggaccucauguaagcuggacaaguacucuaauacugauacuuuuucuucuuuccuauguuauuuauuuuauuuuagagauggucucacuguauaggccaauugaccuggaacccaggauccugauucauuuucucuauauccugggaacgcaggugugcacugccacaccuggccuuaauuuuaacuuugagucuugcuaagaugccuaggcuucagauuugugauccucaggccucugucuacagagcacucaccaccaugcccaggcucuuucucccucuucuuaggagacuugggaggcuucaggacuucaagcaaaaggccuacuccuuuagagaucugcucuuuuaccuagagagcccagcugaacacauuucccugucucaucaucauggaggggucuuacccauaugcauagcacaguugaagaccccccuaccccaggcaugagcauugucauguuaagaccacgucccuuuaugguccugcccuucaccuggaacgcagccauggugaggcccaguuccuucaugacugaaggggcuagagauugguuaagaauacuuguugcuuuugcagaggacccagguuugguucugagcacccacauggugguuuacaagcaucuauaguuccaggaaagcuaaccuuucuuucugaccuccacaggugccaagcauacauguaccuugcauguacacauacauacaugcaggucaacacucauacacauaaaagaaaaaguuuguguggguuuuuuuuuuuuuuuuuuuuugauuuuucgagacaggguuucucuguguagcucuggcuguccuggaacucacucuguagaucaggcuggccucgaacucagaaauccaccugccucugccucccaagugcugggauuaaaggcgugugccaccacgcccggccaaaauguguguuuuuaaaaagacacucaugaggagaguugccaagaugugucacaccuucacauccccagccucaccccuaaccuggaaagagcagcucaaggccccagucauuagcauggucaggaauauggccacaaugagagccagaucccguguacccccuccccugucugcucuuucaccuacagaguuuauugccauaacauggcccugccuugccacaucccacucauugucaagaagguguguccuaaaacucuagucauaggaacugccaauguguguggcccugcccggguuuguuuuguuccucaccuggagggugcacccgaauaccccgaucaugagcauagccacggugagguacucagccagaacaucccaccaggguuugagcaccuugaaugcaggcugcugcucugugaacugcuugaacuccgccacugggaucauccugccuaugggagucagaagacaagagggguugagacaccaaacagugagagcaagggugugccugguggaaaccccgagaggccagacauagcucagaagccuacgcacucucagccuggccagaacuuucuagaaucuaugcaucguuguauguucccuuccccucuuagccggggucuuguugcuuccuucggaacucaccucuuucccagucucacagcguuuccccuccuccaaagcacagguuuaucuuucacugccugcccucuucagaacucugugagaguaaaaaaacuacagggcagcuguccuccagucuccuccuuuggcugcccaccucugaaggaggaagccugugacauucguucugguacuccuuuauucuagcuggguucucaccuccaccuugccaccaggguauccccaggcucaagacuuccggggugugccccccuacaggggugcucugggcaccaccuccauucucuaaccggaaaagccggcuagggagaagcaagcuggagcguggcugugcucuaguuaagggccucagggguuagggaguggccaggcugaaggcuacugagcccuggaggcaugugccaagacaccugacuguucagauagggacuagagccuagaaucugaaguggaaauaagaaaucugccccccacccccacccccggggaagaguuuuggcauguguggaagcaugagaaucacuaaacuggaaaacucucagggugacaccuaugacuggagccuggcacagggcugccagcccacucugucuaucucugguuuccuuuucuacuaagguaucauuaucacaaaggccagacccaagucacacggggguguagaaugugagcuaagacaggacucccaggaagucagcuacuugcuuagggcagagaaggaagcaaagagugaaggucucuuggacagcccaccccugucagcauccaagcuuugugcgcgcacacacacaccaagguguggauauggaagaguaggggguucuguagaaaagggagcaggcauuacgucuuccuauauagaaaauaugacacugaggucccaaguucauccugaaccagguacauguaaggagacgaccagagaacaagguccuuuacauaugcucaccaaacacucucuuaaaagucucaggcuguggaguagcucaauugguagggcacuuuucuggcauguacaauucucugaauccagucucuagcaccacauaacuaggcauacugacacaugccugcaaaucuuagcacuuggggauuucagguaggaggaucagaguucaaaguuauccucagcuacauaggagacucaaagccagccuggguuacaugaaaccacauuucaaaaagaaauuuuguugcccuccuuaaagaggggcuguagcuuaguacuaaguguuugcaagagugucuccagaacuggaggggaaaaaaucccaaucuucauaaucugacagaaauaacgaggggagagagaugacucaagggaugcuacacauguaaaaucaaggaccaguucccugucuccaccuuccacgacccacgucacagugucacaguucccaacucugccaggcuacccucacaagucacaggccaggagacaggagcccucugcucagcucccaggaacaagacacgauguagacacacaaucagagggaagcacaggggauuaucauugucuggccccgugacucaaacaagaucuugcagaaccugccauuaaauuccagcaggcagauggaaggcuggcccccuucccugugucuggacagagauaguggaaaggucacagaacugggggaaguguagagaaaaaucacaauggauuuuauaugaaagaauuucucuuguuguucuucaugcugauuuuuguuuuuuuauuuuuaagguuuuuuuuauuuuuuuuuuuaauuuuuuuuuuauuuuuuuuuuuuuuuuugguuuuucgagacaggguuucucuguacagccuuggcuguccuggagcucacuuuguagaccaggcuggccucgaacucagaaauccgccugccucugccucccgagugcugggauuaaaggcgugcgccaccacgcccggcuuaagguuuuuuuuaaaguguguguguguguguauguguguuugugugugcuuauguguccagugguugaugccagaugucuucuaccauucaugacaucaguuaucuuuguuaucaaacucaggagcucaugcuugcuaagcuaccucucccauccuccaucuuuucuuuuuuucuuuuuuuucuuugagacaaggccucuccuugaaaucugagggugagcauuuucacuggacuggcuggucauucuggaauccacuaagguuaccaaagugugucacagugcccugcuuuuauguguguagagaaagaaccuuggaguuggcucaagacaccccaagaccaaaucagcacaaaggagauuuauuugcuccagaggggcagagggcauggaauaagagaugaagagacagaagauggaggccgagguagaaggcgaaaggaacaggcagaggggaaagggauaauuuacccuggagaacaaaagacuuucucuggauaguaggagacagaguuggcccauaggaaaguggacguuuauaaagguaaaggagaaaucuguguuaggaucaggaguucaguuuugauuggauauguuaauuaggugagcuaagggggcuucugauuccuggacuucaauacuuuguuaccuguauuuuggcagucagucucaggagagggaaguagccaaauaaggaaauaaaccuuaggggcuagcuucagaaauguaaucuaacaguuuuuagcaaagcagauggaaaugggggucgggggagaacggcaaggccugccacagccaugcuugccaugcucagguuggcuagaguuccuuuaaugugggcaugagaugcaaacucaggugcgccugccuuugcagcaagcacuuuacccacugguccacccuccagcccucuuguaucccucaaguuuuuugaaacaaggucuuacuauguagccuugucuaggcuggugcuggcuauguagaacaagaugaaccgaaaauguacugggauuacagaggugugccaccaugucuagccuaaugcugaguuuuaucccaguuugggaaguauaagugugagggucuuuguccuuucaucuuggaggaugaacauaacucgcugaggauuucacugcuacaaguaucacuugagccugcccagccaaagucuaccuccuguuugauggcaccaacucuguuuccacccacugaaagcaccccucauugagaugcagccucuauguauguaaggagugcgcuuuggggaaaugguucaguaagugaaauaucugaugcacaagcacgaggauccgagugauauucccagcacccacauagaagugggcaggguagccuagaucuaccaacacccccuuccuaucuugcaagcuccuucccacagcuaagccuuagcacugcuccugcugaugcaauggaggcaggggauguucccaaccucagccugucuccccagcuguagcucauaugcuaagggccgagaagagacagaagaguuuucaacuuuuagaauacaaagucagaacuaggaauguggccuaguugauagagugcuuauucaggcccuggguucaauucccagcaucucauaaaaccuggaauggugggugcacaucucuaucauacuccuuaggauagaggcaagacgaccaacacauugagcucacccuaagcuguguagcaagcaagcuuguuagaaacaggccagcauuauaugaccuugucuccaacaaaccaacaacaacaacagcaacaccccaaaacacagggcugcggagguggcucauuggacaaaggcaccuguugccaagcuagaagaccucagugcaaucucagggacccauagguggaaggagagaaccaauuacuacaaguugucucugaccucgaugagagugccguggcauguaugcacacacacacuaacuaacuaacuaacuaguaaagaaaaaaauuaagcucuugaaaaacuaaucccuacacuucucacaagggggauaaagagguaagggaaagacaccccuagaggaaagucuugggggccuauagacuccuaggcuagccccuucccaagcuuauucugcugggauuuggaaggguuuuuuguagucuucaaauauaagaaccuugaaauguaagggagcaggcuugugagggugggguucugcagcuuuuagggcgcucaugaagaugagcucugucuuucucagcuaccuccaccaccccacgcugggacaggcugccaaagacugucaaagucgacuccugccuguugaucucucuuccuucgcuugaucccgaacugccuggaucccaggacaccagcucccuggggccaagcuggggauuaccgcaccccucucccagcccgggcuuucaaugugugugggauugcuccggccaaggccacggaaccacccacaccugagcgacucccuccacuccuccgggccauucccuggguccagguugaucuacacggugggacgaaagccucccaagcccccgcuacuuacucacugcucagggauggaacuccggggcccaacuucuagaugccugggaguagaucgacccggacucccgcagaguucccgggcgggccagagagggugagucagggcgggcugggccaggagccgccccgccccgcccccgggauuguucggccccgccucacuacagacgcuaucaggucgaccccacuccacgccacgcgaucgcuaacaaggagagauauuccugagacaagggucuguagaagucugcagucccucuaccuccuggcugugggggcaaacugguauccuguagaug

SEQ ID NO: 4270 - RNA, 3162 nt, Mus musculus
cagaccgccucagccuccguagccccgcccacuagggaaagagccccgcagugucccgcuaugaagccaccgcagagacggcggagggucccagcacgcuacguaggugaagcuacgggccccaccgcuuggagcccccgcgagaugcggcaucuacugagacuacuucaggcucggcggggccagccggagccagacgccgcggagcuggcccaggagcugcgaggccgcagcgaggccgaggugaagcccuggugcugggggcggggccggggccggggagcgggacggccgugcuaagguggagcuggccggguggguggaccgucgcggaucucagcggcgcgcgggauuugcgugcaagauggaguucagggcggggguguggguggaauuugaggagggggucauggaggugaccaaggaauacugacugaucaggggcgggugacagugagguuuagagugaggcuaaacucugguaaagcugcggcgcagugggugggaggaguucgggggcggggcugcgauggcgugcugcccgacugcgggucugugagugaauauggcaaguggagcaugaagaggugguaugugagugggaaagccugggaguggggcguuacgacuggguggagugagucuguggguaaggcuguggagaguugugaggcuguagagugugggcgggaaacgucggcgugcuaagcguaggggaguggaggugaguggaagagaggguggggcguggauuaaggcagaguugguagcccggugugugacauacaccucuaauccuagcaccugggauccuuucauugguggaccucuuugaguucaaggccagcccaaccuacauaguuccaggacagcaaaugcugucuuaaaaaaaaauaucagcaauaacaacaaaaaaaguuaauuugaguacaaccaaagugagaaucuacaaaauggaguggaguggaagugaacagauuaguucucauuauaagagcaaacaauggcuccaggaaggaacaagaauaggccuagcuuuuacaucuucauuagguagcuuggucacacacuggggccuuggcucaagucccagcaguucugggaaugcacaacgcuggacuaguccaggagagggagcaguagcagggccugagaacagcaaggugguagacuuuggucuugccucuguuucugagcucacagccugucuuccuccccagaucugucgcuuuauccagcagcucaagggccgggugguucgagaggccauucagaagaugcagccagguggcagagaggggccaaggcaucaaggaacaccgcucccagccccgguagaggugaggcaggagggcaaggugggggauggccaaggcuggcuucuuagggagggaggauaaccuggucagaggaauacaagaaagagcaaaacuugggaccccugggggcuugucccuagacugaccauguaccaacuggcuucacccagguauggauggaucuugcugagaaacuaacaggcccaauggaggaagcccugacugcagcuuucucccagguaagcccauucccuuggcaaguccaaggguguuuauuaauaggguaccaggaugcccuauacaucaauaacccagggguagagagccacuggguuuagucaggcagugguauuguauauaaucuccaaauuugaaggaguagagaauugccaggccccuccuaacacuacccaaaaagaaaagaaagaaauguagaucugguacaaagucaguaacuccagccaggcacugacacuugagccauagugucuauggccaucucuuguguggaucaccuucagagcgugcagaggcagaggguccauucuaggucuagcaguggaagaugaaagacuuccucccguccugcccugacggcucuuccccauuaggugcucaccauugcugcugcagaaccccucagccuccugcacuccaggccaggcaagcccacaaaggcccguggaaaggcacugguguucuugagcaaccaagaugggcagaaggauccugcaucugaagguucugggccuguccccaugacugcugcugacccuacucgugaggcuucugucucugacccuaaggccucuggagccaacccugagaccucuggccuugccucagaggucacugucccugacccugaugccccaaccaagucccuggcuggauccuccacagagagagaccuugcuguggacuuugagaagaucuacaaauaccuuuccuucuccuccagagguggccauggcccugagcucucagcagcugguaagagcuacuagggaggagagggcuauacuguguuuguguugcgaggggguugucugggggauguuaaaaccuguccucucauucuucuccuuuccuucuaccagagucagcugugguccuuaaccugcucauggcacuuccagaggaacugucccaccugccuugcacggcccugcuggaacauaugaccaaaacauaugcucaacugauggcuccccagaccgcucucccuggagagaagaggcccaggccugggacugaagauggagggacuggcuccacagggccagaggagccugaccaagcuaguccucaagcuucugagcccauagagccgaggcuggccuggaaagcaguugggaucugcccacugaacccguuccugguaccccugggccucgugagccaggcccccagcccuucgaggugaagaguacagcagacgagaugugcugaguuuugcccagaacaucaguccagcaccacugguguuggaacuugauuguggacuuccugacacaguguucagccauaggcuaagccuucagaugcuguauacaccagcagccuuagaaagugaagcacaauugugaugaaugagggcuggagagacggaaggcucuacacaaagcaggauuccugcacugguagauuggggcaagugucucuagcccacugugccuauucucugccauaauagcagcacaucauuaccccuuuguguguggcucuagcaucuggaucccccccagcacacucuccccaccucaguggaccucuggaugguucucuucaccuuuuccugggguguccuguaacccucaauaaagcuaucaucuaccuagcu

SEQ ID NO: 4271 - RNA, 18270 nt, Mus musculus
guuaacucagcaaucugcuucacaugcaguaagcacucaauaauagcuuuuauuauaauugccacgguucagaggcggggaggugugaaaggcaagggaagggcauggggacaagggggacaugggagaggugggacaaaggaaaggcacucuaaccugugcuggggccgagucugggaaggggaugagccugcuuguacucccgcacauaaagugccagauauuaucaacacaagcagcagccauggugggguuucugggucugucucugaggcaaacuguaccgugcauuauagguaggcagcguccaaugugagucgaagaaagccugccugccagggccaggacucaaggagugcacugaaauugaggaugaccauaacaaagaaauaagagauaagagguguccgcauuuccaggaaagaauguagcaugccugguaguuggggaaagcugagguuggugcgggguccuucacucaccagggacucaguguugagggaucagcaaugaggauaaguauguagagagaaggggacaggguagauaaaggcaccaggugggguucuggccuggccaggaaggaagauggguagcuaagguagguaaggacuggacuucuccgaacgcccucaacuucgagcuagggcaucuaggcauaacccugagcacaguccaggcugguggcaccccuccacggggaugacccuaaggaccugccccgacugguuccccaucacaccaacgcauagucgaacugcccgcguucgagcgccuccuuguggucgguccaggacgaggcgggcaugcggcuguaggggucuagcaguaugcgcacacagcgcaccaucaacagaaccaacaccacgagcaggcagagcacgaaggcgaacaccgugcguugcucgacguccaggcccgcgcccaccgggggccccgucgacggcggcagcggcuccggugauaguguccacgccgaacucauagcucacaucgccgcgcucugaggagagagggguacccaccccgggguccgcggggaugaggcuaugcccuuccugcaccuccauccaccccuucuggaguagccccuuugcuguaucccacagcaucaucucuguccguguugucgucuccgggcuacgcccaugccccgccugugcgcuccgccgccacagccacgcggggacucaacuccagcggugcgcgcagguggggucgcugagagccgggacaggucagcuuagaucugcccagcccgcgcacaacaggugcgaucgcgcugggacagagaccagagcugcacuguuugaacugguccccgccccgcucccuuuguucuccaaggcccaagaccccccucccccaccguagccgacucccgggcuacaacgcgccccccucacccuugguccuagacggggaccggccgcccugcagccccucucucucucucuuucucggaacucgugcgcugcuuugcucuggucuucccggguggcagugguagcggcggaggcuguggcagccccggcucagcccaccccacccgccccuggagcgguggagaccgagggaggaaggagagccgcgcgccagcccagccgccgcggcuguucccauggcgacgagggcggggcugcgagggggugguggcuguguuaggagcggugccugggcuugugaccccgccccggccugccuaucggaaggcugaaccuucccaccgcugugccagcccagacagccucagcuuccagcuccuagagcacccaggaccucgccaggacaugggcauuuacgccucucccacggaagccucuccuaaccucggugucuguauccguauucuucccgggcaaccccuuaccccagucucuguuaguuaagccccgaagccuuagggaaccccgaauucaacugagaccccagacagcugggaugcuuauucuucccacaaaagggcaggguguuggcccgagaaagcagcacucucucuggcuacaauccuucacugaccuaggucucugacaggcccucagucccagccuucccagcagagagguacacuucaaaccguucaaacugcucuucugcgcuuugguguuuuauuagguccagaucuuaggcuuauguacaggaaguaagagcacugauuuaaaaacaaaaacaaaacaaaacaaaaggaccuaaaguggcuuggaaggcaaugccaguggacuacuuagaacagcaggccaggccucacccgacaggaguccugggcuggggccuucugacacugccagcaaccccugugacggacgcacugggagacaguccccauccugcuagacaccccaagcucuucccuuguccagcugguuucacagcugcccugaagaacuuggggcagaagcuuguucacagcuguaucagauguggcaaagugucucugugugucugucccaugauggucuagccucgagcugccuagacuccauugcugcccucagaggaucugcucugugcuggaggcugagauguccagaaggcgccaggcagcauaaggguugagcuccuccuggucucugcagagugcccacacguacagcauucgcugcaccuuguccugugaagaccgggcagggugaggggucaggcuugguggguguacagaaagaagggcuacugagggggacagggaagggguucccgggcugcuggcucuggucaguggucagaugaaacggugcucugacuucaaaaagcucucaauucguacuuguggugcuucugccuggcucugugcuggggaggcgugcaaugcacagggcccuguaugugagaagcacucccaaaccuccauucccuugauuaccacucaccgggucaccaucauacaccucgccuuuggaguucuugaucaccaucaccaccugggccugaaagguaacgaucagcacugggcccugcuccaucaucuugcccauggccagcugcaggaaacacacaaguacaggccucagaacuguacaccuccacccaaugcucacaacccuggagaugaaacgccccaaaguugcacucuguacuuguccuauagucugacacuuugccgugcuaaagguaugguaccacccuccccgacuuuagaggagugauuuuuuuccaaugagcuccuucucaugggcaacuccaggccuucaacugugggauuucucuguucccagacuggguccaugcagguucauaaaaccaaggggugaaggaaggcaggaaguuggcuccacuuugccugcagcuccuacgagguaagaaguucuggugacggaagcugaacugccuguuaggggcccacgcugcagaggcaggggcaccacugccaguggagcucaagggcucagcaccugcccaauaacacaggauccuggaugcaggaugagcugcguccugauaaacacgcuugaaaguaucauggaaaacucauuaaaacaccaaaugaaauaagcauccuagccaaguacagguaagcaaaauuagcuucauuuuguaauuaauagguaaugcaaagccuauuuuuauuuugauacagggucucagguaacauaggguggccuuacucacaauauaguuaugaauggccugaaucccacugccucagccuucaaaugcugggauuauaggcaugagcuaccacacccacuaacaaagaguauuuuacaauaaagucauuuagcucagauuacccuuaaacucaugggaucuuccugccucaacuuccagagugcuugaauucuaggugugucucucgaugccuggcucaccgcauagaauuuuguuuuuauuuuucauuuuuuguaugaauagcaugugugcuaauaugugcacacaaacacagaccagcccucuccucaaaaccaaccaaacaucaaccaaucacucaagccacauuguuuggcuggaaaucacuuacacuucaagcgcagaaauacggaaagcuuugagaggcaggucaacaguuuuguuuguuaccauccuaggaauucaagccggugccuuacaaaugcuaagccaggacucuuagcacuggcauauccccaggccuugucuuacuuucucuuuugaaacugugucacaaaguuaccuagaugaguguggaacucacucuguagcccaagcagcccugccgugaguaugggggaucggcaggucuggcuucauuuauaggcuaugucagcugcugcuucacucugacugucugcuuccuuggggaugacuuacguccacauugcugauguccagaauucgggaguggaacuggaagcccagagccuuggccugcuggauagggugggccagcuggcuguaggucugcaaugagaggcaauaugcccauguagucagccacugauagggguuggguuacacccagagguauagccacuuuuauaugcccuaacacccaaacuggcagaagccaagagcacaaguccaagcccagaaggaugccacucuuggcuggccagaccugcacacuucucauuauggaaagagccauacguccaaguaggaucaguauuaaucaguguaguggguaauucacagcaucauccgaaguacacucccaggguaagcugggggacucuuggcugaucucuacuguucccagauucaccuccccuggaaucuuggccuggauucaaaugccguuucuaggauuugucccaacccuuugggcugcccuagaacucacagcuuaaguagccucucucacagaacauccaacgugccacccuccacugccccaagagccugggggacauguagccacaaggagagcaguuugagcuuggagucaacuaagacaggaaauggccugaaggcauuucuggacuucagaaauaacagaugcugaacagaagugggaguggcucgaauaagcaguagugcuagguuggggagauggcucagugauuaagcacuuuuugcacaauuaugaugaccugaguucaaaucuccauaauccauguaaaguugggcguauguaaucucagcauuccugaagugagaugggaaguggggacaggagcucuggaaacccuuggccagccagccuggugcacacacaguggugaacaagauacccugucccacacaagauaagagaugaggaucagcacuggagacuguccuauggcuuccacacagcauuguggcacaaacacauuauacacacacaaaggagugccaacccuaccugguggguuucugcuguuuauugcuauagagauaaggguuucauguagcucaagguagccaugaagcaaaaaaugagccuggggcuggagauccggaguucaauucccagcaaccacaugguggcccauaaccaucuauaauaagaucuggugccuucuucuggccugcaggcauacauggaagcagaacacuauauacauaauaaauaaaucuuaaaaaaaacaaaaccaugaaaaaacgaugucucugcugcuucuccuuccccagugccaggaugguagacauggucuccacagcuggugugucagugcuagugagcaaacucguggcuucuggcacaugagguagaagugccaugccccacacccagcgcuuccucaaggcagcauuuuacaaacaccuuacuggaagccaacuacaauuucagcuguguucuggggguaccaggcuauucuuggauagagaagaucagccaggacuucgugguuccaaaggaggagagagggaggaagggaggaaggaggaagaggaagagaacucuccuaaugcccacuggcuuagucaccagugcaggggaguaguuaaaaagagaaccugacagaucuucuccucugcuuuucccaaguuguuugugagcucgggacagaauaggaugagccaaaaaaaggcuccagauugcuucacacaaagaagcuggaagaaaaacaaaacuaaacaaaaaccucacaacccugcuuggagaugcagccagaagccgguagggugagguaagguggccugagcagaccagacgagagcaggaguuccauggagacagggagguugccaggaaagagcagacagcaugugcucccagugaagauacuggcuuccccacagccugcucugaccgugacccugggaucuuaagaugagccaugacucugggaaguagcuagggccuccuuaggacacaauguccuuccucagccgggaagucuacccacauuucuguuuuaaucuuuguuacauuaucuuauuagaggggggaaucugcugggucauuguaaauacuucaguauucacaguuaacucauaaucaccaugaggcaccugccaccaccauguauggggcucagcagugccaggggaaaccuuauacauuccagugagcucuuccaucaccuuccugcaugggacgcccccaaccugcacaucccaggccaucuuucaugggguccugaucauugccacuuaaacugugcagaaaaaaaagacaacuacccuggaaauuauauauuugugucaagaauuauuucugccgggcagugguggcgcacgccuuuaaucucagcacuuaggagucagaggcaggcggauuucugagaucgaggccaaccuggucuacagagugaguuccaggacagccagaacuacacagagaaacccugucucgaaaaccaaagaaucauuucugugauucucuuuaaccaaaauuaguuucuaggugccggggaggugguucaguggguaaacacuuuaugugcaagcauguggagucuggaucucaagaacucacacaaaagacgagggguguggaagcgucgucuguaaauccagugcccaggagguagaagcagggagcucacaggcaagcuggcuagcuaggaaacugcaaaccauagguucagcaaaacucccugccuccauuucagguggagaggaacugucaucagccuuucuucaagccuccagacacacgugccuuuacccacauguaaauaugcauauacucauaugccauacaaagauacauaggccacaugccauccacccacccccauuauuuuacagggcugaagauagaguucaacaguagaaccuagccuucaugcaugcauuaaguagaaccuagccuucaugcaugcauuaaguagaaccuagccuucaugcaugcauuaaguagaaccuagccuucaugcaugcauuaaguagaaccuagccuucaugcaugcauuaagccugaucugugggcaccugugcaucacaugcagaggaaaggacagaugggcgggcugccgggcucugugggaaccaacuauaucagauacgaagaccccucucccaccagacauggggagccagagccaccuaaucaaucaaucuauguaucuaccgacccuccuuccuuccuuccuuccuaucagucaucuacuuauuucucuuugcauugcuggggauggaacccaagacaccauacaugcuagaaaaugccuggcccugagacacacccuagcccuucugacagauuuugguuuuguuuugcuuugcucuuuggcugaagagaaaaaugguacucacagcuucauagcaccagucuuugagaaugucaagcuccccggaaaucauggccuaaacaggagaaggaagacguaagcacgagaagccgagcgagcuuuugcagcaggaugcaagagccuucccuggggacccugaagcccugcccaccagccugggucuggggaagagacggaggcgagguugggugacaagcagcuguggguguccccccuucacuuuguucacauagcucuggucuucugagugcaagacaaggaauggcaaggggggggggcgguccucacaguggaggaguuaguugucuuccagguauaccucucugaggaccaggcuuugcagucagaaaccaggcaggcuauggagugagguagaagacacagccacacaaaccuagguaguuaugcugaggagggugagggaggugcucagagagaagcaguuguggugcugcccuaacgaggcugccugcucuuggugacagcucccuucccaccuccucucagccccacccaaagacugagaaggagcuggggaaguggagagagaggagaggagaaagcacacggagguagaaggccggccgggggcggugggcuuucuccugguaguguaacgaaggccuggcugagcugaguacgauccccagauucugccuuucugagugcugcagagaggcagagauggagaagcagugacgggugugcugcucuguggcuuggacaagaugccuucucuugccuuacaagcaaagaggcaagaacaauugggugcaaaugucagggcugccagagacacuggcuccaggccugcuuggcucauaaauggccagggugcccuaggucugaaugagagucugcugucugcuccuccccaaugccuaaaaaguuggggcuccuagacuuuucccagcaaugucuggaaauggcuucaagaacaccuuaccaggaggcacaauacagagcuucagggacaagagccaugacuauccgaccacaaaaacagagaaacccaaccuggagaaggcaagagaccuccacagcucucacuggagccagcacugagcacaggaaaggguuguguccccuggugagaacccuaaccgucauggcaggauggacggagcuucuauagcuggggaagacuaagagacgucgcucccaggcugcacugugaccugaccggagcuguaccggagguaaauaucuucgagccucgguaacuugacucugagguaaucgcaagucacuccuagggugccauccagaauggggagauggggaggaggugcagcaggccagggccccaccacggcuuauggcgcggcucgcaccucuaggauguuggggaugaugucagucucacacugaugaagaaagugguccuugucaaagguuggguccacucucaggaucuccguuagcaccucugacauuucugucuuugagaaaagaccuccugcaaggagaggagcccucagguuagggcuaagcuuccagaccuggcuguagccagggaagaaagaauagcccugacgccacacucaccuagcaagucagugaccuugucgguuaaggcccgcgacgcccggaugaggacauugucacuuucaucauacuucaucuucaucucaaagaagccuacggauacacacaggaaggagcuagaggagggaccuucugcugagacacccugacuccagucugagaacuuccugcaagacuccucuucuugacaggggucaguucugggccugagccugccuccucgucucagaauggggauuaccuauccaccuaccugcccaaaugcagagcucagcuacagccucucagaagcuguacaaaaauugggacaccaccucugcuaaucccagggcuccugacaucuuaacuguucucuuaucgagcgucuuagugacaggaucuacagguagcuuaguggguagauuuaaggagauuuaacccugucugaucccaucuuuccuucuauaaagugggguucugucuaguguauggcuggccacacucacgguugaauacaacguuguuaucuuugaaguccuuccacugcugguaccacuuggaguccuuguguagcacaaccccuaaugcuucccugugggaaaaggcaggcagcuggagugaccuucagcccugcagaggucagcccaggacgcuacacccuccucugaccacugggaggaugcagaugauggcuccgcucuguauccaggagcuucaacugcagcuuucucucuucucucuuccccucacccaucucucaaaccccagcuucucuggagggagccagaaacccugagagagaaacagacuugcacuggcaccucccaguggaccuugagaacagacaccaguuggccaggaccacucaggagccugucugggaccuacucauuagccucgaacacuuugcuuucuuugaauuuugcuccagcaaacucuguccuuuuccggagccgcucgggccggcgguagggccccgucuguccaagcacgcucucgucaagcuccuucuucacugacucuacacccugcaggggggacagggcugugguugcugagagccaccacuggggggcggucccugcuccugccuggccugagccaggcucacccaccugggagauggcuuugaaggcugccgucuugcccagcuucuccccgcucuuggacacugacuccgcugacugcuuggcuguccuggcggccucuucuacccccuccuugaucuuccggccaaggucacucuuacugacuucaucaagacucuacugagacagaggcagaggggaagaugucgcacaggccuaucgcaagccuugagaauaagaauacugcauucaaccuuuuaaguucagggugcucccuggaauggacaugaguggaauggcaauucccagccacgugaaacauuuacaaaagugagaggauguuuaacccagcacugaguauuaucccucuaggaggagccuacaccuaccuguacccugaauuggguuggagagccccucccauucuauuuucagcccuuguuaaguugcccucgggccuuaccuccuucacugucccuguuaauucuccaagcuucuuuuuuauugcuucacugguacgcacaguuucugauucgauggauuucuaggaucaaagaguuuccuccguuuauuuggauccaacagugaacuugagcaucuaaucaaagguucccaggagcacuggcugcuuaaacucugugaagagcuucaauucuauugucuuagacaggguuuuaugcuaugaagauacaccaugacaacuuuuauaaaggaaaacauuuaacuaggcuggcuuacacuacagaggcuuagcccauuauugucacgguaggaagcaugguagcauacaggcagaguucuacaacuacauccgcagguagcaggaaaauaacugccacaaugggacuagcuugagcaugugagaccucaaagcccacccaccacagugacauauuuccugcaacaacaccuccuaauauugucacucccaaugggguaagcauugaaacacgugagucuaugggggcaaugccuauucaagccaccauauccaugcauguccauuugguagcuaccuccagaauauggaauccccaagcccugagucuuucucugagugggaagagauguuucugccaaccacuacacaccaauaccauuucauuucuauaguucaaucuugggucccuggcuugcuguguucccagauaacucacucuuuacugaugggacaaggccaucuuucaucacacaaguuguauccuccaaauaaauagcuuggaaaugcauagaagggaaaggccuuccugggggaacugguggggaucaacagauucaaaugcagaggacccgggcuaagagcauugcacucugaggcucagcggcucauugguagacaucccaguggccagaacuagauggcuguucaagagacaccagggaguaaucaggcagagagguggcgcagagcauggagugccugcuaugcaaggaugagagccuuccaucuccagaaaccaugugaaauaaagaaggggaggcaagcaugugcuuguuagucugguguugaaggugggugaggugaugcgaggcagcaggacagguggauccuuaaugcucacuaguucaacagaguccccugaacuucagguucagggaaagacccuaccucaaaauaagaagguagcaaccaaucaagaaaggcagauaccugacacuguccacugccuucacauacauaaaugugcacaugugcacacaaaacacacacagaagaagagacaguagcgagcacuaaaggacaccagcauuauggcccauuucuuauuagcauuauggcucugucaggggucccaugauucccaaaaguaauuacuuugguggcucuacugugcuaucuacaaugcuggagguagagccaaccgcacaguuaacuacagugccacagagaaucuugcacggccgggaggcugaagcaaccugcuccugcucugacaccuuugaaucagcgcuaugaccuggcugccuucccccaguggcucugguccagggaacagagaugggacugagauacucacauacuuccuucuggcuuccuggagagcauccgacucuucuagcuucuuggccucaucucggaacuuuuuuauacuuucuuucaucucuuuguuuuuggcuaauucuuguuugauguuaucuagcaagccugacaaaaacccuuuucugcucccagaagaauaagauuuggucuagaaagaauauaaaauugaaaaacaagaaugaacauuuagaggcucgaaagaaaggcacacacaguaacaucugguuaccacugaguguccgauuuccucuccucuguugacagcggaguuuaacagugaacagaugucucuuuuauuauaacagaauuugaauuacaggaacauccacgauacaugacauuguaggcccuauauguucacagguucguaucuauugaugauaucaaccacaaguccaaaauaaaaacuugcaugcauuggcauucauuggcacauuaguuacaauauguaagaaauggaaccaaauuaggugucuaacaacagagaaauggacagagagcauggaguuuuuuuuucagucauaaagaaugaaguuauggcuggauaugguggcacucacuuuuaauuacagcacuugggagguagagcuagguggauuugagugcaaggcuagccuuguuuuucaaagugaguuccaggacagccagaguuauguaaaggaaaaaaaaauguccagggagugggggaaaccacauuauguacuguucuggaaaauagauacaauuggaaauaaccauauuaagucauauuaaguaacuuuaaguuagacucagacaaacccuugugcauuugcucaguuguggguaugagauuuuauagcuacaucaagcaauaugugugugugugugugugugugugugugugugugugugaggugagaaagagagagagaaguacagucaaagcuggggaaacaaaagggacuaauggagggucaagaaaaggaagaguauuagggagaggaauaugcuagaaguuaaucauaugcuugcaugaacauggucuuauauaacuguauagucaaaacugagccagguguaguagcacauaauguaaucccagcacuuaaaagacugagcuccaucccugggaucuacaugguggaaggagcaaacagauucuugcacguuguccucugaccuccacacauguacaucguggauauuccaguaauucaaauucuguuauaauaaaagagacaucuguucacuaaacaugcuccucucuaaauaauaauguuuaaaaaauaagagccaggcagugguggcgcacgccuuuaaucccaguacucaggaggcagaggcaggcggauuucugaguuugagccuagccuggucuacagagugaguuccaggacagccagggcuacacagaaaaacccugucucgaaaaaccaaauuaauuaauuaaauagauaaauaaaaaaaaaauaagcuuaagcaacaacaaugacaaaaaaugaggcccagacacagcgauuuugagauuaaaccugguucggaucucagugaguuugaggccagcuuggucuacaucacagguuucaggcuacauagcaagacauugucucaaaaucaaaaaacccaaaacugaacacauggaagauugucugucugucugucugucugucugucucucucucucuuucuuucuuuuucgagacaggguuucucuguguagcccuggcuguccuggaacucacuuuguagaccaggcuggccucgaacucagucuuucuuucuuuuuuugucaagauuuauuuuuacuauuuuaaucgugugcucagagggguggauauacacacaugcgugcgcaugagcacacacgcgcgcgcacacacacacacacacacacacacacacacacacacacacgaaugcaugaaguuacugagcucaaagguguuagacuacccuggaacugggguuaaaguuaccugaugugggugcugggaacugaacucagguccucaaaagagcaauauguguccuuaaccacugagccaucucuccagcccuguuuuauuuguuauucccuaaaauuacaguguagcaacuacugacacaguauuuauacugccucagaggugcuucuagugcaguugcuuguaauuguuaaccugaaucacuaggaaaaaggagucucagacuguccagaccagacuggccuguugggagaauaucuugauuaauaaucauaugaaaaggccaaaaugugugugagauucugaaaauggcaaaacucaaagacaguaaaaauaccgauggcugucaagggucuaaaagaagauggaugaacaagcagagcccagacgaucacugaagacagagacuguuugauaaugaugauuaugggggcuggugagauggcucaguggguaagagcaccagacugcucuucugaagguccgaaguucaaaucccagcaaccacaugguggcucacaaccauccguaaugagaucugaugcccucuucuggagggucugaagacagcuacaguguacuuacauauaaucaauaaauaaaucuuuaaaaaaaaaaaaaaagaauuugggagauaaugaugauuauguaagugccauggcuuguaugaaaacuugagaagcgggcuacaggaauugaaauccugaggcuuguauagcaaguacuuugacccacacauucaucuuacuauuuauguggaggagcuuguuuugagauagggucugggaucuggucuugaacuugcuguguagcugaacuucugauauucuugccccacuuuccaagugcuagaggucacagauacacaccaugaugcuuagucagugggacuguucuguguucucucuacaauagggacaaauccuuaucuaccuuagacucucacagaauguuuaacacagcaaugaaccugaauguagccagauucagacagcaacaguguauccacucugguucaacuguaacaucgucauccacaaugacuaaagggaacccgugaacaggaaaggggagaaaguggccagggagacuguacuuuuugugaaauuuuuauuaauuuuguuuguucuuuaggggaauguugagauaggaucucauuaugaagcauuggcuacgcuggaacucucuauguagaguagaccaggguagcuuagaacuuagaacuccaccugagugcaaggauuaaaaacaugcaccauggugccuagucuaauacauuuauuauguacaggaucucauguagccuaacuuagccucuaacuugcuaaguagcuaaagaugaccaugagucccugauccucuugccucuacuuucagaguacuggaaugaaaacuguggaccacuaugucuaguauauggaaccuaaggcuuuaugaacgcugggaaagcacucuagcaauugagccacaucuccaccccuuuuaauuuuccugugaagcuaaaacugcucuaaaagauagucugucaaaaguaagauaccaaagcaaggccacaaacucacacucacaaacauucacacacucacgaaacuguaggugaggcacaccuaagacugcagcacuuaggaaauggaagcaagaggaccagggcauccucagcuacacaggugcuggccugaguuauaccaacccuuaucuuuacaaugaagaaaauggucagugggaguggccacguguggcugaugaauggaaggcugguuacaaugccugaaggccaacugccucccuauguuuuaucaaucuacaacggaaagcagcagaggggaaggaaccacggggaacugccccacuccuaaaauggcuguucgaagaacaggaucaggaagaagcugaggagaggcucuggccagcaugcagacuugaggacucagucacugacacacuuacggaaguguggucgaagaauagugaccaaaacacaaugagacccaagguaugaugaagugacucuauacccauauuuaaauacccaugcuuagugagacacucacagacagaggccagagagggagaauguaaucugaugcaggauacaggaggccuuuucuagccaucacagcaaacuguauguguaaaagugccuuguugcugacaaaacaggagguagagcaagcauaucccaggacauccagaaacaaggccugcugcucucuguaauugugaauacccgcagcacaccacacucccugaagugacggugcuggcaugccccgcccccacccuuuuuucccagaccucuguugggucugcuuauugguauccugggucacucaccagugucagcucucuuccuggccggcuuaucugguagcuugaaccaugggguagguuguggcuggagagaaauuggauuccgcugccuaggcaccucuaauugguuaagaaaaagagaaagagccauucagaaaagaggguaacucugagggucaccaugagucauuugcugaccuuaacuucaugccuguuguaagcuaauaugcaaucuuuguaaaaauccgagaagccacuguaauuagguagaaagagaauauguugcaucagcaccuccaggaccuagucccacaccugaaacuggggagaacguggguagguaccaggaaaccacaagagcaguauauuugugacaguguaacccaaucuuuacugaagcccacuccacuucugccuaucuccaacaacuacagaggagaacuuucaaagacaaaccaacaacuucuuggugcagggaaaacuauggaauagaccugucaugcccuggucaaagguucuaaauacagagccccucugggcagagaauccaguaaccucaugagaaagacccuuuuugauccuaccaaaugaugaacucguaguugugugcaguugaguccagcacagguccacugaaacacaaugaccuaacagaagcacuuuucauuuuacaaacuuuucuucuccacuuuuuccuagcuauguaaucacugguuaacaucccaaacucacauagguugagaagugaagaggaucaggcuguaucauuuaucacugcacugacugccaggguugacuugaaugaucuagcuacuuggugucauuuucccccuuccuuccuuccuuccuuccuuccagcuccacguguguucuucucaaaguugcacauuuagucaaagaggaugaucuuucuuuggucaagcauauaccugcucuucccagguagaaccuccaaacaagcucucaagguccaaaugcauaccaguauggcuauaguuacugaaguuugcucuugggauaacuuguuuuacauuucccuuccuccuaauaauuggcgauagaaucauacugagcugggcuuuggaccagaucagcaaccuacuagcuccgcgucugugagcagauugcuuaaucuaaguuucgcguuccuuaaccuaaugagacuggguuaaacaauagcaauauaaagaacuauauuuauauucugaguguguauuaacaggacauugaccuaagucaagaguucuaguucuuauccagagcaagaacuacuuccugcacuuucacgcugaucauuagaaguggaauuuaggaaacacucuccgcugaggacuugacauucaaacgggaacagugaaugucacuuuaaagagcgagagaaaaaaccaaacuuucaucaagcuguuuucucaaugggguaucaucuccccagacaccagggacucccucgugcacgagggaacagaccgacaggugagaggugaccaguuccaggguagcuucgagcauugccgcugaauucggggaagagggggugggggaucaguucccgccccagggccuuccugcuacuuucccaagccucggcugacccaaugaccgaacccuaacccaaccguggaacccauaagaaaaaacgagagcgauccgggacugaagagaaggagaucuuaaaagccgagcguccagaccccuuauuucugcccuaccagccccgcacgucugcucacccgcggacagcggcaccagccaccccgcagagcugccgccgccauguuggaagagcccgugugaccuuccug

SEQ ID NO: 4272 - RNA, 1778 nt, Mus musculus
gagucaggaauagcuucugggaaccugcccccaguuaauucugauugguaaauauggaugccagcagccaguagcuggggaggagugagaagcaggauuuagaguuccugagcuugagauccugaggaagcaggaggaaggaggagagcggccaucccuuaggugaggugcagcagugggaggagagggagccacuaugcuuagcagaguguacaggagaggagagaggccauuaaagaagaaugugcaggagggagaaucagagcagccauguaaaaaggccaagagaacucagucaagagggcuguucaauugggucaagagcagcaaagauugaacauagaaaugaguaaguuguaacuuggaguuaucaaugggagguagauacuaacagcaugaagguuagacaguugacaggcuauucaaaguauauuaaauauaaaggcuguguguguuucuuucauccaggaacauaaauggucuacggugguaaggaagcaugugccaggauuuauuuaauuauuaauacuacagagguucccacuccccagauaauacuagcuugugucaaguuagcaaaacacuagcuagcacagucucauuccaguaucagacuagaaaagcacagggguaguggguacaaguuuguuaaagucugggcuucugauacuucuaauagcuucuuuugggaguugggaagaggcugagaaagcuggaacuauguagccuaggcucaccucaaacucacuacagucucagccucccaagugcuuaggauacagacacacaccuccauccccugcugaaaauacagucucaguuguguucagaaauguauacuuggacaaaggcauccagggaugugucaauggggaauucagauuggaagagagacuggcauagugguauacccuuguaaaucccagaacuugaaagaaagguaggaggauuuagacuuaaaauuauuuauuuucaaagcuaguucaaggcuaguguagugaccagaaugagaauggcucccauagauucauauguuuauuuguacuuaaauauuucauuggccccauguggguucugggacucaaacucaggauguccugcacagugccuuuaccuucugagacaccuucuagcccaaaauguguuaucugaagcaauuaguaacaacuuuaguaaccacuuguuauaccaacaaggaaacuuaugcuuuacaaguggacuccaagacuuccuuuuuuuuuuuuuuuuuuugguuuuucaagacaggguguuucuguguagcccuggcuguccuggagcucacucuguagaccaggcuggccucgaaaucagaaauccgccugccucugacucccgagugcugggauuaaaggcacgggucaccacugcucagcucuacuucauuucaauaagccaaauguguaggacucauggucuucuaugguaccucucugguuauuacaauaaucucauaaggugguuaauauuauuauucccauuaaacuuuuaaaauuagggcuccagagauuguucagugguuaagagcaauuguuccucuuccagaggacaaaaguuucauucccagaacccacaaagcagcucacaauuugcaauaucaguccuacgggauucugacacuuucuucugaccucuguaagcaucaggcauacuaaugguguacauacauacaugugggcaaaacauguauguaaaucuaaaaaaacauuuagaauaacuuaguauuuugucugugaguggaaaugagcugacaauuugca

SEQ ID NO: 4273 - RNA, 34815 nt, Mus musculus
cgggacuuccugucggcgucguccgcgguggaccaaggcgcccaguggagucgcgaaguggcuggcgauggccgcggagagggugaguuggagccuggcccgcaguggacgccgucuggacgucgaggccaaagaguggcgcucuuuauagaacgcacgucgugugauccucacaaugcgggcugugcagccgcuuacguccagagaaagcaaguuggucaucgggagcccucgcuaggaggacaggauccccgauucgaaucccggcccggacauuuccggucugccugcaguugagcaccggcugacgucacugagccgggccucaguuuuguuaucuggugaagcggguuaaaggauguggucagcauggucagccucugggaaucuaaaguuaaaauuucuugguuuuaagauuuuucuuaguguguaugcauggguguucagccugcauguauguuaacccugugcaccauaugcguguagugcagaugggagucagagagaaggucggauccuccgggggacuauuguuaacugcguuugggagccgacuacugaacccaugucuucuguaaaagcagccagugaucuuaauugcugagccaucuuuccagccccacuuccuucgaaauuuaaaaugccuacuaugugccaggcagucgggcagugaccagaaaaacaacugccugugccuuuuggaggcugcuguucuggacuagugcuaucagaaacguauaugccacccuguuugauugaaaacuucucuauugucucuaccucuguccaccguuuuuuagcguguuuguuuucuuuuagucgggaucuuccuaaguaguccuggcuuggaacuuauaaaucacgcugaccauugccucauagagaucugccugccucuguuuccugauugcugggguuuagggugauguuucauaugauccagguuggccuuaaacuuucuguguaacgaaggaugucagugaaaugauccuuuugcuuucaucucccaaguucuaggauuacaggccugcaacacagccgcugcguguagguaaccuuuuaaaaguaguucuacaggauuugaaaaaaaguuauauucaaaauuuuuauauuauguauguauuuguuuguauguauguacguguuuuuaaaggaugguguuuguguauauguguauaauauguauauauuauaauaugcauguguuugugugaccaucuaugugagagucaaaggguuacuuggaggcgucaguucuuccgucauaagagauauggggguugaacucagguuuacacucagcaaccaaugucuguucagcugagucaucuuuauagccugcgauguccuuuguaaaaaaaaaaauauuuauucacuuaacaucccaauugcugcccccacuccugguccccuucuccuucuccucugagaggguggagccccucaccuuggcauaucaagucucuacagggagaggcacaacuucucucuaaggcagacaaggcagccccguuaggggagcauauuccgcuugggacauccuucaucagcucuguacaguaaaacuuuaaagaagccacaaaauugucagcuauauggcaacuuaaauuuuaaaauuauuaacuuaugggccaagggcguagcuuagugguaaaguacuuuccuagcacauccaaggagguucacaaaagaagaggaaagggaaaagaaggacauggauauaguuuggugguugagugucuucaugacauacacaaagagauaaaguagaagggucaaaaguucauagacaggauggaaagauggcucagcauuuaugauuaguguuacagagaaccaugauucaauucccaucaacccaucuauugacucacaacuaacuuuaauugcaguaccaagggauauaacacccucuucuguccuccaggggcacugcacucauguauacaaagccacacucagacauacauauacauaugugacucacaaauaaaaauacaaucuucccuuuaaaaagaaguucauucuugacuauguagcaaauucaagaccagccucagcuacaugugacccuuuuuuuuuaaaguaaguuauuaguugaaaagguaaaaauaacaggucugcaagaugguugagcaggaugaggcaccaccugacugccaucuccaggacccucaugcuagaaagagagaacugacuccugcaaguugcccugccuuguuuagccucuuuaguagaagauguggcccuuacuuucauauccacacauuggcacacacacuguuuguuuguuuauuuugugugaaacccagauauuuuuaguagcuuuacuuaaccauauuucaacauaugaucaaaguuaaaaguuaugagaucuuuugccaggaggugguggugcaggccucuaaucucagcacccaggagguagaggcagguuugaggucagccuggucaacagagcaaggcuauccagagaaacccuauaugaaacaaaaaguuaugagaucuuuuauauuuuguguuuuuccucuauuuguuuuugaaaucuagugcacauuugcauaucaaguuggaccuguugcauuucauggauucagcaguccuacguugccacuggaccaugaggaggcagaaggaaaaucaaguggguuccaucugcagugguuuuuaaaagggcaagaagaaaaguaagcuggggaaaggguauauggaaggaagggauuguaguucagaggguaagccaggaaggugggcucuaaagauggagugugaacaggaaucagaggaguugggaagaguuacagucuuuguuguuuagcauugcccuguagcucaugcagaaauuaugggucuggggccuaggagauagcuuaguggguaagagguuuacuaugcaagcgugaggaccugaguccagagcccaguacacacauaaaaagccagguauggacugugugucuguaaucacaaugcugugggaauagugaugggaagauggaugggucuugcuggcugucaaucuagcucaagguucaagggagacucugucucaaaggaacaaggcagacagugauagagagcaggauauccguuguggggcaguuggucguggcaagaagcuuggugagguugaguggguucagagaccccagcucucaccugagcacaguagguguuucccugcucccuaccagacuccuggccugaaacacaugaccacacgccacacauagggaugugacaaccacguagcacaaaacaguucuccaugccagugaggugucuagaugggcccuggggauuuagcuaagcuuuucuucccagacauuccuuccugcaaaagguauuuaaucucugguccacccugaggagguuguaugcacccauuuuccaugaugaacagugacugaauggucugaauaagcauggacugucucccaucaagaacugccacgggaagcauggagcgagccuucaucugcagagcuuccaagucuaagucucuugcagaaggccccuccuugcuagccggaguaguugucuguguuguccccccugguccccucguccuggucuugucacccucagccauugggccccggacuacuccuccuugugauuuccagcggcauuugaauguccaggagucagggaagcccaacuucagccucagccugcauuuuucuuacucaggcuaaggcccccagccuggacugcauucauucuuucucucucucucucucucucucucucucucucucucucucucucucucugucacacacacauccagaguggugcuuccugaaagcccaucaccaaaugguggcauaggguaagauguagucuagcaucuuccauuuugccagcuuaagugguguuuagcggcgagauggaccaugggaccacaucuggcauauauaccaugggacauacucagcugacacauaccccagcuggcaacccacaagauccacaucagcacucugaauuaaacagacugugaguaaccccuggcgcuaggccaaaagacucagaccuucccacucuaaagacagauacauccucuucccacuuuuguuugugggcggagcuacugcacugacccccaucuaaauccagacaauccaagggaccauugauaaaaacuccgaggcagagcuggcuccagagccacaguggcuacuccaacuuggccaagaacacacaauccauugccuuccucugaccucuguaugugugcauacauucaggcauacaguauacuugcacgcaaagaugaaugugucccuuaacaacacuucccaauucaaacuugauguuggguacuuaacaguucacuaaaggucugaauuuuuuauuauaguuuuguguauguaggugugcuuguguggauggguauguguauauucaugcaugcacacauguggucacaugcauguagaggccagagaucccucuacuaucauucuuuaugugcugucuguccuguuuuucugagacaaagugucuuuauugacuuaaaaauuuguuaauuagacuaggucuggccagggagccccaggguucuaccuuugucuuaggguuucuauugcugugaagagauaccuuacacaauucuuaaaaaggaaaacauuuaacuggagcuggcuuauaauucagagguuuaauccauugucaucuuggugggaaacaugguggcaggcagguggacaugaugcugaagagauagcugagacuuaguucuacaucuagaucuacagggaacagaaagaacaguggaccuggcuccaggauuuuagaccuaaaagcccucuccagugacacacuuccuccaacaaagccacaccuacucccaacaaggccacaccuccuaacagugccacucccuauggggccaauucaucuaaacccucacauuucacuccuugaccauagagucugauuuaucuugugggccuggcucuuuaaaggauccccaguggugauccuuuaaagauggauccuuuaaagugcagccuggcaguggugucgcacaacuuuaaucccagcacuugggaggcagaggcagaugaauuucugaguucgaggccagccuggucuacagagugaguuuuaggacagccagggcuauacagagaaacccugucucaaaaaaaccaaaaaagaaaaaaaaaaaaggaucccaguugcuagucaacuggcccuuuaagaauucuuagcuguaagaacugcuugaccccauaaccuuuaguauugguugccucuugaguuucugggaacaggauaggauaucaaaaagucagcagaggcuaagagggauugggggcuagcaggcugaggagaaggcaguugauacagaagaagaaaaagucaagugaggacacccugagaugagcaggcugauagcuaauagguuagagaacaguuguuauaauauggaacuguuaguauuaggaaaagugggagaaggggcuguuuaagcagacuguuggggaacugaggagaugguugggagaaacauuugaagagguugggcuggaaacugggaggaacgguuuggaaagaaauuagauucagauacauacacacacacacacacaccaauccuuuuuucucuccuaucuaguguuagagggugaaauggggguggggauaaagagugggagaaagaaaaagcaaagaccacaaaauagcaaaguccagcuguaaaccacuauagacuuguagccauaccauaauguaaaauguacuuaguucaacuucaaaaguacccauuuucuguaacagucucaacccuguuuagaaauccaaaguucagcgucucuucugagacucaugguaaucucuuaacuguaaucccuguaaagucaaaauggaaaacaaacaaaacacaaaauaaaaccaggucacauacuuaaaacauacagugguuccaaaagggagggaagggagcauaaugcauaauggaccggugcgagaccaaaaaccaguuagugcaaacuaaauucugcaucuccaugucugaugucaaaaugcucuucggaucuccagcccauucaguuuugcugaacacucuucuuggguugauucuacucccuguuaacagcuuuccuuggcagguauccuacaguucuggcguccccaacaucuuggggucuccaaggcaauacagccuuaaccuucacaguuucacacaauggccucucugggccuccauucagggacaccccugacacaagccuggccucagcagcuuuccuugguuucggagggagauucuguaacccuuuccuuaucugucuuguauccuugccucuaaaaccagggccauguggcugaagcuuccugguucugcuguuugcuugggcuggugggcagagguucccuuguucaaucacaucugcauaagcuuuaugguuuugaugguuuccuuugcuacuuaagcuuuucuuuaauuacuuuucacaaguuggaagcuuagcuggauagaucuuucccuagacucugcuuacuacuccuuuuauuucauuuaaucuguuuauuuccuugaacucgggccuuagcuccauuauacuuccuagugcccccuuucuccucaagguguauauuuuguauaguuuuucuucuucagcuugcucuuuuauguaugucuaugaauuauaugcuugucugcuaccaauggagacuguaagaagguauggggccccugguaguuagggagagcugugagcuacuauguaggugcuaggaauuaaacuuggguccucaggaaaacaaauagugcucuucguaaacagccauuuuuuucagccaccccucccuuuuugaaauggugucauguaacccaagcuggcaucagacuucauauguagcuaaggaugaccuuggacucguacuccugcuucuaccuccccagaaaugggauuacaaguguguaccaccgugccuguaguugguacacuuuuauuuuuuaccauguaggaucaaacucagauugucucacuuggcacaguucaccucuaagccaucucauuggccauagacuauuuauauuuucagaaauauaacaaaaaugauuuuuuauuaauauccuacuuggguuuuuuguuuauuuugagaugaucuuacucuuuagcccugacggucuggaacucacuagccuuaaacucugccuugagcaagauaugccugccuuuguuuccuaagugcugggauuagagguguuucccaccucuucucacuacuguaguuguuaccagaccugguaguacugauuuguauucccugcuauucuugaagcucagaguaauaguuuauccaucuguaaucuuauuauuugggaggcugaaauaugauuaucacaaguuuaagacuagccugggcuacauaucaagucuaggauagcaauaguaauaauuuuuuaaaauagagcuagggacaucaaagguaguggggcugccuaguauguguaaggccugagauucaguccuagguacugagaaggggagggggaaauagcucagucaguaaaaugccaggugcacaggcuugaagaucuagcauugucuuacacugacauaaaagcugagcccugugccacaccuuuuaaacucagcacaggugggauggagauagacagaucccuagagcuuauugcuuagcuagccuggcugaauugaugagcucuaagcucagagauccugucucaaaaauaagauuuagagccagugagacagcuuagaugcauacauacacccacauacauguuuacaugcccacaugaacacaucauuaccacugcacacacauacacauacaaacaguaauaauuuauuguaauuaauaggccaauauugaugacuuguuuuugauuauucagaguauuuuucucuaauaccuguuuucucuuccagggucccacaaagauuacaacauacaaauuaauuuuucugucuaguugcuucuuggcggugacagaaucacagcuuccauauuugugauggccuuuacacuuuuaagagguacaggucaggcauuugauccuuugaaacuagaucuuuguagcuuagagccaucuuguugucuagaaaaacaaacaaacaaacagguugucuuagaacucacaauccucuugggugcuggaauuauagguauaccucacugcaccugcuggugaguuauuuuggaagguguuucuuuguuagaauagucauaagauuaugguaauggguuauugaccgaaagauaaaaucgccaaucaguuuuccacccaucauacuguguguguuugugaauguggaaggcaaagguugacaucuguugucuuccucaaucauuauccaucuuuuuuuuucccccauuuuauuuuuugagacagagucuccuauugaacauggagcugacugguagacuaggcuggcuggcccaugagcgucagggauccuccaaugagggucuguuuccucagugccaagacuauaaguaugcaucacugugcccaguuuuuuauguggguguuggggaucugaacucagguccucaugcuugcacuagaagcauuuuacugacugggucaucuucccagugcccucauauguuaagguacauccaucaacauuauuugguugguugguuuugcuagagccuucagcaugcuguuauuagucagaguucccuagaguagcagaaugaaucuuuuucuguauauauaaaauggggaguuauuagauucacaggcuguguuauaacuaauucaacaauggcaggcuaugaauggaaaguuaagaaucuagaaauugcucaguccaugaggcuagaugucucaguugaucuucagaagauguugaaaucccaaagaaauaggcucaagugccagugaaguagugcaugcuagcuagcaaggcaagagcaagccgacauagagcagaaccuuccaugaccuuauauaggcuuccagcagguguggcucaaaugaaaggugugucuuccugucucaaaggucaagacuagaaguagauguacuucaaaccaagcaaaaagucucucacagguaugcccuccauuucuggauuauaguuuauuccagauguagaaccaagaauaguuaucauagcaaccauuuucuggccuccacaaauuguacaugcauacacagaaacaugcacauacauaauuuuuaaaaauaauaauuaaaauaaaaacaaugggaagagccaguccacugugggugguaccaaucacuaggcagagguccugaggaaauugaaccaugcucaaguagucaaguaugcaugcauuuuuuacuuuguguacuucauuguagauauggcaaucagcuguaugaaguuucugcuuucacuucacaaugaucaacuauaguacauuuucugcuuuuauuuuaacugaauacuacuucauuuuguuguucaaacgguucugauuuuggccauuagaauuucuuucuguugauuguuaugguccuugauuauuaucaccaaacaugucaagguuccuggacacuucuaacucuagcauugcaagauccugcaggauuguauuauauacuucuuaccucaguccugaaauaaaccauuucuccaagaagucuuggauguuuguguaagagaaugaugaugucaccaauuaagaugaagguuaaugggaugguuuagugugcggaggacuuacugcccaagucugaugaccugaauuagguuccugggagccacauggaguuggaaggagagaauugaccucccaaacuugccuucugacaucuacagguaucccauguuaugugugacugccugcccucgcagaccagauauuauaugugcacauauauaugcacaauauuuuuccccuuuuauacagaggcucacuauauaauccuggccggccuagaaauuguuauauagaacagguuggacuagaacuaucaaaaaucuacacgccucugccuuucugugugcugggauuaaauguguacauuaccacgcucaaucacauuuuuuuuuuuaaguuuuucuuucuuucuuucuuucuuucuuucuuucuuucuuucuuucuuucuuucuuuauuauauguaaguacauuguagcugucuucagacacuccagaagagggagucagaucucguuacagaugguugugagccaccaugugguugcugggauuugaacucuggaccuucggaagagcagucgggugcucuuacccacugagccaucucuccagcccucaaucacauuuuuuaauuaaaaacuugagaugugcuaugagcuccaagagcauguacuacuaacuuauauuguuucuuuuauaccaauacuugguuguuguuuugauccucaggcuggaaccuagggcuuugugacugcuagacaaguauucauaguaccagcccucgucacagcucuguuaauuguccccauuauaccagguuuagucacucaacucuggagauauagcagugagcauacaaggugugucaucuagcucaaugucagcccuuagagacaugagggcagcuccaacauuugcuuuauggccuuggaaaauuaauuuccccuuuuuaaaaugggggggagggaaugauggcaauacuuccugaaacucuaugagaacuagaaacccuggcagagcuugagcaaguguuuaucacauuuuucuccgucauucuagggaaucagucccaaagccccacuguugauuaacuguuuccuccagauugaaauauuuucuucuguacagaaaggggaagcucauaaaacuuagaaaguaaaggagacguccaaguuucaggaagaguuugcaaccuagaagauucacagggagcuucacugggcuacagaaacaguaaccauuacuaugaagagaaaggaaaguguccugugguugaacugaacugucuucgaggccguuagaguuccaggccugcaguuucuaugagucguccugugugaggugagcuuuucagugacuuggaugucuccgagccaucuagcuccaguaaguaaccuaagugcacugccugguucacacuagacuuggguagaaugacuucugcacacuggcaccccaucuagaaugaauagacaagucguccuucuuggcucaggaagucacaaacaccuguuuauauuggacaagugcucuacugccaugcuguacucccaccuccuuguuuucucuuuagguuuucugguuagugucagcccuugaguaagaaaaagcagacagucaugucuggcccaggauguucuugcuguaccuucauaucccaguuccuucagcacaagcugcacugcucauaagguuaggagauggcugaggacuuuuuuuuuuuuuugguuuuucgagacaggguuucucuguguagcucuggcuguccuggaacuuacucuguagaccaggcuggccucgaacucagaaauccgccugccucugccucccgagugcuaggauuaaaggcauucgccaccacgccuggcaggauuuuuuuuuuuuuuugaaagauuuguaugcaugugucucugaaugucugcccacaucuguggccacgaggagaucagaagaggguaucagguuucucccacucuaccuauggucuuucccugaaccugggacuuuuguuuguuuuucaguuggacagagucuagcaagguguaguggucucugucucugccucccuuagaaccggguuguagaguguauugguuuccagcuuguuauauggguguuggauccucaugauuaugcaacacguacuuuaacuacacaucaucuccagcccagagggguuuuguuuguugcuugcuuuguuuuuuugagacaagaucucaugcuugaacuugcuaaguagccaaggaugccauugaacucagaguuggggucccuggugcugagaugacaggcacauaccacugugcuuggccagagaugacuuaagucuugaugccuccuuugagaauaucuuugcucucacauauacuuuucauguuggggcgcaucuggcucagucaaagcauaggggaugcuuuuguauaacucucuccuccagauuaaagcauucccuccgggaagaauaaggaagguuccuaaaacucaggaaguaaauaagacuuaaaagcugcacaaggcuucucaccugagguuauagaagaaauaacaguuguacauauagggacucaggguuccaucuguagcaccaccaccaccagucaugagggagagccuaccaggcagagaagcaggaugcuugggacccagacagacaaaauggauaccaggggcugcagauagggcucagugguuacaacacuugcuggacaguuguuaagaacagaguuugagucccuaagacccauauaaaugccagcuggauggguugcaguacccuguaauuucagccuugggagguggagacagaaucagcagagcaugcuaauggggucugguuugauugaagcucugccuaugguucccaacaucaacaugggccuccacaugcauguacacauugcaccugcacaugugugagcucauacaugcaaacaugcauacauauacacauacauacauacauacauauaugaaggaaaaaaagggggaggguacgccuauucuggaagauuauucuucauaaggaauucagguagugaguaaagagaauggugaagacacugaagaggugauggucaccuguucugaagaaucacagagaagaagcuggagaaguuacaucaugauucuaaggacaggguaagacuaagcuuuacauucauuuguuuguuuuuuaggugagcaguggguggugguaucacaugcuuuuaaucuuagcaguuaggagucagaggcagacagaucucugagucugaggcuagccuggucuacagagcuacuuucaggauaacuaggacuacgcaaggaaacugucuuaaaaggguguauauguguguaguugucugaggccagaagaggguaaauaaguacuggagcugggguuauaagugguugggaggcaccuaaugugggugcugggcuugugcaagaacaucacgcccucuuaagcuaucucaucaaacccagguccuacguuuuuguaaaucaugugguugcccuagcaacaggaaacaugcccacauguguuuucugucaacuccuuugaagcaagcuguggacauguguuuauuaguucucuguuacggacagagcgccugagaugagcaccuuagguuagggaagguuuaccuuggcuucugggcuucagucuguggucccuuggcucccuugcuucuggccucugaugggagagcggaagaugguggugggaaacauccaguggaacacagcugcccaucucauggcagcuaggagugggagaggcugaggacaggagagcagguaccacauauccaccccuagugaccugcuuccuccaacaagguccucccuccuaucagcccugucaguuuguaauggcucauucagaugugaaccuaucaauggauagguuaucaauggauaggaacuugaggagccacugaugaagucagagucuccacaguccaucuugcccaguccaucucucaacauuacugcauagggaaacuuugaagauagggacuuuggggggacuguggagauggcucaguuugaaaagugcauccuauacaagcaugacacugcuuggauuaccaguauccauuaaauaaaaaaauaaaauaaaauaaaaagugaaaaaaacucaaggcuggguauguugaccugugcuuaugaucucaguguucagaagguagagguaugaugguugcugaaaguuccaggcuguccauggguucauggugagaccucauguucaaaggguaagaacaaacaaaacaacccaggagcagcagccagguguugugaaccuaagucaguacugagaagacuggaaugucuccauggcuugguguccaagcaggcuagccaaagagugaaaagcccuuucuuucacacacaccaaacaaacaaaaauggcuuuuaacacagacacuugggagguacaagcaaauggaauucugaguucaaugucagucaaggauacacagugagacuaucucaaaaaccaaaaaacaagagugauugaggaagaugcccaguguugaguuguagccuccacauacaugguacuggaauauaagaagucuugcagcuggguaaagagugauugggggaaaugcccaauguuggccuguagcuuccacauacaugugcacacauauacacacauagugcugucauguggggagauaggaaaacuugcagcuggguauaagguagccaaccagaaagaggaaggaaagcucuaggaaaaacaagacagagcuggcuccacugcucuccuaggcaacacaguagggcuauccuugauggugggagcuagccccaaggguauaggcagggaagggcuaguccuacccuuagacugcuauaggguggcuugggagaaagagaggcucccucagccccuuaccucucacugccuuugagauagcccuguaccucaccugggcagcacaguagagcugacccuggugguaaagguguugguaggcuggcccaaagaugagaacaggaaagcugguccuaccuaccccuugcuggcuuggcacugggugaacuagccagggcacugcuggagagcucacccugguaguguggguacaagaaagcugcugacccacgcagcuaccucccaggccuacaccaucuaugaucugcugaugcuagugaaaggguugguccuguagauccaaaguagcaggcucuucauagcacagagcaacaacagaauaucugggaggagugccugugacgauccaguauugacagacaguguagcagaaaccagaggucucaguacagaccaauggcucauugcaauaaacauuugcaaauaaagauguauggauaaaaggguauacuauggaacacaguuuagcuuccauggcaagaauuuuuucuuuuuuauucuaauuuuauaugggggaggguuugcaaggguggauauggagggguggggagaugagugggauugggguguaugaugugaaaaucauaaaaaaauuaaguaaaacaagcaaaauaacaagccaguccuuugcugggucccauguagcaccuccugcaccguacccccaucuccaccucucuaggaacacacaaggcacguuugcucuuuuaauaagcucagcagcuguuaguaauuacaacuucacuuguaaccaucuaauugcuacagacugaauuguggguaugcgcagcuucuaagaaaccaucuuccuauuccugaaaagagaccuuagagugucuuagugguggguuaaaaaaaaaaaaaaaaaaggaagagaaaugcuaggcccagcccugucaguccaggagcuagaggcagcuguuguugauauuuguuggcuuaauccacccuccauucagagaugauaugcuucugcuuuuuaaaaauuaaauuuuauguguaugugugucauaaugcauguguugaagucaaaggguaacuuagaggagucaguucuaccauguguccuucugacaaacugggaucaucagguuuggcaguaagaacauuaauccugcauuugcuuuuguuguuguuauuauuaaauucguucacuuuacauuccaauaucagccccgacaaguaccccuucacaaagguccucccuccccauuccacucucccuuucuccuuucaaaggaggagucucuucuagguguugguacccccauacacacacgcaucagguugcugcagggcaggcaacagacucagggacacacuuccaguuggugggggacccacaugaagacuaagcugcuuauaugcuacauaugugcaguggggcuagguucaguccaugcucacucuuugguuggugauucaggcucugggaaaccccaaguguccagguuaguucauucugcugguguuccucuggauucccuguccucuugggguccagucugccaauccccccccaauuuucccauaaaauuccccuagcucuucuaauauuugacugugggucucugcaucucuuuccauuggcugcuaguuggagccucuuagaugacaguuaaaugcuagguuccugucugcaaacauaacuagaacaagcagaaagucuauauuuaaaaccagaugcaggaaagagggucaagacuucaagaucauaaccaccuucaggaggauucaacaccuuuggccucuaugcgugccugcacauaacuugucccuauaauacacauaauuauaaauaaugaaauuuuaaaagggaagaaauaacucugaggguauguguucuaucccagagcccauauaaagagccaggaaaggagguggguacuggagagacagagauagguagauagauccuuagaguacaguggcuagccaaccuaaccuauucagugagccccagaucuugugauugacagugaaaagguauucuguguuccuaagaggagaggacaagccacgccauccaggaccccucaagagagggaggaagggagagggaagcacgggcacgagcagugugauagauuacauacaacagagcacauuagaaacgauaagugggcuugggcuugccuagcucaaaguuuuagaggacuuuggggcauaggguaugccccaaguugucugguaaaugacucuggaauaauuaagagaaguagagaagagguagaaauguugcacagugguaaauacuuagcuagcauauuugaggcucugggcaccauccccaacacugaaaacaaaacugaagauuaaaaaaagaucaucgcaaagcuggucuguguacaccuauuaaauaccagcuacucaaaggcugaagcacaaggauaguuaaaggcuaguguggucguuugaauaugcuuggccuagggaguggcacuauuaggagauguggcccuauugaaggagguaugucacugugaggguggucucugagaccacccuccuagcuccucccaacugccugaggacagucugccccuggauuccuuugcaugaagauguagaacucuugguuccuccagugucgugccugccugugcuuccugccuugauguaccauauggacugaaccucugaaaguguaagccagccccaauuaaauguuguccuuuauaagaguugccuuggucauugugucuguucacagcacccaaacuaagacagcaagccugucuguccaacagugagauuuuuuuucuauguaucuacuuauuuacugcuuuguuuauuuagagaucgggucucauguggcacagaauggccucaaaccuguagaugaucgugaguuccugauccuccuguuucuacuucuuaagugcuaauaggaaugagauucuuccugugugugugugugugugugugugugugugugugugugugugugugugugaguuggacacacuugcacaacagcauauauguagagagcagaggacaaccuucaacaucaguacuuguuguggauugccuuggugcuguuuguauuuugaugcuaauucuguuccuugaagaggggcugccccugacaaggaauggauccuguacucaggagauuccauaugaaccuccuccccuuuuuaaaugaucaaauaaaggcuagagccugugauugggcaguggaagggaaugguggggcuggaaguuuuagagaaggaaagggaggaagaugaaggaagaggagguagaagauggagcagaacgacauggccuggaggagcugcaaguagcaagagaucucauagcuggggaauagaguaguguaguggugcaucuauuguggauagcacauauuugcucagucuaggcaugcagcuaauuaaagaaaggggggaugagacgauuguuuucagcauggggcaaggaggaauggccaggauggaaguggagccaacgguguucccagagcauagccaggagugcucugccggcauuugugggagugguauuggcuagcagguggggguggggggguggggguugggagugguauuggcuagcaggcggggggggggggguggagggguagggauugggagugguauuggcuagcaggcggagguggagggguagggguugggagugguauuggcuagcaggugggggguggggggugggggguagucugcuggucccagaaccuagccagaccaagcaugggcuuuuuaaaauuacacacaacagguacuuaccuuuuaccuuguuugagauuucuugguuguuuucccccagugaucaccaagcuagcuggcccaugagcuucaauggauuguccuguccacuaucaccauaggagggccaagauuucagacauuugagauuuguguuuuuauaccagcaguggggguggggggugggauuugaacuuaaguuuucacacuuguguggcaguauucaauuggccauagccuccauccaagagcauaacagaaaaacaguagucagucuagggcaggauauccuugaaaucuagcgaaccauauugggaucccagcaaaaggggucacgcagagacugcccauaaaccagguacuugggccucaaaccaagggcuuuuaaggcaucuggagaaaaccgcuuucccucccucuccgguugccaggcaaucccugugcuucuggaccacagcgaagugcaagugguuuaagaacauacauagacugaaagugaauuauaaaacaacguauuucuucuaaauggaaucuaagagacaaaauagcuauccuuacaucacauaaacagaccugaagucaagcauuguaaaauaagcccaagaagguuauguucauuacauuuugucuuaucuaaucuguucauugcugaaaauggauauugguguacuuucucagucuuguuuuauuuaucuuuaaauuuuaaaauuucuauuuguguguguguugugcauguguaugugcacaaacaagcucacaaaguggucagcuucucaaggagcuauggaaauacauauucugauguauauuuagcaauauuaauagaacugaaggaagacauaggcucuaaaucaauguuagggcuggggagauggcuaaaguauuugccaugcaagugugagagcuagaauuuugaucuccagaacccacauaaaaugccaggucuucauggcagaccaguggaaagagacaggauccucagagcaagucauuuagcaagaauaguaguguggaugagcucugcgcuuggcugagcgacaguaccucaaagaauaacauggaagaguuauuuccuacaccaacgucaggccuguacaugcacucaugcaugcauaugugcacaaaaacauaagugcccauacacauggaagcaugcacggacacaugcacaacacacacacacauagaguuuuuuaaauuuaaagauaaaacaagacuaugagaguacaccaauauccauuuucagcaauggacagauuagauagacaaaauaugugaacauuauacuugaacaucaaaaacauauagaacaucccauccaaaaguuacagaguccacauccuccucuagaauacuugaaccauucuccagaaaggaucguguguucggcacaaaacaagucucaacaaauuugagacagacaguaauuaggacucuuucccaccuccugugguaugaaacuagaaauuaauacuaugaggaauuucauaaaauucacaaauacuuggaaaauaacacauuuguuaaagugauaaugaaaaaaauucaguuggguuacaucuauagucauucuauaacacuuaacaccuacaucaaaaaaaaaaacaaaaaaaacagcagguguaggggugcacacuguagucccagcacuuaggagguagaugcaagaaguucagagguucagggucagccuaggcuacaugagagucuguguuaaaggaaacaaaacacaggacuggagagaugcuucagugguuaagagugcuuaaggucagccaggcagugauggcaccaggcagugguggcgcacgucuuuaaucccagcacuugggaggcagaggcaggcggauuucuggguuggaggccagccuggucuacagagugaguuccaggacagccagggcuauacagagaaacccugucucgaaaaaugagagagagagagagagagagagagagagagagagagagagauagaucucuuucagaagaccugaguugguuuucuagcuccacaccaggcaucacacaaccauuuguaacuccagcuacaaggggaccugaugccuuuagcuuccacgggaccagcacauauguuuaugcagauauacacacacauuauuuaaaauguuuauuuaauguauuuauuuaaaaauaaacaaaagccuaaacauaccaaaagggaagcuugcuaugcacaaaauccuggguucuauucccaguaccuuauaaaguaagcaugguggugcaugccuauaaucccaguacuuuggauguaggggcagaaggaucagguguucaaggcuauccugcacuggagagacacugucucaaaaaauuaauaaaaucaaaugaaauguuggagcaauuuccagugagacgagccauaucagggagguaugagcucgacagccagaaccugccucagugaaucggcauaaaaacaguggacagaaauuccugauaucaaccucaggcuuacacacacauacacacacacgcauacacacacacauacacacacacacacauacacgcacacacauacacacacacacacacgcauacacacacacauacacacgcacgcacauacgcacacgcauacacacacacgcauacacacacacauacacacacacacauacacacacacacacauacacacacauacacacacacgcauacacauacacacacauacacacacacacacacacacacauaugcaaaaacuugcgcgcgcaugcacacacaggaaaaauggaaaaaaauaaacgguaaagcagcagcuugacacaggguuagugaggacuggcugguaggugucuggaguacagaguaucccucccucccugugaaacgagcagcuauggagaaggguuuccagcugcuuuucccagacagccagggcugccaaagucuuagcaaauggcucuuuuuuuuuuuuuuuuuuuuuuuuuuuuuugguuuuucgagacaggguuucucuguauagcccuggcuggccuggaacucacuuuguagaccaggcuggccuggaacucagaaauccgccugccucugccucccaagugcugugauuaaaggcgugcgccacaccacguccggcuagcaaaugccucuuaccaguagaacuucaggauacucgaggauccgacagguaaaaacgacuucaggagaaugcccacuucagcccaggauguucaggcagugcccaucccugcaccuuugcugaugaccuccaggucucugcucuacagcccucugccauggcaggacugcugauuucauggacaauauuucuguuguucuugcuguugagagggggaucucacuauacaacuaagacuuuugaucuuggccuuuccagggcuggacuuguagcauuucagagggcuccccagucgguauugggguauauauuaggcaaacacucuaccacagcccucguuuuuacuugauauuuuaaggcagauccuuuuuuuuaaacaaauaagugucuugauuuuuuuuauuaagcaggaaugaacuuauuuaugacaggaacacuuuuuuuuuuuuaagaaagauuuauuucauuuauacaaguacacuguagcugucuucagacacaccagaagagggcaucggauuccauuccagaugguugugagccaccgugugguugcugugauuugaacucaggacuucuggaagagcagucaguggucuuaaccgcugagccaucucuccaggccacuaaguugcucuuaaacucacugaacucacugcaguccaggcagaccuugaauuuggauguuuaagcuauccaugcucgcuugcucucucucucucucucucucucucucucucucucucucucucucucucucucucucucucucucugugugugugugugugugugugugugugugugugugugauauuuauuuucaucugacucuccaaaugcuaggauuacggaucugugucaccgguuuuauguggaaguaauguuagaaccuuaaguuucauacauccuaggccacguucccagccuagcacuuugucuuuaauucacauccuugggaccuuugaacauccugucuccuacucgcaguccugucuacaucuugagcagacaagcuacucgcuuagacuuccucuccucuucccuaugaagggugcuagugggucaagcccugacccccaagcuggggaaaaugggcacacauuccuaguaacucccccugacacuuggcuucaguagguucugguuugccacgcugcgucuccaagccuguagccacgcugagcagcguccuaacccagccucacccacccagauccagaagccgaggaaccugagaagcucauggaucugaaggguaggggugagggcuugcauccccucuacaagaagacuccaucugcugcaguggcuggauugcacgccacacccucggaguaagccccacccagaaagcacccccugguuucauaagcucuucuguuuauaucuuccucauuugaaaacuggcuguaaaguucuacccaccaaaacuacucaaaucuacaccaucaagauucauccucaggugccauuccucaaaacucgcccccuggugcuauucuccaaacacagaccaaagcuuuaugacuugcucugguguguggaacucuaagcucuaaucauccuggggggccuuaagcuucacucaccugcagccggccagcacccuccacugccccgcggagugggguagggggugggagagggcaaaagaccccgacuaaguagaauuaaauacaacaggagguucggagugugaggaauacccagagaaaggacgugucgcuagcugcggaugcgagugaugaaaaguuaaaagcgguuaguugugaguucuuguggcaggccuccccguuccuccuccccgccccguccagccccgccccaucuuccuaaacacuuugccccuaucccccagagggucaaguuaaccaaaggaaagaagaaaugcuuucaaaaugaaucuuguuuugcuuccugcagacaacagacgcugucaccuggauccuggcuucacauuccaaaccagaacauuacuuucuuuccaguguugugguuacaaacaguuuuguuagaauggcuuucauuccguaucacucacugccccacugaaaguguaccuuuccagaccgggagcuggcugaaggaguuugcugcaaaacuugaugaccuuacuuugauuccaagcuccacugacucugcaaaguugcccccagaucaccaugguucucauguccccagccucccaaauaaauacaauuuuaaaagugggccagcaacuggaauuuuauucagcaacuaaaaaauaacauuaugguccagcacuugggaggcagaggcagaggcagucggaucucugugaguucaagacaaaccuggucuacaaagugaguccaggacagccagggcucuguuacgcaaagaaagucugucucaaaaaaaacaaacaacaaaaacaaacaaacaaacaaacaggaaaagaaaaagaaagaaauuaugaaauuucaggaaaacguguuaaggccaggacagagcaagagagcaagaaaaggcaagauggcuccguggcucagugaguaaaggcaccugccaccaaaucagaugaccuuuguuucauccccaagacccacaagguggaaggaaagaauagauuguuguccucugaccccacagauacgccaugauuuaugugugcccuguucucauguacaaaauaauaauaaaaauuagaaauaauaaaacuuuuaaacgcagcuaacuauaaaaagauccgugaggagauggaauaaaaagcuuguaagggagagggcugcggacaguauuggaccucacauaauaagguauugggaggggauacugauugagaggccuggcugcauaaagugccucaagguucauggggcagguaaccugcagagacagauguaaaauaggacuuggucuaucugaaggagagagaagucccaagucucacagagcugguagagaggaggagcaggaggagggagggagagaagagagggggcaggucacugcaggguggggcucugacuauaaagaaugaagccaguucacugaucccauaggcaauacacgcuacaagcaggcaccagcucucaggaccagaaaggcauuggugagucuuuuucugacuacagcagaggcuagagcaaguccuuugccaucugccucucuuucagagaguuccagggguggcuugagauacugaugucuuuccuuccacuuuuauagguggcccccuuaaaccuucagguaucuggagaggagaucuaaccuucacuaugaaacuguggcuuuuugccugccugguugccuguuuuguuggggccuggaugccgguuguccaugcccaagguauuguccuuagcuauaccuaccuugccccgguuugggcauauugcuuucucuucucacuuguccuucuccacuuguugaagucucccuguauucuguauccuuugaacucuucagugucucuugggagguugggcauaacaagaauuccugguacuacuggagguagauggguagagaugaaguguccccagcuacuuacucccagaucccucacuuucauucugaagugcuuccuuugcaagacucaagagguuuaggggcugcaggaaccugaggguggauuccaauugaggagaaauucacuuagccagaaaugcauuuugaugcccuucuucugccuaguuaggggaugugaaguuaagcucagaacccugaagacucuccagacugcauucccugccuuuccucccuguguaaucuaggcaaggggcuaagauuauucugugugggacucaguguccccaucugcuaagcaggaaugaaaauuuaaggauccaaugaacugcaaaauacucucagcugcaacaggauucccagcccuguggucagggaaccaucuuugucuucuuucuuggccuccuggaaagcagguacuggaggauucaguuacccaaggccaguucucaggggcaugaagcaucccccaagaguccugucacugggugcuucaucucagaaaaaacugugaagucccagcaggugucaaggcaaaaucccaggccagguugaggaccaggaucccugcuuuugccuugccugcucuucuacagacaggucgugcaccuucaagcuuccaccguacccauagaaagccaagcuuggcuuuuuuuuuuuucccauucugcuaucugggccacucccaaccucugcccuuugauccugggagaaaaauggcccccaguguuggaaaacaccugucagggaucccugaagucccauuucuuaucugacaccacugccccuuguccucaagagccaagguggagcaauggcaaggaggaugaacucugucccugaaccucuacuaggcucuacuuguccucagaucgaggaacccacugucuugccaacuuucuuuauucauuugcuucucuccucagaacuuucuaggaucaucuccuccuccuugggcaccuccuccagcuccagugcaccuucuuucauguagauaacauuuuuggcuucccuaccagguugagauacuccugagcauuaggucuaauucaugucuguguuguauggcucuuugguaccaagaagaaaucuuuaagcucuuguuagacuaacaggggaaucggcaaagaauggcuaggucaguuuagcagccacugagaugaguauagagaggaaaagggauuuaaguuaauucaacauggggacaagcugacucauaccuggagcugagauggucaggaaaguugaauaaccuguuuauauuuuuauccaacuuacauuuauuuauuuauugugugcgcguguguguggaucaguaugcacagugcccauguggagauaauuugcaaagucuuuccuuucacucuguggauccauggggucaaacucagguuaucaggcuugguggcaagagcuuucucacuauguguaacucacuguccaggaacucacuauguagaccaggcuagucucaaaugcuuagagauccuccugagugcugaaaugaaaggcaugugccacacauguggccuuuaaauuuuuuuaauuaaaaaaaauuuugacaggguuuuccuguauagccuuggcuaugcuggaacacacucuguagaccaggcuagccuugaacucagagaucugccugccucugccuucugaauguugggauuaaaaguguauacugcuacaucuagcuaauuuuuauauuuuuaaauugagauagggucucauauaucucaggcuggucuccaacuagcuuccuagcugaggaugauuuugaaauucugaucugccugccucuacuucccaggugcgaggauucuaggaauguacuaccgcacucaguuuaugaacuucuggggauccaagccagugccucauggaagcuaggcaaacacuuugccaauaguccuaguaccaucuaggugcuuugagacagguuucauguagcucagacuggcuucaaacuccuuauccucugucccagcugggcuuaaagauacacaugugccucaaugucuggauaaccacuuuuaggaaauuagggcuguacugguugugccccaggugugcaccuguucucuaccucagagcagaaauagaagggacuuugggcuguuucuuugccuaccuacacucuauaguuccugccagugcccugauaucaagagcugagaacaagccaggaagcuuucuuuccaaggcagccuggugaccucuguaucuagaagguggugugugugugucugucugucugugugcacacacaugcaugcacgcacacacaaacaugcauguaugcucacaucugugguuauccugcuagugauguacaccuggaaucaagugugugacuggcuugucagguuacagguaccuuuuugugauuuauuuuggagaauuucauaugugcaaauauguuuugaucaaauccauucccuauuccccucucccccaauaucaccucaucccccaccacuuuccucauccaguuucaugaucugucaucuacuagaacauugauggucuuucagggauuauaucccugaagaaaacugagccucucuuagcagccaccgguuuccaguagcucuucagccaggguuaagacuuagugugcucugucuuuggagagcuuugggggcccccuucuaggaauuuggcaggaauuugacuuugggcuaggacaagaaaguaggcacaagaugaauacagcugagaaaugugaucuuuguauauugaugggucuuguuaagacucugaauauaggccgggcgugguggugcacgccuuuaaucccagcacucgggaggcagaggcagguggauuucugaguucgaggccagccuggucuacaaagugaguuccaggacagcuggggcuacacagagaaacccugucuugaaaaaacaaaaacaagcaaacaaacaaaaaagacucugaauauaguaaccaaggggccuuuguuugugcuuuguuuguuccuuaacuaucuguuuaugccuuguuugcuccuugacuauuuuguuuaugcuuuaggacugaccauauucuuugcauguaccuagaaugauagaaaagcagacuggaaaaaaaugaaccagcuuuagcuucagaacuggcuggggucauguuauaguguugucuaauugucuuuuucuuuucaguccucccucccucuuggagaccugcugacugacugagcuggcuuggucagcuacccauccacccuuguuuggauucuagcugucuuaaucuugggugggucugugcacucauuacagugcaguggccuucucaugcccagcaacuauucuuucccugaggaugucuacuuccuccaagucuuacaguuuuucugcccccacucuucugagauaauccuugagccuuguggcuagggaguauaauauagaugucucauuuauagcugggaauuccagagucucuuuuccugaaaguugaucauuugugggucucugggauaacugccaucuacuacaaaaggaagcuucucugaugaggguauaaccuaugagcuauacauaaaaauggaguggagaguuuauuacuauguccuuuuauuagguauuagacucuagcuuagaccuuaugacucguguguguguguguguguguguguguguguguguguguuguaguucucagguacaugugugcaccuacaugcaugugccacauguguauagaugucagaggauaauuugugauucgcuccuacuaugugguuccuggggauugaauuuaggaggcaagcaccuuuacccacugagucaucucacuugcucuguaggugccuuugaagacugcugccuggguuaccagcacaggaucaaauggaauguucuccggcaugcuaggaauuaucaccagcaggaagugaguggaagcugcaaccuacgugcugugaggugagcaggaccucccuuugcugggagggcaucaugcuugccuuagauccucauguccuaacuuggcacucaucuucccaccuucuguagauucuacuuccgccagaaaguagugugugggaauccagaggacaugaaugugaagagggcgaugagaaucuugacagcuaggaaaaggcuaguccacuggaagagcgccucagguggguaaggccucaggccaacaucucagggagaaaaacagcgauuauauauuuccuaugcuuuuuacuuuuucucccuuuuagcauugugcauugaguccuucagcauucuggguaaguguucuacaacuaagauacaucucuaggccuuccauuuugucuuuggugugugugugcuacaugcaaaugaguuugcaacaguuguguuuaugacgguuguuuuauucaggguuucuuuuucuuucucuucuuuuucuuuuuuuuuuuuuuuuuuuuuuuuuuuuuugcgagacaggguuucucuguguagcccuggcuguacuggaacucacucuguagaccaggcuggccucaaacucagaaauccgcuugccucugccucccaagugcugggauuaaggggugagccaccacugccuggccccagaauucuuuagucuaaggcuaaggccuccugggguccaacugcucccaucuacauuagcaugucuauuguugcaaacucccugggccccugacucuuaacauauuuuugcucccucuuccacaauguuuccugagccuuaggugcaggguuuauagauguguccacugggacuaggcacaacucugccuuuuguuuaguuuagccuucuggagugguugcuguugcaccaagaaguguucuuagugagaacugcacuuaucuguggguaacaaauguuuagaaugucauuagggauggugcuggcuuaggagaguggugguuguagggucuuuuccaagagccaugacuuugcuggguuuccaguaccaggcaugauguugcucuuuuuuuuuuuuuuaaagauuuauuuuuauuuauuauauguaaguacacuguagcugucuucagacacuccagaagagggcgucagaucuuguuacagaugguugugagccaccaugugguugcugggauuugaacucuggaccuucggaagagcagucgggugcucuuacccacugagccaucucaccagcccgauguugcucuuuuugagaaguucuaaaguccaauuaaagaacuguugguuaccaccaagaagugugucacuacugcauacaucaugccuuugggcuaucaugccuggcugguccuugugguucauagguguuggccuggauaggguuguuggaaccucgcauggugccaugaaacacaccuguuuuguacagggcaugagggucaagcucaggugaugaagcuuacagaaaaaccaauucucuccaggccuaucuuguuuuuuauuucuuugcuuuugguuuguuguuguuguuuugagacaauguagcccugacacucauuauguagaacagguuggccuugaacucaagagaaaucugcccacucugcuucccaagugcuggaauuaaaggugugugcccgcacaccugccuccacuuuguuuucugagaccacgccucuuacugggaugggaggguuuccaauuaggcucguuggucagugaacucaagaccuuggcuucgugucucgucagugcugggcuuacaaauuacuaccacaccuggguucuacauggacgcuagggacggagcucggguccucaggcuuuuaugauaagcacuuuaccaacuucgcucucucuccccguacauccuuguuuuaacuacugacuuaaguuuuucuccaggggcuaagaagacagcucaccuguuaaagugcuuaauguccaaguacgaaguuuguauccuaagaaauccauauaaacccuggguggcuguggugguuuuccugaauuucuagccucggagcauggagacauguguuucacauaauaaacugucagcucuggguuuaacugagagauccuuccucagugaaaaaggucaaagaacaauugaggauaauuucugauuccgcgugcacaugugcacauaugaaaugagcccacacacgugagaaacaauguaugcacacacaugcacacuguguuacagcucagagcagagacguauccuggcaauuagucacacuacacaacaaaccucaaacaagaaauuuauugaaaaagacacaggagggaggguggcuuccucgacagucuugugugagaaggagcugggcaggggacaggcuuauauaggguuucuaagagcugaggcagagguuuccagaaugaccugugauuggugggaaucuuguggucugaucucgggggccagcucaggcauugaggagauuccuuauuuauuuauuuauuuauuuaaucuuuuuuuggaaaaguuuuuauaacguauuauuuauuuauuuuauguauacaaguauacuguggcuauccucaaacacaccagaggagggcauuggaucccauuauaaauguuugugagccacaugcaucaaaauauaacuugaggaaucaaugaguucuacugggguuacuuacagaaauaggggugaggaguuaacuuacaaaggcagaaaugacuaaacauaccuucaucaaaacgcaccccgcuuuuuucuuggaucaagaaagcugaaaaacaggaguacacuggauacccugcaggcagcuaaacaagcuggagagugucucauccaggaggcuuggcuggucuggggcgaacuugcuuagcuaaauuugaauguuuugaaguagucuuuccugcuuauauaccuuugggaauggaguggcagggugcaucugaucaguuucagggucuuucugaagcuauucaauuguuuacuuccugaaccuaaugaauuuccuaauguguuucaccuccgcucagcauauccuguuguuucaccucccugcaaguugugucuuaauagcuuucaucuaagauggcuuuaagcucagaagaaacugccacaaaagguguccuuauguaacccuggcugguuaugagcuggcuaugagcacaaacuggcucaaacuuuaucacacugauucagcccugugcuggggcuacagcuuuauagcaccaugccuagcuguuagaauucuuuuauuaaaaaauaaucacuuaccugggcgugguggcgcacaccuuuaauccuagcacucgggaggcagaggcaggcggauuuuugaguucgaggccagccuggucuacaaagugaguuccaggacagccagggcuauacagagaaacccugucucaaaaaagcaaaaaaaaauuuuaaaaaucacuuaaaauuaauuuauuuuaauuuuguguaugcaugcuuguuuuuaaguguguguaccauucuucuggucuggugccggugaaggccagaagagggcaucagaagguauucaacccuaguccgcuguaagaguagcaaguaaucuuaaccacugagccaucucuacaacucccauuggaacacaugucuuuuucucucuacuuuucaacagacucucagacugaaaggaagaagucaaaccauaugaaguccaagguggagaaccccaacaguacaagcgugaggagugccacccuaggucaucccagguaaagacucuugagcacggggccuucuuccaccaaucacuuugcugacagggauuuacucuuaggaacaggggccuuacccgggacuuuggucauacccugaacuuccuagguggcuguucaucccucuaccugguguagggagcaucaauaaagccaaaugugaaacaugaucuacuaucagcaaacagaaagugucuucucauaccacuuacuauuugcucucucucccuucccuucccuucucucccccccuccccguuuucuguuuuccauucuucccuuuaaaaaaauguuuacauugauugaccauugcauguguguguguuuauagcuggucuuugcuacuuuuggguucuucucccacccuuuaucccuggcuuccaauuucaccuaucacuagauagagagaaagaagauagaggggagagagaaauagagaucucugaaucuaauuucuuuccuuuuguuucuucuuugagcacaacuacuaacaaacuggaaccaauuucccuaaacgaccaauaaccaaccucacuucuaagggcccuagcauuuauauauccucuaaaaaguuccaagaauuccagaggucacccaaucacagaacuaucuacagcuggcaaaacugugccucugcuagagcauacaacaaucugaagcagccucacacauauaucugggauuaaaacaaaagcacauucuuguauuucugugcuuuuaaaccagaauugccacagugugcgcgugcgugugcaugugugugugugugugugugugugugcgcgcgugcgugugcgugugugugugaccguguuuccaguuggaagucagaggacaauuuucaggagucaguucucacuuucuacaauguagguuucugcuggaacucagguuguuagccuugguggcaaaugcugaaucaucuugccuccuuccccucuccuuucuuccuuuuuuuuucauuuuccuccuccuccucuuccucuuccuccauuccuuucuguuuuuuuuuccccaaccagagucucauguaccucaggcuggcccagacucccuauguagccaaggaugccccugaacuucugauuuccugucuuuaucaaccaagugcuguggucacaggcauguacuaccaugcugguucacgcagugcuaggggauggaacaccaugcuaggcaagcacucuaccaacugagccacacuucuagccucuucuuucucccuuaccccuuuucgacuuucuuuccuucaucccucucucccucccucuuaucccucucuuucuuucugcaauaauaaggcuugaacccaagaccuuauaaaacgaggcuagcacucuacugcugaccuacauccccagccuuuuuauaauuuguauuuugagguaaggucucacuaaguugcccacuuuggcuuugaauaaacucuguagcuguggcuggaucuuuagcuccuuuuaccuuaaccucuaaaauacaugccaucaugcuuggcuucaauguaacacagacacauauuuagugugugugcauuugugugagagugcaugagugcaugccaccgugagcaaguggaggcuagaggccacuuuugggaauugcuuccuucuucucaguauaugggucucaauagucaaccaucugacaccaucuacgugcaaauuacacgugauuccaaagguuaaggguacagccauaugaaacugaucccauugaacacucaaacucucagagccccaguuuucccauuugcagaaggggaacaguacuagcauuguuuauuucacaggauggugaugaugcccagaaagaccaacaauuaaguuaauuacucagaguaagcaccagcuggaggaugggaggagucugcugaagugccgucuucuaggcaugccagugccaaugaacucacugaagcuacaguuuccuguacaagaccagacccaccaacgucucagcauguaugaggaaggaacuacugcgcuaaaggcccucccacucaccaaggagcuauuggcuauugaugauugcugagggaagggaguaauuuuuuuucucuuucugaagugugacuugaguaaauugcccauaguucaguauauaauccccaaccugugcucaggcaagcaacccuaauuaaaugcaauagccacauacaaaagaaaaggauaugaauaguuugguaggaggggcuuguuaggaagaagacauuaacaggagagagaggaacgagaggauagugagugugugagagugccuacacaugugaaauggucaaagaauuaaaaaauaaaaacuuaaaaagcuauuaaaaaguaaugacugacag

SEQ ID NO: 4274 - RNA, 2865 nt, Mus musculus
aaaaaauaaaaaauaaaaauaaaaaaaagaaauuaagcaucuuugaagcagaaaaaagaauguuuuccaacuuuugauuuuuaucagugaggguguguuucuuggagagagcauagaguuggaucuagauuuuuccccuuaaauauaugaauagauuguauuuucauuuuauaagaaugauuuaguugcuggguggugacaugucuuuacucccagcacuugggaggcagauacagauggaucucugugaguuugaggccaguguggucuauagagcuagguccaagacaggcagcgauacacaaagaaacccugauucaaaacuauuuagagcuugaaauuuauaagaauguugagagguuucauugcucccuuugcccaucacguguaagccucucccaucaucaacauuuuuccauuacagugcugugugugguacaguccacagugacacauucucacccaaagucuacacuucacauuaguguucauuauuucuuccuuguucuucuuuauuaaaucaggcuaccuuucaacuugcccucccaauagucuuccaaaugcugcaguuguaugugugcccacuauaccaaacugggguucauauuuugugccuuacauuugguaaguauugacaaauauguaaugaccucacugaaauaccauacagaguauuucacagccccuaguccuccacauucuuccuagucaccucugucaagugguggccuuccacuguucuccauggaauagucaagugguggccuuccacuguucuccauggaauagucaagugguggccuuccacuguucuccauggaaguuccuuugcaguuuuuaauccagucaaucaguuugcaucuccguuuuuuguuuguuuguuuguuuguuuguuuuuuugucaaguugaggccauuacuuguagauuaucauugaaaaauaucgacaauuuuuugucauuuuuguugguuggauuauuguuuguucuuuauauugucccacauuaguaucugguuuacuuuguuggauauaacgggcuccuuccagcucuccuuuguucagcuagccuguucauuaaaucuauucuuuccuguguggccaugugauugaaauuucuucuuuugcuugcaguauuccuuuagugucuucugcagugcuggcuugguggucagggacuccuucagugugguuauguugaaauguccuuauuuguuuucaaauucagaagaccacuuugcuugcauaguagucuugacuagcaauuaccugcuuuugagacuugaauuacaucauuucaugauuucuugguucacgguugcugauaguacucuggugcuuugcuuuuguaggugaguugguguuuuccuuauauagcaucuaauacuguuucuuugcuuuguaucuuugacaucuugacuauaagaugucauggagagguucuucccugauuucguuaguuugggauuuugaaugucacuuauguuugaauguuuguuucuucuucugggcuuggggaagcuucugccuuaauguugaauggaaaugcuguaccuuugguguuuacuucacuaguccuguggguucuuggguuuggucuuccuugaacauugugguuaugauaauuuacuuuuugcuuauuggugccuauauguauuauuucuccucuccucuccauccugauauucuuucuucuguuuuuucgaguccauuguccaugcuucuuauuaugcgcuuuugguuuuguuuucauuuucaaccccuuugccccuccucuucucagcuucauugguaaguuuccuuucaucuugcugaguuuuuucaucuauuuugcugccuuuuucuuuuguauugaugacuuucucuguagguccuguauuggauuaauuuucgcauugaauauuuacuuucaggucauugaucauuuuuuuuaauaagaaaacuuugaaauacucaucugauauuuuaccuaucucagagcguugcauuacuuuuuaauguuucuuguguuuuguguuguaagcuacacaucuucugguuuauaugucucuucuggauuuuggagauguaguggugguagugaugguggugaauuucaucaauagcuuagaccguagggaaaguaagugcuacaaauucacugaucucuuugccagucuccauaaagucugaaaccucagaaagcugaccggacacaugaucuucuuuccuuugugauuuuuauuacauguaauaguuuuuuuuuucuacuaugguauaagauaguauagaaguuacuuaaaaaauuaaaaauagaacauuauugaaucuaacuauaccacacuugggcauauagacccagaagacaucaguaaagguauuugcacauccaagguuauuguuguacuugcaugguagguucaaaaaggaagaaugcuagauaucuaucaacaggugaauugauaaaguaaguauggaacauauuuacaguagcauuuauucaaccuuaaaaaugaauaaagucauuacauuuaaaaggaaaauuauggauuuggaaauuguuaaauuaugugacuaaagccauggucauaaguauaaauaucauauguagcuggcauccauucuuucucucuccccaaucacaugaaaguagaaaguagccaagagagggaagaaagugagggagcuggaaaagagggggguaaugaaacauacauaugaauauagaaauaaagauuguuuuaagauaaggaacaagaggagacagauagaggggauggggguauuagcuuguuagggggaugaauaggaauaaaauauauguaugaaaauguaauaauguucuaacuugaacaauuaauaaaaaguuuacuaagucuuauaacuaua

SEQ ID NO: 4275 - RNA, 1661 nt, Mus musculus
aaaaaaaaaaagcugagcaauucccauagccaaagcagccucaguuucccaagcuguagucguuccucuggcuggagagcagcacugucccagagcuccuggugcugaugccgagccagccugcggaugccgagccagccugcggaugcagcuaccugaguucuccuggcuaugggcgacugugaucaucauaacuucccagcguucauguauguaggaauggagccucucugggucagcccuucaaaccuuuuguagguguaauugagaaaaacccggucuuuggauuuguagucgggcucugugguauucggcacuggcuguaagauaucagacucagggaagucaucaaaguuugaggugucaucuauacuccggauuucuauaggaauagcugcuggucuuucccuuaugugcccccagucuacacccucaaagaacggaugaccucugauuucuuccacaccaccuuucccaauucugucuucagaaucaguacaaaaucugagaaucaaguccuuggcuuucucagagacgggcacuuccggaggaaaugccagcgucuccuuccagcucauaacuuuucuguacauuucuugugguguuucggagcagaaagguggaaagccuauuagcaucucguacauaaucacucccaaggaccaccagucacacaauuuguuguagccagucugcaugaauacuucuggagcaauguagucugguguuccaacuguggaguaagccagcugucuccuguucuucuuccaugucucuacuuuccacuuugaauucauguucugaaaugagaaguugcuugguggguuaugugugagguuucuguagaauccaguccugugagcuuucuuuaaccccgugcacaaaccaacaucggauaacuuuacaugucccuuggcauccaguaaaaggaugucugguuugaugucccgguggaugaagcccagcuggugaauugcaucuaucgucaagacagucucugagauguagaacugugucuccuauucuguuaagguguccuucuucaucagcaaugucaucaugucaccuccaggaagaaauuccaugaugagauagagauuccguuuguccugaaaacuguagaauaucuuuaccacccaggcuccaucugcuuccaccaaaaugucccuuucugcucggauaugagccaccugcucuuucucaagcaugucagcuuuccucaggaucuucauggcacagaugugccccuugucuuucuucuggaccagccgcaccucuccgaaagcuccucuuccuauaaccuucagagacucaaagucauccaggccaagucugguccucuuaaggcguaagaacuguuucuuuaugagcaugcugcgaucgacguaacguuuucuccucaucugccaguccuucuucuuccauagccacuucuaacuucuucugccucguuucucucucuucgugcuguaaaauuagguugcuguaaaaauucuccagugugagcuuggccacaguuacucuuucccggguaugguugcucauaggaaagguaauuguugccccugccaucauugccauaguaacuggaagugccuguguuggccgcgccugcucagucuccuccucagucaccgcagcccgcagcgcgugucucuccu

SEQ ID NO: 4276 - RNA, 829 nt, Mus musculus
gggcucaggaaccgaauucacugucugucuucagcugaggcggaauuuacagcagguguaagagugaggcagggggauuccugugaguaaggaaggaacugaggcagggggaugaccgugacugcacggaccugagacaacaggagagagacuuccgguacgcagcaggaagccccgcccgcuuggccuugacugaggcaggggcuugcgcuuuauuuuucuuuucucaauauauaaacaaacgcagugauguagccgcccccuccgccugucaaucaccgucuccgcccacugagcugugcucgccaaucagagaaaaaccucgcggggcucagaggacccaaacccgggacugggacagaauuacgacuccuagcaugccuaggggcuaccgccaccucacuuccuguggcaaacaggagaucccgcgcgaggagggaaguaacuacaacucccagcaugcacuagaauuauugaaccauaacuuucugcgccagacaggaugugccuccggcccggacaggaaguccgaucggucugcugcggccgcagggguugaugggagaugcaguccagucaggaagcuucgccucaugcgugccccguccugcucgcuguuuccggucguaccgaauggcaccgugacugacggcacggagaggcuuccagugggcggcgggagccccucugcggcggcggcugaggagcgaagcgggagcgggaaacggaaucacugucugcagcugaggcacggggcgggggaugacagcgggugugagagugaggcagggggauucccgugaauaaaggagcugaggcaaggccauga

SEQ ID NO: 4277 - RNA, 10035 nt, Mus musculus
agaugucuagcuauauuuaauaguagaguaaaaugggaaagauuacaaaaauagaacuguguuaaaaaauguacaguuggucccagagugggcugugggccuggggaggguucucagaaaagugauagaugaauagacacagacaaacagacagacagacagacagguccuacaaagacagagagccacagaaaagcagcaguaugcugucauuaaacauacauuuuaagagaaauaagaugcaggaacaaggauacuaaaagugcaugcagcagugauaugguaagggagaugcuaacccucuucucuuggugccugagcaucaguaagaugugggaagccacaugugccguugcugaguggcacugacuacugcuggccaccacgcauaagauuggacaaacaaccaauguguacauaugcaguaaaguuuuuugcaaagacacugccuggcccagguaugauaaugagguucuguaagguacugagaguauaaccaaucagaugugagacaugcaaaugagguaugauaaugagguucuguaagguacugagaguagccaaucagaugaggaacaugcaaaugaggcuuagugcauaaccaauccgggugugagacacgccccuccuaggccuauaaaagcagcaccaguucugggcucgaagucuuuucgccucuacaaucaagcucucccaauaaacgugugcagaaggauccuguugcagcgucguucuuccuggccaguugagcgcgcgcaagaaguggugccgaaaacccgggacaagaaacgucuucaggcacgagcgaagacccccugcuacagggaggauucagaacugcaucacggggaaggagcaguuaauaaagguucccgcaaaacagacugcugagaaggauccggcguggauucagaacucuucagcuggggaacggugguaaugaaguguuccugcaaaacagacugcugagaaggauccggaguggauucagaacucuucagcugaggaacggugguaccgguaaguagaaagaaauuaaugugagaggcaugcucuccuacgaaauagaucugauaauuguugcugggguugcuaucuuucuugccuugaucuuauaucauggcuuuaauugucaacucccaaaauguaaagauacaaaaaauaguauaaaaaauaauaaaaagcagaaaauuaagucaauuuacccuccucucgaggacucugagucguuagaauugucuagcucagaggauuccgaauuaucaacaggagaggaggaagauuugaaggaggcugcugcggaguaugaagcagaaagaucugguccaauagggaggaguuucagugcucccccaccuacuccaccuuaugcagauaaaaaagcaauugauaauggucacucuuuuugcacuccuaaaggguugcaaaaaauaugucaggcuuuuccuguuuuucaggaucaugcucaacagcgauauuaugagccaauaucgcauaaacaaguaaaagagcuagcagagucaguaaggaccuauggaguuaaugccucauuuacucagucccaaauugauagauuggcucacaaugccaugacuccuuuugacuggaugacugugguaaaggcaugucuuacgaugggacaguaucuagauuggaagucuauauggcaugaucuguguuugagucaggcccgugcuaaugcuacugcagggcaacaagcauggagcuuugaaaugcuuacaggucaggguauauggacaaacaaucaauuaggauacccagugcagaucuaugaucaaauuaaucaggcagcagugaaagcuuggaaagcauugccuaaucgaggagagguaucugguaacuugacaaaaauuauucagggaacuaaugagccauucucugaauuuguggcucgcaugauggaagcggcaggacguauauuuggugaugcugaggccacaaugccauuaauugaacaauuaguuuaugagcaauguaccaaagaauguagaaauucuaucacaccauggaaagggaaagggcuacaagcauggaugaaagccuguagagaaauaggaggaccucuuucaaaugcagggcuggcugccgcaguuuugauggcgcaagcaaaagaaauaaccugcuauaauuguggacaaacaggucauaugcaaaagcaguguacaaaggguagaaagaguagguuugaaaagacagaaccagguacuugcccaaaaugugggaaaggaagacauugggcaaaugaauguagaucagucagagauauaaaaggaaggccaauaccucaguuuaaagugcaacagccaaaaaacggggugaggggcccccguccccagggcccccaaauguauggggcauuucagaccacaguguccaugaggccacccagagaccgaggagagccacuccggguucagcaggauuggacauuugugccaccuccagaguaauucuuacaccucaaaugggucuauuucaucagacuuuagaggucccuuaccaaaggauacagugggccuacuguuggguagguccucuucugcuuugaaaggauugaugauacaucccggaguuauagacucagauuaugagggacaaguuaagauuauguguucugcaccccgagguauuguagccauuucuccuggagaucgcauugcucaauuacugauucuuccuaguuugcauaacauguucccuaguagccaggauucccgaggagauaagggacuugguucuacaggaacuaauguggccuacauaucuuuagauuuggauaaucgucccacuuuacaauuacaaauagaaggaaaaaccuuucaagguauaauggauacaggagcagauaaaagcauuauauccaguaauugguggcccgcuucuuggccuguuaaucaaucgucacauagcuuacaaggauuaggauaugaggcuaccccaacuauaagugcaaaauccuuacaauggaaagauaaagaaggaagaacagggcuuuuucaaccuuauguacucccuuuaccuguaaacuuauggggaagagauguguugucagccaugaacuuuauauugacuaaugauuacucucagaaaagcaaggaaaugaugaaaggaaugggauauauaccuggacuaggucuuggaaaaaacuuacaagguagaauuucaccaguuaaagccacagaaaaaguagauaagaaagggcugaguuuuuucuaggggccacugaggagccuuugcccauuccauggcguacggaggacacggugugggugccucaguggccuuuacccucugagaaguuaaaagcagcuaaagaauuaguacaaaaacaauuagaccugggacauguggaacccacucaaucacccuggaacaccccuauuuucguuguaaagaagaagucagguaaauggagauuguuacaugaccuaagagccauuaaugcacaaaugcaaguuauggguccuguacaaagaggacucccccuacucucagcucuaacuaaggauuggagaauuauaguaguagauauuaaggauuguuucuuuuccauuccauuaaauaagaaagauaaaccuagauuugcauucaccuugccuucuauuaaucauauggagccugauaaaagguaccaaugguggguauuaccccaaggaauggcaaauagcccuacaauaugucaguuauauguaggaaaagcuuugcaaccgguuagggaugguuuccccuccuuaaaaauuugucauuauauggacgauauugugauuuguggaccugaagaagaaaguauacagcaagcuuauggcuugcuuaaugaaacuuuaaaaaauaauggcuugauuauugcaccagaaaaaguacagcagucuaauguuagucauuuuuuaggagccacuauuacuauacgaugugucaccccacaaaagauuaguauaagaaaagaucaucuaaagacauuaaaugaucuucaaaaauuauuaggagauauaaauuggauuagaccuuauuuaaggaucccuacuuuggaauuaaaaccuuuauuucaaauuuuaggaggagacucacauauuaccucauugagacaauuaacaccugaggcuucugauguucuuaggaaaguggaaaaggcgauccaaacagcacaguuaacucguauaaaugagcaagaaccuuuguaccuaugcauauuaagaaccauaaauuugccaacugcuguguuauggcaagaugguccuuuaguauggauacauccacauauauccccuaauaagacuauagagcauuaucccaccaugguagcaaauauggcccacaaagggauaaaaacuucaauuaugcacuuuggaaaaauaccugauagcauaguugucccuuauacugucgcacaaaugcaaauauugugugcuacuauaaaugaaugggccauucuuagaugcaguuuuucugguuuaauugauaaucauuauccuaaacauccguuauuacauuuuauguuauuacauccaguaauauuuccaaagguaacggcuaauaccccuauaaagggagccauugauauuuauacagauggaucaaaaacaggaauuggaaguuauguaaucaaugaaaaggcuguaagguugcaauuuacaccaggagccccucaauugguagaauguuuggugguuuuagaaguuuuuaaaagauuuccuaugcccauaaauauuaucucugauucuguuuauguaguuaaugcgguucuagcauuagagacugccagaaauguuaagcagucuaguccaguaucugaaauuuugaggaaaauacaaaauuguauuuugaugcgugagcaucccuuuuaacauauuagagcacauacaucauuaccuggaccuaugguuaagggaaaugcaauugcugacucagccaccagagacaugguuuuccuaucacaaaguucuauagaaagugcuaagaauuuucaucagcuuuaucaugucccugcuucuacauuacgacaaaaauuuaagcucacacgaacagaagccugagauauuguccuacagugugguaaauguguagaauuuauuaaugcaccuuccguggguguuaauccucacggauugcgaccccuagauguuuggcaaauggacgucacgcauaucccaucuuuugggaaauuacaauauguacauguauccauugauaccaguucugguguccuacaugccucucccuugacaggggaaaaagcaguucaucucacugcuuagaggcuugggcugcauggggcaagccccuaguguuaaagacagauaaugguccugcauauacuucuucuaaauuuagccaauuuugcaaacuaaugcaaguaaaacauauuacuggauugcccuauaauccacagggccaaggcaucauugagagagcccaccgcacucugaaacaauauuugcaaaaacagaaaggggaaauagaggcuaugacgccaaagauggcucuaucccuugcaauauuuacucuuaauuuucuaaaauuagaugaugcuggaagaucaccagaugaaaggcauggacaauggccucaaucgcccaaugaaauggucaaauggaaaaauguccuugauaauaaaugguauggcccggauccuaucuuaaucaggucccagggagcuauuugugcuuuuccacagggugaagaaaauccacuuugggucccgacgcgacugacaaggaccgugaaagagcaagaugaaccccaagaugauucuccugcuccugaugauugaaaccaggauaaguauaccuuuaugggccauaguaagaucauggccaguaccuuuacugguacauuccaauucuucuaccuagccuuuguuuuuugcaaaggaauguuuuuuggaugugccuuaugcacgacaaacuccucaagagccacggguguauaagaguacuaguuuucauuuaaauuauacauuaugcuuuguguauaauguggauaaaccuuuuacacccuguauauuuuuuaagaaaaauauuaucucuaauugggcagaucaaauuaauacugcugacacuauaagucagauagcagaaaaaacgucugaggcauugcuuacccugcaaaggguggauucucauaucaccucaggguuaauguuagugaaucagagaguggauauuuuacaacacgacauggaacagaugauggaugucauacaaaugaguuguguggcaucuacaucgcaugugugcauuacucccaauagguauauuaauaauucuuuuauuaaaaguacagaccuaucgaauuaccugaaggggaacuggucgcaggagcuggaaagguugcagacgagacugcagauacagauccugaaccuuaaugggaccagaguggaaccagugacccucggagacuuuaccucuugguuuaccucugcuuuuucuuacuuuaaggaaugggugggagugauuuuguuuggugcugccauaugcuguggacugguguucaugcucugguugguaugcaaauucagaacccaacaaaaacaugacaaggugauuauaacucaggcacuuuuagcuauugaaaauggcuccuccccugaaauuugguuaucuaugcucaagaauuagucagcaugagaugggaugagagagacucaacgaucauugaucagcccuugcucaucaauagggugaucaugauuucaccacuaauucauuuuuuggcuggccucuuuugcagaguucgcccuaggucauuuagcaguuauugucacacagcacugcgguauccagagacgggcaacuuuccucgugcacaguccaaccuaagacauggggcccgguggcgauaggguuacccuaugacagguaaggcugugauauuagaggaacgaccuaaaacaggagccacggcggaugggcauaauugcacaggccuaguccagccucauuuuauuaaaacaaacagggggagaugugggaagccacaugugccguugcugaguggcacugacuacugcuggccaccacgcauaagauuggacaaacaagcaauguguacauaugcaguaaaguuuuuugcaaagacacugccuggcccagguaugauaaugagguucuguaagguacugagaguauaaccaaucagaugugagacaugcaaaugagguaugauaaugagguucuauaagguacugagagagaguagccaaucagaugaggaacaugcaaaugaggcuuagugcauaaccaauccgggugugagacacgccccuccuaggccuauaaaagcagcaccaguucugggcucgaagucuuuucgccucuacaaucaagcucucccaauaaacgugugcagaaggauccuguugcagcggucguucuuccuggccagucgaacgcgcgcaagaguaagacaucuuuuuaaaagaccacugcuaugucaaugguucucuuucuaucugucucugucucuccuuucucucucucccucuccuccccucccucccucccccugcccccccucgcucucucucucucucucucucucucucucucucucucucacacacacacacacacacacacagacgcgcgcgcuauucucuugcucucucuuuuguucucuuucucccaaaugccucaugaagagauaggauagggguuaggguugggguuaggguuaggguuagggcuaagguuaggucaggguuagugguuaggguuagggguuagggaauaggguuggguuuaggguuuagggcuuaggguuaggguuaagggagggccuuuuuuaaaaauuauuuuuucccagcucucucuugcucuggucacucacucacucacucucucucucuagcugguuugcugugguuucuaucccugcugggagggagggagggagggagggagggaggaaggaagcccaaacucuucugcacugacuggcuuccuuccuuccuucccugcuuccauccuuccuuccuucuuuuuuuuuuuuuuuaaauuuauuuuaggugugaggagggcacuguacgcagaucccgugacagaggacaguugaauuccaaucccaguugucccuucuuuucuuauuuuuauucuuuuucuuuuuuuuccuucuuuuucuuuuccuuuuggccuuuuuauauauauguaaauguauguauaaauguauauguaaaugauauguaauuguauaugcaacugauauguguauguaaaugcacauaugaauaaauuugcaaauauucaaaugagauuuagaugugugggcggugccuaauucuggugggcauggcauuagaaggaaugggcauggcugggugcagaggguguggccugaguguggugaaacuggccuaaagaauuaugggugggcguggucuggauaggauugguguggcauuaggaaguauggguguguccugaccaauugagggcauuguuguugaauagugggaguagacugaagaucuguggguguuuucuguaguggaaguguccuaaaggaguaugggcauggucugagaguagugggugugcccugaaggaggaugggcguggucucagaguagugugcuuggccuaaaggagggugggcauguucugaagcugcaugggcauggccuaaaugagggugggcguggcauuugaaagcaugggcaugaauaucauuugcauauuugcuuauucacauaugcauuuacauguacacuugcgugcacauugcauauacaauuacauaucauuuguaugugcauuuauaaauacauuuacauauaugaaaagaccaaaagacaacugggauaauucccacagugacucgcaacugaggauagccacguggguaggguguccuccucaaaccuaacaugaagaaacaaaaaaaagauucagaagucagccaguccuucucagugacuauguaaaugucuauguaaauuuguggauguguccucgcugucuauguaaaugucuauguguauuugugguuguguucugaguaacuauguaaaugucuacauaaauaucucuguaaauuugugggcauguucucagugucuauguaaaugucuaugugggcgggccuaccaaugugugggcaggccuaaagaugugugggaguggccuaaagaugucugggcgggcccaaagauguuauggaguggccuaaaagugucugggcgggccuaauuugagguguguucugucucuguaaauuugggggcguguucuaacugucuauguaaauguauauguaaauuugggggcguguucugacuauguaaguguccuaaagaugugugagaggagccugaguguagugggaggauccuaaggaugugugggaggggccugaauguagugggaagguccuaaagaugugugggaguguccuaaaaugugugggaggggccugaguauagugggcggguccuaaagaugugugggagugucauaaagacgugugggaggggccugaguguagugagaggguccuaaagauguguaggaguggccuaaaaaagugugguaggggccugaguguagugggagggccuaaagaugugugggagggggcugaguguacugggagggccuaacguugugugggaggggccugaguauaguggaaguguccaaaagaugugaguguccuaaagaugugugugaguugccuaaggauguguggaagaggcauaaagcccugugggcauagccugaguguugugggcggggccuaaaguccuguaguaguggccugagaguauugggcagggcaugaagcuguguaggcuuggccugaguguaauggguguggcuugaguguagugggaacagcauuaaagccgugugggcgugaucuagguguagugggugugacauaaagacgugucggcagcggcugugaccuaccacgucacggcggcugugggaacggaggcgucugacugacauuggggucaccgagcgaccggggcgcaugggucgcggcaguuaccguugggacggggaaaccccg

SEQ ID NO: 4278 - RNA, 598 nt, Mus musculus
uuuuggcuuuuggccgccgcagccaucuuucaguaacucgccaaaaugacaaacacaaagggaaagaggagaggcacccgguauauguucucuaggucuuuuaggaaacauggcguuguuccuuuggccacauacaugcgaaucuacaagaagggugauauuguagacaucaagggaaugggcacuguucaaaaaggaaugccccauaaguguuaccacggcaaaaccagaagagucuacaguguuacccagcaugccgugggcaucauugucaacaggcagguuaagggcaaaauucuggccaagaggaucaaugugcggauugagcacaucaagcacucaaagagcagagacagcuuccugaagcgggugaaggagaacggccagaagaaaaaggaagucaaagagaagggcaccugggugcagcugaagcgccacccugcgccacccagagaagcacacuuugugaggacuaacggaaaagagccugagcugguggagcccauuccauacgaauucauggccuaagguacacaaauaaaauaccagcaccaggaaaaacaaacaaacaaacaaacaaacaaacaaauaaacaaac

SEQ ID NO: 4279 - RNA, 1036 nt, Mus musculus
agaaauacaggagaagcaguuccggugaagcucccagaguuuguuuacauuccgagaagaccuagcgguuggcuucuccgacucagacgccaagauggggaagucauucaccaauuucauguguaagaaggauuuccauccuguguccaaauccaacaucaagaagguauggauggcagaacagaaaauaucguaugauaaaaagaaacaagaagaauuaaugcaacaguaccuuaaagagcaggagucguaugauaacagauugcucaugggagaugagcaugugaaaaauggccugaauuucauguacgaggccccgccaggaguuaagaaagaaaacaaagagaaagaagaaacggaaggagagaccgaguacaaguuugaauggcagaaaggcacucugagagaaaaauaugccaaagaugacaugaacaucagagaucagcccuuugguauucagguucgaaauguaagguguauuaaaugucacaaguggggccacgugaacacagaucgagagugucccuuguuuggucuuucuggaaucaaugcaaguucaguuccuauuguggcucagggacgucgaugcaugccucggaucuaauagcggagaugagaaacaguggguuugcacugaaacgaaauguacuggggagaaacuagaccacaaaugauccaucacaggacuaugucggaagugacugugaagaagacccugaaguugaauucuuaaagucgcccaccaccaagcagaagcagaagcuccucaggaaauuggauagacuugaaaagaaaaaaaaaaaaaaagaaaagaaaaagaaaagugauaagaaaaagaagaaguuacagaagagcaaaaauaaacacaaaaaacguaaaaacaaauccccuuccucuuccuccuccuccgagacaucagauagcagcagugagagugauaacaaagaaaagagagaaagagaagagaaaguaaaagaagaaaaucaaauguucugaaaguaaauccagugacuguaaggaggacaagucuaagaac

SEQ ID NO: 4280 - RNA, 1809 nt, Mus musculus
ggccgcgcgccgccgcuccucuuuccuuccucuuccgagcauguccugcuccguguaccucucgggucccucaccauggcugcgcucacccggaacccgcaguuccagaagcugcuggaguggcaccaaccucaagcugcgcgaacuuuuugaggcggauccggagcgcuucaacaacuucagcuugaaccucaacaccaaccaugggcauauucugguggacuacuccaagaaccuugugaacaaggaggugaugcaaaugcugguggagcuggccaaguccagagguguggaggcugcacgggacaacauguucagugguuccaagaucaacuacaccgaggaucgggcggugcugcauguggcccuucggaaccgguccaacacacccaucaagguggucgggaaagaugugaugccggaggugaacaggguucuggacaagaugaagucuuucugccagaccuugaccacccaggagaccaucaccaaugcagagacagcaaaggagugguuucucgaagcagccaaggauccaucugcaguugcaaagcacuuugucgcccugucuacgaacacggccaaagugaaagaguuuggaauugacccucaaaacauguucgaguucugggauuggguagguggccgcuauucgcuguggucagccacuggaccuuccauugcucugcauguagguuuugaccacuucgagcagcugcuguccggggcucacuggauggaccagcacuuccucaagacgccccuagagaagaaugcccccguccugcuggcucuacugggcaucugguacaucaacugcuacgguugugagacccacgccuugcugcccuaugaccaguacauguaccgcuuugcugccuauuuccagcagggugacauggaguccaacggaaaguacaucaccaaguccggggcccgcguggaccaccagacaggccccaucguguggggggaaccagggaccaauggucaacacgcauucuaccagcucauccaccaaggcaccaagaugauacccugugacuuucucaucccuguccagacccagcaccccauacggaaaggucuacaucacaagauccuccuggcuaacuucuuggcccagacugaggcccugaugauggggaaguugccugaagaggccaggaaggagcuccaggcugccggaaagagcccagaagacuuggagaaacucuugccacacaaggucuuugaaggaaaccgcccgaccaacucuauuguguuuaccaagcuaacacccuucauucugggggccuugauugccauguaugagcacaagaucuuuguucagggcaucaugugggacaucaacagcuuugaccaguggggaguggagcuggggaagcagcuggccaagaaaauugagccggagcuggagggcagcucugcugugaccucccaugauuccuccacuaacggacugaucagcuucaucaagcaacagugggacaccaaacuagaauaacuccagccgcggcccuacugacugguccuccuugucccuucucaccauaugcacugcaugguccugccccucccugcccagagcgcaccaccgguaguuggccuggacuacaaggcuguugggagaagcuggucuggaacugccauccacccacuacgcacccucccuguugaagcagauggaagggcuuugacgugucauguuguucugaccuuuauuucacaccccagcuagaauaaagacaccuagaggaggcacgggggcucagccucuucaguuuaaaaaaaaaaaaaaaaagaaau

SEQ ID NO: 4281 - RNA, 1809 nt, Mus musculus
auuucuuuuuuuuuuuuuuuuuaaacugaagaggcugagcccccgugccuccucuaggugucuuuauucuagcuggggugugaaauaaaggucagaacaacaugacacgucaaagcccuuccaucugcuucaacagggagggugcguaguggguggauggcaguuccagaccagcuucucccaacagccuuguaguccaggccaacuaccgguggugcgcucugggcagggaggggcaggaccaugcagugcauauggugagaagggacaaggaggaccagucaguagggccgcggcuggaguuauucuaguuuggugucccacuguugcuugaugaagcugaucaguccguuaguggaggaaucaugggaggucacagcagagcugcccuccagcuccggcucaauuuucuuggccagcugcuuccccagcuccacuccccacuggucaaagcuguugaugucccacaugaugcccugaacaaagaucuugugcucauacauggcaaucaaggcccccagaaugaaggguguuagcuugguaaacacaauagaguuggucgggcgguuuccuucaaagaccuuguguggcaagaguuucuccaagucuucugggcucuuuccggcagccuggagcuccuuccuggccucuucaggcaacuuccccaucaucagggccucagucugggccaagaaguuagccaggaggaucuugugauguagaccuuuccguauggggugcugggucuggacagggaugagaaagucacaggguaucaucuuggugccuugguggaugagcugguagaaugcguguugaccauuggucccugguuccccccacacgauggggccugucuggugguccacgcgggccccggacuuggugauguacuuuccguuggacuccaugucacccugcuggaaauaggcagcaaagcgguacauguacuggucauagggcagcaaggcgugggucucacaaccguagcaguugauguaccagaugcccaguagagccagcaggacgggggcauucuucucuaggggcgucuugaggaagugcugguccauccagugagccccggacagcagcugcucgaaguggucaaaaccuacaugcagagcaauggaagguccaguggcugaccacagcgaauagcggccaccuacccaaucccagaacucgaacauguuuugagggucaauuccaaacucuuucacuuuggccguguucguagacagggcgacaaagugcuuugcaacugcagauggauccuuggcugcuucgagaaaccacuccuuugcugucucugcauuggugauggucuccuggguggucaaggucuggcagaaagacuucaucuuguccagaacccuguucaccuccggcaucacaucuuucccgaccaccuugauggguguguuggaccgguuccgaagggccacaugcagcaccgcccgauccucgguguaguugaucuuggaaccacugaacauguugucccgugcagccuccacaccucuggacuuggccagcuccaccagcauuugcaucaccuccuuguucacaagguucuuggaguaguccaccagaauaugcccaugguugguguugagguucaagcugaaguuguugaagcgcuccggauccgccucaaaaaguucgcgcagcuugagguuggugccacuccagcagcuucuggaacugcggguuccgggugagcgcagccauggugagggacccgagagguacacggagcaggacaugcucggaagaggaaggaaagaggagcggcggcgcgcggcc

SEQ ID NO: 4282 - RNA, 2548 nt, Mus musculus
aauggccaacggccagaaagaagggugugacaauggcagcuucuacgcaguaucccaggagguacuuccucacaccugagcccugucuucuagagcuaacuugacuggaggaggggagcugagagguguucccaagcuaaaaaagagagaguaaguggaaugauucugaagggaaauggacagaggaagaacagugcaaauaugccuaauuaaucaaaucauaaguguacuauucacagcugcugaguaauguucauuguugccuauaagacuggacaccccagggaguuuagaggucagguggguugguggauggggacauccacauggagacaguggauggggaugagguaugggauguggaacagucagagggugggcuggaggggggcauuaaauauggaguguaaauaaauaaauagaaugaaauucaucaaauaaaacuaccuauucacgugcucuucucucucucucucucucucucucucucucucucucucucucucucugugugugugugugugugugugugugugugugugugugugcauguguagcagaaacgagaagaaugcaguuacuagcuuaugacccaccuaugccuugcagagcuccucuucuuguagagcccacuugccuuaggauggugcuuccuacagugggcaauuaaaaaaauaucucaaagacaugcucacaggacaauuugauguuaacaauaucucaaauuuagcaucauacuucucagguaacuguaguuugugucaaguugacaaaaguuaaucagcacacaaaguaacauuuuuuucuuuuaauacguuggguccuuuuacucagauaugauuuacuacuugagaaauaaugccauggaguuaggagaaacuuuugaauggcaaggauauaacuuagugguagggcuaguugccuugccuagcauacauuaaauccuuuguuucccucuuccucaaaaacucuuucuaaauguaaaguauguccuucaacugcagacauaagaaggcccuacaaccaguacaucacugagcaucuccuguuuauacccauuccuuaacugcugcucagcuuagccuggaagacauguuuacuggagaaagaacuaaauaaacacagaauaaaaaaaggagggggaacacaugauaaaagagaacuagauaaaucuauuucuugccugaaucgugcaacaguauauauguauauaugaaaguauagaccucugugugugugugugugugugugugugugugugugugugucugugugucuguguggcuguuugucuguguggcugucuuuauugcugucuguguggcuguguguggguacguuucuuugugguuaguaaggaauacauuucucucuuuuuuucacuuggauuagguagaaauaaaccuuccuuuauuuaauaaauuauuucuuaauguacauaugucuucucuuccuacuaaaaguucaaucuuaaugaaaaacagaaauuucacauggacaaauccauuaugcaauuuuaauuaaccucauaaagauauaaaaaugaccuaaccaaaacacacauuuucagugcuagccaaauuaauauuuuaaccuaaacugaagaguuagcacauuugaaaucagguguaaugucuauuuuauaggacuuauaguaauaacuuuucuaccucaagauaacagugaguuauguauauuaaauuaaguucuccuuccccagcuugggcuuaaauccucagggggaaacacauaaaauauuuuacaaaauaaaguuacauuuauaguaauggaauacagugggaauuugcugcuauuuaaaugagauaaaucuuucaagauauuacuaagggacuuuaaaggaacaacgugguucacagcauuuuagauucaguuuuacaaagaagaagaguuaacugcagucuaaccugauccugacaauaugaaauaggguucuuauauuauuaucuuccucacuugucuuugccuugguucagugaaaugauacuuggaaacacugaucuccaaaaugaauaugaaagcaaaaggauauauguugauuuagaauguaaagaugguggcuucuaagcaaacaaaaagaaggaggaggaggaagcaggagaagaaggggaagaggaaagaggaggaggaagaagaagaagaaggagaaggaggaggagaagaagaagaggaggagaaggaagaagaagaggaagaagaagaagaagaagaagaagaagaagaagaagaagaagaagaagaagaagaagaagaagaagaaggaagaagaagaagaagaagaagaagaagaagaagaagaagaagaagaagaagaagaagaagaagaagagaagaagaaaagaagaggaagaggaagaggaagaggaagaagaagaagaagaagaagaagaagaagaagaagaagaagaagaagaagaagaagaagaagaagaagaagaaagagaguuauuccaccuuaaggaaccucuuccacccuuuacagguuccacugaauuuuuccuacaaagcccaugucaacaccuggaauaag

SEQ ID NO: 4283 - RNA, 2162 nt, Mus musculus
ugaugguguacgccuuuaaucccagcauuugggaggcagaggcaggcagaucucugaauuccagaucaaacuggacuacaaagcuaguuccaugauagaccacagagcuguccagggcugcagagagaaacugucucaaaaaaaccuacacauacacacacauacagagagguagaguggaauccuuacugccuuugaaccuccagaagaacccuuccucuaaacuucaugaauuggaccuaauaugcaauguuucagcauuaaaaggugggcccuuugggaaagagaguaagcccuggggcuuugguuuaaaaaaaaaugcaacuaguguguuuuguguguguguguuuuguuugguugggguuuuuuuggccuaguguucuuaagauguuuacaagggaacccuuaucuuaugcauucuuuuccccuccuaaggucuccugcuggaagcucagacagaauccuuagcacaaacagauccacuacuuaauagaguucucagccuccagaacuguaggaaacaacuuucucuuggguauaaaauaaugagucauugguauuuugcuauagcagcucaaaaacuaaaagacucauugagauaggccacuacccauuuuucuuuucgaugucuuuaaagagagcuauugcucucugggacuaggccuugagcucauuauguaguccaggcuggcaaaauccacaaaacuguaaccuuuuaaauaaaacuuuauuaagagcauuuaacuggcucuaacauauacauucuuaagaaaacuugggacuccucugggcauuguucuaauuuauuguuuguuuacaauaaauuauuaacaauuuauuaauuguucugguugguauguaugcaugcauguauguauguauguaugugugcaaccccagcuggccuccaacuuacuaaauagccaaggcugaccuuggacaacugguccuucugauccaucuucuaggggcuaaaauucugggcauguaccaccacauccaacucacaauugauacauucucaaugcuggcuaaggaaacaacaggacuuucccaauuacucgggccuuauccugucuuucagccaaggcucaucauaaauauucuccaacuccuaagguuuucgugggucuuguugaggugaaaguuaaagaccugaaggcuggccagcauucuucucuuuaguugccacgcagcggcggaaagagccgagcgcgcucggccgcauucgccggcccuccuaggcgacgucgucagggggcggggcucgugccggcacgcucggcgcggggcauugugggaagggcggccggugcugccacagcugccaucuuagggacuccgggccgggccugcuaggccuucgcggcggaggcggccgugugcguggcgggugcgcuuggggcgaggcggaggguccgcgggcggggggccgcgcuucccagcggcgagggggcggccugcggcgggcagcgggcgacaggcggcgggcgccgcgcggcgcgaggaugggccggucgcggagccggagcucgucccgcucuaagcacaccaagagcuccaagcacaacaagaagcgcagccgcucgcgcucgcgcucgcgggacaaggagcgggugcggaagcgcuccaagucccgggagagcaaacggaaccggcggcgggagucgcgcucccgcucgcgcuccaccaacgcggcggcaucccggcgcgagcgggagcgcgccucguccccgcccgaccgcaucgacaucuucgggcgcacggugagcaagcgcagcagccuggacgagaagcagaagcgcgaggaggaggagaagaaggcggaguucgagcgacagcgaaaaaugugaggggcgcgcggcuggaggcgcggggcgcgcucacgggggccggguggggcgggagcgccggcccggaaguccgaguugagggcgcgaggcgggagguuggcggggcugcggauccccgggcccgaggcguuggagcgcagggcaccugugcggggguccgucccggggcgcgcccggcuugagagugugggcccuuucugaaccuccuuucauacggucguucaaagacagaugcacaaaguugcagcggacacccggggugccucuccggccccucucuuuuuugucuuggccucagccccucuagug

SEQ ID NO: 4284 - RNA, 4734 nt, Mus musculus
ugccugcaaaggggcuuugaccuuuccugcgucauucaagcuguucacucuaaagcgaaagaccugaaauugaagggcugaagcgccuccaugcugaacuuugacacccagagugcagcaugcugggaagaaagacaaaggacaucguuaucguuaucagcagugaggaagcuggugccucuuggccuccucaccauggcugauaaagccucccuccgucagggaauugaaagcccagucaauaccucugauuugcauguggaauauuggcaaaagccugaagcuucagcuuggaucugauucuucaugaacguuuagaggaauaaagauuuuaugucuaauaaauugcuaaaaaauauuuaguucugguccuacacauugcugcaauuggcaagggaugauguguaacgaggguaccagggacagguuuugaaggacugugccgcagagagcgugguguguguuugaugagagacucugaaagccagggggguuggaaucagggacuacugggauguggggccaggaaauguuuugaagugagggugcggcuccagauguuauggauguuuaucagccucccggccucuacacaugaaagaagcagcccccccacccccacaaagguuacugaaaucagaacuaacuccagauagugccaacggucccuuuggaaagagaauagccccagugaagaaccacccaucuaaccacagcaguaagaaacccguggccaaucgucgcaaaaggaggaguaugauggcaauuuucaaauaaaaaaaaaaaucugucaccugcagcaggauggauuauuuauuuaccugcugugagccagcuauaugaucauagagcguuuuaaauggauacuuugaaggaaacauagggaagaugucaugugggaagugguuuuaugcuuuuuguuuauugaaaaacacuuaccgacaacucaauaaggggcggacggcagcgauaguggagcgguggaguucuuacagacauagaacuccaucugccugggaggucaugagacaagcaaccucagugaauuaguguucucaccaguaggcagcggcccggucuccuucuguagucucuuuuuaaaauuauuuuuauuaaucauuuuauucauuuacauuucaaaugguacccccuaccugguuacgccuguauaagucccccaucccacaccccuccccccuccccuuuuccuuuaugagggugcuccucuuaugcauucaugcauucccaccucaccccucuaggaucccccuacacuggggcaacaagccucccuccccucccauugaugucagauaaggcaauccucugcuacauauguagcuguaguccuguaucccuccauguguacucuuugguuggugguuuagucccuagaagcucuggaggggucaaguuaguugauauugucuuuucuaugagguugcaauccccuucagcuccuuuaguccuugcucuagcucuuccauugggguccccaggcccagucccaugguuggcugugaguaccugcaucuguauuggucaggggcugguagauccucucagagaauagccauaucaggcuccugucagcaagcauuucuuggcaucagcaauacuguggggaguuggugucugaaagucccagacucuagggaagugaggggcucccaagagccaauaaugaucacuuuagcugaaauacccaacaaaggggaacuagaacuuguagaggcuaccuccaguagauagauaauggcccacaguggauggggccacccacacaucucaaaauuuuagaccaagaaauguuccugucuaaaggaaagacaaagacaaaaaguggaacagagacugaaggauaagcuacccagagaccacuuccuucuggauucuuaagcaagguugcagggugguacuuugccauugacuaauucuguggauuuauguggggacuggguggcaaugcugucucagagaccacacugagaauaguggcaauagagauaauaugaagaugucaucaguaggugcauggggcaugcaagcugcaugagggugugugcuguucauuugcaugaugggagaggagccucaggucaagagaagaugguuccagauugagcccuagagguaagagguaauuugccacauuaaaagucacagggcccccaauggaggagcuagagaaaguacccaaggagcuaaaggggucuguaacccuauagguggaacaacaauaugaacuaaccaguacccccugagcucgugucucuaggugcauauguagcagaagauggccuagucaccaucauuggaaagagaggccccuuggucguguaaaguuuauaugccucaguacaggggaaugccagggccaagaagugggaaugggugggugggucugggggacuuuugggauagcauuugaaauguaaaugaagaaaauaccuaauuaaaaaaaagaagaaaaaaauaaacacauucuucaauuaugaaaauaguuaggauaucacgaaaccaugugcuaaaucaaagccaaaguugcuucauaaugugcaaaaaaaaaaaaaaaaaguuaagguuuuuuauuuuuguuuuuguuuuuccagaccagagguauauucaggcugaaaagaugcuuuuugcacacacuugagguucugaguguagacaucacuaccuauguaagaaugcuaggcauagccagauaaaccugaaauccugucaccugggcuggggacauugaagacuaagaguggugcugggguugauggacagccagccaagcugaaacauggugaugggagaagaauagggagagagagggagagggggggagagggagagagaaagaaagaauggaaagaaggggggagggggagagagggagagagagagagaggcagaacaagugaacagaacuugacuucuguuuagggacacauauacacacaugcacgcacacacauacacacacucacauacacacacucacauacaugaccacacaguacuugcugucuccugucagacuuauuucuuuuagcuuacaguccucauccccacugacauugcugcaaauuacacucuuuaaggcugcguaguguucuguuaucucacauuauauccuaauaugauaucuuuauuauuugagaauuuuguguguguauacaguguauuuugaucauacucuugagggcaguggcccugucaugcacagaagaugcuaugcagcuucagugccccgcaauaucagcucauauaccuuccugccuccucuuccucaguagacccuguucuuggggaaggguacgauacacgagucucauuuguagcugggcagucccuaucucucugcacucagagcagcugugaguuucugcucauugucugccccccccccccagaacuuucugggcuaagcagguaccagucgggucacaucaccuucugccaguucauuugcauguuuuuuuuuuuuaacuaaccuaagaucggaccagauuaauuaucuuauucucaaaucccaguuuaauuccuggcccaaugagggugucgccccacauggacagcaccagauauaccuuggucauuuuuuuaaaaccuucucauuaucuagugucuaugccuagugccuuauaaccaguuugcagggcugccauugcuagcagucugaccuggcucccuaagagcacacuaauacuucuucauugcucucauaucugcugauaauauaaggugaugucucacaucccaggaagacccagcuucaauaugcagucuuuacaacugacuuuggugacagcuucaucuaauaaccucugcaugaucgaugucaagccgucuaaugaaucauaagcaugugaccaaaacuaugcaccuuaggauauaacucuggcauuauuagggucaacuugguuaugccuggugagauaucauauaauuugcuaacaucugggugguuaaauucuaaaauuaaaauucuauagaauugaucagcgccccccaaaaauccuaaucagaguugcaucuacccuuaaagugguuuaaaaugaacccaucuuucacacccuguggcagggcaccucucugcauguucaguucucucccugggagauuacaaauaaaauguuucuucucugaagugucuuucugggggugggagacuuuaacaaugacaaaacuuaguauauuguuccuaccucagauacacgaucuccacggaccucaugcuugauugagcuagcucuuccuuuaaauguuucuucugggugcuugcagguuuccagaggacagacucugggcguguugguugggaacuuguucuuucacugaacagcacuaagaaacaacucacacuaucuugccaacgggcaggcauccugugauccucuuagggaauugcuucucacaugguucgcaggcuuuccagagagcuuugcaggauccaggaguucucaucacacaaucucugggguucgcauucaucucccaucccugagcaggagcccuaaccgcauccucagacucauuguguuucuuaauucaaaagugaaguaccuccacucaaucuauugggguggcuuucuuuuuaugagaauauuuaaaucccacauuuugcauacugcgaagguugcacccucacaucucaccacaccuugcgcuuucuaacucgacaaucgaaacauguuccccacaucuuugaugacauuguucucucaagcguccugc

SEQ ID NO: 4285 - RNA, 14441 nt, Mus musculus
caguguccugcgcaugcgcauaggggugcacagguuggcuucgcgcucccgggaggaagcuggagaacagguuaugugggggccggcgggguuauuugccagggacaccgcgcgcgagccggaaguggaggcugcgccagcugggcccgccgcgccgcaggagcuccgggcuagacaguggcgacggcggccccucggcgggaggaagacgaugaggagcggcgggggcggcgcggggccucgcugcagcgcggagccggguuccgagcccgcggccgacugcgcagcccgcccgcgagccugaguaagugcggcggggacgcgggcggccuccccgaccuccucaccccgcagcucggauucgggagcccguaucuacucccagaacagucggccagcaaaccccgggcuugggucggagggacugggcgcguuugucuguaacaggugcagaccugcuaaccucgcagcugcgggcgacggggccauaaaauccagagaguugucgcacacuugaagucacugggccucuuuuuuuuuuuagccauuggugugaagcgagaaugcaucagggagugugcuuggcugagcuggcaaccuaaaguaaaccuuuaguugugcacuugucuaccaggcagcaggaaccaagugacacacuggcuuuaaguuugaacguuggguuuuguuuuguuuuuugucgaucugcucugucuuuuggcaugaauuaguccuuaugugugugugugcuuagacauguucuucucuaaagcacuguuuuaucucacugagaauuaaugauuggcagugcagaguuaugucacagcugugcuaccaaagacuugacucaguugagcugggauugaguuggacuugcucuguaccuucggccuugcuacgcguugaaagcguccgauggaguaacauaaggucacugccaucacggaacucccagccuauauaagcaggcucaucacccccuuaguaaauagugccacaugagucggcccaggcuacaggauggaacuggugacacugggaacgagguccgaggaaagcuugcuggaggaccuguagucugagcugggucuccacagaaaaauaaagcuucacucuaauaacuugagucacugccgugauuuaacugggauucgcagugcuuacugagacuugcuuugcugcgauagauaagaaaaugcuugaauuuugacucagagguggcagcauuuuaucaccacauccuggaaauagguauuagaaagaccgggcaagcagaaggcuagcugacuuguacauguacagccacagguagcacuuggccugcugccuuucgccggaacguuggaugcucucccagacaguucagaaacucaggcacugggcugucaagucuuuguuucucuaguucguucauccucccaagauuccaguuucuuauaauuguugaucugccucaggaaaacccgaggccccuaaaacaccccacuuuagaucuagggcaagccccaguucuuguaauuagaauguuuggugaguggcaggcuuccuaauaccuuauuauauauaguaugugccacuuagucuuacaagucuuagaucguaaaguaauguguauuccuaacaucagcuugcuagaggugcaguguuuuccacagcaagagcaaccuacauucagagugagccuaggagcucaaggccuccuaugaagucugcuuaauaaaagacaauaaaugccaacuuaugguaacuucuaaaacauggccuguuugcaguagccuaucacucuacagucuuacaugaguguuuacguuuuccggcuugaguuucuuuuugauguuuaccauuuucuuacuuacagaucuuuaugaucacagaacaaauugucauugacuucccugguggcagucauuugucauccaaauuuuugccuaagaugacugcauuugcacagccuuugggguuucaagagggaaagcacagagauguuacuaacuucuaccugguguaguuuaaaaauguccccuucacagguucccaugcacucuggacccuccagccaucuucucagacagauccuguccaucuguccccuaggccuauuaagacacacuuacucauuauugauggcauguggguaccaucagggagcuggauagcuucuuccauggugucuccagcacaccaagagcagcuaauuuguguuugcauuucagcugugugucuggcaaagugucagaacuuccucuccauugcuuagcagcaaaggagaaaaguugaugugagaauggaguucuguguuccaugaaaugugguuggaaugugugaauuccccguggacugauuaaugagcaucuugagguuguccccuugugaugugguuaucagcagugaccugugcucucuauuacagucuucagacaacucagcuuuguaauucacagagggaguuuucagagaucucuugauguugguagagucaguuaacaaaugcaaacuguaccuuuucaacuuuaaaauggauuaaguagagaguaauuuuauuuggggaauaguuuugaacuguauaaacuugacugugguaaagaaauagaucugucaaguuuccuaucuaguugauaccacauugacaguuaaaaccuaugcacuccuccauugagcuucaguuacucuuuagggugaaauguuacaggauaaagaaccucacaggcuuaucugcucuaaguuccucucugcuggccuugccuaguguguauuuagauuauucugaauccuuuauguuucuaugaauaaugugcuaagugguuauaacuaagugguacagacagcuacuuaaugggaaguaaagaaucccagcccugcaguuagccuuguccuguuuuaaaauauuugcucaaauuuuccuugauauauuuugugauggacagguaguaaaaguuugaguuguuuugcuguauuauggaugguuguggucuuugauuuccuuacucugcccuguaauugcaugaauuuguguuaggcugguguggucauaaguguacgucugccaugcaaacagcucaaaaguuguuggagguguacucagcagaucaugagccauacaacagagaaacaguggcacauugaucauuggucagcuuacaaauuuuaagcagcaggauucagaguggcaucaugugguguuguccugggucuuuaagugguguagcaguaagauguguuggcgucagauaaucacugcuuagagacagcugggaagcuaccugcuguaauaguauuuuauugggcuuucuggccaucuaccuuccaaauaagagacacagaaaccugguauuuuuauuuacaagcuguaagccuagacugggcagguucugagcuuuucaaacuuaaucccagccauaggccacuuguuacuugcugcuuaagucucacccagcuugcucuauuccaugugucuucagggcaagcuucucucggccacaugcucauuguccaucuugccuaauggcaaccucuuccuaccucugacuucucuuuucuucucccucauggucucucucugagaccucucacuggauccuaaguccugccuuucugucuugucuagacagucauagaguucagccuuuuauuaaccagucagggacuacugaggaucauucuuuacagcacauugguuaacacuugccuaagucuggguugcagucuggcuuuugugguaaucuccagugggucagaugaguuugacagcaccccuggggccacagcaguauucuaaacgguaggcuuaacauugauacugagcucuuucugaagcaccaguuuauaagaugguuaaauguuuuguuucuucuuuuauguguacaugugugcacucaugugagauuacuuuaugugugcaggagccuguggaggccagaagagggauuggauucucuaggacuagaguaguuuggagcagccauguggguguugggaguugaaugaacaggauaaucacugagccaucucuccagccccuagguauaucuucuuagaaauaacaccauuuguaucuuucaaggacauacaucaguaagguagcacggggugaugaggucagaugagcauggccagugugcuuaguauauuauguuagcuuuccuuauaccucacugaagcaccuuaacuaagggacagagauugcauggcaguagcagaagcccugauggcagggguaggcuauauaguagcuucuuaaguggcacucaccagaaagcacggagcuucuuggggcagaagucaugcugaacuguaacuuucaagacccacaccuaguaggccuacauccaccagccaagccccagguccagaagucuccuaaaacagugccaccaucugcggagcaaguacugaaacccgugaggcugugggaacauugcacagcuaaaucauagcugagugugcccaucuuagacauaaagacaggaagcauccagagcacuggagaugcugaagacagguauguggcuugaaggaacucgccaagugacuacuguuaguguuuggugcauccugaucacaauucugaugcaguguaagacauaguugauacuccauguuuguaucucaggaacaguucucuuacaagaaaacaauccuagcuuuacauuauaauauauuccacuuguuuuguuuccugagaagugcuugcuaaccgcagugccguauguaccccagaauguucuacauaaagcaggaguuacuguaauugcuguuuucucauccucacacaugucacacauauuacagcuggauguauacucuugauugugccauauaugguugguggcauugguaauguaaugcacaaauccuagcaugccguacuuuuuugagcauaguuaauaugauguuugagcugucagugaggcaucagguauaggagaacagagauggaaaauguaaagaacagacaugcuaggcuaguaaggacaaauucauucuggagugggcuacagucuugagaaugaaaccacuugggggaaacagaacagaagugcuugcuucuauucuuauaauaacaauaccugagaaaauuaguguuaaaaggcagagaaauuuuguggcucauaguuauaaaaguucacucugcuccuugcuuuugccauacagggccaauaugcuguggaagggccugacuaauaaagaagacuguguccucguaauguccuaacuuccuuguagcaggcccacuuuaugaagcccugugucauuccaagguauguuggggacagccacauccagacuguauuagcaguaagugagcagacauuacauggagccugauagugaggaaagagucggaggaugguggauauuggaguugucgacagugguugccacuuuaaucaacuggauaugauggccagugagguuuguucuugagucuuaagagcucacucagauucccagaaguucauggaauuagccugcccuucucugguuuccagagaaauaaaccugaagguuaaauaaguccacauagugaugcuuuucagacacacgugaugcugucaggucaugucugacaacauggcaaggauaguauugagagagaugagaugagauauucucuuagacccaggcugacaucacacagaagcgauguacaagaauggcauggaagaggucagugcuuccaguggacaaccuccacuguugguaaagaucccaacugugagcaaaccaugucugaauguauuccagcaugcaaaauaccuugauaaaugcugauucuuuucuggugauaccucauaaaugguuugccuuguugcauacauacuuugagggacaguugcugaccucagucauuuuccaugagagucuuggguuagcuggguguuuuagacucggcagaccuaaauacuacacaaggcaugagccaagcucugcauuauucagugguguuggcuagaaagccauguuggcaccaaguguaucuuucccauugguagcucagguauaguggaaagaugacacuauaccugagagggaguaggucccacacaguguggcuguucccugucauguuaaaaguccaugguguaggacccagcgcccagcagaagacuggcuauuccauuuuggcaaucaaggcauccagcucagagaagcccucucuuaaaccuggcuugucuguagcccuucacuguccucguaaccaggaaagaccucaucaacaggaugcuuugcccagccagucacagugcuccacagaagcucagccagucacagugcuccacagaagcucagccagucgccugcccuucucugguuuccagggaaauaagccuggagguuaaaugcuaaccagggagcuuggguuaacccuguaucugguuaacagcuagaagcagagcacucaucuaaugcagcugacucaguccuggcagcauucguuuccaccgucagagcaccugggcuuuauguauugauagugcaucucagugcaagcucagaguaacugcuuaaugacagucucuccgaauuuagaagacuacaaacccuucucgaaauuacauucacaugauggaguuccuuuacgaguaucuuuaagauagaugguggaauaaggcagagagagguugccaauuggcugugucaugugcuaucauuuugacccauagucugucagcucaaaggaaauauccaugcaugcucauacuguuaaucugcucuaaaaaacugaaguucucucugucuucuucaaaaugggcacauaguuauguuuaucauauuuuguuaucauaauuauguuauccucuaaggugacuuaugaauaggaagguuuugugggggaaaguuuauuacaauuaaucaguuauacacucagacagauggccuaagacccacugcucagaguaggccucagucuuauagcaaacugaugauuuuaaaacauuacuggaggcauuuuagucuugagggcauagccaugagggauagaguauuuagacaagagaaggggcucagggcugugguagcugaggaucauaacuguagaguagcuuaaucaguuguaaauacggguuugagcuucacuaugugcuucgucuguauguuggccuuucuguuuccccuuacgaguuucucucuuuuccuuaauaagaacuuugacuugaaaaauaaaucaucuuauugcuaauuauucaguugcaagaacacuuuuuauagucauauguuucuagauuuuuauugucuuacacauacuaaguaaauucuuauauugacaauuagcuucaaccaaaaccagaaaacuguagagccaaaauauccauuauaggggcaaauggaauuaucauaucuauggcauuauagguguuuuuauucauuuuauugcugaccaguuuuauguaggaauuauuuuaaaucucauuuuauugagaguauucagacaagaacuaggugacaaaucaggaggcacucaauaggacugagugggacaguaggguuucaguaggguugcuuuuuccuacuaagguagaguggaauuaggugacagacugggaguuuauucaacagaggcguaagggcaguagguucagugugcuugugccuacuggaucccuaaaaugagccuugagucuuuuauuguuggccacuuaucaaugacaacucuaucagaugaauagguggcuauuuuauuuaauaaaauaacaauaaagauuuugacuuuuuaaaacaaaucuuaaaugguaucuuaccgaauuuugcaguacucuaaugugcaugcgcaugucauuccaaaguuuugggucuaguuaaauuuguuaccaucacuguuucuguuacuuugcagagagagcuggggaucaagccccaggcuuuccaugugcuaguaggugcuucucauugaccuguaugugcuuccuccacauauuuuauauuucauauaaaacugaaaccaaugaccuaagcucaugugaccaugugucuucagacuccacugcugcaugugagcuguugacaggagacaggagagcauaaaauaaccaagccacccaguauacugguguguugugugggcuuugcacugcauccuguugguccacuuuggccaagccagauuuaauaacuacugugcuuggguauuuuuauuuuaaacuuuuguuuuuauuugaccuucaaugcucuuuuccuguaauaaaguuugcuacaacuggauggcaguguuauuucugggaaucuaagaaaaaguauuaugcuguuguuucauguucaaaaugauucauuugaauaaaauucaagcaugaggacuaagagggugggaggaguucaguugccuagcaugccuggcuggguuuggcucccagcaccacguauaacugaacguuaugguagaagccuguaauccugcacuggagauuucgaggcaggaggaacagacguucaagaccauucuugacaguaugaaacaauaauaaaaacucaucugugaaauaacagacucuuucgaccaaucuauaaguuuauuuuuggcaguaagucauuaaauacucuugguagcuuauuagcacuuuuaaaagcauuuaaggaaacuuacaaauugucucagguucuuuuuuguguaugauaauauacauaaagguuaucucugagcuacaguguaaguggccagcacugcccucaagcucagguuccuccucgucucaggaagcucaccuggggaacuguaacacagaacugccuggcagagcggaaucuucacucugguccuuacuccuuacugccgucuggggcgggggugucucuucacuuaugguaguuacuguuucagggcucuguuucacuguuguguuuagcacaucuucuugcgucuacuaucucugguucucaggaucugugugcauucauaacaacuugacuuuguuagcacaagcucuuuugcugacccaugacugaccucauggaggagcauagaaguauguuaugugcugcagugaauuucucacagcacucgcaaucggauguguauucagucugauauggaagauuaagguuuuucuggaaguaauacaauauuagaguaacuuaccuuggguugguuuugguagguuaaaacuuguuaguccucucuuuauaaguacaguuugcccaggacaaguauuugucucuuaaccauccauauuccaugaauuugugauccuguuucuuuggcccuggcuguuacuuuuuuuuuuuuuuuguugguaucgagugaauguaguuuguuuguuuguuuguuuuuaaagaaagggguuugaaagaagggaggguaggagggacuccaggaaguagcaugcuaccuccugacuucuuguagaacuaggacagcagccagagagccaagccuccaucuccucaugugugaagcugggaauggcauuuaaaagcuuuguuuguuguuguuuuguuuugucaaaucacugagaauacacgaaugaaaaccuggaagcagguaagcaucauuucacaguggauggguuuggugaacgugguucggacuacagguugggaagauguagaauggggcugacaggcaguuguaacgacccagagugagguagcuccuagaguaccaagugcuuuucgugauggaccugaccuugaaguagaggugcuugcugagucacugguucucucugugucuucuaggauaccuacguggagcuaccauggaaaaauccuggaugcuguggagcuucauugaaagauggcuacuggccuuggcguccuggucuugggcucucugccgcaucucucuguuaccuuugauagugacuuuucaucuguauggaggcauugucuuacuuuuguuaauauucguaucaauugcagguaucuuauauaaauuccaagaugucuugcucuacuuuccagaacagccaucuucuucccgccuuuauguucccaugcccacggguauuccccaugaaaacauuuucaucagaaccaaagauggagugcgccugaaucugaucuuggugagauacacuggagacaauucccccuacugcccgaccauaauuuauuuccauggaaaugccggcaacauaggccacagguuaccaaacgcacugcuaaugcuggugaaccucagagugaaucuugugcuuguggauuaccggggguacgggaagagcgaaggagaggccagugaagaagggcuguauuuggauucugaagcugugcuagacuaugucaugacgagacccgaccucgauaagaccaagguuuuccuuuuuggccgcucccugggaggagcaguggccauucacuuggcuucugagaauucucacaggauuucagccaucaugguggagaacacauuccuaagcauaccacacauggccagcacucuauuuucauucuucccaaugcguuaccuuccuuuauggugcuauaaaaauaaguuucuguccuacagaaagaucucccagugcaggaugccuucucucuucaucucuggccucucugaccaguugauuccacccgugaugaugaaacagcucuacgagcucucuccaucccggacuaagagauuagccauuuucccagaugggacgcacaacgacacauggcagugccaaggcuacuucacugcacuagaacaauuuaucaaggaagugaucaagagucauucucccgaagacaugacaaaaacaucauccaaugucaccaucaucugaugccauccucuugauggaugccuuggguuucaauguguggagaaugaugucuuuucuggguguguguucauacuggucugcacagugacucugagcuuugaaaggccucagcacuccauucugaugauccuguaacuuuccaaauuuucagacugggcuucuuaagagugcuugauauucucaucagaacuccagccuagugaaauacccuuaacuuuaguuuaacacgcugguuugauagaugucauccaaaagguucuugcugguuaagugguauaaucuaaguuguacucagauggagauagaaacaagaaaccuucaggugucugucuuuccuuuagugauuauugggacaaucacgguuagcaagcaagugcugcugcguuuucaccuuaaacauuaagaugaagugcaugguggugguuuauucuugacuuaugcaaugcgguauuuuuaauguaaauaacacuggucacaugccaauguauaugguuuccuggguuauaucuauuuuuauguaaacucuauuuuauuucggugaggaaugagugugaggccugugggcagauuccauguucugcugcuacugagauccagcuuuuuccuaauaauaaacaggaccuuuuuccaauauagaugugccguguuuuuguuaggagcugucuggaucguggcuagugagauaggagguuagcaucuuacuacagcuuucuuuguauagugaacuuuuuaacauuagugauuuugguugcagaugaaauuuuagccugucaguuugugaaucuucagcuaaacaauaacagccacagcaagggauagaacuagcugaugguugagugaggauaacucagcacgugugcacacggccuuaugcaauccuuucaucugaaugaagucccaguaccuagaaggugccugaccugacagaggcaagcaucauuuauugaacuguuuggaaguaaauuucagaaugaaagaaaaacaaaaaagcaaauaaccaaguauggcuuaauguugcaguucuguguaaugggcuauauaaagucuuaggggaauuugucagguuuuuuguuuguuuguuugucccagccuauuacacauguagcaguuaaggagcuguaggugggaaguugugagcccuuuaagccuggaagcauuuaguaaccuuccaggcaggagguggaaccugccagguccuuucccacaguccucaccagguagcugugcuugagcccuucacacuaagucagcuccuacccacgacugcagauggcuuggcuguaugauugaccuuccacagcagcuagagcacagugauaaugaggcagucgucucgaccuuaauuuacaacuuuccaggaacauagggcuagaaguacuuuugccaaguagcauucuuagccuucauuuuaugccaauguuuagaaaacaauaauguauagcaaguauaauuucuaaagaauaaugcuuuucuauaaauuauuaauuguaaagagucuuguuuuuuaaagaguugguaacucgccguggaggguguauuuuguauguguaaauucaccacaauuaaaggcugcuuuucaucuugucaaucuuugcuauguagaaugacuauccugaauacuaaucugccgaaagggcaauauguagcaacagccagaauguagacuugagcugccauggcauacuuaguuaguuuuuacauuuacggaguacuguauuggaguccuguuuucauuaaucccuuggccuggaggaguuuaccaauguguugugucaaccacuaaaauggaacaguugcuccuuccuugcuguuugcugcuuucuguucagcuuuugcugacugggacuugugggguggaagaacagcauucaguuguacuaacuugcucuccuagagagaguucuucacuucagcagagacaacuauguuuaaggauguagaacaucucucauuaccagcuauguguuugauaugauuaccuuagaugaguagggauagaaaaccaacucaaacuuuugagggccgugauagaccccgguaucauuucugcaagcucucauuuggucucugaaacaugacuacugcaggaucauuucuucacuucagacucuucauuggugggaauggccauggucugucaaucucuaacucacugagaaaugagagaaauggauaaacuuagaagucuuaaauuccauaguuuaaagaauaauagagugagacuuaagaaaaaagaauuguacagagaauacugcauacuaaaagaagaauguauuuguugcagacuaaaggauacuaauagacuagaaaccacuugacagcaguuugugagguggauggacagaaaacuucagaacacaauuuuagaucaaagcccuaacauaagaugacccuugucagccucauguaacuaucuuaagguuuugacugugaugacacauccauuaaacguugcuguaaaaugggucaugcaacaucuuaaguuggccggauacacuuauggaaggacuagagacacuuaaauguugagacagaucaugguucugguaacaucacuggagugauagcaugugugucccugaaguuaacaccuacugaggcuugcccuucuguuaggcuuggcuugguugugaguagaccugauagagaugauuaaagcuaucuuagauagcuuucacaugggucacauaucagauagcuugcauaucagauauuuacauuauaauucauaacagcaaaauuauauuuaugaagucgcaacaaauaauuuuaugauuggagagucacaacagcaugagggaacuguauuaaagggucacaacauuggcaagguugagagccauugcucuaggccaucauuacauacuugagcccucugauacucucucccucaagccuuuuuccuauuguguuggacaauuauauauuuuaaagagaacuacaaagaaaaauuagucauaaguaacucuuuuggaauguuuacuuaaauuuagguauugucaugugacucagguaaaguuagaauugacacagaacaggggucuauuuuuuagcuugcuagaguagaaaaugcaaaacuauauucucacugcauaugcaccucgcuccccgucaucggaagugcugcugccuuguguguuaggcaggcagucaucuuauucuagucaacauuugccaaugauacagagauaccuccauuuauauuuuguauuuuaaaaaaguagauuaaagauagaacuguauaacccacacuuuuugacaaaaaagugcaauauaaacauauaacgggugugugugcaacaucauuuauaacaauuucuguugguacaagguguucuaaaguucaucuuccauauaggagcauucaguaugaaguaaguuaguccagcuucauaaucugagccauaauuuuguuauugccauacuuucuuugaaauaguaauaaaauuuuauaacucaaaauuuaauguccucuuaacuaugcgcuacccauggcaaggaaacauugugggguuuugugguugguuuugguccagauuuuuuuuuuucuuuuccacauuucucuuaagguauacuuucuauuuuucuguacugacaugcaauaaauugauacaugaacagcuugauuauugucagauaguuuguacucagucuuuuaaaaaauucuauccauguacagucuaccguaggucauuaaguuaucuaaugguucaauaaaaccaugaguuucacugaaag

SEQ ID NO: 4286 - RNA, 4482 nt, Mus musculus
gugcgcgauguguuacucacugugcggcggggaccgcgacaagcccgggucgucguugguggcagcagcagcagcggcagcaacggcagcagcggccccaguggcagugugggccccgaguguccggacgcagaccgucgucgcgcagugcagaacgguggcagcagacgggccgcgcgcguucuaagcucggccccgcgacucggggaccccgacucucgacccagccagccaguccccgggcgccgcccgagagcccgggaagcagcggcagcggacagucgaagcggggggguggccaucgcccgcaccgagcauccuucggagcggcggagggcccugcgccaccgagccgcgcgcgccuccuagcccaccgccugggcccgggggacgcgcgcgcguggccgggcggccgggcgacggguggcggggagccgcccccgcccgcgccccucggcccucgccauccccuguucgcccagccgggcagagagaccugaagcggcggcgauggcuagcgcgccccugccugggccccccgcgucggcgggcggggacggcccgaaccucaauaacaacaacaacaacaacaaccacagcgugcgcaagugcggcuaccugcgcaagcagaagcacggccacaagcgcuuuuucguguugcgcggccccggcacgggcggcgacgaggcauccgcggcuggggggucgccgccgcagccuccgcggcuggaguacuacgagagcgagaagaaguggaggagcaaggcgggcgcgccgaagcgagugaucgcgcucgacugcugucugaacaucaacaagcgcgcggacgccaagcacaaguaccugaucgcccucuacaccaaggacgaguacuucgcuguagcggcggagaacgagcaggagcaggagggcugguaccgcgcacucaccgacuuggucagcgaaggccgcucuggcgaggggggcucgggcaccaccggaggcucuugcagcgccucucucccgggcguccugggcggcucagcgggcgccgcuggcugcgaugacaacuacgggcucgugacacccgccacggccgucuaccgcgagguguggcaggugaaccugaaaccuaagggacugggccagagcaagaaccugacugguguauaccgccuaugccugucugcgcgcaccaucggcuucgugaagcucaauugcgaacagccgucggugacgcugcagcuuaugaacauucgccgcugcggccacucggacagcuucuucuucaucgaggugggccguucggccgucaccggucccggggagcuguggaugcaagccgacgacucggugguggcgcagaacauccaugagaccauccuagaagcuaugaaggcacucaaagagcucuucgaguuccggccucgcagcaagagucagucguccgggucgucagccacgcaucccaucagcgugccgggcgcgcgccgccaccaccaccuagucaaccuacccccuagccagaccggccuggugcgccgcucgcgcacugacagccuggcggccacccccccagcagccaagugcacuucgugccggguucguacggccagcgagggcgacggcggcgcggcaggcggggccgggacggcaggaggcaggccgaugucgguggcagggagcccccugagucccgggccggugcgcgcgccccuuagccgcucgcacacccugagcgccggcugcggaggccgcccgagcaaagugacucuggcgccggcagggggagcccugcaacacagccgcuccauguccaugcccguggcgcacucaccuccugcagccaccagcccaggcagccuguccuccagcagugggcacggcucgggcuccuacccgcugccaccuggcucccacccgcaccugccucauccacugcaucacccccaaggccagcguccguccagcgguagugccuccgccucgggcucccccagcgacccggguuucaugucccuugacgaguauggcuccagcccuggcgaccugagagccuucaguagccacaggagcaacacacccgagucaauagcggagaccccgccagccagagauggcagugggggcgaacucuauggguacaugagcauggauagaccccugagccacuguggccgcccuuaccguagggucucaggggauggggcccaggaccuggauagaggacugaggaagaggacuuauucccuaaccacgccugccaggcagcggcagguaccucagccuuccucugccucucuagaugaauacacucucaugagggccaccuucucugguaguucaggucgccucugcccauccuucccugcguccucucccaaaguggccuacaacccuuacccagaggacuauggagacauugagauugguucucacaagaguuccagcaguaaccugggggcagaugauggcuacaugcccaugaccccuggggcagcccuuaggagugguggucccaauagcugcaagagcgaugacuacaugcccaugagccccacaagcgugucugcucccaagcagauccugcagccacgcuuggcagcggccuugcccccuuccggagcagccgugccagcacccccuucaggggugggcaggaccuucccaguaaacggagguggcuacaaagccagcuccccagcggagagcuccccagaagacaguggguacaugcgaaugugguguggcuccaagcugucuauggagaacccagacccuaagcuacuccccaacggggacuaccucaacaugucccccagcgaggcaggcacugcagggaccccaccugacuucucagcagcuuugcguggaggcagugaaggccucaaaggcaucccgggccacugcuacagcucuuugccccgcucuuauaaggcucccuguuccugcagcggagacaaugaccaguaugugcucaugagcuccccugugggccggaucuuggaagaggagagacuggagccccaggccaccccaggggcuggcaccuuuggggcagcuggugguagucauacccagccucaucacucagcagugccuuccuccaugaggccgagugccaucgguggccgcccugagggcuuccugggccagcgaugucgggcagugcggccuacacgccuaucgcuagagggacugcagacccuucccagcaugcaagaguacccucuacccacagagcccaagagcccuggcgaguacaucaacauugacuuuggugaggcagguacccgucugucuccgccugcccccccacuacuggcauccgcggccucaucuucuucacugcucucagcuaguaguccugcuucaucccuggguucaggaaccccaggcaccagcagcgacagccggcagcgcucuccacucucugacuauaugaaccuggacuucaguucucccaagucccccaagccuagcacccgcaguggggacacaguaggcuccauggauggccuucucucuccagaggcuucauccccauacccaccacugcccccacguccuuccacuuccccuuccuccuuacagcagccucugccaccugccccgggagaccuauaccgccugccuccagcaucagcugccacuucccagggucccacugcuggcuccucaauguccuccgagccuggggauaauggugacuauaccgagauggccuuugguguggcugcaaccccgccacaaccuaucguggcaccuccaaagccagaaggugcccgaguggccagucccacaucgggcuugaagcggcuaagucucauggaucagguaucugggguggaggcuuuccuucaagucagccagcccccugacccccaccggggugcuaaggucauccgugcagacccacaggggggacgucgucgccacaguucagagaccuuuuccucuaccaccaccgucaccccaguguccccauccuuugcccacaauuccaagcgccacaauucggccucuguggaaaaugucucacucaggaaaagcagugaaggcagcaguacccugggaggaggugaugagccgcccacauccccaggacaggcacagcccuugguggcugugcccccagugccacaggcuaggccguggaaccccggucagcccggagcuuugauuggcuguccuggaggcagcaguucucccaugcgcagagagaccuccguggguuuccagaacggccucaacuauaucgccaucgaugugagaggcgagcagggguccuuggcgcagucucagccgcagccaggagacaagaacuccuggagccggacccguagccuuggggggcuccucggcaccgucggaggcucuggcgccagcggaguguguggggguccaggcacuggagcuuugcccucugccagcaccuaugcaagcaucgacuuccugucccaucacuugaaggaagccacagucgugaaaggugaggcccuu

SEQ ID NO: 4287 - RNA, 821 nt, Mus musculus
caaggaaggugugugacagugaccccauugagauggaugcccaacacugagauagcauggccucacaucaaccugucaucugacacuugguguaucugucaagaaccaagaaguugcagauucccugaccauuccccacgucucuggugucugcaauggcuugcuccacucucugcccacugcucuuuauccaccagaaccuguccugcaaucugccauuucuucuucucggucaccuugggacauggcugucuugcagagggacagcucagcugccuaugcauauuaggcaucagacaaccacuggggaggccuugcaagauaaucucuucauggugggguauguccgucaaccgugccacccaccacuucaucugccuggaaagcccuuugccuuucuccuccacuagauccucuuccguguggaguucucucggcaaugcugugagcuauuugcugguacuuaaggugacggacugugaauagcagaaaagagaaaaaagaagcugcugucaaagcaaauucauuauuaauguuugaucguuuuccuggcuucgucccagcuguucagcacagagcugugaggauguggcuguguuugccuggugccuggggaggccaugcaggcagaugcuuaccucuuucuagaagacagacagcuugacuuggagagccauuccccuugcugagcccagggagggaaggagggagacaaggcuggagaaggucucugcgcuagcuucuuaucugugaugagucagcuguaagagacuacuuaggggaggaagguuucauuuugguucucagcggcugagaaguug

SEQ ID NO: 4288 - RNA, 16751 nt, Mus musculus
uuacuuuuggaauggcgucuaugcuggucuugacuugguugaagacacaggcccagggaaacugugugucucauucuuuucuccaugggcauuugucuucacaaaguuccuguucugugagcacaccugagauguauaccuaaaauuuggcauuucaggguucuuuaugucccugcagcuugaggggcccuucaggucucacccagccacacaggcaucucuaauucccuguuguagggauguggccuccucccugggcugagaguuacuuuagcuugaugguuuccagcaaugucucaggacuuccaggucccuucucuccugugggaagacccaaaagcuuaauuuuagaaacauugacauaaaucuuuccuuuugaguuuugagccgaagagaugucagcugcuuucuuuauccuguuggcuacaauuucuaaguacuuucuacagacaggaguggccauaaagccacaauuccaucaccugagagaaaugaccgguggucagagcggaagggaauuugugauggccugggcugugacacuaaccacagcuguccuucucuuuggccugccccuccucuccccccuagcaccaaagcauccugggaagaagggcacuuuauuucccaugccugaaaggcagaaggcagcagauggacaaggccauuucaauuucaguggcugguguuuaauggaaccuuuuaguucaucuacauuuaugugacuaaaguagagagagugugugugcaugcauacacacacacacacagacacaugcacacacagacagacagaagcacauacacauaugugugcauguccacacagacagacacacacagagacagacagacagacagacagacacacacacacacacacacacauacgcacgcacgaaugcacagcacagaaaauggaaugacuaaucuagccgcccgcccacccacuuccuguccacgcaugcagaacuuguguaauuauucacacguuuguacucauuuagcagcguggcuaacacucucuucacucugugacuggaauguaauuauuuugcugcugcuguuuguguuuuuaagcagugcacucccccaccauccaguacucccuuacuugagugagcuuuagaacacccgaccacgcugugguuuucacucacucuggggugacuugucauggcugggcuugagcuagccugucccaggagggacuuuguccucaggaggggccagaacagugauucccucugccacgguuaugacgaucccauuguuccucuuauagaauaguuuaaaaaaaaaucaacugcuuuugaauugaauguuuuaggagugagacgggcuuguacaaccaaagaggagucccugagccugaguccuggcacuggccacauuauuuauucacuuagauuugagccagagaaccagggagagagggcaagggaugggucauccccaggaccauccacacggaaugccugcuuccucucuuccaggugugcgguuugugaagcaccggccauggugauggcgguacacagucagaccauucagauuccgcagugcccuaacgguugguccucacuguggaucggcuauuccuucgugauggugaguguuugggagacuacauuuccuugggagggcccccauugaugucguuaucuccucuaugacuccaaacuucccagaucaucccuuguugaauguaacuuggagccuggucuguugcucuugcggucuacagugcgcccagggcucccugcuccucuguguugggagcugcugccucccaugagcagggagcgccuagaguguggacuagaguguggacuagaguguggacuagaguguggacuagaguguggacucuccguagucaugugaccagcacccgcagccugaccagcucccuccuguauuguuaacacacaggagcuuuaaagcagagagcacucgaugggugggaacauggguaccccuguaagcuuacacugcuccugccaaaaugguggccaggagaaugauccucccaggcuaauacccaggaugcaccugggcagugagguacgcucuucuaucaccuggcugguuuuggauguuuguuggcuccuuguaaccuuuccuuuaaaaagccaguuauggcaggggcgauucccugugugaggagcucauuguggcuucuuugguuuuaucaucaugcugaaaaguauggacugagugcccacaaguccugaacuaguaagaaaacggggaggaauuuaccaacuucaaguaagcauucuaagcagacaucuuuaaaauucucgggcagaaccaauuuguucaucugaccugcaaacugauguuaguauuugauaggaaaagggcuuccuaauuauuuucuaagaaagcugggugcuccccucucagugggaggagcuggugucugguuucugggauugcguagaggccugagugucccagccuggccagcagaccuggaugguggacuaccauggcuguugagcaguuuuuuuuuuuuuuuuuggcucaaagucugugagccugggaugacuaggagggaccuggaaccuucccgaggaggcauccuggcuccuuccuagggacgaugaaucucucuuuggguuugggugauaaaaccucagacucaugccuuaugcuugucccacagcacaccagcgcuggugcugaagguuccggccaagcccucgcaucccccggguccugucuggaagaguuuagaagcgccccauucaucgagugccacggcagaggaacgugcaauuacuacgcaaaugcuuacagcuuuuggcucgccaccauagagagaagcgagauguucaagugaguuagacauggagggcucuggccuccuggcagcccuuucucuuuuguuuccuauaacccaccaaauaggagucuguucugagagggcagaugacccggaugauuuucaaaggugauccgaggugauaggcuccauucuuccauuugcuggggagcugagaaagaaaagaggucauuugccauuuguagaugaaugugcuaaaauguuauagaaagcagcugaaaucuucaaaaggcuugugaaacauuguauccuuaauagccagcggggagggcuguguggcuccucucuguagcauuuacauaaggugugcaggauaugugaacuaaggaacuuaacaaaagacguuucuuucagcacaaauaucacugaaauaauaggcaagucuuuccuuucuugucccuucccauuucuaagauucauuugagagcaaugagcccagagaugcuggcuuuguugaaguuauuuugguccaccuccaauggucaggagcauguuggcugauggggcaggaggagcuucuuacugcuccugcccagacauggccacucucuccugcagacaauccucucugucuucucuguuuuggaggcugccgugaggaauucugcagcuauccuguuuuucagaucaggucauuugcuaaacaucccaaaguaucaugugcucaacagcuaggauaugggaaauugucagaugcagcauuagcaaacagucuaguuuaguuauggaaauuagagucugcuccuuaccccucagccggggcuggggugggcuucguuauaagguuaauagccgaaaaugggauuuuugcuuggaaccagcagccugguauaaugaaccaaacugccuccuuaaacagaauuagauuuuuuuucccuuaaagcuggaauuuguaauggaauuuguaggguaagcuccuucaaguucaggacaagauguucuuccauguggugagcgaccucaacguuuaguuggauuugauaaguaccaaucagaggugagaauucaccuugcuaaugacuaaaauaaggaucaagacgagucucagcugcucagugucucccccucucucuggccucaccucaggccauguguauugaaacacucccaggguuaugaacaggguuugagugucagcucauuacuccagguuuaccacuuacccuaccauccaaugaaauguaaggaacacucacugucaaauauuguggagaaaaauaauguucuuccauacccugggaaggcucuaaucuauuagagacaaugaaaagcuaauuauaggacuagagacauggcucagugguuaagagcacugauugcucuuccagaggcccugaguucaauucucagcaaccacauuguuucacaaccaucuguaacgggaucugaugcacucuccugcuguguaucugaagauaguuacagugugcuuguauaaagaaaaauaaauaaauuaauaaaaauacauauuucuuaaaaaaaaaaaaagaaaagcuaauuaguccuauggcugagaggugugaucuuggcugggcuccggugggcucgugcauguagguaaugucuaaaacauucccauguuguagaaccacagaccccaguugcuguuuaucaucaauguagacggauguuuaucuggucccuuagggaucauagggcucuggagcuggggcuacagaauuucugauucuguaagcaccugcauuucugaugcuccaugacucgcuguugcugcugcugcugacgguguaacucuguuguguugcaggaagcccacgccauccaccuugaaggcaggggagcugcgaacacacgucagccgcugccaagugugcaugagaagaacauaacuaugaugcucgccucugccaccgucacaacauggugcuacuccccccccuuguccucuucucccucccauuguauuuguaacagcaaugaacccuagaauuauauccuguguaccucacuguccacuaugaaaaccauaaagugccuuauagggauucgcguaacuaacacaccccgcuucguuggccucuguuugcugaaggagaaggacaggcagcggagagcuuuccauaauggcacauaccaaauggcgcuccugauccaauaaaagaugaauugcauuuugcaauccagugcacugaugucuggggcgagaacuccauaagaaacccaaaggugcuaggggcgugaggcgcucuccacacagcccacagcccgcuucauccugucaccccagaugugagugcuguccaacccacuguccaguguuuccacaucaggucccucgaggggcuaugcagagaacagucaagggaacugguuucuuccacuuucuacauggaacuccaucguuucagccccaaacacaaacuuaugcccugugugguacuaugcagcugcuuuuguggaagucauggcuuuccuguggaauaaagaugguccaaagguuagauggaaaauaaauaaauaaguaaauaaauauauauauauauuaguaauuuauauaggugucagcaauuaggcaggucaaguucuagcguagagccuguuguuaaauaaagcgcacuugguuuucgucucuggagaaacuguacuauccuuucacaggguuaccaacaucaggccacugaaugugaaacaccagcuuuccucaaacucacuccuaaaccagaggagguguauagauagccaaagccaaacccauuccuaaacauggugucugauaaugagcccugugccuggcgcuucuugcuucugcucugcguggaguauuuucaggguuugcaacacuaaccacagacugaaugacugacuucccguacgacagccaaggccuuuguuagccuccuucauccugcauccuggcaggcauuucacaccugagcacacacaggcaacuucccagcuccucucgagcugugacacagccccugcagggaguggacaggucgcaggagggcagacucggaccacuaugcuugaagugacauuucacuaaaaguacccacccuccaaaaaaaaaaaaaaaaguuuuuaagacuacuaaggccuucuguguaauuucuuuaaauguguauuucuuaagaauucaaauuuguaauaaaacuauuuguauaaaaaugaagcuuuuauggauuuguugcuagaaaugaaacguugaaagagaaguuaccacacguaccacuaauaaaccuguaagcuuugcugcauaccuuagaucauuuuuauuuuguauguguucaaacaagaguccuagacuggggguaacuuagggcgacuaacuacaaaggaagagaacccugccauacuuucacugcauugucagcccaggcauuccuuagucaccaggccagcagagugacauugaaauuggaucugucaggccuuagcccauuucugcagcagagaggacaagggcauggggcugcauucagacucaacugagauacucagcucagaugugugcuggagagguggcucagucagagaguguacauuuggauuuccaggaugcacggaaaaagucaagugcgguggcccaugccaguggcuguggcaaugggggccugggcagggagggcugagacacucagaucccuggcccuugcuuaccagccugucuggcugaguuggggaguuccagguucaaugacaguuucccagaaaauaagagugauucaggaagacccugaacauugacuucauguuguacacacgaaccugucuccaugcaugcacauaaaagaugguauacacaaacauacacauacauguacaaaaagaagauauugucuguguguguguguguggggggggagauuuaagcuuugguaauuuuguuuguuauucgagacauugucuuacuacauaaaccaaccagcuggcuggucuggaauucucuguguagaucaggcugacuucagacugguagagacccaccuaccaccucugccucccagggcuuggauuaaaggugugugucaccacacccagcaagcuucaguuuuaaacucgguugaaauacaguccaugugggauggauauguuuuucaguuuucaugaaaagucuaacuguugacauguccuuggcgaauucaacccagcacagccacagugaggaugaaucaggguaauguaugagcgagcgagcgaccuuuaugcgcaaggaagaagcaagagcaugagggaacauugugugagauaacacaggagaucccgcuguggacgcuacgcacggugcccugaaugcucacauuacuaggccaaggucacagagggaggucugauuuugguccucugcucacuuuugacguaacugauagacagcacucuuugugcuuuccucugucugugagaauggagaagacaaauaauaggauucaugggaccauaaccaaaacccucugcaguuaugucacccccccccaauccagguucuuacagcgccguggcguucucagucucucccccuccucccucuacucucagaagugaaacaaucuuggacauguuugucaaaaaucagcugcaucuagaugugugggacauacaagcaguuuaguuuuuaaaagauuaggugugccuuuaacacaugauuacguuacauguggguaucuguucucagauaccuugagagagaggucauuguuucuuuucucuucuuuucuuuucuuucuuucuuucuuucuuucuuucuuucuuucuuucuuucuuucuuucuuucuuucuuccuuccuuccuuccuuccuuccucucucucucucucucucucucucucucucucucucucuuucuuuuuagacuuauuuauuaauuuauuuuauaucuaaguacacuaaagcugucuucagacacaccagaagggggcaucagaucuuauuacaggugguugugagccaccaugugguuguugggauuugaacucaggaccuuuggaagagcaguccgugcuccuaaccacugagccaucucuuuagcccgaggucauguuucuuuacugaguucauuuuguaucuguaauuuaauuggcucuaagugugagcuuaucuuagggauucccuaguuucacccaccuaccaguggcuccacuuuccauaccaagcugucuugauuuagcuuaaaaguaaccuuuuuaaaaaaaauguauguauaugaguguucuguuugcaugucuguacauuggucgugugucuaugcagauagacaguuuuuacauuuccacgauaaaguccacucagucacaguguguuauucuuuuuaugcaucaaacauuuugguugcuauuuuaaaacuacuuuuuuugugugaauuucacaccauguaccucagucccauucaucucccuguucccugguacccacccuucacccuugcaaccucccugccaaaagaaaaaagaucuuguggaaaucuuagugugucacacaguauguccuuuugucuacacuuugcuugcaaauguucacuuccuugagucuggucugaggcuucuggauucugcgacucuaucaauacuggaacccucugagacuccucuuggaguccuguuguugcccugugucauggagauccuauaguuuuggaucuguaggacugccccuucauaaacuccagcaguucaucugugggguagaugcuggggugggcugauuuaaaguccuggaucugggccugggagguagcugaguuggccagccugcaagcucuccaucucugccccugcuaggucauccaauggcagcaaggggcagaaccagcucucugcuuucaugcccucagggacugcucauccacgcccacaccaucagggccagcucuacuguccugcccaggugaggugaugagccugcuuuccuaaguguggcagcugugugaggaaugaggccagcucucucaccuggcauagguggcaaaggaugagguggggggccuuucugccucauguucaccucuguacagcagacauguugugggcccagcucuccuacacugaaacccucagggccagcucgccagugccccugccaccaggaucagcucuauugugacccaagcaaggugcagggcccauucucccgauugcugcagccggugacaggcagggacagcucuccugaucucaugccccagggacagcucaugaugcccuaacaaggggugggggcugauucugcacaguccccagacaucaagauggccccagguaguggcucagaccagagacaucagacuggccuuuggugguugcagacuccugcugcugcagggccauggaccgaccccagacauggcucuugauggcagcacaggccagaaccgccaccaugguggcgucaccagcuacucacaucaggcuguuccucacucacucaagucuccaauucugccucucuucauggugcccacauccuccuguuucucucuuucccaucucucugccacugacuugcuccucuuagcagugccuguggugucugagugucugugauugucucaggauuggucucaggagugcuaugccccaccugugcagugugguaccaggcagggguccuuuugggugucgucugccuaucuaggccuuccugguuacucuggacuggugaucaucuuggguugacucgcugcuugggccacauggccccagguuggaaucaucuccuuguuugcuaauauuuuauuaaauacuuuuuguguacgcaaguuaggaaagcugcuuuuagucuuuuuguguguugccauggucugguuaaauuuguuguuguuauguuauguacauguaugugcacauaccuuggcaugcauacagaaggacaacuugaagaacgggcuuuccuuuucccgugugggguucugggaauugaacccaggcugagaggcuugguagcaagcgccuuuacccacugagccaucucgccagcccuugguccaguuuauguaucagggaacgccauguacaaaacaugggcagcacaacauucugccuuuuguuuucuggaaaagaucaagcaagacugaugccgugucaucuuugaauguucagaagaucuugccaagggaaccgucugagucuacaaaugucuuuuuugaaagcuuuccaauggcaaauucaguuuuaaaugguugcaggauaaucugggcucucugguaaucuuggacaggaccgggaggcuuccugucaugaccaguuccuccugaguuacugauccccacaccggcauguugugguggcaacagugguggccuuuacuuauuccccaauauuagaaauuaucaucuucaucguuuucuuuguugguaucuguuagcauuuggucuaggcucugccccacaguuaccuggcaacagacaggugugccgacucaguauaaaaggggcugcuugacccucuuccuugcucucuuacucucuucccccucuggcuucucuccccaccccccuccccacccccccucaccaugugcuuauaggcagccucucuuccucaccuccucccccuccucuccccuccuccuccccuucucucccuccucccccuccuccuccuuucucuucuucccccucucucucugucucugucucuguuucugccuuucucugucucuacuaccccuucaauacccccaugcccuaaauaaacucuauucuauacuauacagugcucccucaggggauaggaugccucagcacgggcccacagagggagccccuucccccacaccauacagcgccuccaccaaacacaucccuggcuuugcucucucucucucucucucucucucucucucucucucucucucucucucucucucucucauucuucuuccuuccuuuuauaaaacacaacaguaacuauguugauuuuucuuuuuucuuuuugauugauuuauuuuauauauaugaguacacugaagcugucuucagacagaccagaagagggcaucaaaucccccauugcagaugguugugagccaccauguaguugcugagaauugaacucaggaccucuggaaaagcagucagugcucuuaaccacugagccaucucuccagcccccuauauugauuuuccagugaaucgguuuuuguuguuguuucguggauuuuuuucucugcuuccaauuucauugaucugcaaggcccaguggcacaugacuguuaaucccaaugccacggaggcugagguagggggaucaugagcucagguccugcuggaguuacggagugagcucuugauuugaaauauuuuucuuugaauuuuucuccugccuuuauaauuuccuuucgugucuuugcuuugcauuuauucugccccccuuuucuaacuucguacacuggaagccuguuugagacuuccugcuuucauauacgugcuggucguccaaaauacuuuuccguguguagacuagcugcgucccaucgcuugauuccauuuacauucagucuaaaguaauagcucguuuacuuugaucuauggucuaucuggaauguguuguuugucucucagccugguggggucgguccccugugggaguucuuguuuuaguaucugguuucaucaugauuucauucugaccacagaauaaacaacuccugacuuccaugguuuugcaaauauauguucaagcuccuuuuauaacucaggguauguccuuucuugguaaacuuccuuuguguaacugaagauauggguccaauuaguguuggauacauacagcccuguguguucuuuacccggcauuugcaucaugucuguagaggagagauggagucuccagagggcugcucuuuaucuuuucuugcagcugaagcaguuccuacucucucugaccagcucagugcaaggcaugcccacucucgaugucuccugucucucugaugagcugacuuuucuccuggcuccaggcacggagucacgucucaucacuguucaauuuugaaacagcuauuucuuuggauugguguuuuaccagugugguguuucuggguuauuuuuuguuuuaauucugacaauacaauugcauuugaagugagauuuuuguagacaacauauggcuguaucauguuuuccaaaucuguucuggcaaucuccuucuuaacugaugugauagacugcauucauguuuaauuauuguuauauuuggauuugugucucaguuuuuguuuacuuuuuauuugcuaccccugagauuuaguucuucucuccuguuuugugugugugugugugugugugugugugugugugugugugugacauuuccagcaugcuguuuuaacccaccuucugcggcuugucauguugacauauuuuuaaaacagaaguaaagaauaguugaauuugguuugaguuugguuugaggcaggacugcauuauguauuccaggcuggccuagaacucaacaugugguggagaaucgccucaaauuugcagcaauucuucugccucagcuuccaaggugcuacgauugcaggagugaccuccagaauaauuuaaaauuugcgggauauuucucacuuuuguuuucucccuucauuccaaauauuuauuucuagaaccgacaugcuugguggcucaagaacuuccuuuagagcaagcaggucugcagggcaggaugagucugguuucuugucagcugaaaauguccuuacugcguguuccuggaagauugcauugugacaucucguuccucucagucauuccccacugccauuuccuucccuucgucugggccccgcgucaggcgagacccugcaaucuuccaggcgcucacccucagaagagcacaaugcucccuggcuuccuguacuguuccuugcugacucugcucaguuuucccauaauugaucacacuacaccuugauacggaucuggucucuuugagcuucugaauccauagguuugugccuuucuucugugucgaagccuuucugcucuuggucaugggagcccaguugcugggguagguuccaggcugcacuuucugcuccgcgugugggguguauguugaugccuggucgccuuuggcagugcuguccaggucuguccugagagagcuaaucuagaggaaagcuuacuagauccuaguuguggagccucaucugcugggcccaggugagguccuuguucaugacauggcuaacgacaguguauggaaguaugcuugaugggggaaggcacagggugagacaggaggccagagaagcaaacaugacaccgguucuucaaauaacagcccauucuuuuggcagcuaaaucaguccaauagauguacaucgauuccuucuuugaugcaauuaccuucugcuucuggccuccuuuccaagacuuuaccaccucccaucaccaccacauuugaggacugagcaaccuagcaccaccauauuugaggacugagcaaccuagcaccaccacauuugaggacugagcauccuagcaccaccacauuugaagaccaaacaucucaacauaaccacacuugaggacagacagaguauccuagcaccaccacauuugaggacuuagcauccaauuuucccuggagaaaaucucugucuaaaccauagcagauuugagucauucacauuccggacaucuacuggccaguccaugcaugcaugugaaggaagggaugcagaugaaaucagcuuucaaaauagggugaugugugaaacuggagcaaauggcugaacuuuugcccuucuguucugaaaggaugcuuuuauuuaaugugugugugugcacgagcacgcauguguuaauucagagaccggaagagggcauugaauacccucuuucacucuccaccuauccguuugaggugaggucucauucuccaccggucacuguguuuguuuagcuagacuggaaacccacgagucccagcaauccuacuuucucuguacugaugggaugccuggcuuguucuaugggaacugggauuugaauucuaguccucaugacuguguggcaagcacucuuaaccacugaacuuucuacccuacuaaaacuccccacuccucucuaaugcucgagagcacugcgcgucccugauuuaguuggcgacucugccagggcucuucuaucuccacgugacugcuggcucuccuggagcagcugucuguuguggauaucacuacacacaacacguauucucugcguuaacugggggcccugucagcuucauaccagaucccucaacuccuuagaucaccugcucaucucgugucugacuccaaaggccacuguguuguagucagggcacuagaacaauugcuauuuagauacaagucuuacagguugugggcacaucaccgaaacggugugcuugccuggaaagaguauuccaucccuuguacugagaggaaauagauucuggcucugccacauauaaacuauagaagaggcuggggaucugcacgauuuaggucauuuuuuuuuuuauuugaaguuuuuccaaaccaaaaucguaaguugggaggaaucuacaggaagagaaaagcuagcccgacugcgcucccucaucuagccuuucugcacucugccuccauccugugcuucaguccuuccucccacccaucuacccggcacccaccuacccagccauuaucuaccuccucuacccauggcuccucccacccacggcuccucccacccacggcuccucccacccacggcuccucccauacauuccucauccaucccucucuucuucugucuguuuuaucgucagcauaaacacucgcuguguuuuagguaugaggaacagggggacuaaagaacacccguccuuuacagugcuccguguaagaagcaagucaucggagaacaagcuuacgacccgucagaugugaaaauuaggucgaaauuaaaaguacaguuaugcaacaggaagagauagaccagaggguuggguugggaaugaaaucaaacacuugccuacuucacaguguccccacgaagaggaaaagagaaaagaggguuagcugaggauuacauccgggcucuuccuucacaccagccugaacuacauucugcaucuuuuuuuuuuuuuuuacaaguuuaucaaaauggcuuugagacgauucuguuguuuguccucacuuguaguugaaugauuuacucugauuugauuccuacaaugcaaagcugcauuucaugcucuuggauuuaagauggccuuaccacaauaguucaagugcuucaaacugggcccaguuugaggguuuuguaguccucggccuucgaaauuccagaucugagagauccacaggugacacuuggagccccuuguccuuauuuucaugaucaaguuacuugcauuuggggggcuauuccgauguuggcuugagagaagaaaauuacacuuguguguguguguccccaguuaaucuaauguucaauuuggcauccucuuaguuuacaaaguaguaacuccccccccccccuuacaaaguccaggucacauggauuugggaugugugugugugugugccugccagagagagagagagagagagagagagagagagagagagagagagagagagagagagagagagagaaauggugacccauugagagguauccacuuugcacuugaauuuagguaucucaaguucccucuucuuuuucccuacaaaucacacccaagauaaaguuuuuuuguuuuguuuuguuuuguuuuguuuuguuuugauacauuaggagaaaaacuccuccccauccuccauccucuggaaagcaaauuuuccuaucuaugccgcauagccgcauagauggcagcauagcaucugugggugcugguguggaaggcucccugggcucugaacugcaauggaaaacagcccuuugauccucucugagccaugguaucgauuguuaggcugcuccauucuggaagauucagacuccaaggcggugggagccaagcucugcggguggagggcaggcagcaucccagacauuuccuccccccucccccccccacuguugugaggagagcugcgggcuaguucagugccuugugggcucacacagcucuuaccaguuccuugcuggcccucaggacucauaaguuguaacuguagcccaggaacaggacagcugagcuacccagucaccucuggaguuugcauccaagcuccaagggcuugaaggggugggggugggggcucuagaguguggaucgcaauucccacgcgggggaaugggucacuuguggcacuugccgcagggacaugucccgggacgaagucuccugugaccacauggcacaggauauugagaagagcguguucauugggggacaguggccuguccuuggggaagcacaggaacaaaugcgcgcguggggacccaguggccugcgcgcuuuugaacagggguucacgguggcgcggaucugcagccccgcgagcguugugucgcagcugagucaccuccccgcaucccccgcguggggagcucuuccucuuacaccccacuuugagcuuccugagcugcgcgggcucgcgaggaccauccaccgccucacccggaauagcggugcacacccgcaccaccgcgcacuugcggcgcugagucaccgggaaacugagucacccucccgccaccaggaaauaccuuuuuuagacugccagucugagcgggguugcgggugacuucggagauucgguuccugcugaucaucaacuucccgcggaggcgugcaggccuguuuuccauuuucccacgcgauucccuuggcuuguugcugcgggcaaguuuggcacagcguguaccuggacgcccugcggggaccagccagcuugcggaugcaguugggaacuuagggcggucgcuaugcgaucaucacaucccagugaugguccuuacacaccgaugacca

SEQ ID NO: 4289 - RNA, 114406 nt, Mus musculus
cuuggagacgccgcccgcgcacugccgaggggagggggcagcgccaacaaauuggggagcuccucgggcggcgcgcucaggucucugcgcagagucaccgcacccgggacggugagcagggcucacgcccgggcccuccgagacugagcaccucgccguggcccacgggaacugggcugcauuuccccgccgucucugcugguccccugccgccccgggcgcgccaccauggggccccggcucagcgucuggcuucugcugcucuucgccgcccuucugcuccacgaggagcgcagccgagcagcugcgaaggugaguucccugcgggcugcgcuccccagccucccucccugcaccccugacgccccgcgaggccucuuuguccagcgccuggcgcagucaagccgccuggcccucgaggguaccgcggguggcacggccaggugcauucuucccccgggucucccucuccuagucccugugggcagcgaucgcacauccauuacggaaccuccuuuguuauacacugggugcgggagaguuaggaagggacugaagcuuagcguguaccacggcggggugaggguaccgaggagccagugagauuugaacccucaucgccaaggcucucagcggcggggcgcgcgagugggucggggcuggaaggguggccaggcacaccccacgccacucagaguccuacacucaugugcagggggaaccgcuuuggguguguuucugguuguuuggagaccgugaugguugaggcugaacagcuuugggccguuugccuggaaacaucuguauuuuugcuuucccacgacuuuuguguagccuacggcacgcuugagaacagacgcggggcucuucuccgcauccuaaaagucucugccucgacucuugccuuuuaugagugcgugccugaaaauuauaaccacauuuagacuugagugugaaaccaaagcgaaacuccgucgcauuguucccugcgcaaauuguuuuuuuuaaguuuuuguuuccucuggugcugugcuuggccaggagggcgcugggagauguuugcaagagccagacuuccagcucuggaggaacccggccagacuuucugccuucgccccuagagaauacacuucagcugcugcugcugcugugacagccaugcaggcccaaaggccacaagguguggccucuccacaguuugccuuccccucaaaugccuaaaaaacgacguuugcuucucaccgaagcuuccaaguuuuaaaagaaaccguugcuuaauugugcauuuuccuuuccuuuuaagaauuucaccucuuuccugcaggagcgauacugaucaacuaugcuauaaauuauuaacuguuacauacuagaauaaacugguaacguuacuagggguuuucuuaauuggguuuugccucccuuucugaagaaggaugauuaauuacaucagcaaccaacuucagagaguucccuccucuccagucuucaccuucaccgcagguagccuuuuaacuacccauucucuugcugaggguaguuucucaaaagagcaggcuugauaggcuggaccugcuggcggugcaggucuuguaguucuugcuucuuggacacccgaagcagggggaucucaaguucaaggcuagccugggcaacagaaugaguucaaggcuagcccaggcaacauagggagacucucgcuauaauaauaauaauaauaauaauaauaauaauaauaauaauaauaauaaaguaaaaagaggcugacgggcaaagugcuuacccagcaugaacauagcccuggguucauuccccaggguggaaaauauuuaccaaaagaccuaggccuucuaaggggaucacugugauggaaaagcaugagccacuguuuggacuuagguuuuucugaacgaucguguuagcaaagcuaacugugagaucucacguccagacccucaggacuuuaaaccguugagucagccacaugaacuccugaucuuacuuggaaagucaaaccagccaggguugaggcuugacauugauguauuuccuacuaauuguccuguaagaccaaguacauuucuggaugcucgcucuguucuguuccuccagcugccuuaucuuaagugauuuggcccguggguacccuaagauguuaccuugguaagacauucaccccauuagcaagccugcuaaaugugcauaugaccuuagguaugcaagaagaccuguuuaaaaacaacauccccccucauuuagaaaucuguguccuuuucaugguaucaauaacauuuugcccagcuccuuuuaaaacuagcuguuagagguaccacagcaaugaaguagccuccauugaguuuuccaagucaaauauccucuaagcuaauuguuaauuuagaugggaagaucaucaguucugcuuggggaugggcccaggaucgugcacacacugggcaggcacucucuauuggugcuuaucaaauggcuuuucagggucugagaugugaacuuuccccuaaguguggccaugccugcccagcaaucuugcugucuccugaacauuagucaugucuccagggagugagugaccagagagcucauacgaagagggaagacuuucuucccaggccugucuggguggcucuccuugaguuugcaucuagaugagaaggcugacuuccuaugucaccccaacaaggcauauugggaguggggugcuagugaggaggguccccaggccucuuucuuuuuacaaggaacaggacugggaaaggguaagggcuucugaaaucagccagagaucugcgcacuagccgugugugugcuagacugggcuccacuagaggugcugacugaugcuuugaaaaacuggguguacacucaaugaguguguucagggauguuuagagugcgugugaacccugugccucaguuucccuugcagucacaacuuccccuuccuuauauguagauuuuuguucguccuuuauuucacaaaugcuuggaacacccacuuccuguccugucccaggcaggcgcuggccacacugcaggucagagggaguaauaacacacaguuuuggccugaggacauggacugacuagagacacugaggaucagacagugccacaaccgagggaccucaaagacauaggagaacuuagucuagcuuuuggggggacuacugggaggauguuaucccccaaacgugggggcuagaauagaagccccuggcuguuaugacacugcccugcagcagaaugcagcaugacauuucccaguaucugucaaucuuaaggaucuuugcauuccacagugaccuugaaaucucuccuuggagcugucuuggggauuagcugauggcguguuugaccuuugguuuuacaaagccuaaggggaguuaaagggcaaggucuacgccaucagagauaaggagugcccaacccagugugugacacgucuucucuccgggugggagagcuccugggaguagggggagguuggaaaguuaagcaaggaugaaccacucaagauaaaggagugucugugggaacugacccagaaagccuauguggaucugggcaagggcaggagggaccucacgaaacccccucauuauucauuaacagcagugggcauacuccugagauuggagagagggccuaacaagcuggguuauuuagugaagagcugguaaagguuuugcagacaguagaacccgggaguuacgaaggaccaccaagccuuggagauaagggcggggccucaugagucgaccccagcacgaaucucuguuaggaugaauuguacgauguuuguucacaacugaacagccuugaauugaacagcgauuguucccaaacauggaaacagauuaaccucguuaaagugucucucaagcggguuuggcauuuggaacuccgggauaaaguaagcaagaacaacaauagagggccuaacucaggaucucggggcauuguucuucccagccagcaaauaugugagcugcagaacaauaccaaggaccaugucugccauuguccagcacacaaugaaaggucaaaaucagaaccgggucauugggaaugucuucugagguuugaacucuaggauuccuuugggguuaauguuuggcagucugucacucaggggccuggguccacccuggguucuuggccauuguucuuguggccucuguccugggguugcaaugcugucugcugcccuuugcuuccugucccagucccacugggcgugucuauggaguaggcccgugcuuucuucucuucuaagcucucuacccaggcaucugcucccugcauucuguaucacuccugacaguggccaucuuaagcuuauaguuggagaaugacgccucaucccgagcuguccccauuugauuucaaacuucugcagaguuggacuucagcuucucauaccgccuggccuuuggacgccccaccucccguuugguuauuuccgauuaacagugauggcggauggcucuggaguugugcucuucucuccuggcuccuccauggcucugacccacacuagguccugcuuuuggcaggauugucuccaccccuccuugcucugccauucucucuugcuugcuaacacuuuugcaguguggggguaguggucuacucaucgugggcacagcccacuuggcuaugcagacccucucaguauggguguaugaauugcuuaagcaucauccucacagcccagcaucgcaggggccaguucauuucugaugcucccacaccugcagcgugccuggcuucccuuagccuucuccagucuccugagcuuccuagaguuaggguguggccuagaauuuuaaaguucaucguaaugagaaccauuacucuucaagccccucaccccggucuguaaggugaggguaaugacaccuuacggaggaggccugugcguugcagggaagcugugugcaugagguaagugagcaaccaccaggaaaggcaggcucucucuaccacauagcuugcuauggcaucaucuuugggagcuggguucugacaucccugccaauuguaaaacgccuaaggccacaucuuuuuuuaaagcaccuugacuaggcuagggagagagccuggcccauagguggaggcaugaauuaaucacugguaauuaauugguccugauguuuccaggcuguucccucguccuccccugggaguccugguggggcuguguccuggcuccuggaaacuaugucacagugucuguccuguggcauuauuagagaacacaaaggaagauaauggcgcagggcgguguuuccccugaauucggaaucugagcagauauuccuacggagacuaaacacgacauggaaacacacacacacacacacacacacacacacacacacacacaaggugcagaccucccuauguaaauaguuuacuccguggcuuagugauguucguuauggaagccuggcuggguuuggcuuuacaccacgcacuauaggcacaguucguguaaucuggguuuuagaucuggcuuggugugugguaggaggugagugcagugccugaggcagauguagcagauguaccucaccugccacaggggccccagugggcugcgucaccaccugcuaaggagcauccgccccguugccccuguaauccacucuuuugggaagacugcuauuggcaaguccauauuuuguuguauuugggaccuuucuuguucaggagacaucaggagacacuggcugugaaccaagggaaacaacuguuacauuuuauugcccagcacaccaauugggaagccauuuacccaacacagcauauuagcgggacuccaucugugugauugacuagucauucccacgagguuuuccugguuggaauuggacacugcucagcauacuuucuuucuguuuuauuuuuuaucuuaucauuuuuaguuaguuaguuaguuaauuaauuaauuaauuaauuaaauuuugagacaggguuucucuguguagcccuggcuguucuagaacuggcucuguagaccaagcuggccuaugaccucacagcgaucugccugccugugucucccaagugcuaggccuaaaggcgugugccaccauacucagcacaauuucuagaggagcugaauuccucuugcauuugauauuuaauucgaauggcuuaaccauuuuguuguuaaauaucuacuuuggaaagcaaagacccacuucuagagacacaggaaacucaguguucccaaggcauaugccaaacugacacaagcuagaacuaucugaaaggaggggaccucgauugagaaaauggccccauaagacccagcuguagggaauuuucuuaauuggugauugaugggggagggcccagccuauuguggguggugccaucccugggcuggugguccuggguuuuauaagaaagcaggcugagcaaacugugaggagcaagccaguaagcagcaccccuccauggccuccacaucagcuccugccuccaggugccugcccugcuugaguuccugccccgauuucuuucagugaugaccagugauguggaaguauaagccaaaugagcccuuuccuccccagcuugauuuuuggucaugguguuucauggcagcaauagacgcucugauuaagacagccggucauucuccuucuggcagcagugacauuuccuggguacuagcagccguguaucuucugauggauaagcucuaccuagcacuccaguuucuaggccaguacucauuucauguuuaagcaggugacugaugaaacuaacgguaacuauugugacauuuuuccuguguuuaucuuacagaaauuaacauaaauauauaauacaguuggugaaggauugggcuacuauguagcuuucuaauaucuuuuuguguguguguguguguguguucaggcaauuacauuuccuaauuagcucuuaauuuuuaaaaaaguuuuuuuuuuuuuuuuaaaacaacuguauguaaacaugcacuugagcacuguacuuagggacuagaggaguuugaccuguggaguuggagucacaggugauuguaagccaccugauaugguguuaggaacuaaacucagguucccugaaagggcaacgagcacccuuagccauccagccaucucucuagcccccucacuagcccuuaaguuuugagcuacaucuuuugcuuuccuauggaacacaguaguauuuuaauuugcagaguugucaucuaggugagugcuuugcauaugcuaggaccagcaugccacugcaucagggcuuaauggauggugauggugucauuuuacuaugacaguauaggagguuucaguagguaaacaacacagacccagagcucggucuuuuauuauaauggucacuuagaaaaucuauaacuuggggacguuagcuagaacucaauguguauaugccagaggagaggguuggucacaauuccggugaccuaagcuucggcagacaaaagaaaagcccguuucucuaauaagugaaugcuaggagaucagaugcaagcucauaacuuuggaaagacaauggggcacaucucaggaggaagggacuaaggaucugccuugcucugcuggggguugacauguuggcacacaggcucuggccuccucaugagugaaaggcagugacccuguugaugaggagaaaaugagcuauuguuugcaaagcauuuaugcagugcuugcuuaaugccaagcaauaccugguucaaugaaaaggaaacgcagaggaguaaauagccaaguaaugacaucaacggacagguggggcuggaggagagcgguuggaucauuaugucagcaccacgaagcucauaccagcaucagcaccaccaagggauagaggacacacccaaaguuucugguucagcagugugggguguccuggugguucuaaaugucuagugggggauauuacugucuagagaacuagggucuagcuguucucuuugcguuuucuaggcaguagcuuggaguauguuuagguuguggccaagcagccgaaugcuaucagcaugccagcaccuggggaucuccguugacuugcuguuagauugaagccaaaguguugcaugggaaaugcccccuucuuaguccuguuaucuugauucucacuggggccauuauuguuggccacuagcauguuccuuagaaggucccagcaacauacuuacggugugugaagaagugggugcuggugaacuaauuugcccuggcuuccugaacccuacucuucaucaggcuguuucacucgucugagucuugccagcuuugguggugacauuuaggccccucaccugcgaaggggggcagugaccauuuguguggaggucagccggggugaagcccagcuggggcaugcgaugaccugcauagaggcccacagcacuccacacuucccuggccuaggccaccugguucccugacugggaauaucugauuugugucccauuacaaccaaacccauuuccuggagauuaaagaccauuugggguuagugguuuaaaauaacuccuaaauuuuggucaggaaauggccuauaaaauuaagaggagauugccaaggcaggcaggaaaaugggucagugcugggggugguugcggagggggcagggcaugcuagcuaucagauagucauuuagucucuggaccagauaggcuuacuuuggcuguauauacgaacucagcuuaggauggugggcacacugggguucaugacuguuuaugaggugggugaguucuucugacauaugccuugucuagagcugaucacagacugacacuuuagcuugcaaggcuggggccagaccacaugcuucuaucacuguauuaccccaggcuggccacaugcuucuaucacuguauuaccccaggcuggcccggccaccguugggcgccuucuuuguaauuagauuuugcuuucccaaauacuugagaauugaaaaaaacugaacgauuuuauuucuuuauucuggaauccgggcuuuugaaauugagggggaaaaagacuuuuuaugauagucauuuaauauuuucuuguugacuuugggucuuuucucaucuuucauggggcugugcucugcggauauguucugagacauggcuuucccacuucaccaagucagaguaacuuucauaaugagaugauaaugugugauacugaacaaugaacuuguggucucuucccuuugaaccucagaagggguucaugucaguccugaaacucuaggaagagggucauaagcagcugcaaacuaagaggcagaggagaugucguuagaguccugacuuacccaaaaguaacugugaggcuggacaagcggucugcuaaccucuccaugccucuguuuucccacguauaagucaggaagagugacauguuccuuuaggguugcgucuauuugguuguuugaaagguggaccagugagugacuucuguguuguuugaugcugcgccuccuuggcggcuucuuggcuggacgcuuugaucuucacuuguagauaaagcugggauguuggagcaaucuccaucccuucaaaccucuagugcauucuuuaaaaaacaagcugcuuacuggguaguugauaaaauacucccauuuguaucacacauacacaguuaauugcaauuaauauucacacacauaaucaaaugucguuauggaauaacuguggagugcggggcuuaaggcauucccagagguagacaugauggagaguaggccuucugggcucccgugggcacagcagaagugugcgcauacauuccucaucucuggagcaucuugggugucuacagcuuauucugaggugccaucuuccaucaacaccccaaguggugcccacacauuuugggaguugcuuugagacccuucucucucaccuuagaggagcaggaaggugcagcuuggcuuuggucugucccagugugaacucggacuggugucagcgguauacagagaggcagcagcaagcauuguguuagaaggagggacuggagcuaaugucuuauagcuuugaguucgucuaccacauccuagcaucccagcagaugugugugugguguguggugugugugugugugugugugugacgugaagguagagugggaaccacuuuguagggauaggaacuaaagaaagagaggagaaaagauguagagagggaacauauauuuuuuucuuaaacauggaguagagacuuaaaaauaaaaaacaaacccaaaccauauauuuaaaagacuucagggcagaaaaggaaccaugcgugaggaggggugguaagggagcgucgagaaagaggaggguagggaguuauagguaggggucgccaguaaggcacagcuauggaagaaccuuagugaagcucaguaguuagucuguagcacagauugauaauggagccagcaggauugcuccgcugcuaacgugcacaaggaccugaauucacuccucugaacccacguaaaaagccagcacacaguuaucaucccagcacuggagaggcaaugggugguggggcuuccugccaccaggaagcugacucgugagucccaggccaaaaaaaggcagaugacaccuggggaaugucacucaaaguugaucucuggucuccacaugcaugugcacacaggugaacauggacacgcagacauacacagacacacagacacacacgcuaaaaacaauacauuuaaaaaagaaagcaccauagcaaggguacuuucucuaucugcacugugguggauuucaggucagaaagucgcucagugggagaacauaaacaugaaaucugacacacuaagaguagucaucugcuagaaaccauagcaguggaaagccccagguagcccuguaaaaagcccuccgcacaggucugauuuaucuuuccuuucuuuaguuaauuuuaugucuaugugugugucccugaagauauguguguguguguguguguguguguguguguguguguguguguguguguuauggguacccugugugugcaggagucuuagagcucagauagggguguaggaccucuguuacagaagguugugagcuaugguaugggugcugggaacccaaccuggguccucugcaagagcagcaagugagccaucucuccagccaucuguacauuguuucucagagugcuggcuugugugugugaaauguguuuagggagcacgcuggcaacuggacuuccuaaggagaggcuauuuagugauuacaaauacauacgcaugcauauugggugcuuuguguucauaugugcaugugugcauuauauauauuaagugguguucauucaugcauguagugaguugucccucuauacacacuauguaucagugugaggaagaccauaaagagcagcugcccuuggugccuuuauggaauuaacacagguaaaccguuuuuaccuucaccagacucaauuagacaugauuuaaaaaagggaucccuguuuauugauucuggagugucccaggcucagaaacucuaauuugcuacagaucuauaaguguaggaagagagucugagucuuuccuggaagucugguauguaccugaaguacuguccugagaccaacagacauucagaguugcuccauuuuuaaaagaaaauugaauugucaguagaauaggaaaugggcuagcugaauucgcuguccuacacaaagcuaggaaugggaaauaaauacuuggguuuaggauagaugaagccaucagauguagaaauaccagauguaaaagugacagggcauucagaaaguagcaugcuuugaggacgguaugugucacacaacagugacauaagaaugucauccugggcuuuaaagucacagugcuccacacacaagcuaucaggaguggcucuggugggguugggggugaguguagacaggaugggguuuacagaugaugagaaagggggugcuuucauaauucccaggcacacgaacuuuggaccugugacuacuuaaugcacagugguccaugcauaucagcaaucagagccugucucccguuccacucugauucacauccauuagcgcccuggucacaguuaacauggcagccuuuuccugggagguuugccagauccugggcaagaggaagaagcuaaugugugggcuagguaugauacauuggaggcgggaaguuguugcuaugaaaaccaucauugacucccugagaaaagccagccggacccuugggggaaggcccuacugcuuguccuagacaguggguggcgcauacguugucauccugcgggugggaugaguccuuacuaaggaggagacagaauacaaguaucugcugugcugcugcaucugaugugauauguuuguuaccaugggaagugaugagccuucaugcgauuccuugacuggcuuuucucaucggaaacaacaacagcaacaacaacaacaacaacaacaacaacaacaacaacaaaccaaaaaaacaaacuaucagagaguuaggaagaauuaagacaugcuaguguuucuagccuguuuaaauucuucagaacugugacccugaguccggaucacugcacaugagcaguggcuauguggggcaucauggucuaacugcccaguauggcccuacacacugugauccgggcagucacagaggcggcuagaagguguggaaucacacaggcagagaagguggccccaaaguccagcuucccuauggccugcucuacugaugggcacugucuguacucucauuaagguccugauugucuacuguauugugacaccagcagccagccuuggcauuggugagguuccucuuagaaaaguguugagacacaggcaggauauuaugcccaauagaugcuuggggacaccuagacagauaaacagggggugaccugggucccaggaaggggcuuugccucugucugugcucugggcagagauagccccuccccuuccugaucuuaucuaagugaugguacucauuucucugugccaaccaacgacguguuccaugguucaacgaccagcuaucacugagcagacaauacacccaggaccacuggugggacaaaggaggauagauuugaacccaaaccaaacccucuaacaacaagagaaacugacuggaucugguggaauauaggagagaugaaggauuugaaguccaugcauagcucaugaacuggggugacccaggaauggauguugggcagguaccuucccccaggcagcccuggcugccccggaugcuucugaaaauguucaugcuguacuuugggaguggaguuggaguccaaagggaaugggguaagugagcugaggagacugagaaagaaugcucccggcgaggcugccuuuuaagggaaacucuuggguaauguaaacauguuguuggucauuagaugugcugauuaagaggguaaaucauaaaagaaauuaugucuuggacauaaacucuaaacagugcaaugacauuuugaugauaaaaaugaagcuacacagaguguguccccgggggaaacacgggaaccggagccugaagguugucccaaggagguucgaggcucgcagugagguccccaagcuugcaguguggucccuguguacauauggggguaaauguauccacacguugcaugacugaagaaagucaacuuuaagaggccuuuaaccaggcuguaaaggggaggaaaauaacagaauguaugcaacagcauguaaaaauuauugagugugaaacaggaccgcccuguuuagagaaacaucaaauugcuuucgaagggagccaacugcuugcagugcagcuagcuggaguuuagggggagggggagcccaggaaguugagaauagcuuugcuccuggcugugacuacuuccaggccagccccuuucugucauccucucuuuucaaggucagaacucuuuaaccccuuuccugagggaccuugaaacaaccuguuugucuucguugaugcacagagcucgcuacucuggcaucuggucaugugggaugcaggggagacacuuucuguagaagauggaggaaaaugugggugguggcuggcaguggccccuaaaggggcagcccguggcauccuggguaucuggugucucuggacugcucuagucuuucagcagacagaucuuuugccuccugaggauggcugcaauuaugucuuaggucuggaacacagauguguaacagcacagcauaugaggagacaggaagugcccaugguccgggaaugauuaacacuugcagggagcuagcuagucagucuucuuugauuggaaauugagaaguugguggauacaaggcccauaguugauuccugagaguagacagggccagcagcagauaaacuuacagggccucgucuguccucucaggugagggcacugggaagugaaugaguccagaccaugcacacacacacacacacacacacacacacacacacacacacacucacacacacacacacacacacacacagagagagagagagagagagagagagagagagagagagagagagaagagcaccaggguaagacuuucuguguaguuagccuggcucuuuugagauaggugucucacguaucccauguuggcccagaauaaccagaucuccugucuccaccuccuaaaugcuagaaagauaggcaaccaccauagugccuagaucaacucccacauucuuguuauucuauuuuuuauuuguccaaggaaaacacacuugguauuaaaaauccagaagaguagaugcagugaggaccagccugccagcagcauuacccauggcugggaaaggaaauucucuguaucucuugagcccuuuuucuuuucccaagguggugauggguauaaucuccuauguguuuugcuuucgcaauggauccccaugugugaacccagcugugcacaaguuucucuggcucccacugucccucauaaguggaaacuuugcauuuccuguggcgcugggguugcagcuccuaguuagcuccguaaaggaagccuuguuccuucccuauacacuuccuacccauaaauagcuugggagccaugugggauuugaggaagccauguuuccucuccuguccuugagccuucgcagggcguuccugggcaaggccacucuggcacauggcccucaccaaugggacacacugcuucacaacucaguuaccucucaugagacccagccacccgcucccauugucgcaugcuuuaacccauuaaacgcauggagagcuaggcucuggcucaggcuugggccaggcuuucuuguagaguaaaucaggaacuugaagauaggguauuaauaguacuggaaguauagcagacaaagggcuggggaauauuuagauuugcagcugugucuaacuguuuagagguacucuauuccacuaggcuggccuugggcucuggguggggaccuugaauccagggggcagagaccucccgcugucuggcuuuuggaaugcugagguguuucuggagcuugugagaaugcugcuacuauuacugaaaguuccaacagaaaucagcuagggcaucuaacuuccagccacagggaagggaagguccuauccuacccauagccuggcuuguccuggcucucccuggcucuccccuagguggguggccucugagugagaaacacaaaaggcgaaucucagcucuccucucuccacccccagccuucauauuuccaucugccacuccugaauuuucuagaguuuugugcuaguuccaaacuuuagaggaucucagaacuuguguaggacaauagaguggggcucuauccagacgcagggucugccuaagucuccuguguugguccacagccugagacauggcaguagaaggaugcucuacucgugcucugugugccugggugccucaccacaugcucugcagcauccagagguugcaggaccucagaguugcaucugagaccaauuuaccuugagccuagagaaccuuucucagcgccaggggacagucuuagauuccugaggggcuccugccccugugggcuaccuacggugacugacuuuuuuggcuugcuugucuaccaucuuccagucuagucccgcuuccccugcccugggcuugccccuccuuuucacaggaugaauguccugggauguuucaacccugguucucuccuaucccagcugucucacccugaccuuccuugccuuuuaauccauccccaggcagcagagccuccuagcagaugcucugacuacugaugggagcgagcccuuccagguggagccacuaguggucucaucuccagcucauuuccuggccuccagccagcucccugccccagaacuuuagacagccaugucccuucauaagaauaagucagagagagcuucucggucgauccuucaguucccacuacucucugguucuugucacaucuaccuuccucugcugcggacuuguuaccuccaguuuagagucguccuccccgugaguuucauccauccacagaguguccucgagggcaggaugcuccucccuuccacacuuguccagacucugcucucucguacacacugaaguuggguguuaaccaucucccccacugugagaguccagggcaaaagccaagcugaguucuguucccagagcaucaguggcacagucuugggaagagacuggugacugucaguugagaucaccagagagaaccaguaggagaugaggggauuaccacugugugggcuucaagagccccagggguugcugucgguugagucccuaggguggugguggguagagucuagccuguacccgaaggucucaagcccacaggcauagaggaagguauaauuccauuguucucuaccuuucuguucuguauagaccuuggagggcuaagauaaaggcaauggauagggacugugugugcuuccugcugacccagagcuaagcuuguuuauuaguggcucacacauaguagaauaacugggcaaacuguggcccagccguggcucauauaacagcuguuauaacagcuuagcucagugguucuuauauauuacuacagguuagacaugcccaauacaaaaauccaagaucucaugagaaaugucauaccaugggauuucuguuucauguacaaaauuaagacaguauuguguaaaaugaccuccauuuugcauguacaacacuucauuauucauuuagucuuugguuuuguccacaagauacuucuuguucaguacacacaaguauuucugaaucuagaauuccuaaaaucagaguggcuucugaugggaggacuuuugagcccccugugauagacguggucgaaaguucuagccccauguuuucugggaaauguaugcucacggauagcaugcccucauggauagcaugccacuuccauguuucuuaaacaaaacggaugacgagaauggcugaagggucucguggauuucuauucuuuugaggacugaaagacgaccacauugagucauauugacaucuaaggaccgagaccucugcagcuucccuaacaugguauuccuuugggauuucugcuccagcacugaagccaacaaggauagugugggagcugcagggacagacucugcuuacagauuuuagaggcaugcaguggguuguggguuucugacauccagaauguugucuuugcucccauuuuaacuuucuuugugacacuaagagccaaccucccaggggacuagauggagaccuaagugccauuuuuuuuucagauguggcuagcagguggggacauugcagaguuugguggguuuaccagguugcagcaacaugagggacauuuagggacagcucaggagucugggaggucacaaccuuuguucucucuucuguaugcuccuucauuggcuggggaaugcccuggauugugaaaaggggguuggguguaggcuguaaacucacagagcucugcucuacccuaaaggucguuguaggaauugggaaagaagccgggcagugguggugcacacuuuuaaucccagcccuugggaugcaguggcagguggauuucugacuuugaggccagucuggucuacagagugaguuccagaacagccagggcuacacagagaaacccugucucgaaaaaaauccaccccucaaaaaggaguuggggaacaacucucaaccccauuagauaaggccccaugggcuggagguucuccaggcagggcucaucuucucugcagcccagugaacgaugucagccagaaaccauccaugcugcagggcacuauugucuaggugacaaggagcugcccuuuccacuccuugucuuuccacauuugauuagagcgagcccuaggguuaugaaaggcaaccccacaaaaguacccaggaaugcugucaaaugagccaggcucacuaggugggaauauguucagaauucaccagguucagcucacacacgacagacagccuuugaauguucucucugucucugucucugucucugucucugucucugucucugucucugucucugucucugucucucucucugaguguguguaugcucgcgcuagaaaacaagaaugcaagaauacaugugcagacccauguaacuguauucuugauguuacaugugaagaaaaccucgaggugaugccaggaggggacacacagccccagcuguauguccuggaaucuguaucguggugauuugggacgcagggguccauccuugaguaagacagcaggacagucgcccaagaggugcacgaccagacaagagcuacagcuugaaaaauccuucagguacacauggaucgaggucagaauggagcaaauggcucguacaggggugggggcaggggcggugguaguggguggugggggcacaguguagauagcagagaccuugggaggaaggaagcacccacagaguguugaggaggugaagguuaaagccagcggcugcagauguuugaaggcacagaagagggagugacguuccugacagggugccaggcuguguagcagggggaagaagaguucuguggcugugugaguuaccauuuguuccaggagguggaggcaucacuuugaucgggauaucaauaugcccaauuaagccaaguagcccuaaucauuauuucuuucuuuuauuucuuccuuccuucaucccuaacccuuccuuccuugcuuccuuccuuccuuucuaauuuuguuuguuuguuuauuuaugugugugugcgcgugcgugugcaugugugaaugucacagugugcacauggagaucuauauguuacuagcaggaguuguuucuuuuuaccauggaggaccuagggacugaacucccauugagccaucucacugguccacaagcacccaagucuugacuagugagucuucuugacuaucuaauuuacagauucucauuuuguuuggagacauagucucacaacgccuaggcucgucuugaacuugauagguggcugagcaugaccuugaacuccggaucuuccugccucaaccuuccaggaacugggauuccaggcauguaccaucacacccagcuucagggauaaacauaaaaauugagcuccuaugugaguguagcagaguucuccauuucucuggucgccuuuccuggguaagcagugacugagcaucucagggcacccacuuucagagacccuucuagguuucgggagauggagcuggcugugucucccaggaaccugaguuucccacuguuguucguagagggcucagggauuaauuuauggcacucagcucuuggaaucccaucauggauuugugcugagggucgcugagcaccuuuugguaugcugagaaaguucaggcagugucucuguuucucacauuuguuuugggcugucagacuuccagcuguaggggauggcucacccuucccgagucuccucaucacacaacaauguugauucucacagcuguucuccccagagaaggaucucacagagagcaucucagauaucugguggcugcacaggccagcuguggugucagagaugcugcugcugguguuggcugaacaacauucuccucacgagaaaaguugggaacugcugaguuguuuuuaaggucugaguacuuaaaaaauugggacaugugggaacucaggcugaauucucaguaccacaagaaaugaggugggauucagggagacacuugaugggucgguugaugcucagcacucaaaagagcugggcuugguggcccaccaagugcugguaaucacaguacugggaggcaaagcaggcggaucucgggguugcuggauaguuaguuagccuaaauggugaccuccaguccuggugagucugucucaggaauaaggugaauggcucccaaggaacaacaaacacuugaagcucugcccucuguauaugugcacacacacacacacacacacacacacacacacacacacacgcgcgcgagagagagagagagagagagagagagagagacauacacacacauacuuagagacagagagacagagauagacacacacaaacacauacacaaacacacacauacacacacuaaagagagagauagagagacagagacagacacacacacaaacacaccaaagauagagagcaacagacagacacacagacacagacacacacacuaaagagacagagagacagacacagacagacaacacacauacuagaaagagagagagagacauacacacacauaccuagagacagagagacagagauagacacacacaaacacauacacaaacacacacauacacuaaagagagagauagagagacagagacagacacacauacaaacacaccaaagagagagagcaacagacacacagacagagacacacagacacacacaauaaagagacagagagacagacacagacagacaacacacacacuaaagagagagagagagagagagagagagagagagagagagagagagaguuugaggugggaagaagagcucuucucuuccuguuuuaccaguuugagagaacuggguucccucuguggcaaacaauguaauagggugagagaaacagauaauuaauguagagccuuaacacauggauggugggauaaagacagauccaggccagauuuggaaauaucaaguaaauuuauuaaauaaauacagagaaagguuauggguuccaaccaagaagggagcuugaccuuccuaucucuaugugggugcuggcaccgugguuauugagcugggggggggcuugcuggggaguagcaaggcuuaggggcaacuuucuuuccuguaagcuuugcagaggcuggagugggucuguucucuacugaggugugaugggugaagucugugccauggaacacagccgagccaaagcuaacccgugcugugaacgggaaccugaagcuucuauauagcucauuuuuagaaugcuuucccuagcaauacaagccuauaauuguuuucacucucaauagcauaauggggacuuugugauggauucaugagaaucguggacuuuggaaugugacuuuuauuuuaagauuuuugagggaacuccuagcggcguuucacuucugaccuuuauaggaagccugugguuggccagugccacauaguaggcaucagagggacauuguuguugugucuaagaucucagugcucuggaugcuacggcacaggacaaacaugucacacaugaagcaguucugcgcccuauugguucguuggacagaugaacacaugguguuucggguuccuuuacaagcaaacuauaaaaucacaauguucucuauacccucuguaacccugauuuucauguuggauuuagaaacaaaaguuagguccaccaaggcagaagaaaccuugccaacagagagaacauuagugacaaagagaagacaggagagggaguccaggaagagagagcugaggacccaggacagaugcaaauaccgacuuuuuuuuuuuuuuuugaagcaaacagugcaguggggguggggcagggccucucuuuugggaaccugucaggcagggguggcucccaagagcaauuggcucuccucaugucugcccuggaaacaaagccacucaaaaagagggucacucagcaacagugcaaugcauguugggaauaaaagaauagugugacacagagcuggcuagaagguugggugaucauauuaaaagaaaaaauacuaaugaauucuggggcuggcaaaacuauuggacagggaucaugcuaagcacuucuggguggccgguguuugauccuggggaggcuugcucugcaagaaaagacaugcagaggaagaauuuugcguauuuuggguucccccauaaccuguagguaugugugguccccaccuugggaagaaugcgcagcuugaggagucacacacugagccaaggcucagggcacaugggcugcucuggagggacuugggguuuauacaguagaaacacgugcuucagugagguguccaugcccagccuggcauggugugaauucgaaaaaugaggcuacuacgcaugggaaguagggguaccaugccugucacagagggagcagggugugaggugggauuaagucccagcagucccagcuuccugugaggaucaguggcuguuggccuaaaugucugucaggcccagugaagaucagauuuuugaggacagagguuuguagcggauaacagaaaagauggcuuagguaaaugccaaaaaguacauacggaauaucugguagguuuucagacgaugagagugcugaaggcagguguagccugauucuaagcacuuuauaugggauuggcauggggcuggcagucugagcccuucaauggacucagcaugguggagccacuggggacagcgcacagaggaauaggaagcaaaugcugaccugccccaccucccucuccugccaccacagaggacugugguggcagauuucaaacaguacaggugggaggagacccaggccaagauacagugaguguggaccgaagcuccuagaagggaaacacugacaggauguuuuagaagagagaaaaagggacgggggcagguaaaaacuggagagauggagauguuuccugauagaccacauaggaaaauggagagaagcaguuuggaggagggagaggguauaauuauggcuuggcaaaaggaccguuccccugccuuguccacaaggcugcuucauuccacugacugccccguguccaggagacuugggacaaugccuguggccuaucaaugaauagaaucuuugcuauugcugccaaagugguagaacacaugggcuuaaagccacugauuugagaagagcagaggccagccaggucuguguguaucugcauaucucacagugagcuucauccagggcuguguagugagaccuugucuuauagccauaacuacaauaaugauaaugagacuuaaaaaaaaaaaaacuuacuccagggacucuaaaucauuauauaaaguccaaggcuuccaaauugugaauuuucagaauuugggccaugaaaaaucaaagcaagacaggaauucauaucucaccugggaaauaccauggggaaguaggauuggaaggaagucucagcacagaacugucuugcuacaaagcuuuaucauaauguaaacuuaguuuuccccgaaccaaacuuuauauacaucuaccaggaaucagaaguaucucuuggaaacugacaguugaaaaucugguuuacugugaauaaaauauuuuuuaaugauuuuauuuaauuuuauuuuauguucaugguguuuugccuacgugaaugucuguguguguugggucuccuggaacuggaauuacagaaaguugugagaauaaaccuggguccucuggaaaagcagccagugcucuuaacuaucucucccuauaucuauccccauggggcuaauacuuucgagucuguugaugugugcacuucucagcaaaaaaggcuggaauuaaaaaaaaaaaaaacuuuaguucuauuugcauuaguuuuaaaagaaaauccaucaggcaaaauauuagagaauuaaaaaguuuccaucaacuacucuaaugcuaggggagguuacccaaucuuuguagaaagacaacaugggaguuaagaagaaaacaaagccaaguggauauugagaaauucgagagaaaugaaauugcuaggcugagugagggugaacuuuaacucacucaaugugcaagacuugggccagugaaggagugugggaggggaggccaguguccgcucagggucaucugugcacgaaaagcuggauacacccagaguugaaaggagcucacugcuguaggggcuggaaagcagagugcaggcgccaggucucugggcgagcuuccugggggccuuacugguacuccaucugccauguuaucugugcuuucccugcagggauacuaauugacugaaaaccgugacaaaaagaugcuccacagacaagaguuaugucgacagagauuucaugggaagucagauuggacgggauaauggggaauacagaaaguuuuauguuaguagcugguucuucagugaugucugauuaugugcuguuuacggacaaugccagggaaggggcuguguuaacauguauaggacagaguuaggacauuaucgcuuaacggagcacaucaguggccaggacagugucuccagagggacauuccuaucaucuacacugaauuuauuggaaugcaaauuccugugaguuaaaccuaggacucugcaaguugagaaucuaaguuguagccagagauacuuggaguaguggccugauagguauuacagugaauacuagagguuugugauagaacccacguucuggcaaagggagaccacaccauuccuugcuuuugacaggcuggaaagaaauuagaagccuaagguuucaauaguuaaaccuuucaaauaaaaguuagauguuauauauggcaaauagcaccacagaauucuucccacaggacaccgacuccugcuguccauccugaauggaaaacauguggaguguucgugucucagguucuuagugguuuguguggguuucacacagggucacagcaggaugauaacugggucuucauggcucuggucugauuaguugggguggaauaucauugaccaaucccucugccccugcucaggcuuugaucuccccacuaccagcaucccuggggugguccacuuguuucaggacaaaugcaugacaaauagcacgucaaaauuccuccugugggccaucagcauccccagcccagaguccauccugauggcauccugauggcaaaucucaggcuaucgcuuuggaugaauguaaagugacaugcacacacuaucacaauacugccaaaaauggccucugugccagcaauacucccuguaugccgcuucuucauuccccugacucauccuuagcuaugcccaucaucuggcuggacccacagugcauccuucucuacaauagucacagaguaugcuucucacauagucaguagcaugcaucuguguagccuuugcagauuggccugguucucuuuguuaucuaccuuaaggucccuucaggcuuuuuuaauggaucaagagaucaguuauuuuuaaugcugaguaauagucaauuuucaggauggacuaaacugugcccauuugcccacugaaauggguuuggcuuuuagcuucaagguccucuuuucaaugcugggguauuggaaagugguuagcucuuguauuuuaacuuuguaucccaccagggaaagugauuggcucuuguauuuuaacuuuguauccugacagggggcuauaacccauucuugggguuucuuguuuuuuuguuuuuuuuguuucguuuuguuaacacaaauaggcaugucaucugcugaguguuuuuaugaaacuccagcagaaaaaauggagacaacuggaguaaauuagagagguuauccagaaagaaaaggcuucuguagcuacuugaaguuguuuagagcuaaauagugcuuaacauuuuucuugauuaauuuuguucauggcccacacacauauggacgcauaaauguaugcaucagauuuuauauauuguauauauuucuuuuucuucuuuuuuccauuuaaaaaggaagucaucaaugcuaacacuaccuguugcaauuguuuucugaucugcccuuaccugucacaucugccugcuucugaucuuggcauggucagugcuuugaggucauuccuuucauuuccuggaugaugcagagucucccaagcgcucauucaucucuaugcugcaugaucuuugggccacagauauaacuuuugucuuuugagauucccgcuguccuucaacguaccuguggugauacucuuggagagagucaaguccaggcucaucucugccacauacuuccauccucacuaaguagcaaggcagcucagcagugggaagggacuggaagucaguuacuucuggaagacaaucagaucucccagcgcaggaccauugcugcuucaguuaaccgaacuuuaaaccuccuugauguggcaucacuacauuacauguaggcugagacacauuuccaaaccaccuucauuuucugugauuuaaaucugaguuacauuuaacagagaagauucuacuuucccuccauaacaugccguacugauguaacagcugguuauauggcggcguugcuaaugucugucacugcuguccgugacugcagggcccuuguaguuuccacccaaagcacggaaaacaaaagaacaucuucucugaaguccuuuguguuuauuggggaguggggugagggaagcacauauguaauuaauaucauuauaauagauaacuuuuuauguaaaaaaauugagcuggccaggucccaaacuuauggcuccuaugucuucgaacucauaguugcuucagccuguugagaaauggagagaaaugucaucucucucuaguguuucaagccacagugacaacauugugugugugugaugauuguguuccccugugggaugaguuucuggaacccgggcccagcucuggcuuccugugaccgucacuagagagaagaccuacaucugugcagggcugaugaacauggggucaugucaaacaaucggucauucugaccugagaacuuaggguggggccuggccaacuucacauccucuuccuauccuuggucuugcucucugggagagagaaggaaacacaauucucuugucuguuuucauuacucagaugacaucuuaaagcucaagucuuuuuccuaaugcaacuccuuucaggauuuuuuaaaaaagcaauuucuaaagcuuuaaaauaugaaauaauuuccgacuuacaagaaaguuucagaguagucaugguuauccauccaaauucccccacugguaauauucccauaaaucacagagcagugaucacaacuaggaaggcaacgucuauaaaaugcuguaaccccaauacugcuaaaugucauugccgcucacaaugaugucauuuucccaucugaggucugugaacgaucucacauuuaguugccaccugucuggguaguccccucaaaucugguacaggccuucugccuuuuugggucuuuugugagcuugaugguuuugaugagugacucaauaaauuauaaaaugucauucacucaggcggggugccuuuggggguuccuggugugaguaacauaaucucugguuaauguuaaucuuccuuucuuuggucacuaacagauacuuuguuggcuacacaagcagaccuguuuucuucacaggagaaacacuguuacuggugaaaucuucacugaggaccccugcugaagcaagcaucaccugaugcggcccuucucuccuuaguugucacuuggcauuugacuucucauaaaaggaagaacuagccucuuuuauuugcauauucauuuuauuaugcaauuauuaaaaaugaauuuaugugucauauuuuguugcacaaauuauaggccauuuauguaugccuuucuuucuuguccuggaggaagcuacauaucuuucuuguccuccaccaacccugacaccagccuuucuucuaagaggucugucuccuucuacugaaaaggaggcugggguaugguagcugaugcuuuuuccuguugcuuuucccaccugacaaguugaauggguuauugcauuucuucuuccuccugcuaggauuggaacccuuaaagaggaaauuugcuucauucuuaugcaaacaauaauaggaaagaagcuguggcuaugaucuucuuaaugcauacugcaggauggucaggggucaugcucagaugacauuuucuauggcucuuccuucugcauuggcuugcuggagagccagaauggugucaccuuccacaguguacucagcugucacagcagcuccuaguccugauggggggugggggaugugguuccagccucuuucaaaccuggacuauccagcaaguguaugcuuugccguguuggcaagggcuaaggccuugcauuccagaggaagugcagaaggcauuuuuuuuccuucugguuaaauguucgggaucucuaugcauaauuuuuauaguguaauuacuuuagaacaucucaugaugguccucaaauuugcuguuacuccaugaaguuggcaggguuguguguuaucugcagugagcuggagaccgugcuuccaagcucagugcugucaucgccauggcauguaccaccuaacuuugggugcugaauaggugugugcauauguccaguuccccuccccccuccacaugcaugcuguuuaacugccggggaucuuuccugcuggaaacucucuaccugcuucuucaccugcagaguguggcccuggcuguuuuggugggagggagcucgggagcuuauggauaacuaggaauaaccaaagagagccagcaaacagcaguagggugggggacagagaaaugccuuccaagcuuucucaguuuuuccgagauccuagcccugcagaagguggacugaugcucugauccccacagcauguaagaaaaaaagagauacauuccuccuugugaguucuaaccagagauccccaggccuggcuaacgcuuccugaccacguucucccucugccuuuccucaaggcucugagggugacugccccacuccuagacagccuuuuugugccagccuccaugggcucucucuggacuucggauggaacuugguccucccaaggccccgggcggguggcguggaagcacagagcacauugggugaccggaaauccucucugcagcagcacauugugugguuugugcucugcucagcaccccacgugcugguugagaguggaguggccuuuguaguuaauucuaucugcucaaagaggcucgccucaccccugccuuccagcugcugcagcagggcacgaugucacuccacugcccagugcccgcucaugccugacauuccugcccaauuuucaaguacuucuuuacauuaauuaauuaauuaauuaauuaauauuuaugagacccaucuggcugguuuuuguuugauugcugguuuauuucuuuuguaguuuguuuucugagacaggccuugaacucacucugcagccaauguuggccccagucuugcggugaugguccucugucuucugagugcugggaucccguacauuaggaggcacugugugcaucucuauaucuuccuuuagaaagaucuuuuaaauaaaaaccaguaaucuucuuuaaaaguuucagaaauuaugaaaauaagcucccguguccucccacugagcugucaaucauucacauuuugcugcuuugauggcccucccccaacccguucugaauucugcugagcgcugagagagcagguuuacagaguuaauccugugggucccugugcuggucagcauuagaccugaaguggaaugcucuuuaauauacugugauaugucuuuugaguucagaaacauuaacguuuuaacaaugauauauccguuguacacuucuugguuuuaucagcuggccuuuauggcgcuuuguccuccaccagccagagguuagccugggacuacucugcguuggggcuauguaccugugccugcccuaugacugcccccuuuuggcugacugaguguuaauauuuucucacccaaaucaggcuuggggucacccuucugccagucugauccauggcuggacacuaugccuugcuucucacaagcuucuucuagccuguugugauacaucuguucuccacacagugcagagaaaguuggcucugcagcugccucagccuugccagccacggugcagggugggugcuacagggcgucagcucauucccgggcugcacugcuaaaaucgcugagguggggaauagcuuucagcucguuaucaccguagcaaucuugcuguguggugaauuucccuggcgcaugacuucacucucugggucauguagagccagcccuucuggccgcuguuucuauaaccuuguuagaagcauucauuaccgggagccaucccuguggauguuggucuccccgaaguggccacaugggcuaaucagugacaaugccugcaaaugauugagccagaggccuuucuaggcccccagugucauccuagcaggcaugcagugucuggggugauccucagaggagucuaauggaacucacacuccuucaacaucuacuccucugagcauaaagcaugcuuuugccgagaugguaaugaaagauuguccuguugucccuggggacccauugucuucuucgagcaguuccugaacucccagcuuuggaccuacuaagugcaucagggauacacacagucuacaugaguccucacauucccuggauggcugcugaagggcauggggcuugcaaggaggcaguguccuuccugaaagccagggaugcaaggcuguagucacuguguuaagaugaucccugacucauggugaugaugccuagugucucaccugcccuagggugggacuucuguguggagaaaggugaguucugcugcguugaaggcucugaacuuuaaaggcucuggaagccagagugugaacaggagccaggacugcacagcuucaguagggcugcucuggcuucucugccuuuuagggcgugguuuaccuucuccuguuuuauucuggagaauagacccuuggucuuuuucugauuuagucuuuaugucggguggauuauggcauccaaacaugggugauaagccagcuuuuaauuguagcugacuuccuucuuguacucuuucuguggcuuucuucuaccuucucaccucccuuggcugaguggaggcgagcggaugcuuuauccuuuucggauaguaacauuuaaauguaagcauuagggaccuagaugagaucuuagaaagggaugagaagaucucugggcaguccuggucagggucagugagaccaugcgccgaagcccagcacuuuccugagcucuggggggggggggcauucuuaggucagccuaagauucagaacacauacacugguuacccagcaauggaagacaaguauucaaaacacaggggagaugaugggaaaaguguacguagcaggacauggccgaggccaagaggcugugcucccugauucaugaggcucaggggaugcagggauuccaggcuuguugcuucacugggucagaagggugaugaccugucagccucugagugcugggguaaagaaggaaaggaaggaagaaauggggaggagagggaggaggaggggaggagcuuuggcuaacacggaagguugagcgcauuguguaugggaugacaccugacauccuuaagccgugaauggccuuugcugaaguggcugcaggugggacuuguaggccgcucugggggauggaaaaggccugugccucagagacgaggaugaaugcgggugaagcucgcuacuuuucucgugaucugucaguuugcccauccccaaaugaaggaccagcacugguagacuuuaaauuuagaaccaacuaacccacacuccuguaagcugauuggaagaccuauggcaaaggccuggccagggcugggggaggucuggacgucagcaccccauagagcccuccucuguucugaacaacugggaauacaacugcugagccugccaaagagugacaggagugaggguguucccaacucuucagagcauuggcucugaggagaauuucuggucuacuuuuuuuuuuuucuuaauaguaagcauuuaacuguuuaaaaauuucaaaaaauuucaaaauuuauaauaauuagaaauuugguuauccuuggccauaacguggaugacuugaccuucuuuauuuuaugaaauaacccuaauagguugagcagcagcuagcacagcacucaggugggaggugcaguuucucuuagugcacgauacacaacuguauauaaugugcucacaaaaagauaaaguuuucauccauuccguuccuuuagaaaaauacacugacuccauuuuggugauaaaggcaaggaggagcuuggucuguucauaccugagucugacaggguucccacgugccugugaccagaugcagagcuugcucuucuugcucaggugugucugcaacggaacaaagugauggggguuuccccccaugauucucuugcccuggguugacauggaaccagguccucccucaguaaccuugagguccuucccucacggcacaugugaucuucccuuuucuggacucauauuucuaauuuuacagucuuggcuuggggguaugacaucaucccuggaggucaagaacaccuuauguucacaaaagacccuuugccauggcggguggcuuacccucucuaggcgugggaagagaacacauacgugcuugguuuaaucuucacgauuucugcuguguggacguuuuccaggaaugcuuguggugugugugcgccggguccaguaacuagaaucaccugcuggggggagggggcaguuagguuuauccgaccaaaguucagguucucaaagggaaaguccaguccccagcgucucucccgcucuccagguccgccgggguuugugccaggaucccgccuuagagguaaugugcugggugacucugccgggcuggcaggaaaguacugagucggucacucagccuuggcaggaagggcaucacaaggagaaucuggaaagggcaguggaucagggcagugggaaccauagacuuugaccuggaaauuccaggcggggggauaaugagcgcagcaggcuggcaggcgugugcuucccuagcgcauugucuggacuuuccuuacgcacugugcaccggggcugggggcgggggcccugggcucagacuuuuuuauuuuuuuucucuugcguuuuccucccauacaagagcaggccugugggaggcagggcaccacugagguuguugauaccuuuguaauuuugucuaaauaaagucaagaauuaagagcagaggaagugugugugugugugugugugugugugcgcacgcgcgcgugcgugcgcacaugcacaucuguaauuucagcaucugggaggcugaggcuggaggcuagcagugaauucaagguugcauagagacuucccuggccagcuugggcuacagagugggacccugucuuaaaagaccguguaagaaaaugaacaggaggaggugcaaggaagaccacagacccccgagagcuaauguacauacguacaagggucuugugggauuuccuuuuguuuuggaaccauuguggccgugaauggguuugcccaaucgcuucucuccaguggcuuauucuuuagagggcuuuuggcuuuuccggcgguuacugggaaggugaaggggugcuuuuugcagaggcagcaucugagaguguagucggaggccuuggauuaggcagggugcucucaaugccucccauccuggacuagacggagauaccccuggaccucagugccuccaacugcaccuuagcaaucccaggaauuccuguggguuggacagcuccaugagaaccugugucaaaagcaccgcugagguacugaggagacucuugcuucuuccuuuccuuccuccccuguguucccagggugcuggguccagacucuuagauacaggacagggcuugugugcucugggccuuuggauuucuuuaaacagaauucuguguuuccuggcuuugugccuuugcacagcuggaccacggaggcccaucugcccgguauggagcuaaaugaccauucuuccaugguccuggccucaaugcaagccccagagguuuuguuuagaaaguuggguuuuuuucuguuacaugacaggcacaguugcuggagaugaagcaggaucuguuaggggcuaaagucugggcaggcacccagaugccucugugcuggcuucuuuuccuccagccaccagccauggaggggacucucccagaaaccucacaggaagugguucgcagaaaaugcucucugcaugccaggagccucuguucagauucaugucccugcugcguguugggaguguuuaagacaucuuuuguuguuguuguuguugcugcugcugcugcugcugugguugcugcugcuguuguuaccagcaacaggcuucugcuuucaaagugucuuaaacugagcagcuugugucuucuguccugugaacacaagguucuacgugaucuauggaggacaccugaggacuaggaagguuggggcagaagauagggcaacacguccuugagucugggggcaaaaggaggcaaaaccaaaguuuucuuuagagaauucaaaauuaugcaacagccaugccuuuggccaaacucucuggcuaaggcacccaucucuagcaggaugugauggguaggaggggccuuaagccagcaguccucugugugugugugugugugugugugugugugugugugugugugucuuugaggagggaggagaauggcuuuccuaauccccagcuguaagcuuugcuggcggaacauugagaccuuaagacaaguucugggaauuugagaaaagaaaaaaaaaacaaaacugucugccauuuuuaguuauugcagcaaaauauacacuacaaaaccuuuacuguuugagucacuuuuaaugcagcucauuggccuuggcuaucuucccacuguuucucaguccccucaccaucaccugucuccagagcucugcacacuuuaggaugugggaccuucagugcccaguucugggccugcccuuaguggacagaauauaacgauaagguugcagaagaaggguggggucugcuggagugucccugaccugaguccacguggaaucuacaggcagguuguggacagcauaguggcuacaggugcaaccccacccagggugaagagacuuugcucuuugucuugguuacugaaaacuauggcuaacccucuaguacaaccagaguaauaccaaaagcuggaacaacuagacaauuauuacccgagauauaucgacugguaacaccaggcuuaagacacagaagggaaaagagauuguuuuuucaaaaaauauucaaaguauauuuuaucaucuaaauguaauuuuuagaaaaacugcccaucucauuguggcuugcaggaucuauuuguuugacucaagcugacuaaccacacagugguagcaaagguucuacagaacuuucuagauguuaauauguucuguauaaaagcuuugcauaaaaaugaaccucaguggaacccggugauuuaaggauguaaaugagagggguguaaaugaagcggugguuuucuuuuucuuuuucuuuuuucuuuuuuaaauggcuccaguuaaagaccagggaacugggcuuagcucuguuuccaggcaaacuauaguuuaaaguuggagccauuugacugaaaagcuauucuacuucauauuuacuuucauaauaaauuaugaaugacuuagcucugguaaauauuuuucuuaacuucccuuggaaaugacaggcuuucagacgcaacaacaagguucuacaguuacauagcauucuguuggugaaugaaagccggucccggugggugcuacugagagucaguguggguuucuuaugucuugggaggagcagucuguccugggguccccagggacauauggucuggcaaggaccucacugugcagcugauugaggaagcccuacagguaccacauaggcaccauccaccacagagccacagucacuguggagcacaacagagaaaccacagcuuugaccgaaggcaguugcuucucggcugugguuucccucguuuuuuuuuuuuuuuuuuuuuucgucugaccauaaaugugcaauguuuuagguagcucuuuugaaagugccauuuauggucuacacaguagcaguugggguguaccaaccauuacuguccauauacuuaggaggguuuucgcuucacacugcucacgcuggcuuguccccaggaagcacaucacauagaagucuuccagauggaacgccugccgcuuaucaaaugccccgacggcgcuccacugucuuggugcguguuggugauccggcugcacuuauuacaugcacuuucuguuuacauuuugucugaguuuucaagcacaauuuuaaggacacaaaucaggugauguuuccaagggcugcauuucauuuuagcgguugucauauguaaagggugcaaagucuuccauuuccaaauugaaaaaccgauugaaggugagcccuggcagaaggaucucucuuacauucuccucucugggugggauuaaucuagauucguucuccaaaacaugucccaugccagacaagcaaggugaaaguccuccguggcugcacacgaggacauuucguagucucacuggguuugguuaguaacaguuccugaaccaagaccugcuuguauauaaagagauuugagcagcccucugcuguccucaggauuuuccaucccagagcaggacacucagaauggcagcgucacucuccacaugcacagaucaccacuacuauauacuccuggcuauuccucucugagguucucagccucugauuggaccacacauucgguuuguaacacuucuucuuccuguugggauguccucauuugcuacccuagauucuggcuuggagcugugacccugcaaucuccaugagccauauacaggugcccuguggccacacacggucauccacaaacgacauuagccucugccuucuuuucagcgaucccguguuacgaggcagugauuggcccuggaaguauuaguuucaaacacauucuucuccucccucuugauaggagggaaaggacugcuguccucugucucccacagaacagggaacaauuuguggcuuuccccucucuauccucauuuguaggucuggcucuuguuggauuucugguuggaaggauggacugggauggcacuugggaauuagaacagaaucaguauuacuccaugcaugaaagucuguauuuucccuucuguagauaaacguaaucauacauuaaauaagccuuaacaaugaggagagcaugagccacucuguauggcaagcagaaugaaaaauugucacauggauuugaugacaguguaaacaguaguuaacaauagaauuacugaauaagaggauggaacccucuaucaucuguugugaaauaggauguaccaaagcuucuguugguuucucuuucuugcuuccccuccacucugucuacacgagaguagaaaauggcacacuaucagcagugguuuaaaauauuuaauuguucagugaaagauggugggguacuccagcaacuggcuucgccucgggucagucauuccugaacuaucucccuagucacguaggcuucuuucuuuccuccuuuucauuuagcuacaaacuaaggcucccuaaaggcucagccaguggaaugcggaaggauaaauaauccauuguuucugcgcacucacaucgugugggaagagaacccuucugcucuguugcugcuaucuguggucucugagagaaagguguugaaagauggcccugaugaugggcagucuuuacucuguacagagcgguaggguguauaugaugugcuuggugcagagucaaaccagagcgugugcuuggaaugguuccuguaguguaggaaugcacagagagugcgcugggucagagagauagugaaaggcaucaggaauuccccaagagcucccagauuccacacguagcccauuggggaccucucugaagguacaguguggaaaagauggugggauuugaccugagggucagauguaagaagugguaguaggugauugaauucagaggcugaggcaggauaagaagauaggacuggggaggagggaaagaggaggacugagaggagggggaaaggagaaggacagaaacaagcuuggucgucaucuccaagauggaggagauagcucuccuccacuucuucaugccuggcuguguaacauuagucuuucuuaaggacaacugggaaaccaucauggccugacuuguguugauagucuuugcgaggucaauggcuauaauauugggaggggaagaggaaguguucugaccucguggaccagugagaacagcaugcagggaugcggaagguaggcggccauguagugaaggaugaguucugucugaaaguagggacuuugcugagcccaccucgaugucccuggcuggugacucagagucacgggaaccaucucucuaggucaucuccuccgugggucccugugggaauacaugcucaccaacucaucacgaauguugcuguccaauggccaccgucacaugacagcuaauuauagccucaucugucugcagcuggagaaagacuuaauacucuggagacgaggcacuggacuucauuauguguucccuaugggguguccucuuccccagcaagaacauuugaugcccgcccccauccagugggagggaagaaaagcaaugagaaugagucaccagaguugcaugaugggaggaaaauaggaccagaaguguggucacauguugguucgacucgaagccaagccgacacccucgccuccgcagccugugguguuggugggagcccacauggguucugcaacuuggucucaaaugagaagcagaugggucaugaauugugcuggcaaagccuuagucauauuauugggggugcagagaaggaggagagaggagccgaacauuaggauuucaacuggcuugcuaauuuuuaauuuuauguuuugccaagaauguaucaacacuuguaguuguuuucaaacuggggcagaguuauuuuguaaguuuacaggguaguaaugguuguucugugucuguauuccauuaucaaaagagacagaaaugauauuuuccugaacuaaauucuccucucagcugaaugaagauaaagaaggguuucacaucuccuggggaguucuuucugucuuuaaaaaaaaaaaaagcaaaacaaaguuauaaaauaaugauauaaguguaggugauggcggguaugagccccuuagccugcggggacaauauuuuuaccuuugaaucaaccaggcuuauuuuuggaaguccaaaaaugcugugcaaaagucaguuuuugguuuguuuuggggacagagagcucugggcuucacacaggcuuagcgcccacuaguagccuauacuccugccccccuuacuuuuuauuuugagacagggucucccuaaauuguuuagcuugaucuugagcucacuguugacccacguggacucugaauguggaaucccucugccucagccucccaauuaacugguacuacaggccugugccaucaaagcugacucaaaccuaaucuuuuaagcaguuauuauuuaggcggugauauuugaccccauauugugaucucuacuuaguuauguuaauuuucuaauucuauauaguugaggagacauucuauggauauuuccaguuuuguacaggguugcauccccugaccauagcacccauagcacaugaaagggcggcucaccauucuuccuucauuggugugugcuuuuaauucugcucugguagcccugaaaugcauguuuccccauucacauauuucuuugguuggguaaguaauuauucugaagaccccugaggaagcgccaugacaggaagugcaguggacuagcgacauccuuaggaaaguauuuugacauuuuucacaggauaggaaaugugaaaacaaaucugaaagauaagccgucgaggcuuugcagagcuccacaugucccuauuuggagggaugggaaacauaaaaacuguucaagcggauguuuggugcccauccccaucagcagcaagggaauuucagaaaugcaaggacauccugugugcuccuuccaagccugacucugauagcacacaugucaugguuagggaaucuguagggcagaucaccucugcaugguggcaugugcucugccucgcucacacagugcucuggcacagcaagcaucuugucacuggccugucacauggcgucuggugaugucuuccguucagggacaaccuggaagagucuucaucucacugaaggccauugaccucuaucuauguccccuaccuucuuuggcaggaacacugugcacugugaaguugucaaccuaccauaguuuacuuaugccagcauggcugaugggucuacuuucuggaaaccuugaugggaguguuuugcuaauacaggucguuuuaaccugucccgagagguuugcagagacagagaauauaaaagguauuugaacuggggauuauucccuagggccuucugcauuccuucaauauugugccuucugcuucuguuuaauguggccucggcuauuggaacauugucugugcccaugucugaaaggggacuggaggcaguacugguuacacucuuguuacuaugagcaaauacaccacaggaagcaacugaaagagaagaaggguguacccuggcucacacuuugagagaugguccaccauggagaaagcaugggagcagguggcuccuuagugccagaggcgugccgguggggcacuuugcuucacauuuugguggaacaagaaauacagagaaagaaguuuagcugagcuaucaagccucaugacccaccccagugacccacuuccuucauuauggcccugaugccuaaaggcuccacacccuaccaacauagugucaccaacuggagaccauguauucaaauacuugagcccaagggagaggccauucaaaccacaacacaggacuuggggagugugcucuccugccugcuuccacguagagaucuuugcaugcucccacuucugacugcaaugaugggucgaguagggaguggcgaacaggacuuucagaagagacgugguuuucauucaguucccuccaguucuggaaacguaauuguuuuuuguuucgagcuugaaagcccucuguggugccuuccccuguguaguuggguucuucacucucuagucuguggauggucgacuucugugagagagacuaagucucauauggcuuguccuuugagguuacgaggccacauuccagggccccaagugggcagcguuccugacccacuuccucuugccugaaucucaugggaagcaagaacaggacuuagcuaauccaauugacccuaggaggggaagggacugugcaguucacagaauguuccaguuccucccguucuagaaucugaaacagauggggcugggagcuggugggcguggcccagugugcuccagacagggagaagaaugagcaggccuuguaaaguccuucagauccggagccaagggggcaccacuggguucaccaauggcauacaucuuuccauuuugcugaggggccucaggaagucaggaaguuguguuugugacacaacucuucucaugugaaguccccaacuuaaccucaaaccuaugcaagccauaaaguccuagcaggucaccaugugcggaaacaacugugaacaaagacucguguuuuaauuaguuauuucggauguaaaugucagaccugacuggacagggucucagggucuuagcucugaugguuuuaccucugugcccuggacuauagcagaacaagccccuguguuggggagaaauccagcaagggccacuuuauaaaaauggaaaucaugagggauccaaauagagacauuucagccuuaauccuacuugacaaagugaacacaucacaggaccuguggcuguuuuucuaaaacaugauguuuguuuccaaucaagucauuuacagaagauucaaggccaaccagaauaggacauaggaugcguggucuccaacgcuucucucggucagguugguggucuuuuuccuguaaggccagcaccaggaaagcugagcagagcauuuagaguucgaggccagccugacuuauauaacgagacccugucuccacuuccugccuccaaacauuuuuuucugcuuuuuuuuaaacuuucugaaaaagcaaaucauaauuuauaugcuauuugaauagucaacucaucugaauugcuuucuggagaccagcacuugguaauaagauuuccugcuugccuaaaaaaugaaaaagauuuccuucgucaaugaagauauccguguuggcucuaggauuggacaucuuugugucuaggcuguaggaagagggggcucucuaucucuuugguucuggauucugucaagaguuucuuaagaccuggaguaggucccaggcaagaugccuacuaguaacccuccccucugggcuucuguauuguaggccuugggcuucacugucucugcccaggauggggauugcagugucuacugagcuuguagaauccccugagggacauaggaacaacucugggaaauuggucagaaggcuuccugcaggugacuggaauugugcuucuuagauggcagaagcuucagaaaaucccagccucgcuacgcagcagucuuuagcuaaggagcuccccuuggcuuucacagagaaaucuagcaacccgaggcuguuguugagucucugcuaaaugugggcgauugggagccauuucucacacagacccugcagcuccuggagucucuuguugggcuaguuucucugagugaaaucaaugggggaagggugaggcccugugcaaguuaacgagugggcuagacugcccuggcuucaaagcagcagguuuagggaauggcagacacuaaggaggaggauggccuuccaccugggggacuugcacuugccuaccuucugguguucaugacuccauagaagggauggacucagcaauggguggacaugccacuaguuauuaauuaguaaccuccuuucucagugugggcuuuccuauccagguacuuuugauaaaacagccugaaccagcuucguggcaagcucagguugugguuaaaggcacaggguaucuccugauaucaacauuucaugggguccagguagucagagguggggacaguuaagucaguuuaagucugcugaggucccucggaguuuuucucuguguguucuagaagguccuucuucagcucaggcuaaagccuuuggcccugcuggugacuggaacucacauucagaagcaggcggagcacagggaggugccugacauuugaaaugucaggaggacuaugagaacgcaggcugaaaugucuggguugugagucagagagaggaacagaccugaccacugggcuuuacuuggcugucaaguguccccaucuacaaaauauacaauuaagaacagcucaccguccuggaggcacuuguugggcuccaauauaaaauaagugucuccagaugggguuguuuugggcagaggaucuccauggugaugcugcuuggaggaugcuguuaaaaauacaggcuucucgugagccagggaccauuauuagcacacguuuauuuugaaggaaccguuaccaccugaagcagacuaugggucugaauuuuauuuccgagcugacacggcgccucuaauaaagcuugcuaaaugguucacccuguguccucuccucccuuucaacaccacaucgccgucuauaacgguuuaaaacuuggauucuaccaagcgcuuugcaaagugcggcgugcgugucucauucugugcuuguuuuuucuccucuuggccacuuuacauaccggaagcuggguuggguccagauuucaaucuugucuuagcauguuguguuaaaccuccauuuuguguccguaccugagaggcugggaugcuuuuuacaugugaccguugcuagguucucacugugcguuugaagaaguuccucuauagcucuugcugaugucuguuagcagacagcaaaugcgguuuguaauagcuuucuuuagaugaauauccaagcuuccauuuaauguaaacacuugagcauaaaaguccgcuccucccugauucuuucucuagucuuuugcaaaguuuuaaguccuuggaaacacaagcaaagcccauugcauggagcccugguucucuugugaacuuaggugugaaacccuuaaaucagaguugagccuauuguuugccuugcaacacuguucacacaaucccuaggugagucuguuuccaacagacaaaggacagccagcuuuguaacauguaucauuguaucacugaguccaaggccuugaacccuaagacccagggauuuuucuaugaagaguaacuugguguuauucagauccagguucugugggaccuugcaaguggugcuaggggggacuugucucgugacuggaggaagaugcugauggcauaauucaaauccuuuuagacauuacauucauuuauuuauuaugggucaacguguguguaccugugccuugacacacgugcagucagaggacagcuggccaggguggguuuucucccuccaucacgugcguccuugggguugauggccagcgccuuuauccacagacccaucucacuggcucucaguucaaaucuugacaauacuuugaaauggaucuccuguuuaaacuuucuuucuuucuuucuuucagggcgauugugguggcucuggcuguggaaaaugugacugucauggcgugaagggacaaaagguaagagcauacacuuuacaauccuguccacaugcugccccuuccccuagauccugagccuaacuguauuaucagcagcuggggucaacuuccuuccuguuuuaacaauuucuccagagcagcccaagggaagcaaaguguugaacagcauucugagcuugguuaucacugcaacaggagcucuccagggaucgcuguaaucaguggaaagucuggauagucucuucaugcugacuguagccgagcaagugggcagcugcugcaccaguuuuugacucaauggcgcuuuuuggaauagacgaauaagcaccagauucaguguguuuuuaaaagaaaaaaaaguuccuagaugcuuugaaggcuuuauguucaaauuaauauuuuuaaaacaaauuuucaccguuuaccuacuugccuagauauuauauauacauauauguauauauaagcauuuguuucucaaauuuaaaacgacaacucucuaaacaagcucacuuccugcuuauuuaagaaucguggauccaggaaaagauauuuuucuugcuucuuggugggccaaacucuccuuuuauuuuuuuaaauauaauuuuguuauuugacaauuucauacauguauauaauguagcuugauuauauuugccccaaauguuccuuucccaucaucccucaggucacacuauggaagccugguauuugaagccaggaguccuaaaugacacacaaaugucuucaacucccaaggaccuuuuuauuuauuuuuuucccuaaaauuuuaaaauguccacacauuaaauucaguugggguuugucguccuuagaaauaggauggggucagcacgcagcucagaaagaguaacagccaccuaaguggcaaagaaugucacagcuggagaaagguugugaucagauucuggugcaagcucuccaagguccccaagggacaaggacagugaguguuacagugcccagucccuucucuggacacuggaggaucugggguagauuaccacauggcuuuguucugugccauacucuugagcugcagguaaaucugaaugcugucaucaagcaaucuauacaauccuacuucacucaggaagcuguccuauuaugcuccacaccaguuguaguuuuauauaaaugagaacuggcauggccaagugauuagaaagaccucuuaaacaagccccauacauguccuuugacuuucaaugaucacccugaguuccuauuguccccacugccuggaagacccuuuuauacucaaauuagguauaacugauuuggccuugcauauaauggcuuugugucuuccuggcggaucugugggaauguuaucuuaaacugauagggcuugauuacggccuggauguuuuugcuugauaaggauucucucuacuagcccuuggguugguaaaggcagccagccccugacaucugcuuuaugcaugaaaguuaagcauuugugcauugcuggaauggggcuuguuuaagaggucuuucuaaucacuuggccaugccaguucucauuuauauaaaacuacaacugguguggagcauaauaggacaacuucccgagugaaguaggauuagggccaccccagguucuuacaccagaccuauuuggauauagguuagaaucugguguccacacauaugugggaaaacauguuaauuuauguucauucaucacugggaacugcccauguucuguugaugaacacuauaauagcaaagcuuagucuuucugcaaagcucagugauucaagcaaagggccuuccugcaguccugggugcacagagaauauuaauuaagacauguggguaucucaaaucuucauagaacgcuuuaauccagcgguuacccagacccuugccaaagaugugggaggaaauacacauuacccugucgcuacucauuacaccgccugugauucaugaccccucuccacacgcuugguuuguaccacagagauaacgucaucacauagagugcucccucacacugccgucuuucugucuaacacgcaugugguaucagaucugaaagggcuggagauagagccagucuggaagugauucuuccgauucuagcuugaaaaucugggaagcauuugguguagcgcuagaagcaagcaugcacaagagggcuuuuccccuuuggguuagaugacuggcuuguggccugaccagcuguugagcccccauagaucuuuaacacuuacccagauccccuguuggacuuaacagauaucuucacaaagacaacuguugcucacagacacuagagcuaggcuuagaugugucacagugaaaaagaaaaggugggagcuuggacuucugugucuacaucagcucgcauauggugaugagcacuuuuaaaaacauguuacuaugacgcuuauuuuaccauggaagaaaguagcuaguggggauucauucuauaauuggacucuccguuuugagugugauuccccccaccccaccccccggggguucgugugcauugaggaaugucuugaagccucccuggucucuacacacucaguuugggaagcacauugcucuauugugaugaauagagauauccuuaauauagcuaaauaugucuuggaguagagaauggagaacgacuggauucacccacucuuagcagcugcuaguaggagcccugcuuaguuucauucauaaugucagguuguggaacauuuacaagaucagugcugcccccuaaaccaauaguggucagaaccaugucuggaggauugccaaagaacucagccuguuccccuaggauugugggcagcccuuccagaucuuguuuucagagagucaaugaggcugucagccuguuagcaaauggaccgcagggacucaugcugugacagggagcuggacaggugagcccuuuguugcagucccuccccccugagagagguugugagaacccuaccuagauuaauagcaucaggcuagccucaggccuguuccuuccaucacgggaaucagguuagggguuaccaagagaugcagagccccaccucccucucagugagaauucccguaggaaacacuggcacccaggugaccuucaagaaaaugcauagcucugguuaaaagucagugagcccucauugcuuacugggcacaguaccuccuuggcuuguuguggccuuaucaaauauguggccuuaucaaauauguagucaggacccaagucuaagacacuagcuucucucaccccauguggaagaggugccauugcugucccuauacauucugcaggcucccuagagcucggauggccuugcuggucugucuauaggagugugauuaguugccuuguguuugguugcaccuuuucugguugcucagagcauaggguuauaucccgugucaaagacauaaugaguaggagcaaagcccuaucaaggagugcuugcucaucacagccgauucuaagaagagagguggaauuuuccagccuuucaaaucuagggacugcuuuacacugccugucccucaucccugcagggccaugccuccugucucagaaccggaaauucucugauucugagagcgucucggcuuacauucuagucauuuuugggcuaugcugugaugaucacuaaagaugccugaggccauaacaucacuuuuaagaugcaggacuuuacccucucuguaucacaaacguagacugcuuucuuagucaucauuaggucugaggugacauucucucccaaggcaaggauuguacuuuuuugguaucuuuguaaucuuccauuuacagaugcauucauuuuguugauuuuuuuaaaaauaggaaacacuuuagucaugauuuuauugugaaauccgaguguaugagcauuucuauauguucugcuuagcauauggguuaguggcucucucuuccuugucauucucugggucuguguaugauuggauacacugagauccuuaaggauggcaggacaagauuauauuuuuugaguaguagacuauuuuaaauuuguuuuccauaaauuaagcuacgccaaguauauuauuuaaacguuaggagauagccuauuucuucccaggaaacgcauucuuuucuguagccgcuuauguagucuugugaaguuucuuugagacuuugagccaguuaguggauuugaccgagcagcagguuauucauaagaauaaguaaguuuauuaaauacuuucucugaggagauacuucaaagaguuuugauuaggagaaucgaguguguuuaaagagaagauuugggugugggacagugcgugcuucccacaccucacacuuggcagcaguaggcaggugcuuuuguuugcugcucuucuuccaucucacagggaguggcuuucaucaagccacucaugcuaguugcucagagaaucauuacucugagcuaguguggaaccccaaguuccacuuaggaagcuaaccgcuccagagugcggggcacuccugacaggucagcagggccaguauuuuucagaguugagauaaauaugagggacauuugcuugcuggcucaacuugcaacagguucauagacugcagaccagccccacucccugcugaacuccuccauuccgacagagguggacaccaagugaccaauuggcagcucccaggacugagagaugucagucacagcagaucugaggugggcuuuguccuuucugcuggaggaggugugagcuguguuuggggaggccuuucuggaagcaucaaccacccacuucuagcccaccucuuauucuguugcucauuuccaaaaucaucacccugugucuuccagaagaacccaacuccuguacccgaugucccagcuuucccaaacacucaguguucugaagcuaacugcucuuccuguagugcauuuccuuccaaguucugcccaggcuaccccaccccccuuccuugccaacaguccuuagucaggucucacugcaggguguucuguaggaaaugguacugcauuucggagaaggcagggcuccagggcucaguugugucuggcuccagcucucugggccaugcauguuugucuguagacccuggggauguucucuucccguuuggugggugauaugggccagcacacacucguccuuuuccauguguagcugcugucuugucaugccaagauuuuuuccagauguuccuauuucccauuuccucacacugcgcaugaaucauccccuggcuccccgaucgugagaaucggcguugauucucacagucaccuacuuuuguccuuuuuuuuggauagaauuuuaaaaggauuuuauaagaacugucggaaucccaggacacauucgcaguuugccacagggaagccacuaagagggauccgugcccacgugggugugacucagucugcacacuguguccuguuaugucuccccaguuuaucaguacccuuuaagggaccuggagcugccucugucauuguucauguucauccgccuagacccgaacauuagcucugugugccccuuagcugugugcuuccaaggcuguuagacuaugggguaacuccccaccgcucuccacuugcagcuguuuggaauguagcuacucuagcacagcuaggaacauaguaaguguguuugguucccauguucagaaacagcaguagggaauuuagugccuugaaauuagguccagagguuggcucaugacucugacuaagaaguccaugguccugaauaugauauauagcccuaguucagcuuugauuggaaguggauuuucguggaagauuggccauggaauucagucaaugcacaguagggccccagcauccuguggcuuuaacagcuuggcauuucauaugagacuacacuguauccaucgguaaggcaggcaucuacagcucuucucuugauuauacacagccaggaugacaaugcuuccuuuuuguagcagugaacccaauguaacauuggcugucaggagaagagcuuuugaaggggacaaaaagagguuguguauuuuaauuaaagaucaaagacuuacccuuacaaaugauaaccuggccucuggauuucccuguuguauguugguugaugccuagaguacacagccuaccuuuccaggcagcagucaggccgauaaugaagguggaacauggacauuggggacuauacccucagaugacauuaacagagccccgaguccuugugaagugguuggagcaaggugggcaguuaaacaaagggagaaucagagugaaugaguauaccagauggcuuuggggaagugcccccucuuguuauauuuuucccauuuggcaaacccauuaugaugucaaaggcacaccucaacucaguguccguguauaguuuagcauaucuccuggcuaauuagacaauuuuuauaaugguaauaugcaaugguucucaaccuuccuaaugcuggggcccuuuaauacagucuuucgugugguggugacccccauacauuauuuuguugcuaccgcauagcuguaaucgugcuacuguuaggaaucauaagauaaacaucugauaugauaccucugugaaaaggcuguuugacucccaaagggucaugacccacagguugagaaacauuacuugacuucauguuaaauccacucaacuucuuccuaugagguucagccgagagaaggugguguuugaggagugaucucuaagacacugcaaugaaaccauucauuccuucauuggggcaucaaaccccucagugggguccccuguuuguccugaugauagacccaucuguuacuagagaaaggauacuuucagaaauggcugcuagcugggacuuucucacuguuucucgggaucacaaaggcuuguccaguguccugcugaaggcuuucacgucgagaagucagcuuguggcucugcgugagagguucauggcucuugaggugaugcgaauuccagggucuaaauuacccagcuccaggauugguuuggaaaagguuuccucuggaagcuuuacaaaggaauuacacugccacaggaaaggcccugagcuagguuucuaagcacuucagagcucugucccucucuccugugugggcucucugugcucccgaggcacuggaaggcuuugguugaaguuacucaggcaggcaugcccuuaccacauaaccacagugggaggagcagcaaugcagcaagcugggcacucugcucgggcugaggagggcagaggcaagacccuuaaaauagcggugugcucgacugcacucaagcggacucugaacuuuacuuccauacucaaguuuacccucagugaacaaggguacauuuccaugaugggagcuuguuugaaagcaagaaaaucuugucccaccgugcugugguacuuugaucuaaagaggugcucauuuuuacggcuggaaagaagagcccuaaagacuucucccugggcuguguucuuacccagaaugccaggguauuuucuccagagcuuuccugcugucccgaggaaucuaauaaacaaucaugauucaucccuaugggugacucaggcauuucucuccgcucugccuccugcugauaaggguuuggagccccaggggguuggugucuugcucagagguccuugguggggagggccacugggucuauuccuagaccacacacaguguuaggaacagacugguguaggcuguguccccucagccuggaucugcagggcacccuccuccaggccucccucuuccuggccuucgcauccugccuuagaaaggggccacucacuucuuccagagauaacgaggggcaguuaauugggcgucuugccucucagggcagaagcaauauacaguugaguggacuuccagcugaucauaacauuguaacuucugauugagguuaaaguaauaaaguaacauuuuucuuuuuuauggguuuuucaguugauugucucuauugaggagcaacauacccccucucacacacagcuccccucuccccccuguuuccaagaccugaggauagcagcugggccugaguugauguugaucuuaggagaauuuuuucagacuuguuuucugggccccagaccaucucuuuaccauucuuuauguaauucucucacauucccccaugauuuacuagucuuuuccccgaauucucuuccccuuuguuugcucacaacacagguuuaccggaucuagggugagcucccgcccugugagccagagguccaaaucaguccugggaugugaauuucagacaaggggaucagggacccugauauuacauagagcaucaggaugauuuucuuugucuuagucuguuuaagacauuguuguaacaacacaacccagacuaagagacuuaaaaauguaacucuggaggcaggaagucugaggucauggauuccuugucugauaauggcucacuucuucacagacagguguuccgugguguccucaggguggcagagaccaagagcucccuagguucuguugauuuuuuucuugaccucaucaacuuccauagucccccccccccaccccuuuuuucacaccaccaccuggagacuagaaaucaacucaugaauccugcauucagaugugugggucaccuggggaggaggacaugucugucuuuacugcaccuguccccuaagguggacagcuguccaugcagcuguggcuaugguccucucugucuaacacauuccuuccuggugaugcucacagggaaagacaucugacuuugugucuuccagcagugcugaagaccuccccacaggccucucuagugucuuaucagccagagcuggaauucgguggcuugcaggaugcugaacugauuugaggucagccaugauggugacuuuauaaguagauguuuccucagggucaaaugcuuuuccagugacuguguucugggaaaagggcccugugauucagcagaauuuagcagaggaccuccaucacucacuccucuugcaagcucugaagugaaaugucugagaugcugaugcccuaggcuaucuccccguuggcuccugggaugcccagcaggagggcugcccugcuuucuaucuccuaaucuacuuaggucucccauguuuuaucucccaaauaauuuuucuuggacaugggaagugccugcuaugaguugaaggaacuauuuaaaucuagccugacuuccuccaauggcuucucugauuguugucacucaucaagaggcagugugucagaaguuucuuagauaaggaucaggagcugaagagaaggggguuugagcucaugagcauggggccgggcauggccauuucccuugccuagugaccugggaauuugugggugcauguucucagaccaguguguaucuuuuguuugcucaucccagccuggaacuguacacaugccuucucuagggcaggacucucucaauggccaagacagagaaaagguggggggagacagacagagauagagauagauaaauagguagagauagagauagauagauuggcagauagguaaauagauagagauagagacagacagacagacuggcagacagacagacaagacuggcagauagguagauagagauagagauagacagacagaguuagcccagcugaugccuagaaauggucuagacuucuaaacagcuuauauuucgaaccuuaugcauauuguccauugcuucaagcaacaugagcaccuagugcagauuaaauugggcugccuaagggcauuuguuugcacaaugacauaugugcacaggcucaggacaaucuguacucuguccagcauuuugcuccugaaguuaucauagcgaggcgcuuaaucacauacuuuauguaguagccauucaaggacagggugggugagcuuguccuuucucuaugccuggguguagcugugggggucucugaggacucugugcaggauggacaggccucuguugguuuggacuucuaugugugagcucaggauugccacagggugaacaacuguauaccugggagacauggggagucauuugggugcuuggcuuaugagucuccucagcuacuucaucucuuuccgaccuugacaccuucgagugggcagugugcuggcaagccucggugcucugugccagcuuccaccccucccugccccgucucucacacagcugggcuuggucaucugcucucuaaucuuuugcuguuguuauuguuaaaauagcaaauuacaugggagaauguugugguuuuauauacuguaccaucuauacuuaguuccgugggaaaguuacggccucauaauuagcaaacguuaaugaaauuuguuucccgcgucuugguucugagccaaggaacuuaacauucuaaucuaucaguauuaggcaauuaaggacauaaaagcaggaaacgauacuauaaauuuaguaugacuuuacaaaccucuaugaaauaggcccuaguaaaaauggcauaaagaguaaaucuaaguuauuauuaugaugaugguuuaaauaauuggaucacagccuggcuuuaagcaugcuucacuugagcuucuaaaaccaucuguguccagucugagcugcacugaaauggccagcugaggaaaaccuucagacucugaggccuuuccucauggacuguauuuuacagugucuggucaucuuccucugcacuuacauuuaaaucaagauuuuuuuugaccccaagcaaaauaauacagaaguucggcuccuuguuuuguuucuuuguuuggguaguuguacuuugaaggagcugugauguuuagugaaaacaggcuaaaauaaaucccuguauguacuggcuggaguccauuagacaauggcuucccacggucaugagguuggucucuaugaauucccaagcucggccaaggcgacccuguguuaauggacagggucucauuuuucuuuugccauuuggagaagcccuuuaugugguuagugggguuugaaacuacgcuggaucccaaggggagaugggcccagggcugauacuugccugguggcuuggugaggaagggagguuaaggacgggcaccaagcugugugccaccagaugcaugugggcugcaaccugaguccucagaccuuguuagaggaugcauuggugugugguggcccggcacacaggaaguaacuaauucuugaucagaguugacccucggaccacugaugccuaucuacucacugggaaacggacuuuuggagaauccaaauaguugguauuggagccaagaccaggcucuucugauucuuguugaaguucuuuccccauuagagcaaguaaugagagaaaaccaagucagacuuccggggccuacucaccggaccacagaucucuguccuugucagucaggcuuggaaagcuaggcucuucaucugcaucuuuugcuuuauuuauuuucucauuuuuuucuaguaaacauuuuauauguccuaauuuaguuuugaggguaucuuggaaagucccucauauuuaacuuugaagacugucuuaugugcuuauauuauuaguuauaguuuuuacacucaggaucuucucuucccuucccuucccuucccuccucagccccucccccgcccccuuuuugagucuguuuccuguauccuugaacuccggauucuccuccccggauucugagugcuaggguuacggggugcguggaccaagccuagcuugucugaguacuucauuuguauuguucauauuuuuguuaccacagacaaaaaaaaaaaauaguccauggccagacuguggcauuuccugacauuuaucuguccugguuuuguuuaaggucccgucacacccacgugcacucucaaguuaacagcaucuucacccuccaagggcugcuuaggagcagaggguacuucucaaacuucccauuaguggagagaauaggucuuuaaacuguugauucagagauaaugaagacaauaagaaaacuuaucuuuaugggcaaacgauuuuuuuuucuuucugagcucaaaaaagagccaaccccugugaaaucuuauuauccauuaucuauguucugaacucucagccccuccccaaacuccccaucaagccagagcauagaauuuugaucuuuucuuggaacuuggaaaaagaggcagggcagucacauugccagcacggugugacaucauggcugaucuuugcagcccucgagaccaucaucacguguugcccaggucaggagcacguccugcauaccucucaacucuaccucauccuucaaggacagccuucauuuaaaaaaaaaaaaaaaggauccuaguggaauuaguaacaaaagacaccaacaggucaagucacagagaagggauacuuaagugaccccuggacugagggcuaaagggacacuaaccugaguguccgaacgguggcaggccaguaccuugcagcaccacuucacugucuacaccgugggugcuuccuugcuguguggcuugguguccccagagugacuuccuguguggggugaacuugcuguagcaccugaugcuauuaccugcccacacagaaggcccagcagggagccgugugccgcuaggugaagagcuugggauggcggcuacaaaucaggacaagcaaagcaaguagaauacaacugcuacuuauuugguggugcuuaacccugguuuauuguuaacccugggucuuguuuaguucugugcauauaaguccccuaacuucuguuggccccaguuaccugauucagcccugacuugcuguuaugccucagggccacagcuaggaaaguucccaaccugucauugagcaccuuguaggucuauugcuuuccuguuuuaaaagaauauucguuuauuuggucaauuauuaauucauuuuuuugccaacacuucauauccuagguuggcccgcagcucauuguguaacucuggcuggccuuguacuuguagcauuucucuugccuugggugcuggcugugaaccucugugccuggcuuguauguuuaagucuguaggggaggagcagguagaggucauacuaauagcucuaagcuucagaagugcucauguugauaagcuguuagcauugugguucaugucaccaccucucuggaagcuacugaagauugguuggauccccaccaccaccaccaccaccaccaccaccaccaccaccaccaccaccaccacacacuuuacaguuggcaagugccaggagaguggaugagauuaccuuaaggcauagguuuucuauagcccagggaagggagccaaaggcaaaccuuugagucugauuugcuggcaguguggugagcccccacaguggacucaacagcucacucuuguccucuuugugccuguuugcaggauuuaauuucuuucugggccauaugcaauucaaacuggaacaugcccacgaugcaagugaaagggaccagcaggcagaaggggaggaaagaguagggacugggagaaguggcugucuucauucagcaaaaccaauauucacuaauauaaccagaagaauucgcaguucauauuguuucuacagucaaaggucuuggucaccucauagccccaauauuuaggcuauccauuucauacuuaauuucauaaauuuuccauuccaauuaaagcuuuuuuuucuagacaauucuaucucuuagaccucuguuaagcuuauuucucucuguugugccuacuugaaugggcacacacacauacagcgugcauauacacagaggugagcugggaucccauguagcccaggcugaccuuggacuccucaucccccugccucugccuuuugaguacagggauuucagggcuugccaucacaccuguuugauacacucuugcuacaguaacagcccagaggaucugcccagcacauguagaccaagcucucccccugguggccagacuaagagcugcagaggaccagcugcccaugagagaccacagguuccugaaaucuccugggucuacaauucuucuccagggagcagacaucuggcugggguccucuuguguguccaaggaguggauagcacuuuccugaagcuaccuaggucagagggccaagagggaaugggaagaaagaagccaaggcugaggcagagacacuccgcagaugugagauguccuggccaguuaggaaagugcccaagacucccggugagucuagagacaggaggccagcauaggucuuacuuucuaauauaaaaccaugcaugcuccagagagugacuuagaacagaaacucugaaagauaccacagagaacugcccuccaacuagugugagaugucugcaucuccuccgcggaggaggacuuggaaaucguuuucuuuuccugccagugacuugccagcgcuccauucugcugcugcuuccccuccaucagugaagucacauuugcuguuggauaggcuucaugggaaagucucgagucgucugugagaagagguuauuuaccgcacuugguuauucuuguguugagcgaguguuagcucuucagaaaguguuuugcauuuuuuuucaaacgaugaggaggaaaauuggguuuuuauagccuaaaaaaauuucugcaauuuuuuuguagcuguuccgucaucaugacuauuuacuaugucuccucucuaccuuuugcugcucugagccccagaguuaacguuguagcaaugugugaggugugagcuggcagugguaggacugacacuuaacagcaguucaguggaaacuucuccccugcuacauucaauucaugguggaaaacagaacugaagagcuacccugacucaagaggcccuucccuugucucacuguguggguccuguccccucucccugcaucaguacagugucaagcagaaggcaugcagggagcucccagaggggccccgacacaggagcuuuuccgugaccuggugacacagauugcagccugcccacaacuuucccagcacuaucacauuccggauaugguccugcggaugccucucuggcuaggcucaagggauugaacuuguggaauuuuggcuaagugccaugguucccccauugacuauggucccuauagaucauggucccccgaauugaccaugacccagcaucccaaaucgcuucccacuaagcacaugcccugguugcuaugggccaaaucucauggcuuuuaugucucaguuauguucagucuugcuugggaagugacaucucagggaacuagaugacagcaggacacagcuggcucaggaucacguccagaacagagauuuuucuguugcuauuuagcuugggacagaggcaucagccaggugcuaauggggccucaagggcuugugccagggaccuggguuguauucugccugggauuuuccguuccuugggugggguguguugugcuguuguuuaucucagaauccugucucuaguguugaugugugccaaacacuagcugaauaacuucuucaaagaagguguagagggugcaucccaagcuuuaauuuguguuggccaucggauucccucuauuuucugugaaaacacacggagauccucuuacccagguuuuguuucaggugugagcaaacauuuuugcaugugcugugguucccuugaagauccaugauccuauuguuuaaaauguaaacaaaacaaaacaaaacaaaaccgugaaagccucacugagacaaggguuccaugcugacccucaaaacagccacaacuuauccauuuaaaauauuuugcuaaacuuuagcauaauauaauacaugcuaaaauuuaaaaagauauacuuucaguucuauuuuguacagaaguaugcuuugccugcaugcauguauguacacuaaaugugugcccagcauccacagaagccagaacagagcaucuaaucuccucaaacccaaguuacagcugguugugagcugccaugaaccaaaccugugucucugcaagagcagccagugcucuucaccacugaaccauaucuacagcucccuagaucaacacuguagacacagaauuuuaauucaucauucagaauaaacucacuacauagcccaggcuacccuaaaacuagcauccauccuccugcuucagcuuccuaagugcuaggauuagagucaccaccccuggccaucgugauugcuuuugauaauaggaguuuuugaugauaacuuauuuuaggcacauuuuauguucccuuuaguuuuuguacuugguaauuguuccuugaauuuagaaauucccuacuauuucaaccucgcauguucuaguugcuuccuauuugacuuucuugcugagacuugagggagcugaaucuuaagcucuuuuugcaguguuggaagaggcugggacaugauuggguauuacaaagggacccuuucuuuccacauuuuacgggaucuuuaugugcuugcuguagauaauacgguaagcaaacauuuuaaguuccuccagcaugaaacucuauuucaagccuaauuuggaauggcuagugucagccccgagaugacucugaggccugccucccuucaucuucauaaacaauggcauuuuguuccucucuucaaguuccaaguuuuacuggggaaaauagccguaaugguguuccuuguuguauaaucuuuuuuuaaaauuuuuuuuauagauacagauugaauuuuagaaguccauuuauaguuaaaauuacuuuaggggcuagagaagaugaguuuuuaaaaauuauuauuauuaauauuggcacauacuuauuaggcaaagugggauaauugacaucugcauuuggugugacagucaggucagaucaggauggccaacaucucugucucuucaggcaucuacugucucagugcugaaaaccuacagacuccucucucuaugacugacauaauuaauuucuuguaacaaugaagccacaaagcgugguugcauugaauuuuuuuuguguaauauuuuacaagcuucucuuucuggcucucccuucccuuccuccguugcugggaugagaaugcagggauccacaagcuagggaaauggucuguugcugagcugaacccucagauccuugccuucagcguugcuggcucacugucguggugaaaagccaugguugugguggucaguugugaccacccuguccuuggugcuugucgcacacugugggaacuggaugacaagggggucuuccucccccacuuugugcuuggccuugagcuuaaggguggucacagcuggaauggugcccacugcagcugcagcaucugguguggaaacuccuggcucugacauguccagcucgcugcucuucucucuucccuggcagaaaacugugagaagcaggauggagccauuugguuccagcgcagugugcgccaugugcuagcuuguuguauaguugugugagcgcuugucccgucucucuauucugcuucuguucucaugguaacauuagagagggcacuggguauccgauuaugaacaugcagucuuuacuagaaaaaaaaaugagaacauuaaaaaaugaggaauagcaaaaggcuugugaaaggaggcgucacuucccucaguuacuugauugcaaaacucuugggagaugugguugcuuaagcccuccacugacauuuggggaagaauguguucuuguggugaaggcuggucugggaauucagauuucuuccuuucuguucccaggagugugaggggucaccagugacaugugaccagucagcucaggauggguguugaacuuucuggacaccaugaacauaagaggguccgauuccccggcugacaucaugcuguggauucguuuaauaugcuacugggaaccagauugcucuagugacccagauaaagaagggaccuggggugggcugacuucauuucuaauucugcuucagagcugagucaguggaaaucugguaggaaucaggucaucuggcucccuuccccgccucguucauuccaugauuaaaaugggaaauaaaaaaaccuuaucucugcuggucuucuggagauacugccaauaucaauuaaggacuaaaaauacuccgcagacacacuagaaaguucuccgccaauguuccauuuucgaguccuccccagcucaguuuggguuauuugagaauuugcaauucaauuuuuauuuuauuuuacuuauuuauuuuauuauuauuuugggggccaucuguucagaguucggucauagucucuuuugaguugucuuuuucuacaucugaaaacccuucgagagagcacuuuugcugcuagcaguucucacagcuccucgguuccaccaccaugacaggcuaagggugaacguauguuucacucugccuuuggacaagucuugguggggauuuccuuccucagcgcucacugggcgucugggaggaggaucccacauccauaugugugugcuugaaucugcuccuuccaguugguuucauugcugcuggcccagggguggaggaauguacuauguccccucuccuuuugucuuuauaaagacccagaggaucggugagacccugaagcaacugaacaguuuggagggaagcgggucuuugaacaugcucccuugucucguuugaucacgugaugguggagaccuuuuaagcaccucauggcgcgugaagugcuacuugaggggguggggaguggcaaauaggguccuaaccaggucauuucccuuugacuuugcacuaaugaagcuuagagaaaacccuugagucuuaagcaacccugccggcccacucuagagucucucaugcuuugaaaugagcuuuagcagguuaccuacagaguaaagauaaaauguguuuauggguuuuuuuuuuguauugauaaucuaaauaugccagucucuaaaacaucccuccaucagacccuuagcucccuuuugcugcuacaagguacucuaaucucucuagguucaaagguuggugucuccuuccuguguguucccaccuuacaguuuuuuuuuucuuuccugugacacccagcccugcuccccagucuuucuccagcccgcagugcauagcagucugacuccuuuugucucugcccauauuuauuuugcauucaucuuuggaaggucagccuaagguccagagcagcacauuuuuuuucucugucucucgacuuucucuguuuuuuguucuuucccaguguauuacagcccuugucaaacauuuaugccaugaaugauaguucuuauuuuaaaaaucauguuucuuauuucuuuucugaucuggggcagaggccaccaguaaacuuucaucuuuucguuggaaaaaaaaaauuacuguugaaaaggagacugaucuaagcccaccgucaagcuauugaucauuugugugcugagaucagagcugugucucugcuuaucaguaccugcaagggucuaaaaagagagacacggaugggcugcucagaaugucaucuguugggagcaaaaagguaccaguggcugggugagauuauaaccaacucaaugaauaaaacucaaguauuuuuuuuauuuuauagacuuuacauauuauacagcuccuaguaucuacaagccauuaugucaggugauaaauauuagaaaucuaacauggaacaucuggagaagguuucauccuucauuuucauauacucaucguauucucuuacggugcugggaaggacuuagaaagguuuauacuuuaguccauuuccuuuggcagaacagccaauagaaugagcagauggguggguggguggguggguggauggauggauggauggauggaugagugcaugcaugggacggugguuggcauguuggauguauguguagauggaugaguagauggguauguggguagauggauauagaagggagauagguggguggauguguggacagguggguuuguagacagguggguggauguauggacaggugcgugaguggguggguauauagaugaguagguagguagauguguggauaggugggugguggauauguagacagauguguggguggguggguacguggauggauggauagauggguggauggauggauugguagguaggugagaagagauuugcucauaaaauuggcuccuaugauugggaggcugaggaguuguaccacaugacuccugaaagcuggugacuuaacgaauuuaaggcuggaagccugagagccugggacugcuggcaaaaucugugugucugaagacuggagaucugaacuugugguguaaggaccaagaauugcccucugcuuuguuauggcucacaccuccgcugucugaugcuccagccuaugacacucaaaggcaggucucccucagucugcccacuaauggagaugcuguucuuagcacaacaccuugcaggcacagccaggagucaugcuucaccagaguucuggacucgacguggucaaguuaacaccucaaaccguccaucucagcugauccuuuuucuuacccugacugaccuguguguugccccacagggagaaagaggcuugccaggguugcaaggugucauuggauuucccgggaugcaaggaccugaggggccacauggaccaccaggacaaaagguaagcuugacuggaauggggggagggugaauggcagauggcgcccaucuugugacagugaccugagcccuccucauggcauuucuguucugcuguagggugaugcuggagaaccuggacuuccuggcacaaaagggacgaggguaagucgaaaaucuggugacucugacagaggaccgaggcgucaugaguggggugcagccuccaccccagggcugccuuucuauguuuccucuaugccuucccuccugccucucugcagugucgugggccaucaccccucuuucccgugugcuggugcugcgugcaagcagaacucuugcuguaugaguuugcuugcuccuguuuacuucuugaagggucccuuagagacauuuaaauuugggagaggggguagcuaauccaagucacuagaggacgagagggcaucauugacagugaggagacauuguuagagccaagcucucuuuacucucucugcuucauccuuuucagaaagccccaagaugaagcucucugaguuucaucaaguacagaagcagugacaugaaguguugggccaugguuacauagcaagaaagggguggggcacuggugucagcggagacucccuggcauuccacaagggcucacagggcagagagagaaaugugauugucacucuccggauauaguugaccauaccugacuguuuaggaauuggaagaaagagacuccuaccacgaauacauuugagucuauucuacaaacacuucuucauaaguguuaacaauuuuaaugugaacaaaacauuaauuuuuaacucagaucccacaagagauuuaaugggggcaaugguuauuucggggcauucacagcuuugauuuuggaggcaagaaacagugagcuuuugacaacaacaacaacaacaaacaaacaaauuucagccugaaucuugagcugagucucagugcuucuuucccagaaugcucucugcucgcgcucauguucuaagcuugaacugggaggaugaagagagacacgagguuuccuguagcuggcugaaaggccuuuguucugucuuugcagggacccccuggagcagcuggcuacccugggaaucccggacuuccuguauguauacaaaacgcacgcaucaauuucaugaaauaucuuaccaccuggugaguuccuaucuuucugacuucuucauuugauugguuguaggguauuccuggccaagauggcccuccaggucccccagguaucccaggaugcaacgguacaaagguaaacuuaaacccuccccucccuugggcaugugcuucuaacuucacacaugaccagucacugggaaguucuuuaucuggaagcuugcuuacuuugauggggguaggggugggggauaagggagugggaggguagggaagggggacgaugcaguuuuucacauuaaaugugugggaaagauaacaguuccuuucuacuaguauacuuuagccuaaaauuguucuuuuaaagauuuuuuuuuuuuaaccugggacuaauuacuguauccaaauagaaucugcugcucugaguccuuauuucugugaaccuagcuggggaguguggugcucccucugugaaguggcacucagggucucacuugugacagaccaugcuugcugccaccacugcagucucucuaaugggugggacagugaugucugcugugaaguguuggggugcauuugugugugacauuuuccaucuuucccagggagagagagggccgcucgguccuccuggcuugccuggauucagcggcaauccugugaguacaagauuauuuaaaucggauuuucucuggcuauccucccacucaucguuuggggacucauacuuuacuacugcuaauauuuucggagaagcaaaacuuacagcuaaauuuuucuucuagggaccaccaggguuaccaggaaugaagguauguuuaauuuaauuuuguuuuaauccucuggguuccucauaagaaaucaauugaaaaaaaaaaaaaaaacgaaauaaauguccuaaacucuguuccauuuaaaucacacggcuuaggguucagauccuuguguguguaucucucaccaugccaugagccaugugaggaauugaggaugugacucuggcauagaacacugggguagcucauuggccaaauagccugaccagcccacuuggugggcucugggccaguggaagaaguaagaaaaaccaaaaaaccaaccaacuaaacaaacaaaacccaaacuagauggugcuugaggggcgacauccaaagcuauccugugucccucucccaucccccaacuuuccauucuaagucccggccuggggccagucccauuccaguauugaguggguucccguuuuuucuacaugucuaucaauauuuugcaucuuucucuccuuuuuugugcccccuagggagauccuggugaaauucucggccacguucccggaacacugcugaaaggggagagaggauuuccugguauccccgggaugccgguaagccauguggcuuccgucuuugagucacucccugguggcuugcaguaugguaauccuuucucuucucauccaaucgcagggcucaccaggguugccaggacuccagggacccguggguccuccgggauuuacuggaccaccggugaguuuugaggauagucccauggagaggagacguggaacacauugaagcugacugagacugucccccuuguggcucacaccuccagcccccaacccccagagcugugggaaaaaggaugcuuuauacgguggacccuccagacauccugggacagaugggacagaucaccugucggugugccagggcuacuagauacccauaugucaagccacuggggaagugggacugaaggucaccagcaggggcucugcccuuugugcagaggagaggugcuguagagucagaggugccucaggauuaggucaggucaguuaggagccaggcgcagaccuggggaagacucugagagggauugagcaccugggggggggggggugcucaggaagaagccccgccccuggucucuguaaggcugacauucuuugcagaaggagagagacuuuuccucacuccuucauuuugacaacacugaaagguuagcauuaaaagacuuaucuacuaagaaucaagagugcgaggaauggucagaggugacggaguucguggccugcacacagccugccugagcauccucucagagagccucggacuuauaccuuaaauucaaucauuuucuuuucguuuuuauauuguuuuucuccgcaugugugaacaggauccacccgccuuccuauggaucagugagcuuguuuuuauauuccagaauggcuggcuuccuuuuugaaaaagugacuauaggauucugaauuuuucuugcaaaugugggguuaucuuuuuuguuuguuuguuuggugucagcauaaucuauucucuagaagagucaccuuuuccccccugaggucugaaguggacuuaugucaaaaauggacagugcuguucucaugugggcaacuccagcuuggagccuaggcuggugcccccaggcuacugguacccaaggacaggcugcagccuuugagggacuucugcccuccucauaauuauccugacucauaacuggcuauucucaaagcuuaaaaggugugugucgcacacaucauccugccaacaacagagugcagaggacugugugugugugucagacuuugcuaggacacaauucuagaaggauacaguucacaaggaggaaagauucgucuuggcucacaguuucaggggguugaacgcaugacccaagguucugugguuugugagccugugagaagguagaacacugugguggggagcaugagguauaguugagacauacugaggacucgcggcgggggggggggggggggagacaaaaugccuccuucaaaggaacaacccuagugacucauccuucaaacccucccccuucccccaccgcaagaacucaccaaugguuaggcacccuggugaugcggucaccucuccauagugcccacaaaagacggaguguguauguguguguauguguguguguguauagggaugaucuuccagaucacagcuggcugguuuugaauacuauuuaauuaaaaugcucucucuuacaggguccuccaggcccuccuggaccuccuggagaaaagguaaagauauuuuuuucguugauugcucucagucuuauuauaggacuguggugagauuccauaauaccuucugagccucauccuuacccagauauggcacuaccuguuaguacuaaguaucuauguacugucucucucuauugauugucaucugucagucauuuuucuauugucuaucaaccaccuacuaucguucucauugcuauuauggugauggugaugucaccaucaucacuauuaccaccaccaccaccaccaccaucaucuuugagacccuccacucucaucuccucaugccuuaguuauuacuuuggauucauugaucauucccuggguacuuuucugaacccagaguuuaaaacccuuacauuaagaauucuuuauuauaauauuuucaaacaaaaaaaucuuugcacagucauugcauccagcagggcuuuucuggcaaaagcccaugauucaggauggaacuguugcuugacgccaaaccucuugccucgucugagcggggcuuuaggaugaggacaaggugagccugaauaacaaagugucauuuguaaccaacagggccagaugggcuccagcuuccaaggaccaaaaggugacaaggugagugagaagccaacgugcuuccucugccugcagcugaaccgcuaggauuagaguuuauuccacaaaaagugaggcuaaucguguccuccagugacacgaggccaucaguucucuuaucugaacacagagcucaagcaacgcauccagcagauugcaaauuuguuucaaaagagugaaauuuagauuggccuccuaguugcacucuguuaaacccaaccaugauggcagccauuucgaggaaguaugauguagggugagauugguucuuucuuggggaccagaaagcaccaaggaugugugccuuggcagaggcagauguaggguggugaagacuggacaaacaucuuuuucuuggcaagaaggcugagcagugaacaccugguccccugcuguccucccuaguagcaucccuggguaagauaagacaaaggggcauuaucacaacugcugccugccuagggggugugcaaguuggugugagcagcugcuaccaguggguaccagauauggugggucuggacagagccugggcucugcuuuuuacuguuggagucuuuggcacucacacauguuuggcugccuuucccuuuaauuccaaaugugcccagcuguuaggcuguuugaguaagagaagcccggugauucucugauuuuucuuuuuuuuuuuuggcucgccuaaaauauccccuuuccugccaagcuccuaucagcuguguucucauuagcacagugguguagcucugugcaggugcaugcacagguggguccugcagcugugcaggcuucuaagccugggaagcccacuucucugguuguagacaccuggcccauuuuccugcagaagccaaggcuuuugcugugggacaaucauguccuaucauuuaacuuccggccguccuauccuaccucgguuuuuguucuauuuuucauaccuaauuaaccuccacauuuuccaugacagggagagcaaggggucagcggucccccgggaguuccuggacaggcacaaguuaaggaaaaaggagacuuugccccaacaggagaaaagguaagucugggcgcucuucgguggaugucugcugucuaaguuuggacaaaaucagagggacaaagagaagcuggauugaaacucggauucucuagccaugaucacuccugccuugggaaguggguuuauagauguccuuugagagcaguaauggcugcucuagguuggcuugggaugugacuauucuguccugauucaucuaaggaagggcuucuuaaauuagccuggcacucaguacaagcuguauagguaagagggguccacuaaggacgucuuagacuguagcccaaaccauacugggaagggacuauuggaguucugguugcaucuuuuguaauaggagugacaaaagugucuuuuuuuuuuuuucaauuaugugcauuggugugucucuacaaaguuugugcauggguguacagaugauaucagaggccauaagcauugccccucccagacaagaguuaugguagcugugagcagcccaguguggugcuagaacuaaacucaggucuuuuucaagagcacuaugugcucuuaauggcugagacaucuuugcagccugaauuuaaaaaaaaaaaaaaaaaaaaaagauguucaagaaacaucugaaaaacugauccaggcauguaaguguacccuuguaaucuugacacgucaugcugagugcugaagcaggaggauugccacaaguucuggguuacauaccagaguuucauaaacaagauucugucucagaaaaggaaaggagaggagaggagaggagaggagaggagaggagaggagaggagaggagaggagagaacagaaaagaagagagaaagaaaggaaggagaaagaaaaccaaaagcaacaaaggguguuguggucauuaggugggcaauguagccauuaugugggugauguagccauuggguggaugauguagccauuaggugggugauguagccauuauguggaugauguagccauuaugugggugauguagccacugggugggugauguagccauuagaugguacugaugugucucucuccaaccccuccauucuuuuagggucagaaaggugaaccuggauuuccgguaagcacucugguucucuuuaccuuuauuauuuuuaugugaaggaugacauguuaguguacuguuauuuccuaccaaagccagcagguccagacacgcguuggcuuuaugcuguauuugcauauaucaaugagucuaacuccuucuccucucgucucuuaagggaguaccaggauauggagagaaaggugaaccuggcaagcaagggccucggguaagugcuuccuagagcuauccucuccucacugcgaagcauuccccucugauccccacacucgcagaaaugaacggaaggauggaugcaucuauagcauuuccuaguuucuuccuuggaccccacugagccugcuagggaggagcucuuggaaaagcaauccgcugugcuguccccuaggacauuuauuuucuuguguggucagagcggguguuuagcuguuuuuguugcucugucugacaccagacuugaaccccuaccuccucccaugucaggcuugugugugccugggaccccaauaggcucacgugcuucucccugucuggacagcaagcagcgggauaucugccuagcugccaguuguugggaauaucuggugauuccccaaaguccggaguagaaagacgaggccuuaucuaacagccucggugcucacugccaaugacaaaauaaucccuugguaccuaagacauugaccucuguagcccuguggacucugcucuucagaaacggggccaucuuccuccccagugaccuagcaacucuaguggccuucuucucugccuuucuuguuccucacaccagggagagacagacaggaacagagcuguggugugaaacacucaugucugccucuuuauugugcagggaaaaccugggaaagacggugaaaaaggagaaagggggagcccgguaagucgguuccgcugcgguuucugaguggacaagggccgcuguccccuccgugaccauccugcaucuuccuugcuuuuagggcauuccuggcgauuccggguacccaggucucccaggccggcagggcccgcaggugcguggugauguuugaguuuuuaccuuuaauggguuguucauuuuaggggcuugcucaucuauuuucuagacuaaauaacucugaacccaaggggauaauauuucuccucuguguggacucaacaguuuguugacuuuuccacaguccuugaugaguuuuugaaagaagacaaucacaugacacacucggucaagcaucuguaguauuuuuuuguacagauuaauuuuuccccgauuauaaauuaagagaaaaugcagaaguguaagaaaggaaagaauggccaaauuuucugccuucugcuguuccucuguaaaugcacgcgugugccuuugacaaaacaggagugaaggacacaucuugccuuauuguuuuucuucauugauugauugguuggcuguguguaggcacacacgagccgcauguggaggucugaggccagcuggugagagucccuucucuccuuccaucauguggguccccuagggcgaauucaggaccuggggcuuggugugaagcacuuuuacccauggagccacaucuugccuuuuaagauuaauaaugauuuguaaauuaaacaaggaggaucugaucugugcagacauccauaaauuaguuguauggagacauuucuaacauccaugcuuucugcugacuggguucuagaucauuuuaaaguuguuugaagcuaacauuggaguucauauugagggcuuugguguaaauccaguuauaaaaaccccaaggagaugccguaaggagucagagcuagaaacuguguuuccuagcagcuuagagaagagcacucugcuucuacaaggcucucuaaugucccucgagaaggcaaacagggcaaacgcuugucucuucagacuuccguuuaggcuguguagacauuuuuauuuccaugcuaccuucaugggauacaaaugaacugggucccuauuuuuuuuaugaugaucacagaguaaccaagccagucccagagggagagguugggaaauauaaugacugggggauuguguagaaccaauuucuauuuuaccagaaaauuucuggccaguuuucugcauggccaucuacaacaaauaacugugcaugucccuugcagggagagaagggugaagcuggacuuccaggccccccuggaacuguaaguaaugaacaugguugagaugggccccggguuccaggggacacucugcagcugccccuuggguggugcucucauccgaagugggugccugccauaugaagcaagucacaacuugcucugauuuuaacaaucagaccuuuaguguuuuuuacauauccucaaacuucuggaaacaaaagucuuugcacacggauaacucagcaaccuauuuugaaaccuggauuuuauuguguuuuuuaauuguucaucaggggacgguuaguaggaggggcauaucaaccauagccugucugaugguucuagcaaaacgaccuuucuuguccaaguaacgcucacgccuugcucaugagcacuuggaccugcuauugucucaguucuucgguuccaaauugguuuugaaacagugggcacuccucuccuguuugcucugggugacaugggugugaguaugugccacucacugugugggugauagcuggcggggggggggggggggugcagagugauuguuuuagaggcuaugccuugaugugcccagcauaccugaagcucuccucucuuccaugacucaccccagggcagguggauucucaucucucagucccaccaguuacacucuuaguuaguuuuaauuuuauuauuuuuuuaaauugacaaauaaaauuuacauauacuuggaauguacagugauuuucuacauauguccaugucguacaauggccuaaucaaagcuacuuaauggcauuuaaaacagcagcauccccucauuauugcuacagaggauaucauaaggaaagcgugucggggcuuggcugugccguuuuccuuacacuguggucauucaagaucacggugagccagguuucugucugugagguuggcaguaccuccuuccuggucuuugucccaguaauuuuucaggaagugcccuuuuggcuuuuagagaaagaagacacauaaaauauccuccaauaaaaggagacaaauaguguguguucuugcccugcacaucggcggggcauuccucuguuacccuguaaagcaagccaggcaccuuguggcuuggaugcaucugcacauuguagacuacuaggcuuuaaauugacugagugagaccauugcugcugcuagggaaaucauauaaaugaggccgaacugccuggcaauucuacacugagugguucuuaguacuugguauucauucuguagcucuccaggccuuuccccugaucccuacacaccuuuguauccauauuccuugaggcaaugcaacauacaugauguguacuaucagcuacucccguaccagccugaccugugcuuuaacgcaggugauaggcaccaugccuuugggagagaaaggagaucgaggcuacccaggagcaccaggguugagaggagagcccggcccuaaagguaggcugcagcuugcuuguuuuccuccaccuuggcucccucuccuccccuuuguuccucccaucuuuucuucuuucuuuuuggaagccugaauggcagucaaguuguucuuucuagcucccaaccucacuguuguaaggugcccaggagccccuauccucucuagcuuccugaggauggugacucugcagggauauugugggcuccacuucugucuucccaaccuggacugugggugccuucaaauagcucugggaagacuguggccgagaaacagaaaguguccaaacaugagugaccucaccucacuuuguccaauucucuccuccccuuucaagguuucccuggaacaccaggccaaccaggcccuccaggugagaguccuuauuucuuguagaauguugcauggucugugugguuucuagucccauguguuugucacacacacacacuggguguguucauaagacaggcugcagguuucuaccugucuuucuaguuuaucagaacucaguguacccagaugugugcccgcuguauacuuuauagguacaaguuagcaugccauucccccauguguaggcaaaugugcagacaguggauccuuguuucccaggggacaccgauuugcccacugggcugguccucugggugugcaucuugcccuugcacgagucuuggcucugccagaguucuuccagcuguagagcuguggcucucuccaagauagguggauggcaugacaucccuuugccuuccuccaccagucugauuuauacuuggucugagacuuuuagaguccuccugucuuuccugggauccccguauggcuguuucuucccaagacagcagaacugguugugugguuccuccagcugcacugcuugggguccccaccaucaaccuucugggcuauaucaccucaccuugugugacuccuuagcaccuuagcauacagagugauggaaguggacucugcauuuucagacccaucacuuugucuuugagccuugcuaggcuggacuugcuggucagcuugugcugaucuagagcacacccucacggaggauccuagcauuuuccccuggagagaguguagauuuucugcacagcuguuccacucacugccuuggggauacugacaugagcuccuaugcugguugcagguuucccuacuccaggccaggcuggugcuccaggcuucccaggugaaaggggagaaaaaggugaccagggauuuccaggcgugucauugccaggaccaaguggaagagauggagccccggggccucccggcccucccggccccccugggcagccaggccacacaaguaagugccaugaauuuccggucagaugccaggagcccagggcagagcuggaugggcauugugacugcugcuagaagcagcgcuguguaauggcuuggugaucccagcacugguuacuugguaaccuuuugcuugaguaguuuuacaaaguuaacuauguuacaaaauagaaucacuaacaagcaaauaggcuuaaaggggaaagcaauauauuaaccagcucuaagucuccuggcaucugagguuaaacauuagcagguugauucguuuaaccuugauugacaaccgaaugucuuuugcuucccauagagugacugugcauaaugcuacuuaggguacacaugggaacagaucacacuagauuaugcccuggcacaaugcggucuagcuagagaaccacacaagaguuuuccuacaucagcuuucaagaaaaagcugagcaugaaguauaagcuugugacuggcuuauugugauugcgugaucucauuucaauaauuuuaagaaaguucuagaagguuuaagucagccaugucaguggaagcauaucaaagcaggguguugggugcuucugggcuacagccagcaagagcuggagggacuauuagcaguaggaaccugcucugaggcugagcaccauugugggcuguaacgcuggaguagcagugggacccccccccccccagcccccaugugugacaggagauuuaugagcguggagcucugcugauguugauuccaagaacucaaggccauucucgugagugggaaggaaguucccaggaugaggcuggcgaggaagagauaagggccgaggggggugauugaguccagauaggcagcuggcucccuugggaagggauuagugugaauuccugggcagagaacagaucguauguggcuuuauggaacuuccuucucuuugacuuuugaauguggagagugaggaugaggccuggccaucccagagacauucccagaaccgccuguucucuaugcugcuuuuguuuugcaaguuaaaaauucacaggcucauuuggaagcaaaggagaauugaaucucuaaaagguucaaaucagccuaauauauuuuaguuuuguaaucaaggguuagauuaggagagaguaagaaugccugguuaugucucauggguuuuuaaaaaauuacuuucagauggcauuguggagugucaaccuggaccacccggggaccagggcccuccugggacuccaggacagccagguuugacaggugaaguuggacagaaagguaagagacuuuaacuuuuucaaagugguagcuggguuuguacugaucaguuuccccacugaguggcuuagguguugucagacuaucacacuaggcugggcacagguauguucaacauugcucuaucugggaguccuucacaaucacucccgagaagaugcauucgguagcucagcugugguugucuggugcuauagcugugauggugaguggaagggacucagccaugauagucagacaacuguccuucacacauucccgagaugaaagaaucuagucuuguauuguauuuuugguucaaagcuugagaguuuccuugucaaaggacacauguccucccuuuaagucaaaccagggaucuauacacgggaucuauacaagcuuucaguguaagcacaaucagggcacacaacucuucgguugauggauuagccagcuuuacucugggcucucaauuuuaucccuaaccuuucaaguguuugcccugauauuaauggaggacccugcuuuaucucuuuagcaauuggacucagagauggggaacucucaccucgugaucugugcgagcacuggcuuagcacggacugaacaaugccauucugauauuuaugugcucguuaaccuuggggcagaacaaacuggggcccucauaaaaccagccccaugcuugaccauuucuggcuuggccuauaaagaguuugacccuuuacaagucuaaaucuuacauggaaaacaguuucagagggcaucucagggcagcuauguaaccuucuuccccacacagucauuccuuacugagaugaguuaucuauuuauuuuacaauguacccauuaucuggaguuauuuaggcugaaaucuuguucgucuguccauccaucaauccauccaucccuaaauucauccauccaucaaucaauccucugcauccuaggagauguaaucugugagccugugugucugucugucugugucugugugugcauauguaugugcauguguguauacauguguaugugaggguauggguguguguguguacguguuguaggcauacguguauguauaugugugucuuagucagggugucuauuccugcacaaacaucaugaccaagaagcaaguuggggaggaaaggguuuauucagcuuacacuuccacauugcuauucaucaccaaaggaagucaggacuggaacucaagcaggucaggaagcaggagaugaggcagaggccauggagggauguuauuuacugguuugcuuccccuggcuugcucagcuugcuuucauauagaacccaagacuaccagcccagggauggcaccacccacaaugggcccuccccccuugaucacuaauugagaaaaugccuuauagcuggaucucauggaggcauuuccucaagggaggauccuuucucugugauaacuccagcuugggucaaguugacacacaaaaccagucaguacaauguguauguauauauguguguguggugugguaugugguguauaugugaugugcauguguguguacaugugugugugugugucguguagugcuguguauggugcaaugcuggggacugaaccuggggucugugggaugggugugagaucaucccacuagugggcagugcugugggcaggagugaugauggagaagggaagagucuggcagcgacaucuguaggacucucucuugugacccucucugagcgccacagagccuucuguuggcauaucgcacacuaaacauauauuaggcauacauuaagcacccguguuucuucuuucaggucagaaaggagagagcugccuugccugugacacagaaggacuucguggcccuccagggccacaggggccuccgggagagauugguaagcaguagggugugggaugaaacaugucagggguggccuuggggucagaugccagcuuccucaaauucugugccaugaaagugaggaugaaagucagucaccagaguguguccacauggacggcuguggucaagcccaccuaccacaguggcaccgugugcuuuugugaucacgggagaguggccuagugguucucccagcuucauagucagucagcucaaagaaggucaucagguuggucuuccagaccauugguguuguaggcugggggacacuguggcuuccugugccagugacuuaugaacaagacaugauugccccucugagccuauucuguccauuugaguuuuguuuaucuccugcccuggauguuccucagaugagaguccacuuugcaacaagauucugauacaguugagucuuggggcaaagggaagcacgucuuacgguugcuuuacucccaucuccuucuaagguuucccuggacaaccuggggcuaaaggugaccgaggccugcccggcagagauggucuugaaggauugccgguaagugaaccauuagaucauacucuugucugaacucaucacaguaauggguucucguuuguguuccagccugucacaggagcuggcccagggacugggggugagccccuuuuuaugcucacaugggacacccagagaacaagugagccuuggauccacaguccauguccccaaagccaucucaccucccugcuugcuuuugauguucagguccccugggcagcgcagaguccugcccacagggucuccaguucagaugguaccacaguggccaucuuucucugugaccacugccuguggcguucccugugcgaucuuaacucuuaccagggaugaguucccccuaagagcuccuguggagggagggagggagggagacugacuccaugucaccagcaucuauuucuguagauggcuuuucuagucuguagaugaauccacauaaaccuauagggaccgauaggaaagcuuucagcugcgcggaauuccagcugcuaagcuuuguucugagagaagucauucugagagaagggauccauguuuaauugcacacacuuggugauugcaagcuuuccuccccccccccaccaauccccuccccaccaauccccuccccaccaguucccucccguccccuccccuccccaccaguucccuccccuccccuccccuccccuccccuccccuccccucccagguucuguaagaauugcuugcuucucuaauucuuuuuagcucucucuucuuuguuagaaaccaaaaguuagauauuugaccuuacccuuuucugaggaaucucuuuaaaauucuucauugcuuuuggauaucgccagaagcgucucuccucuccagggcgccagggcagaacugacucaaaguaggagggggaggcagccagaaggccacaguggcucccugcuuuugaagucagauugccccucuguggcagacuggugcuggugccuagagggcugaguuagaagacacaauuguuuaaaacagcucugagugagaaguucaaauagcauuccguggugggaaucaaagggagaaggacuuugaaggaggcagaaaagggucuuuccaccucugcccacugccuuuauccuuuaucuaccuggcuuuccuggaguccggcuugccucugcucuggcuagaacccaggccagacauucagcuccugacccaagagaccagaaaaaacaaacaaacaaacaaacaaacaaacaaaaagcaaaaagaaaagcaaagaaguaggggaggggagggacaguuggggacucaucaggauaaagaggaaaacaguccacaacacaaaggcuuuccuccugcuuccggaagccaacuuucccaagauggguacaggcucugaguagaggggcacauaaaccgcuucccuggaagucagucauuucccuccugaucacagcuucagaugugguccuccuguguugauguggcuggaggcuggaaggcaugggccagagggauguaggaggagaugaagaugcucggcuguggcuuuuccucuuuagaugguguuuugugcccuuugcccuugaaagccaagugucugacuuuaggaauggacaacagaucccacaggcacugggaacaauuagccagaaccugugucugacuuggcccaggggcuaaguggauguuaucagagguagauaguacagaugcuccguccccacugguuaaacagccagugcuaggcuuuaaaggcagauauugaucccauaggggacuuggaucaaaagagacuuugggugggacaucuuuccaaaaacaucucagaucaggauguugugugccaaagguugcugagacauuuuagcaucaucaaugacacuuuuaaagacuucaaggggcuggagcaaaggcuguucuuccaggggaccugaguucaauucccaucaccuguguagcugccaacaaccauuuguaagaucagcuccaggggauucgguggcuuuuucugauauccauggauaucaggcacuuauauggugcagccauguguauaggcaaagcauccauacauauuacauuuuaaaaauuagagaaagcaagauuaucuuccuaaauccuuagcaucucuuuguccccgacauccaggaagcagaugaaaagucuuggcucuucuaaagccuuucagauacaggaaggacaugacugcagacacaucaucccaaugaaauugacucauuucuggaaugacggccauacaacacgguagaaaaaggcccgaguguccaaggaacggcuuugucggacugucuaguuucuuccaugauuuauaacuacauaucuaugcauauuaacuccagaaaacagacuaagaaagccucaccauuugacaaaacaacaagguuucuacaaccuuuuguuaacauuuccagcagguggcuggcagaaauaauuguuuuucguucuucagacuugugcaaacaaucccauguccagauccuggacuggguuagcucagggcuagcccagaccaccugccacagcugagguguucuaugccugcaucacuauucagcuugguaccuagggccgauggugguguuugagcccuuucugaagaauggaacuuuucaauuucuagucuaaguauuuaaauauuauagcaugggcacagaguagcugcuaagaacuugccuucuugagugagccuccacuaaagcuucauguguggaccccaaggcucuacagggcacaguugacugggugacaucuucucuguccccagccggugcacuuuggcuuugaggagcaccgggaacaagaaauucaguuaucccuuccauauuagucccagacuugauggacuuugagcagggcccuagaaccucugcaagucccaucccugugugggccaggggcuucaguauggagcccucagugaugcuuagggaguaugggagaguggaugggcuuuguggacaggagcgcuuacuuucguacccagcugcuuacacuuccuggcuggguaaucucauauacauggcucacuuuucuuuuagacugacaaucccaugucuuccuuauagaguugugauaaaugguacacaaggguccugccacacaugggugugugacaggccaucuccauuuuuuaaaaaagauuuauuuauuuauuauauguaaguacaugauaguugauuucagacacaccagaagagggcauccggucucauuacagaugguugugagccacugugugguugcugggauuugaacucaggaccuuuggaagaacagucagugcucuuaacugcugagccaucucuccagcccggucuccguuuuuuaaaaguauacuuuuuguauauauacauuuugcucuaaaguagucuucucaucucucccuccgagagguuuauguuauaggcacacacagugguuugugauucacuuccacucgcagaacuugacacagcuuauggaaagagauuaaaauaaauguguuacggagagucuggauucugccagguccucggugagcccagcugggugugccuuucucaucccaggagaccaagcaauuggaacuguuucuuauguugucauuuucuccguguauauccacucucaaggcagcuggaggagagggaguggcauucuuuguagauucaacuucguggaacuaaaaaucuuuugugugucucuuaauagagccuugggaaaguccaaauagcuuccccaaaacccaauuaaagagcuggcucugggcuccuuucccugggucugcccaaucaccagcacccuggaagccccuuugucuccccgaccaugggguguggcugcaaaugcaaaaagcaaacccggagcagcuucagugaggaacacccaggcugggugaauaaugguggccccagaucuugggugucucagcugccucagcauucacauacagcauccaggagucgcacaugcguagugugccaacacuugcugacacguucucuggaagguuugucagucauuaggggaaggaaaguaacucaaggauuucuggaagcuggguucaguguuguuccccugucccuucugaucccgguggaaugccuaacaaaguacaggaaucuaagacagccgcugauggccguggaguuucugguuagcaucuacaggacaucuaacaguguggugguuccugauagggcggauccucagccgguggcugacugcugaugcgucaucccucaguaguucuuggugucacaagaugcuuuguuuucuaggguccacaagguucaccagggcuuauaggccagccuggagcuaagggagagccuggagagauauuuuuugacaugcgacucaaaggugacaaaggagacccagguuuuccgggacagccuggcaugccaggaagagcaggaacucccggaagagauggccacccaggacucccuggacccaaaggcucuccgguagguccauuuccagaguuggaacacguguuuuacaaauggggagucugcaaagaguagagaaaugaauguuuugggucacaaccauggaaccuuacagauggcauaaguuugcuucauggcuccugagccaacauacaucaauggauguagggguuagugguguagacuuguauaauaggcuacagauggcugaggcuguuugaugucuugggacugaauagaugaguuuuccuacccuuauccucaugggaacaauucuaacggugcacccaucauuguuugaagucugggauccuagaccucuagcugugacaacugcuugggagaaggaugcugguguuacuuguuaacucuugugacccugguggcuccuggcuaggcuuuugucacuaguuuucuguggacgauguaggauugucaucugacagucuuuucugucucuugucuccucaggguucaauaggauugaaaggagagcgagguccucccggaggaguuggcuucccugguagucguggagacaucggcccuccuggacccccaggaguuggccccauugguccuguuggugaaaaaggacaagcaggcuuuccuggaggcccuggguccccaggucuuccaggugagacuucagggccugacgggcaacuucaaggucacagaaacaagggcucagagguccaggguacacaguguuucacuucuccccggaagaggggugugacuggaccaguccuucagaguucuguaccucauuucccccugcgucagaugggucagcucacgcacagagaccacagaucggcuaagucagccccucagguagaaguaggugaaaugugaggcuauuuuuaaauuuuuauccauuuucugauccuuuuggugucugcauuuccuaagcaguauaaucuuuacucucugccaaugcucgggcaucguaaguugcaacauccagcuugcuacuuaguuccuauuggcugaggucccuuccugacugucuuuugguaguuuaugugccaagccccaagcagagacucacaauaaacacugugagagacucagcccugcccugcugugcucucuaacaagguuuauuagaaaucugugcaaggguaacguuugcuuccuaugucaaccgugcccaggugacugagcguggcuggccccucucugccuugcauaaguggguacuccauaauguaaucccacacugaccugaacaagucugagggcuccugagacauucuugaauggugagggcagagggcagaaguggcuuacuacagaggaggaagcaauccuguguaccgagaaggauuuaaacaguuguaaaguuaaugaaggauuuaaggugguugaagacacuguuaaggaaguggaugcucacagucauccauuagacagagcacaggguccucuaugaaggagcuagagaaaggacccaaggggcuaaggggguuugcagccccauaggaggaacaacaguaugaacuaaccaguaaccccagcgcucccugggacuaaagcaccaaucaaagaaaacauggagagucucaugguucuagcugcauauguaacagaggauggccgagccagucaccaaugggaggagaggccuuugguccugugaaggcucuaugucccaguauaggggaaugccagggcuaggaagaaggaguggguggguuggggagcagggggaggggggaggggggaggggauaggggauuuucggagggaaaacuaggaaaggggauaacauuugaaaguuaaauaaagaaaauaacuaauaaaauaauaauaauaauaauaauaauaauaaugaugaugaugaugauaauagcaguguuaagggacccaugaauagaauuuccagcaaaaacuuggcaggcacaguuacacggugccucugcacucacaacucugaugaugguuuccuagccaugacuauagcaaagaccuuaucaacuucuguccucauuaggggcuuuguuuucuccuggaaugcaguguaaauccuguucaauggcagaguccuaguguggugcucugagcgucucuuuuggccucucucaucuucagcacagucagcaggacucuguugcuaacuauacuuugucaguggaggacugcagugucucuuuuaccucuuccccauaagcagggggauacugaggggcuuuaggaagacugcagcgagccagggagaggugccccacggagcugagagcucccauggccucugggaccugcagaagccauggaaggaguuaaucagaauggagaggggucagcaggggagcgccuccugggaguuccaggcaucacaagaaagaggggugucagaggaggugcugcugguucuguugaccagcuguccacguucuggagaguucccuccagacccucugagcuucuggaucggaaaguugaccuuugaucugcagagcgguauuuauguggugacauuaaagacuggaucccaggguuucauggagagcagaugcaugcuagggucagauggcucucacagucuguggcgagaggcaggccagucauuccuggagggucuccuuaucuggaauucccauguggacugaggagucccugugcacacuuggaagaguccugauucuuucugaacgucaauaugcugaccuccaguggcucucuagggcuuaacugggaagagauggggccuggaagcagagcgcuuuguguuaccccagggcgcuagggacugugacauugcuagaguggccuaauccacagccacccacuuaccugcuguguucuagcuagcaggcaugaauccuggagaagcagaaagcaaccgagagagagucugucugauggaugaaaauaguguuuuggguuguuuuguuuugucuuuugguuuuuauuuauuuauuuagguuuuauuuggaggggacgugauaaccaagaaaugacccagggcuaccuuacuuuuuguuaugggaaauuuucuaacucuucagggcuugaaugcgaaacacuuaaggaauccagaguugaguaaacauuuuagucacguggggccacaaaucuugaauaucucuggcugagauucuagauaugugggugagaaaugggaaacccaaggacuuuuccgugcagggcuucagggugccucagaggauggggagugguggcuccuuugcaguguacugggagguugcugggacauaacaucacccuuaccgucuucagagagguggagaugugacauauaugauucuauuguuuucuucccucaggcccaaagggugaggcaggaaagguugucccacucccuggccccccaggagcugcaggacuuccaggauccccuggcuucccagggccacaagguacuguugaugucucgcuugccuggguaccauagugcuaccacagggauagcacagugcuaccacagggcaaccacagagguaccacaggaguaccauagggcuaccacagggcuaccacaggguuaccauagugcuaccacagagcuaccacagggcuaccacagggguaccacaagaaggcuaccacagggcuaccacagggguaccauaguguuaccacagagcuaucacagggguaccacagggcaaccgcagagguaccacaggaguaccauagggcuaccacagggguaccacaaggcuaccauagggguaccauagugcuaccacagagcuaccacaaggcuaccacagggcuaucacaggggguaacaaagggcuaccacagggcuaccacaguaguaucauagggcuaccacaggcuuccuuagacauuccucacauugaccguucaccuuucucaccacaggugaccgaggcuucccaggaaccccaggacguccaggcaucccgggagagaaaggugcugugggccagccaggaauuggauuuccugggcuuccuggccccaaaggugagccuagugaggggcugugauucugaccagaagaccaacuggggaaggguagucugucauucggugacuggucuguggucagggucuugguauuugcuuccuacgaaucugugagaaagagagacucuggcaugaaggacacccucggucccuccauguguucaggucccucagaugacaaugucccuaccaccucaggccauucgcuaaugagcauggugucauccugaauagaggguuaggucugcuccagacacaggcagcugaugaggaauacguagccugccuggcaucgccacacacuguuucugucuacaugacgugcuaguugcuuuguucggugcugugacaaaaucccugacaaaggcaggaaggguuuggcucacagauugaagguucaucacaguggggaagacccugucguugcagugugagguggcugcucacauuacagucagggaagggagaaggagagagagagagagagagagagagagagagagaacgaaccccaugggauggcuccauauccaugaggucauuucacccccugaacucagcccagaaaccccuuuacagguaugccaagaacuuuugucucugagguaguuuuagacccugacaguuucagacacaagugaaagugaagaguguuggggagagcccuugcaucuguaacuguuuucugacucuuccacacagguguugauggcuugccuggagagauaggacggccugggaguccaggucgcccuggauuuaacggcuuaccuggcaacccaggaccucaaggucaaaaggugggugcugacucucccaggcugccugguccucauccuuguuaauugagcauauacuauguggauuguuaaucuugugggaugguuuucuuuuuuaauggcacaguguacaagaggcagaagggaaagcaauuguuucagauuugugaacguuucuugucugugugcugggucccagugugcaauguguuucuaacugugagugacaggugagagcuguuugagagccacugucagagaagaaauaagucaaucaggagggugacacguaggauguuccagucaaggcuucaaggcugcugugucuguaagggccacccuggugggucuuuagcuucuacucuuggcaccaacagagcuccuuccaauugugacaacugugaacauaucccccucuuugcuucgugugcccuggguagacaugcugcuggcccaaccugugcuacguaauauagcaguuugcuugcccccgaguauauaccuuaugcaucuuccuagaccggauggaaguuuuggggugacuacuggucaugccucuccucuucuaguuagaggagacagagggaagccacuggcagcaugaaugugaagugggagaaagggcucagggcuauuguuaaccauugcccauguuggaacuagucugguccuguccucacucucuugggagagagcaugggugacaggugacaugccucgguaacccagagccaacacugaugauuaauuuguuccuggugucuuggggauuuccagggagaaccuggcauugggcuuccaggacucaaagggcaaccaggccuuccaggcauucccgguacaccuggagagaaggguagcaucgggggacccggcguuccaggagaacagggguugacaggccccccaggacuccaggggaucagagguaaugcuucagacugugucagggugccugcuugcuuuaugugcccggagcgucggcugugugauuaguccauguugauuaggcggguggggagacucugugaggguuuuguggcugaggcuguuguagagauggauugcuuacgggaagggauacauucuaaccucugacuuacuccuauccuuccugacaggugacccagggccuccuggaguucaaggcccagcagguccaccaggggucccaggaauagggccacccggagcuaugggcccucccggagggcaaggaccaccagggucaucaggugauaugacugucccuuucucagagccugugaaguguggggugagcggggagguuggcauaguugucaaaauaaagggagggaugggggaguauauucuaguuuuguuugguuguuugcuuaauccaaacauuacaggcucccguuauuuccucccucugaacccauuuaaugugccaaagaaaucuguuauagauucaguagcauuuaagauuuuauuuaacauagugucuucccguuaucuuuguuaggagccuugcuaaguuguugauaaucaagcuaaucgauucuuugucuaguuggcuuuguccuuguaccaauagucccagggcuauguuaguauugggggaaaggguaacauagucaaugaaagcuagccaacauuagcuggggccagugguuguacaaaguuacugguaauccucaauggcagaaagaaggaucuucucuuaugagaugacuuauccacugcagugcugacccugaacucagcaccguccaagcucccagugcucgcaugcuuaccugccguccucagacagcacucuacaacacuauguccauucuagaacauucuauaagcuacucccuuuguccaaucucagguccaccuggaauuaaaggagagaaaggguucccuggauuccccggacuggauaugccuggccccaaaggcgauaaaggcucucaaggacuuccuggccucacaggacagucaggccucccuggccuuccuggacagcaggggacaccuggaguuccaggguucccagguaagugacaccugaacuuggccuggaucacucaagagggagcauggcuuucuucuuuccugaauccaggccauuuaccuaccacuggagguccauguggggauguguucuuaacauuucuuuugaccauagguucuaaaggugaaaugggugucaugggaaccccgggacaaccaggcucgccaggaccagcaggcaccccaggguuaccuggagaaaaagguaggagggcugagggcuggcaaaccacguugugucauauuguguggugucuguauuucuugagaauccuggaagguucuugcacuguuacagaucacauuuagcuuuaagacguagaugagaggaaaggacuggaagauagcucuccuucagaggaacuagcucugugcauagaucaugggcacacaguguuaauggcugucuagcugguguggagaagaugggaaugacuuagucucucucugcaagaaaugugggcucuccauuuacauggggguacaaguccugcaucaagagagccacauuaguagaacccacuucaugggcaagcccagauuuuuauuuuuuguucucugaaauugauccaaaauccuguucuuaaaaaacgcugacuguaaacauaaggcacaaaaaagggaaguugaugucgggaugcagaaacuuuccagucugucauuuguuuauauuugggggacacucgagagugauggagaacagagguugaggaagacaucugggaaggaggcaugaggaguccaucuaagagucauguguugcgauugcuggcagauaaugaacuuuagaaggaggcuucacaaugccccuccccuguggcucagacucucgccgccauggucagcucuugccauguucuaguuccuuccugacuuugcagguacuggcuggcaagaguccccuccagacacagcugggucuggaucucacugggggcuugcuuccauuuccuccacaggggaccauggccuuccgggcuccucaggacccaggggcgacccuggcuucaaaggugauaaaggugacguugggcuuccuggcaugccaggauccauggagcauguggacauggggagcaugaagggacagaaaggagaccagggagagaaaggugaguggaagagacaggcaggccucacuggggcaucauaucauccugcuuucuacagcaauugcuuacgaagcagauguggaagcucacuauguuuuuuuguggccuacaggacaaaucggacccacuggugauaaagguucccgaggagacccuggaacaccaggaguaccugggaaggaugggcaggcagggcaucccggacagccagguagguguggacaguauagccacagucguugucaagaaaccugcuucucagugcucuccgcagauguuuaccugugggauuuuucuccguuauucuagggccuaaaggugacccaggccuuagugggacaccaggauccccuggacucccuggacccaaaggaucaguuggaggaaugggcuugccagguaaccugacuguggacucaaaagucucuaacauacacugugugugcacggggcuggugggaugugcgcagggcagcacuuggaagauccagggccugacagccgugucucucaucuaggguggauggcuuucgacugacacugauuggcauuggcugacaauggcuauagugucuguaaugauugcuaaaaaugaauaagugaugcacacuggaaagugaagucugagcuacccauggauaaguggguuagcuggggagguguuucucagcacaggcugggaagugauagucaaaacuggaagccugccuuccuaucuccucucaggucuuugggaggaauuccaaugacuugcuaugacagucuaggcugcuggugguauaccugugucugugugucauagguccauauauggcgugugaaucuucacacugccucacaguccucggaacugaugguuccgcaucggcagagcuguguucucccuauacagugauggucuuucaaaggcagggggaagcuuagcuugccugaggaccccuggcuguguugguggcagacugauaagcagagcgauuuguguugagcgucagccauuaaguccaaguucuauugucugugucacuagguucgccuggagaaaaaggugugccuggcaucccuggcucacagggugucccuggcucaccuggagagaagggagccaaaggagagaaagggcagucaggucuaccuggcauugggauuccgggacggccuggugacaaggugaucaucuccugccccgugacaaugucccugacacuuaccaacuaucucagcacaacuaugauacagcucucccucugacuaacucugucauguccuccuguucacugccuuuucucccaagggcaaacucuagaaucucucugagagggugaggguggccgcauaucacagggaggaagaagaggggcgggcuggggagcuuggcagauggagagaaugucuuuucuggaaagcccagcaaaugggauucuccagugugauugauacucacggccucucuuaccuagaaaucugcuaccuagaaagugcuuccagaccuguaggugacacgucugcuucuuccucacagggagaccagggccuugcuggcuucccaggcagccccggugagaagggagagaaaggcagugccggaaccccagggaugccaggguccccaggcccgagagguucuccggggaacaucggccauccagguaugggggcugggcaagcucuggcagaaagguacaggugaagaaaaccuagcugcauacaacuucugaacuuucauuuccucuuuaggaagcccaggccugccuggagagaaaggggauaaaggccucccaggacuggauggcguuccuggugucaaaggagaagcagguagagauggacccuuugcuggcacuugggugaaaagaugaggagcgcccaggcuucauggggguuggggaguguagucucagccucaugggagaauucuucacacugaagcaggcccuaguauguuaucuggggucuagggccagcugguuuaucccuccacuuucagauccacaggcagagucuguaaagcguuugaggucuuugggaaaugaagccagcaucuccaagcugcuuuuguagugagaagagcauuucagauaucucccuccucucugugcaagcauugggugggggucuaugcuguuccuagcagcagaaaagaaccuguuggaacggaucagagcugacaucagggauaccagggaugcagggaacagcucuuucugaugugggaaaggggccacuucucagacgccacggugcuaaggacaguccacaagugaucauaucuuucuccccaaggucucccugggacuccuggccccacaggcccagcuggccagaagggagagccgggcagcgauggaaucccggggucggcaggagagaagggugaacaaggugagucuuguuccugcuucccagcagaagccaugcuguucccucagagacugcagcgccaugaugaucgaacacagaggucucagugcugaguuccuugcggcuccgaaaauauagauguggacuggagggaugggauuggaucagggagggaugcucauuccuucugugagugaagcgcuucccuggaggguggguccagagacacagaugcggggcugccgggcaggaaugccucccuuucuguuuccccuguguucacugugacaaaaccaaaccaaacagccaagagaauucuguccagcauuuuccccaguuugggaaggaguccuagucuuccagggucugggggucuugugguuacuguugcuuccugugucugcuccuguuacugauagaagagcugucguggcaggaccgcagguuuuuagcuauagcuguguugggcaggaauggagcagcaggggcuccuugcuaucaccgcuggcugcucuucaguucccuuacucauucucuauagacaucauguauaagaagcccuuuccacuuccuccuccuguuuacccacugcuaugugaagcccacucuccugcccacuacccagcucucugugcuccacccacucgacgggaugaagagucagucagauggucaucugagaaaagccagacugcgugucucugccguagucaccacuacccaggacugacugggguguuuuuacucuggccaaguagaacucaagaguaggaaucucccuaugcugcugucccuuuggaacccuuggcuuuaugcaguggugauuggcagcagccagcagcaucagaugguaucucugagugcuugaaggugugugggacccucaguagcugguggcacagcugucaggccuagagugucugggacacugggcucuuaaagugcugcaggucccuggaauucuagcaacaagggccugccugcccuuucucaucuuaagccuuuuccaacgguuauuuucucugcggcuucugcugucuuuuuuugcccuggcaacucucugaaguucuucagccacucucuggucucuguugccacagucuccucuuguguucucuccucuugucuguuuuauuggugauaaagagccaaauguguccaagaaaucuggccuuccauagugaggccuuucacagauaaacaagacugggcaaaaaaugaccacuuagagaaagccucuuuuugaacaccagggggcagcagacuagggacaggagccaagcucccucuuauagugcugggguguaugucauaguuguuugcaccaaucgcaaaccuuccuuucugcugggccaccagugggaggugcuucuucuguagucugggugaagauggcuucaggguccuuuagaauucucugggcuuugaguugcucuguucugaggucuacccagagccauuagaguuuccuuagacuguaagggauccagacagccaggcugcaaugaaggcaguccacuggguaccagaaacguaucugcuugacugguggauuuccuauuugaggcugcccggggccuuauaaggguagggucugcacaauagcugccaguuuccacacagaaaguuuaaaaaacgauguuuaugauaaagacaccagggagcacucucaauucuagcagcaaucaaagggaauugguagcaucugucagggccucgcuguguuuaccuucugcccuagugcccagggaaaggugagccuucuguccugccucuguaggagaaagagugucauuagcgcagaucauuucugcucagcaccuuaaugagccaaacagaaaggucuucaaggagaacgcaugaugagacaguugcagagguguagcuuugcucccagguuccacgggacuccucagggcacucuuuaagugcugcguggugucagggcacauggggcauggccucccacugucucugcagcugaguaagagacuguuguuuucuguccucacccuguagguguuccaggaagaggcuuccccggcuucccuggcuccaaaggagacaaagguaacgcucucagcuucgcaccuuuguguggagugguccacggaacucagcaugucccccuuagcaaagcagugaccgugucuaguggcugauagaugucugaugauugcaccaucugauucacgcgugaugugauaugugguaccugccaaauaccuuaugaugucauuauugcuuacguuuugaguagcauguaaacaugcguucccaucccugguaaucuucuguaguuucuuuuuaauuaaucaguuaaaugcauaugcuugaauguguguguguguguguguguguguguguguguaggagguuguaagcugccaugggguacuggaaacugagcuuggguccucugcaagagcagugagugcuccugacugcagagccagcuaucuagcccuuacuuuauuauuuuuuuaaaaguagcuuuauugggcuaacauuaccauaugauagacagcacauauuuaaaaugugcuguuguucuucaaguuuugacucaucuaugcauccacagaaacagugcauucuggguagugucacagcugucacccaauggcugucccacugguucugauccuccauauuguauccugaaguccucaggccccucaaacaaauacccauguuaauuuaggagccacgaaugauacuguaucuuauacaaguuucaugcaagccuggcuucuucccauagaguaucugguuuacagcuuuccuguugucuguauugauaauucacuugugaagccuaaguagggucccauugcauccuuguaacaguuugcuuuguccaugucuugggaugagccuacucuugguuuuaguaguauaguugcuugaagacuucaaaacacauuuaagauacacauauaagaucucuggcugucaccgcaguguagcaucucuauggacucugcuccucuggucaccaucaucucucucucucucucucuccugugcaggcuccaagggugaaguggguuucccuggccuagcuggaaguccuggaauuccuggagucaaaggcgagcaaggguucauggguccuccuggcccucaaggacaaccuggcuuaccuggcacuccuggucacccuguggaggggcccaaaggagaccgaggaccucagggucaaccuggccugccagguaagggcuuuucaccagacacaugcucaaguuaacaacucagagcugcgcuugggucucuguugaacuggucucugugguuuccuuucuguugagguauuacuuagagagcagcaugagagaagauuacagagagaggugcaguagagauaccauuuggauuuuugcuuuaacuggggcaaugcucgaauguuugccacccugagcuugccuccugugguuguggaggacccuggacacuguggcuucaguauuuuggaagccaacacugugacauucacaugaacaccucaauggugcuguacgcccccgacuuuauaaccacguggcuuuacuauugacuuauuuuagugguacuggggauggaacauaggcuuuguguaugcuaggcaaauauuuuacuauugaguuacacacucagccauuuuauuaauguuguuguuuugagucagguucucacaaaguuguccccacuggccuugaaucaguaacucuguagccuaauaccagugaacugggucuccugcugcuucagucucugguauagcuggggugacagaccugggccgccagugccagcauuugggugcugagucuguuguuuguaugagcacccuuccuugauuuccuggaggccuguguuacucuacaaggccaugguguuaugguugcagagaguugauagcagugugacuguaccauagcccagugacacaguccacuauaguaccaaccacccuaacccugcgucuuuguucuuugcauuagggcauccgggaccuauggggccgccaggguucccaggaaucaaugggccaaaaggugacaagggaaaucaagguuggccaggagcuccggggguuccaggcccuaagggagacccaggauuccaaggcaugccggugagugauugaguguagaauugauuuucaaaaggaacuuuuuggucaagaguauuauuauauguguguguauguguuucuauaugugugcacaugugugauaccgcccagcccuuaaagcaguuccuuccuuugggaucagcauaggaaaguauugcaugugcuuuuauaaucuauuuuauagagccauuaaacaggaaaugcuauacugcugcagauuauaguucagugcccgacuuuacaacccauuuacaaauucagugcaaguauucaguaucuugguaaagagcaguucuucacagccugagaauugucuucuagaguuggcagaggcucagguguuuuaaaauauuuucuccauaauuaaaauaauaauucagauggggcaugaggcugguuuuaaggaacacucacugcccuuugacgaugaagagaccagaagggugguaugguccugauagaacuggguuuguuuccauggcaacuguccaugguauuguggcugugucauggcaucaugcugguggguggggacagcggcuacaagcucgaaggaacugcuguguauauggaccaguaaagagagaccaggggaccaguguugcaguuaucuucucguguucugucguuuaaagaauuguaugacccaccugagcucacaaacuccugugcagaacacagaagugcuuuuugccugacaggguacgcaggguacaaacugggugucuagagccauguccagcucacacuuccuuugguaccuagggcauuggcggcucuccagggaucacagguucaaagggagauaugggacugcccggaguuccaggauuucaagguaagaccaugaggccugacagccuuguuguugaggggauacugucccaaaggcugccugagcuccaagcuuccauauucagaugcugacauggccucagcaagagauaauguuaucuuuaaguuaaaaaugcagugaauuuugagaccagguuuucccuguuuuuuuuuuuuuuuuuuuuuuuuuugagacuaggucuugcugucugucccaggcugaccucaagccuuuagcaauccucauggcucagcccccugagugcugggguuacaaccauguacuccugacaccagauaaaaacagccuucuuuguggcaucucagucuguaugacccugcggguggcugacuaaaggcguucugaucuucuuagcuaagaaccaguggaucacgugugucuuccgaguuuuaacaagaaguuguggcuuugggccacuugauaguuugccaaugcagucagcaaaccucuccuggaugcuagcagcucccacauaccauggcuacaacagaauccuacucaccuaaugggugaauagaaagggcacacggucugcagaugucuguggucugucacacaagcugugaccguagacuccaucacaugcccugauugccacugucagauagugacugcuuauaaaacgauggccuccgacucuacaaagaaaggcuuugugagauacugcgcuaaaaaauuaacacaucuuuucuuccuugaacauaauugagaauguguucauugcacauguaugcucacaugguauacguaugcuuaugugccugucuauauguagggaugaagcuguguguacauuuuugcauauauagaugccuguaucuagacgcuuucgaacauguguguguuuaugcaccccuauauucuugccugugguugaaaucucuaugcaaagacaauaucccuuucccacccaggucagaaagggcuuccuggucugcagggagugaaaggagaccagggagaccaagguguacccggcccuaaagguaggugaauugguuuuauuuguuuguuuuguuucuuauuagauauuuucuuuacauuucaaacauuauccccuuuccugguuuguccucugaaaacccccuauucucccucauccacucccacuucccuguucuggcauuccccuacacuggggcaucgagccuucacaggaucaagggccucuccucccauugaugucuaacaaggcuguccucugcuacauaugcagcuggagccauggguuuuuccauguguacucuuugguuggugguuuagucccugggagcucugggcgggggguacugguugguucauauuguuguuccuccuaugggacugcaagcuccuucagcuucuucaguccuuucucuaucuccuccauuggggaccuucugcucaguccaaugguuggcugugagcaucuaccucuguauuugucaggcagugacagagcuauaucaggcccugucagcaagcacuuauuggcauccacaauagugucugggauuguugacuguauaugggauggauucccagguagggcagucucuggcaggugaauuguuaaugcaccaggcuuuaucaauguucugggcagaugcagaagcuaccaaacacgugggauuggagggaugucagaugaauggaaacaucaguagaaaacagagauuaggaacucuuguuggaaguuuuggcaucagccugucuugauaguggaguugucuggugugugacucggcaaguccaggggagaagagaggggggcgagaggaaccuucguguuggggauccagcauguugcacaggcuuugacaucagaccgacaccagccacuuagaguuggaacagaagaaaaucugccuuccacugcucacaaugacucuggguggcguuugcugugcccacgggcaucuucaggagaggaagggcagguggcagcuguugguuuccagaauggaguugggagggcaggauuuuuggcuuaguuaaacaagaaggauguagcacacaucaccugugcauuugaugaggcucugugaugguguguuuggugaugguacaguggcugcugacagugaagccgauccucugccugucauucccacaggucuccaaggucccccugggccuccaggucccuacgaugucaucaaaggagaaccagggcucccugguccugagggucccccuggucuuaaaggacuccagggaccaccagguccaaaaggacagcaaggugaguccuuggguuguguaggugccugggugugcaugugggguuguguaggugccuggguaugugggcggguuuccuaucaccuaugugucuaagcccagagucugaacagcgguugacuauacaaacacauuuauauuugaauguggaauuuguuuaaaguacaccagacauaauaaaguuuuuggaagacaaccccccgccccccaccgacucuaaauggcaaguaaaauacaagaagaccagaggcuuacaacucaacacaguuagacuuagaaacauccgacccugccuugcuuggcagggcagcuggcagaguggagcacagguucccaugggcugcugggauugccacucauauacagggcucaugaguuguucugucuaugagcaaaggcccuguggcuccuucccuguguuuccagcacacccuccucuaggcccuugcuauucucugccauuccucucucaggagcuggugggaaaggggcugagagaaagcugggggauuggaaacagcaaccaagaaauguuaagcuucaagcugcuuaugaguuaacugugcguguggaaacggucaccacagccugcccauggcuugaacacugagacucuagacuaguggcucucaaccuuccuaaugcugugacccuuuaauucaguuccucauguuguaaugaccaccaaccauaaaguuacuucauucuuacuucauagcuguaauuuugcuaauguuauaaaucauaauguaaauaucugacaugcaggaugucugaugugugaccccuguggggauugugacccacaauuugagaaccacugcucaaaagcacagcaaggagggaggccagacagaccucucuccccgucucccuuacuugacccuuuccaggucuggcugucacauagcaccugcaaaaagcuugggagagcucaggggacagucugagggacaggguuggggcaauaccccuuauaaacagugugucaucugagacuccaaaaggggaguccugggcucugcaagaagcaacugggucuaccaggcccugacgggcuaccaggauccauaggucucucagacauaucagcagucugggcccuacgcuugcuucccuggagaaggggagaaagagggccaguuugcugcccaccagaccagaucacaaagucuucuuccuuuccuguaggugugacaggcucagugggcuugccuggaccuccaggugucccuggguucgauggugcuccuggccagaaaggagagacaggacccuuuggaccaccugguaggucuuuacagcagaaacaauagacccaggccugaggaaccucaaaaggaaguuaaaaauaguucugacaggguaccaagguaguccaugucuuagaagagagaggcuccugagggagcugaggguugcuguuguugaucgguuaaggugugugcuuuccagaguagccaaggcgguggggugggccccuguggauucguagcagcacagcaucccacagcuacaaaaauucuguuuuagccacagcuaguggaaaauagaaguggaaaauaauaaugucaguguuugucccgaggccacugguguggaauaaucuucacgggcccucgugggaagcagggacugucccacuguggugucccugugcaaagagcacagcucugcagaccuggggcggcaugugcuucagccauccgagggaaugcacgauccaguuaucugaggacuuccuucaugcucaggcuguuggaugagaguaaagcuguugcauggauucuguagugcucgcucuccccucugagcagcccaggauuccuuaugaauggagcacugcacuugcaguauaggcuacucuguuauucacagaagagguugucuccugcugcacucugggcucauaaagcuaugcaaaggugugauguggaggccugcgaggacuuaguuuugcccuuuccacaaccuuaguuucgugcagugaaaggucagagacuucugcuacuuuggggcagagcagcuagcugcaguuccuuggagccgggagcagggacuuuggagggagccagaugguagguaauaaggugcgcauuuaccuucucucccacagguccaagaggguuuccuggcccaccaggccccgaugggcugccaggauccaugggucccccagguaccccaucuguggaccauggcuuccuugugaccaggcauagucagacaacagaugacccacugugucccccagggaccaaaauucuuuaccauggauacucucugcucuauguccaaggcaacgagcgugcccacgggcaggacuuggguaagaugcaguucuuuuccuguguggcauauagugggcuccuaauuaggaauauggcauccuuuucuauuugcuacaguguggugggcuggguaggcagugucuuuuggcgaggguuugucaaaucuccuuucaccccccacaugcugaccccucaguucaacagcuucuauaugucuugugagaagcauggucuaugagggcuugguccuuagacguuuuuaaacuuguaaaacuuaagaucucacucuaguuauuaaguacaguugaggguccugcuguggcacacguagcaauuugugcaauguucuuaaaaucgggcugcuuacugucggcucuucuagaaauacgccauguuauucugacagaggcucucugcaucuucuggacugcccccucccucccgccgaguucuuuugaugcaacaggaagccacaugcauacgcccacuauuuuuaucugcuccagggacccuccaccaaguguugcccuaggguuguguacauugcugauguaaccgaguaaaaucagaagcacagaggcugggagaccuacagucaugcaccagacauuccuccugggacaggcuaccuucuguuggcacacucuguuggcauguuuuccuugccucaaacacaucuguguugcucuuuauaguuuccuuauuaccugaucaguugaaaucuaaucugccaaucacuugccagcaucccagcuuacuggugccguucccagacuguguggaccagagugcagguucucacuuccugcuguguucucuccugaucagguacggcuggcagcugccugcguaaguucagcaccaugcccuuucucuucugcaacaucaacaacgucugcaacuucgccuccaggaacgacuacucuuacuggcuguccacgccagagcccaugcccauguccauggcacccaucucuggggacaacauccggcccuucauuagcaggugagcuuagcauccagaggcaguuguuaaaaaugaagacgagaaaucggugcacacuuggccuugaauguagagaggucugcuucugccuucccaggacugggguuaaaggcaugcaccaucaugcuuuuuuucuuuaaaagaagauuugugcaugugugcgugcgugcgugcgugcgugcguguguguguguguguauguguguguguguguguauguguguguguaugugcacaugugcagcuguccuuguagccagagacaucagauccuccuggagcuggaguuacauggaguugagaaucaccugcuauggguggugcugggagccucuucuggguccuuugcauuuucuuagccacacuaauucaucucuccagcucccaaauguccuuucuuaaagggugaauggaugcacauuggauuuuguguauccacggcugucuggguuggcuguucugacuaagccuacuccgaaugcgggugccuuccgaccuuuugcuccauccagaauugggguugcugagucacacguugauucuauuuuuaagcguuugaguuugagacacuuccuuacuguuuuuccccccaguggccgugcccuugaugcccuugacaucaugacauccccaccggccacgcacaagggcucucucccccuuugccuucacauccucacuaacacuugucagucucuguuguguuuuucacaguagcccaagugguugcaaaaugaagcccgugggacuguaguaccgaauauauaauaccugucucaucugcuuguguaguguuugugcauaaaaauuauuucagauucauuucacucagaaacuuaggcgugaucacuagcaccccagaauugaugguggaggagcacagauccauuuccuguccccugucccauugaaguuugcucccuugagacuguguaauacugauugagaaugcguaugucucuggcugagugauucccacauuaagcuuguccccacaguggcagacaucuggaguguuuucaacucaagaucuugccugguaggaaguaaggcuggacauuuuaugagugaaaaguauuagauuguccuauuauuuuuuuugcuugcuaauuuccuucaaaauaaguuuauuguucaguuguacuaagaagugacagaaacauggaaauggacagacucacuuggccaacgauucacuuugugcgugcaguauauuaaagacagaggaaugagaucucgggagcaucccuuagggacugacgagaaagcaccaggcauccucauguacucuugcgaggcagcgcucacuaugcagcccagguuggccuugaacucgagauccucaugccucaaccucuuaagugaucggauuuugagucugcuccaccaugccgagaucuucacagguccuuuaaaaacaggagcgagcaugaagacagacagacagacaggcagccuggcagaucagcuuuaccagagggucacagacuuucuguggcugugcucugaagucccucgugacagccuuuuuccuaaauggaaaaugucauuuauuacacuugaagaguacacagagcaugccguacagacgugugaucuguaugcagaccccugcccaggcuguguugaaggcacuagaaggagaacuaacuuucugugguuuuucuuuuuagcuuuccuuggaaaacagguagaaaauguuuauuauugaugucucuugguuacuuuuggaauggcgucuaugcuggucuugacuugguugaagacacaggcccagggaaacugugugucucauucuuuucuccaugggcauuugucuucacaaaguuccuguucugugagcacaccugagauguauaccuaaaauuuggcauuucaggguucuuuaugucccugcagcuugaggggcccuucaggucucacccagccacacaggcaucucuaauucccuguuguagggauguggccuccucccugggcugagaguuacuuuagcuugaugguuuccagcaaugucucaggacuuccaggucccuucucuccugugggaagacccaaaagcuuaauuuuagaaacauugacauaaaucuuuccuuuugaguuuugagccgaagagaugucagcugcuuucuuuauccuguuggcuacaauuucuaaguacuuucuacagacaggaguggccauaaagccacaauuccaucaccugagagaaaugaccgguggucagagcggaagggaauuugugauggccugggcugugacacuaaccacagcuguccuucucuuuggccugccccuccucuccccccuagcaccaaagcauccugggaagaagggcacuuuauuucccaugccugaaaggcagaaggcagcagauggacaaggccauuucaauuucaguggcugguguuuaauggaaccuuuuaguucaucuacauuuaugugacuaaaguagagagagugugugugcaugcauacacacacacacacagacacaugcacacacagacagacagaagcacauacacauaugugugcauguccacacagacagacacacacagagacagacagacagacagacagacacacacacacacacacacacauacgcacgcacgaaugcacagcacagaaaauggaaugacuaaucuagccgcccgcccacccacuuccuguccacgcaugcagaacuuguguaauuauucacacguuuguacucauuuagcagcguggcuaacacucucuucacucugugacuggaauguaauuauuuugcugcugcuguuuguguuuuuaagcagugcacucccccaccauccaguacucccuuacuugagugagcuuuagaacacccgaccacgcugugguuuucacucacucuggggugacuugucauggcugggcuugagcuagccugucccaggagggacuuuguccucaggaggggccagaacagugauucccucugccacgguuaugacgaucccauuguuccucuuauagaauaguuuaaaaaaaaaucaacugcuuuugaauugaauguuuuaggagugagacgggcuuguacaaccaaagaggagucccugagccugaguccuggcacuggccacauuauuuauucacuuagauuugagccagagaaccagggagagagggcaagggaugggucauccccaggaccauccacacggaaugccugcuuccucucuuccaggugugcgguuugugaagcaccggccauggugauggcgguacacagucagaccauucagauuccgcagugcccuaacgguugguccucacuguggaucggcuauuccuucgugauggugaguguuugggagacuacauuuccuugggagggcccccauugaugucguuaucuccucuaugacuccaaacuucccagaucaucccuuguugaauguaacuuggagccuggucuguugcucuugcggucuacagugcgcccagggcucccugcuccucuguguugggagcugcugccucccaugagcagggagcgccuagaguguggacuagaguguggacuagaguguggacuagaguguggacuagaguguggacucuccguagucaugugaccagcacccgcagccugaccagcucccuccuguauuguuaacacacaggagcuuuaaagcagagagcacucgaugggugggaacauggguaccccuguaagcuuacacugcuccugccaaaaugguggccaggagaaugauccucccaggcuaauacccaggaugcaccugggcagugagguacgcucuucuaucaccuggcugguuuuggauguuuguuggcuccuuguaaccuuuccuuuaaaaagccaguuauggcaggggcgauucccugugugaggagcucauuguggcuucuuugguuuuaucaucaugcugaaaaguauggacugagugcccacaaguccugaacuaguaagaaaacggggaggaauuuaccaacuucaaguaagcauucuaagcagacaucuuuaaaauucucgggcagaaccaauuuguucaucugaccugcaaacugauguuaguauuugauaggaaaagggcuuccuaauuauuuucuaagaaagcugggugcuccccucucagugggaggagcuggugucugguuucugggauugcguagaggccugagugucccagccuggccagcagaccuggaugguggacuaccauggcuguugagcaguuuuuuuuuuuuuuuuuggcucaaagucugugagccugggaugacuaggagggaccuggaaccuucccgaggaggcauccuggcuccuuccuagggacgaugaaucucucuuuggguuugggugauaaaaccucagacucaugccuuaugcuugucccacagcacaccagcgcuggugcugaagguuccggccaagcccucgcaucccccggguccugucuggaagaguuuagaagcgccccauucaucgagugccacggcagaggaacgugcaauuacuacgcaaaugcuuacagcuuuuggcucgccaccauagagagaagcgagauguucaagugaguuagacauggagggcucuggccuccuggcagcccuuucucuuuuguuuccuauaacccaccaaauaggagucuguucugagagggcagaugacccggaugauuuucaaaggugauccgaggugauaggcuccauucuuccauuugcuggggagcugagaaagaaaagaggucauuugccauuuguagaugaaugugcuaaaauguuauagaaagcagcugaaaucuucaaaaggcuugugaaacauuguauccuuaauagccagcggggagggcuguguggcuccucucuguagcauuuacauaaggugugcaggauaugugaacuaaggaacuuaacaaaagacguuucuuucagcacaaauaucacugaaauaauaggcaagucuuuccuuucuugucccuucccauuucuaagauucauuugagagcaaugagcccagagaugcuggcuuuguugaaguuauuuugguccaccuccaauggucaggagcauguuggcugauggggcaggaggagcuucuuacugcuccugcccagacauggccacucucuccugcagacaauccucucugucuucucuguuuuggaggcugccgugaggaauucugcagcuauccuguuuuucagaucaggucauuugcuaaacaucccaaaguaucaugugcucaacagcuaggauaugggaaauugucagaugcagcauuagcaaacagucuaguuuaguuauggaaauuagagucugcuccuuaccccucagccggggcuggggugggcuucguuauaagguuaauagccgaaaaugggauuuuugcuuggaaccagcagccugguauaaugaaccaaacugccuccuuaaacagaauuagauuuuuuuucccuuaaagcuggaauuuguaauggaauuuguaggguaagcuccuucaaguucaggacaagauguucuuccauguggugagcgaccucaacguuuaguuggauuugauaaguaccaaucagaggugagaauucaccuugcuaaugacuaaaauaaggaucaagacgagucucagcugcucagugucucccccucucucuggccucaccucaggccauguguauugaaacacucccaggguuaugaacaggguuugagugucagcucauuacuccagguuuaccacuuacccuaccauccaaugaaauguaaggaacacucacugucaaauauuguggagaaaaauaauguucuuccauacccugggaaggcucuaaucuauuagagacaaugaaaagcuaauuauaggacuagagacauggcucagugguuaagagcacugauugcucuuccagaggcccugaguucaauucucagcaaccacauuguuucacaaccaucuguaacgggaucugaugcacucuccugcuguguaucugaagauaguuacagugugcuuguauaaagaaaaauaaauaaauuaauaaaaauacauauuucuuaaaaaaaaaaaaagaaaagcuaauuaguccuauggcugagaggugugaucuuggcugggcuccggugggcucgugcauguagguaaugucuaaaacauucccauguuguagaaccacagaccccaguugcuguuuaucaucaauguagacggauguuuaucuggucccuuagggaucauagggcucuggagcuggggcuacagaauuucugauucuguaagcaccugcauuucugaugcuccaugacucgcuguugcugcugcugcugacgguguaacucuguuguguugcaggaagcccacgccauccaccuugaaggcaggggagcugcgaacacacgucagccgcugccaagugugcaugagaagaacauaacuaugaugcucgccucugccaccgucacaacauggugcuacuccccccccuuguccucuucucccucccauuguauuuguaacagcaaugaacccuagaauuauauccuguguaccucacuguccacuaugaaaaccauaaagugccuuauagggauucgcguaacuaacacaccccgcuucguuggccucuguuugcugaaggagaaggacaggcagcggagagcuuuccauaauggcacauaccaaauggcgcuccugauccaauaaaagaugaauugcauuuugcaauccagugcacugaugucuggggcgagaacuccauaagaaacccaaaggugcuaggggcgugaggcgcucuccacacagcccacagcccgcuucauccugucaccccagaugugagugcuguccaacccacuguccaguguuuccacaucaggucccucgaggggcuaugcagagaacagucaagggaacugguuucuuccacuuucuacauggaacuccaucguuucagccccaaacacaaacuuaugcccugugugguacuaugcagcugcuuuuguggaagucauggcuuuccuguggaauaaagaugguccaaagguuagauggaaaauaaauaaauaaguaaauaaauauauauauauauuaguaauuuauauaggugucagcaauuaggcaggucaaguucuagcguagagccuguuguuaaauaaagcgcacuugguuuucgucucuggagaaacuguacuauccuuucacaggguuaccaacaucaggccacugaaugugaaacaccagcuuuccucaaacucacuccuaaaccagaggagguguauagauagccaaagccaaacccauuccuaaacauggugucugauaaugagcccugugccuggcgcuucuugcuucugcucugcguggaguauuuucaggguuugcaacacuaaccacagacugaaugacugacuucccguacgacagccaaggccuuuguuagccuccuucauccugcauccuggcaggcauuucacaccugagcacacacaggcaacuucccagcuccucucgagcugugacacagccccugcagggaguggacaggucgcaggagggcagacucggaccacuaugcuugaagugacauuucacuaaaaguacccacccuccaaaaaaaaaaaaaaaaguuuuuaagacuacuaaggccuucuguguaauuucuuuaaauguguauuucuuaagaauucaaauuuguaauaaaacuauuuguauaaaaaugaagcuuuuauggauuuguugcuagaaaugaaacguugaaagagaaguuaccacacguaccacuaauaaaccuguaagcuuugcugcauaccuuag

SEQ ID NO: 4290 - RNA, 136491 nt, Mus musculus
cagugcgcgggcggcgucuccaaggggaggacccugcggcgcggguaagaggcggaggcugcgcgccgcucgggacuuggugucgcagggaguccgaacgccggggcucugcgcuccgcacccagcuccucccgcgccccgauuccacgagccccuuggcucgccaaucccgggcaagcaccagcaaggcacgccggggccgagaguccggcgcccacggagcagagccaggccggccuggccgccggugugccacgggccaacgcuucuucaggggcccaugcgcgcgggcagcagcuccugacccugaggugagagcgacccccgggaggcacagagagccaggccccaagucgcggaccuguagcgccggaguaggcugaggcugcgcgcuccguuggaucggagcugggggaauagggaucgcgcugcaugggcugaggagcuccaggcagggccuacggagaagaaucucccuuuuucugucuccugaugggacagaacuuuggucaccccgcaaggaaacgagggacauuaugcggagucagggugcuaagaugacgaugcucucucugccugccaccuuugcuaacccgcuuugucucuugccuccagguuaggaagggaucgagccgagucuagagcucaaagacugggaucauggaccgagugcgguucaaagcgucuggcccuccccugcgaggguaagucgccuucugccuggucuccuaggugaaggggaccuugcaugcauauuucaggaguugacaaguuggggcccgcauguuuuggucgcuuucuuacccucccucccucuccugugcagguggcugcugcuagcaacugugacagugggacuccuggcucagagcgucuuggggguaaguaccgcuugaacuccacggcgcuuggaguuccgcgcccgugacggguugggacgcucgcggagccucguggaagacaggcucgucgagcccaccugagugugcgugugcauuguaggugugugcuacugugucugccagccgcucgucccgugcagugcaggagucggcccucucuagggagcuaauaauuaaaacguagccucaggcaccuuuugcugccaagcuuuggccuuagcagcaagggaagaaugucuaucacuaggccacgaggcgcacggacagagggggcugggagcaaagaguuuccagaaacucagaggugguguccaggcacuguggugggcagagagcaucuugcuuaaauaugagucucuggggaggggcggggcaaggaggagacagccuccugcuuuaagguuguucggggacaaagggauagaaaccgcggucucuuccaaaccuugaguaggcccugaagagccacagaccagagggaggccuguggucccuggcuucugugacuuguuuacuguaccuguugcuccuugaaagaccaaaccaggccugccagaacagccuuugaacugaacuggagagaugcucuggggcucccucgcauuuuaaauguagccacuccuuauaccaguaccagugugugugugugggggggggggucuucucauagguagugcuguuuaaaagaaacaugaaaauugagaacccuggccagguguccuaugugcccuguuuacuugucuguggaauaccugaguuccaaguagacacagcuugggacaccaguacacucugugucuggaaccaacacaccuuuggggaaggagcccugcuucagccuccuucccuucccucaccuagcuggaaccaucagugguucucaggcuugcagaaagugggcacugguuccaccacacaguuggucuccugcucugcugggaugcagagcccagcaugaggagaaagcggagcucugaccagacuggccgcucagcccuggccagucuuauagcuugagucugucuccuuccugccccaguccucaguccugacauaagagcagaaccuaaauguuggaacagcccauuacuuaugggcccucaugcaugacucccacuuggccgggauccguagaccacagccgcacuuaaacccacguuccuagaaagugacacccaguguggugacucccacaguccugagccgcugcacagccaucuaugucuuuuauccugagaacaaagaccuuaccuggcaucguuuuguuuuguuuuuuccaacucccaaaaggguuugcuauggaaaagcaauuuacccagcucuacccuugccucaugacaccaagccucaguuuccacauuccucagaauauuugcagcuugucccagaggccauauucccuucauuuacgcuauagcucccuaaccucuccaaauccuuucccaugccacaaacccaccucagugucucuggcccuuuacucuuggaugugacggagagcagguacuucccagaaaaccacauugccuagaaaggcuuuccaaaacuccagaucccaucucagacaacccagcaggacuuucugaggcacugccuagaaaccagacacagaagacuuugggagcccugauccgcucacaggagcuaagagacagcgccaggugucuucagugugcuuaguucauucucugggcuguagagucugaauguuuaaaugugugugaaucagugugucugcaaccgcaugcgauuggugugguuaacaauuuggcccacuggcuuuuucacagcuagugccggugacgugacuucuuggugugggauucuuccuugcggcgaacucugccccuccccucuucguccacccaauucugcuauccuguuccauuguuuuugguaucuggaaccauugugggguggaucgguucagaaaauaggaccucggguuguaucuugugggggccucaaacagaagcagcugggaacuguuagugaaaagaaugggcaguuauuucaugaaugcuucuugcauaccaacgugugugcaugagcacaacauaccccggguuucucuuuguccaugaugaggccaaccaccucaccgccacacccagccucccagauucccaagccaguaaugaagaagcucuuaaggcucuccucauguuggggcuuuccugggucuaaagcucaaacaccgauuuuggaaagugggggaaucccuccucuaccacucuaucguucaggaggagcacagaguaaaugaagugaagggcugccaucaucaucuucagcucagggucaccagugaacacacauguucuaucucugcaccucuggaccagucacccaugugguuguuuccaaaggccagaaaaacuccuacacauacaaaugcccaucaugagacuaaggcuugcgucgcaaaggggugccaaucccagaauccuccguggcaggcugccuggguaaagaucccaacuggacaagcaccuaaagccuacugugggugcuuccauguaugucugagucauagggacuuggggaacaguguccaccucacagggcugugaagggagcgggcgggucugggacuaaggaagacuguguguucccacuucccugaggcuuuguuugaucccuuugugugagaccagggcccccaaacagaggaagucacuggggagcucucucuguugauagaauggagccacgagcacucccagcccucuagagccucagaucucagcugcccugaguagcuuagauggcuuagucacagcacagacaguccucauccuacacacuuagagauggguagaaauuuucaucagaagaguggggacaggagagggucccagcccugucuguggagcagucagaaccagaaagagagacaauaugagacucaagugcaaaguucuagagcagaaaaacuaggauucugcuaaaaaauaaauuaaauaaaacucaaagggguguaguugaagguuuggagaggaggcgcuaaugugaguguuggaccagguggagucuguguagagcacugcugcuuuccagaaaggcagugaggaaagcugaaccagggguugucaaaaagauauccaggcucuggggauucuagaaagugcuuucaaauucaccuccaguuuuuuuguugcugaggcuguucaccaauagaggcggcaggugaguuaggcacccacaugagccaacucaccucgagauccaagcacccuuggcaagaggugguuccuccuaauggcuacuagucagcugcuugagcucagagggagugggagcugaggagaugcuggguaagcuguaugcugcuccugugaugguccauacaacccaggucagucagagacagauugcagccugagcugcccaccucugccagaccuuguggagaugggcccugggcucaggagucuccaacccccauccccgggggucagggagggggucgagcaaaauugucugggugagcaucacggcucuccagcauggaacaaaaauugucugggugagcaucacggcucuccagcauggaauagaaaauugucugggugagcaucagggcuuuccagcaugggucgagcaucagggcuuuccagcaugggucgagcaucagggcucuccagcaugggacagaacagaaucuugggugugaggccuucccugcugugcgugcgagcuaguaaggagcuucuggaauccagugagcaaaugucacuccucuaacagccaaucccuccagauaauauccuuggcaucucaggacuguggcccuugaccccacugacuaccccaggugacaaugagguuauuguuuaaguaaucuaucaaagaaucgggugauauggaaucuuaggaggauucugugggugucuaagucccuuugugugugguuagggggugaauuucaaagaaaguuaaguagccggggcuucccuagaaaacucuaaucuauucaugggggggggcgggucucccgucuuuggccccugguggcucucugcucucugaccagcucugcugaggccugauuggcucucacugaggcagaguuuggagcagggaguuucccuguauaucauagcaucaaguguaguaugccacccggagcggauccuggcccagaaaagccauguuagugaaaagcacaacagaaaccuacuggagucuguaauugaacacacuaauauuuauuucuuccuuuugagaagugugcaaaugucugcaagguguuagcucauugucuugucuggguggaggggguacaggaaccugagcugucuuugcauuuuucugccagcgucaacugagauacagauaaauuucuuggugaugaugguggugguggugguggugguggugguggugguggugguggugguugugguugaaauauggcuucacuacauaguccuggcuagccuuuagcucacaaagaucagccugccucugccuucagaguacccagcucuuaggaguuuuuagcagcuagucaaccaucaauuaugggccaaccaugugucagugacaagcaaacacugcgccugcccacccuccaguaagucaaggucacucuucuggcuuaggaaauauagcaggguuguccccuggccugggugagggcuccucucccagaaggcccugcacggcugcagcaggagccuucauucccuacaagggaaggugagguagguggagugccacguagcauuuacucugcuuguccuggaacucuccugggaucaguguccuuugugauggcugacuggcugauagccauucuaagggaucuggagggugggccugguccuggaggaccuacgcagcuuuagagguugggacuuuaaacccuaccuccaagagaggggcccagaaacagggauuagccaugacuagugaguugguccaucauguggauggcgaagaagcucccugaagucucccaaggcuggcuuggcagucucccagcuguagccuggcuggggguuucuggaagcuggugcauccacugagaauauagagucucugugcuuucccuagaccuagguauguuccccugaguucuagguguauagacccagacaagggcaaaggaaccccaguggagacccaguggaucagagacacagaaaaucaaccuugaaccuuugauuagaaccugaagucagguucuaauguccucaucgcucuggagaacaggagagcugcaugcccuguaccacaugagauuaagugcuggagaagcaguggugugccaggacauccuacauccuauguccccaaccaccccuucacacacacacacacacacacacacacacacacacacacaucucucucuacacacacaugcccacacacauaucucuacuuacacacacaucucuacacacauaucucuacacacacauucacacacaucucuacacacauacaucucuacagauacaugcacacacaucucuacacauacauguacacacaucucuacacacacacacacaccugcaugcccccccaccucucucuauacauaaaugcccccacacacaucucuacaacacacacacaucuuccacacacaucucuacauauucauacacacacacacacaucucuauacauacauacacaucuaucucuacauccccaggucucuacacacacacacacacacacacacacuucuacauggcacaggucucugaguaggacccccggugacuacagacuguguuucaguuaaccccuggggaaagaaccaggaacaugaacgaguggcacuuggucugugguguggccuggcacauugaccugucaccuacaucagaggccagcagcagagauggugcagccucuguccugccgccacgucugccugugcuauccucugugugcuucucacucaagcccaguguccccuccccgcuagagcaugcccagagcagagcccaagaugccugugcucgcacagaaaugggacccacggcagacuccaacugaagccccgcucucuaacugauaggcuuucaaaucguccucggagacgcaggacuuuggaguaucauucauaauccucacggagcugggggagguggcucagcucggaaccccagugcuugggagacuggaaaaggagaaaugagagucugcagucagcgugggccagauaggcaagauucugacacaaaaaccaaagcccagaggguagugaagggugaggagggguguuccucagcacaucccauacucaugugaaaacgaucucagguaccauuuauaaugaaaaagaggaaaacguagacauuaaauguggucuacaacccccccccauccacugcuuuucugccuggacacacuuucuucaacucccguaaccauguauccucugugggcaccccauggaauaugcucucugaugccugaaacauagugcauucuagaggaagcagugucugcguggguaugagugauggggaguucaguugccagagccgaaacacgucauuugggugaagacugcacucagggaaaguuagcaagagacuauaucaaagucuguuuguucacacugcaugcccucccccgccccccucccccaaaauuaaauguuaccuccacuggaugaagcaucuggggagugagggcaacugcccauggugauuugcauuuuuuccuagggauuguuugaccccacccauaaaauuccuauuuccgaguuucugcccauuucggugaucuuccaugugggaauuagagaauuuguguuuggaacuccauggagccauuauccagugacuggcaggacucacugagcccugugcucuuaacugaauguugaucuugguggccaugggguuacagagcccugcgagagcaggggaagaggcucuggccucacacggucacagacauggccuccucgcacuguccugaggcucuggcugggcccaggguacagucauuuuaaagacacauuuccucugugguccuguccugcccagucuucacacaugguggcaauggccccaguagagaaagagaggcaggaggaccccacaaagggaugugagggcccaggguacagucauuuuaaagacacauuuucuguggucccuuccugcccagucuucaugcaugguggaaaugaccccaguagagagagacaggaggaccccacaaagggaugugagcccugaagacaauuuggcaccugggaauccuaagccagagagaagcauagcauugcugcuguuucaagcagcgggugcuaaagcccagauccagccauuggcacugagagacagacugaggcagagcaggcagaagagucugcaguagcaggauccaaggugggagaggaccgaggacuccauucuaagccuucugccccacacuuugaagccaggugucaaacccccaaugaccucccaguaaaccugucugugaucaugagaggccuuccauuccuacaucuuucuuucauauguacccuaacgcucccauggcaaccauccuuugcuuccuuggcuaccuuauucauuuuauguagguguugaagggauugaaaaggagcuacucuggccuccacacccucauucucuuacugaauucguuacugauagacaguaaagcuaggagugauuucuguggauaugaauuuuguaucugguuugcccaaagugcuuaugagauguaagagauuucugcuggucuuuggggucuuuccuugaugaguuuuucuuucgagcggcuacuuuucucauccauuuggacaacuuuacccucuagguucuggguugaacgugucugcucuuagcccuuugaccguuuuuaccagguacguuggaaaucuucaucugggguuuuacuuauuucuguaccuuugagcucaguagcugaguuaugauguuggaagaguuaugucuggcucucauauaucucuugccuuccugugcugggguuuguuucucuguacguuugguuaucucuucuugguuaagcaaucuucuuuccaaguagccugaccuugacaucucaguucuagauagcacucagcaaggggcuacaaacuacuacagcaucagcgccuucauaccaucuauucaagauaaagaaauacauuuaaagguuuauacacuucugcuggugucuagccugucugcucuggacaacugccacuccgagccuuuuccugggacuuugacaacauaguauuucucuccuuuacugaaccuucucugagaaggucacugucucacgaaaacucuggaccugagguuuguggaggaugugggcuuguccggaggguagaacugucuaagguuucccuuuuggaagcaacuucuguuuuccucccacaagccagggacaggcaaacccaccauuguaucuucacccucuugccuagcguuuaguucuuucucccaucucugucuuuagaaugaaacccuuuuuuugcuuaccguccccuaguccgccaucuuagccaggaaguugauaaacgaggugaggauuccugcccauuuucucaguguccagagcaugaaaacuaugcuaugucuucauggcucuuguuagaucauugcuguggugaccagaggcuugugcccauguacaaagccacccuguaccgccucauaugguaggagcuggccuagauacaucccugaugccuccacacagagagauccauuucccuuugagucugaaaaauaccagcaaagaggaaauucuuauuugcauuaaaguuaaaucaagguguagcuaaauuaguuccagaaugaaggcuuauaacaauuguauuuaaauaauuuggagguccaauuauaaugggguugggacagaaagcuugaagagucuggauaggcagagugugauauaaagaagcaacuaaacucuugaguaaagaaagaaauguccucccaugugcuucuagggcaaagugucuuccuuuucucuacagccauuugagaaccacugacccucugguaaaagaggccagccaugagcaucucccagagaaaugccuccuuccuccuuucuuauuuggcgacuuacuucuuugucaaguagcuuagucauaacugagaaagaaccaggaugcacacuuuuccugucugcaaaccuccccugccacuucccaacagagcccgugccccaccccacccuccagagaggaccccagcuuggacaggauuucccaccaucauacugucuggccuccucccucuuccugcuauacaggaaugcagaggccaaggucuggcccucucugggaucuguggcagcaucuauugcuguugaacauaguuggguguguuuaaccacaucuggacaccaacacauaaagagaguauuuuuagccaacaccgagacaggccugcuccagcccuggcuucuguugguuuccuucugcucuucuguugauccaucauggucuccuucugccacaguggccaugagccuucacauccuaccuaucucaccauacaagcuggucagucccauuggaccugggcccagagagaccccagcaccccagugcccuuugcccuccuuggcucuucuguccuucccuuuugugggugcugaguucuccaacaacagcacuuuguuaucugcaucucaccugauuggaauuuaccauucuagaaaugaaugagcuguuucacucuagaaggggaaggaagcgggauuacucaugcuggcucuuggcguuggguuuuuguuucuugcuguuuuuuuggugguuuuuuuuuuuaaccuuuucuuuuugaauccaaaaauuccugacugaggaagacuagcaauuaaggauagaguugugucucccuugguucugugggccuguuguucuagcuacuugaggggcugaggcaggaggagcacaaguggaagguuugccugagcgacagagugaaaucaguugccagccuggaugaucugguagauccugccucaaaauacaaaugcaagaagcagacuagagcuguaggucaguggugcagcacuugccuagcaagcaggagagccuggguuccaugccaggcacuggaaacaaacaaacaaacagucccguaagaauaagguauagucuugccagaaaguucuggaauaaggaacaacuggacuacagugauauuugaaacagcugugguuugagucucuugagccaagucugaccuuugggcuauccauccccuaugaaaacaagggagcaaagcaggucaaagucuguuuccuuaacagaggagagacagacagacagaccaaccaauuuaaaauugccuuuuugagcugggugguggugcauaccuuuaaucccagcacccaggaagcagaggcaggcagaucuucaugaguuccagggcagccugugcuacacacagaaaagaaaacccuguccaaaaaaaugccuuuucaugggcacuucaaggaggccugaugucuaagguucucccuccucaguucugcuguggggcagacaauaucccugucuucuagucaaggcugcauccuccuuagguuuaccuugaaucucuaagaauaaagacaaaaggaggugucugaucucucacccuuuuagagucuuguucccauauacaugucaugaguuaaaagacauguaacucuuauaaugccaucuacacaucucagacagacagacagacaaacagacaugauguucaccugaaagugacccugccucaggacuccuguucucucucucucucucucucucucucucucucucuuucucucucucucucucucucucucucgugugugugugugguuuucauagacucuucuuucuaaaaccaugguaaaacauacaacauaaaauuaccaccuuggucucugcagugaaaaucuugggguuuuaaagaacagcagucaugacaccgugaggagaaauaucuccugcacagagcagacagcucgagagauacugcuuuuggucccugcuaccuaugaugggagcugaguagacgggaggaggaagaaucaauccgagggaaagagccuucuggccucccaugcgaaggcauggggcuuggggacuguguguaggcaggagcaaacagaaaagcccagggcccuguccccagucagucucuggugcaguggugagggccugacucggaaggaaccagagggaaagaaagggcaagaugcauccugggccgaacucaagugacugggccuuuuugcucagaaucacagugcuaaucugugugcugagugccaaaggcacguccaucaaaacugugcacucacagucagccagggacauucuucuccacugguucuacuugguuugaauugccguauuuaaaacuacugggguaggcagacauuggcuuaucugcagagucaagcuaauguaaaauaugcuuccacugcaagacagugugccaaaguauuuccauuucaugcccugcauuuuuuuccuugagcugcagacccagaggggaucgggcauguggccagugagcacauugggcugagggagcucuguccucggggucacagaggcccaaaagccaccuuggugcuucuggaaauucagccuuauguucauugugggugaaaauguggaaaguggaggcuggcaagauggcugagcuguaaaguucuugccauacaagcaugaggccuugaauucaaaccccagaaccccaugaaaaagucgacaaaggugguuguaucccugcauucccagugcaugggaaguggagaugggcagacuucggggguucgcuggcuagccaguugagcugaauaugugagcugugagaucagggaaauuccuuguuucagaaaauguggcggaaaacaauugagaaagcaaccugaggucuacaucuguccuacacacacagauacacacacacacacacagaaacacacagacacacacacagauacucauagacacacacacauagagagagacacacagacauacagacacauagacacacacacagacacacacucacacacagacacucacacacauauacacagauacauacauaaacacauagacacacauauacauacacacacagacacacacaaauacacacauagucacauauaaacacacauacaaacauacacauacacaaacauaaacacauacagacauacauacacacucacacucaaacacauacacagucacucacaaacacacacucacugaggaccagugucccaaucacauccaauauggaccaccagacucacuccuucugagacccauccaccaagugguguggacaagggagcuuacccaaaaaggcacuuugucccauucaguguggucucugacaaaacugucugagcccagaggagccaugauuccuucccugaauacauaaaauaccaaacuagaaacagucccaccccuaguuggaggucagaaaugaggacaggaacaagcacacgguuccaauucccccuucacaucccaguccugggucagccugcagcccuggacuuugccuuuccgacucugauagggacccugcaaggggcccuugcuaccuuggggaccucggucugccugggacugcugucugggcaccaguagcaucuacaucuuaauccuggcagcuugcacaccuacaggcaagcguucggagauggcagugaggaggguugcuuucuuuugcuuaccugugagaaggcaaaggaauucuuguuuugcaaaacucucaucuuuguacaugagggccugaacccugaggguucaggucacacgugugauccugagcuucagugaagacuauaaaaggggacaauaugaucuauggcuucuaauccccauaaaaaugagcuuuccuuacacagccaacauuaauuacaaccuuaacaaaguugaggcugaaaguauuaaggugaaccugagcucgaccauccuugaacaagcauucagaguggauuaugggaaucagaaagcuacagcaggcuucaggaguguuccuggaaguucagaguggcuggaagcuccuuugaagucagcgugacaacuguuccuucccaccagaccgccuccaccgcucucuucaggcuuuugauuauuauuuccggucccaguggucaguccugugcauuggucucuaguugaacgucuguccagugucaauaaaauuucauguaauucccugcaaaaucccagccaugucuuaaagacugaaaugcuaugcaauuacagaugaaguuccgugauguuuuucguaagcaucuccuggugaaaucacacuggaagucaccuggugaaggcaggaugggugauaggaacauagcaagaccucaguacuuccucacacagacaucucauuggcugugugucuguacccacaaugcucuggacccuccccuccugucgccucugccucuccaucagacuucaggacuuauucaaugucuucucccaagaaaggagagccagcucuuccauaacgcaaguguccugucuuggaaccucuuucuacaagaugcaccugcccacugcagugucacccucugcauccaggucacaugggucaaaucaagcuccauuugucacagcuguaaccuuucaugucuuaagccuuuguccuccucugugagagaacuuuagaaucugcccagugcauguggccaaaaggauuccauucaguaauguaggggaagcccuuaacggggccugguguagaauaaccaccucccaaaggcucugguuaccacacuuccuguccauccccccugccuuuggaccucagagcgugccuccuccaggaauaguaauuccaagagcuuuccaguccgggaguauaccgcuccuuccaucucuuaccccagcccuguaaagcccaggcagcuagcucacaucucuauucuaaucugcucagcagcagaggaaagcacuuagcuuggcugcugagcugcugucagaagauuggguaaaaccucaucuccaacuaaagggcccguggcuguggcuguggcuguggcuguggcuguggcuguggcuguggcuguggcuguggcuguggcuguggcuguggcuguggcuguggcuguggcuguggcuguggcuggcucuguuuaaaguaucugccuaagguucaggaaugccuuuccacacauaccacaaagcuggggcugggugcacuggccuccacuauccccugaccucaguucucaugcaccccuagagagcacacaccacaguugcccuggucuucucucauugaccaggcagaaccaggcuaccuuccagccaggauuccugguaucaagccucaacauugucaccuccuugagacagauucacaucgaagccucagccuguucucucaaaggcuagggugugacccacucgcucccacacucccagcuggcuuuucugaguuugucuccccacaguggagaggucaaggggguguuggaaugaaaaacaaagaaauccaguuuggcuuguguuguuuuaagagaggaauuuauucugugggugucagugaagcguuaaaaccccccagcucccuacagaggccuccugcugugacccacaccccaagaauucuguuccugugaucaguuacagcugggccuugaguggcgucucagcucuggccuguugccuuucaaaccgaauugucaagguaaacaucuucauagauccucagccacguggacaacaugauuaggaagaucagaaaagucagacuaggaacgucugugcuccugagguuuggcuuuaccagagagcuauguuagcaagaaccaagaccucacuagcacacacuccacugcagugaccuggguucaggcaaacuuagggaaaagggagucaugagcugauccuugcuaggcaaagcucaucaaaauauuguguuuauuuguuuuguuggguuuugagacaguauuucuugauguagcccuggcuauccuagaacucacucaguagaccaggcuggccuugaacucggagaucugccugccucugccucugccuccucugccuccucugccuccucugccuccucugccuccucugccucugccucugccucugccucugccucugccucugccucugccucugccucugccucugccucugccucugccucugccucugccucugccucugccgagauuaauggcauguaucaccaugcucugcccaucugaguacucuuaaccugcuuagggaagccucuccucagaguccugcaaagcaggcaucaggcacuguuauuaacuagcuugguccauucgauuggcgcaucccaaagagucugacugaacaccauuaugucuuagcuagugaugaguugccaaaaucagugguagagucuagagugccuggaaucuaccgggggaguugggaaagcugcaucucagugccgaaaaucccagugaggagcuggaggucuugggugagucauagagcaccugcuuacuguacauaaggcacaggguuccauacucucaauacagcaagagaacaauaccuucuccuaacacacacacacacacacacacacacacacacacacacacaccauaaaauuuuauuccuccuuucagaguucuucaggccauauuuuuggcuguuuggggaguuuuuuguuuuguuuuguuuuuucuauuccuuccauagauaaacuagugaauuauuuuaaccuagcuucauguugaagaggcacgagcccaugcaggucucaucugccucccuacgguaaauauaaaucugucucuguagaccucuugcuauuauuuccugccuggcuuuuaugaaaugcgggacuaaaaccccgggauuucacaagcaucaaugccauugucuugguuaucucaguagcucaucugcauguuugcuuucaugagcaugaaauaccuaggacacaaggaaguucccugcgaagaggccuuuacagguauaacaugcuagggccaaaucagcaaacccaucuuuucuuaaaguugggaacuagaaugcuagagcacacaccagauccuggaagaacagagacuccaugccccugguccauguuagcuugauaaaugaauguucucauguaauccuuccaauuaaauaauuuucuauguuagaucauuuggggaaaaauuacaugauucacugucucuaaaggcuuguuuuggaagccaugagcaggacacuccccagccaaaacucauagacuuggguagaacuaaucuauguuaugagcuucaugagguccccagauuguggcuauaaauaaauaaauaaauaaauaauaguauucuuuuauuucagugcaauguguucacuguucauaaccagcucaaaaauaaaggaaauacccagucacuacaaaaacagagauaaauugaauggagaaguucagacuguuggacaaauuacuuaugucuuuaaucccuggaguauuaaauauuuuagcugcaaaugcuuucaaagauagauuaguuuccucugaggucagacaggaccacagcuccucuuguagucuaaauaugaaaacuucccccauguccaccauuacccugaaucaucacugguauauuaugcauauacuaauguguauuaauaugcgaugagacuugaggcuggagcaacauccuuucuacagggaagacuagacaggaacauuggcugugccuugugcgucucacuuccgaagagcaagugcugagcuaugcuccuccuuugcuugaaguguuuaucccaagcagaucauaugugugucacucaucucaguaugaggugcuuuugugggucccauuggauguuuucagucauggccaugaagaaacagaggaauguauguccuaugguccuaauaggaagggaaagacggccauuaacaucucagcacacucagcagaaugcuacuccauagccagugaaggaaaauauagaacugugaagccaccuugucaucuuuuugauugugugcauguguucuuguguuugugugugcgugcauacauguuugugugugugugugugccuguccauauguaugugccugugugugccuguauguaugugugugugccuguaugugcauguguguaugccugcaugugucugucugugugccugugcgugugcccauagcucauuguugaaugucuucuuuuauugcucuuuaccuuauuuuuugaccagggucucucacuagacuggcuaucgagucuagugagaugcauggcaggcauuuugcugacuggacaucuaucuccucagccccuugucauaaaaucaggugugacagaugugacauacauacggcucggaguugagcgaaagcuggguacucuguuuuucacucuuucugaaguuuagaugugcugggcaguuuucuaauaaacgugcuggguacagagcuuaacugcugaagauuuaaggcuuucugcugccccuugaaccaagaggaggguuugauuugauuuugaaagucacucuauagcugcaugacuucaccccaagcaggcuaaauaaaugaauuuucaacaccauuaauggacacuaggcagacagccgaugugucagcgauuugaagggggugaaguggcagggcaaguguggaaagauacugugcuucccggacgcuuuccuuggauggcuucauuguguagguguguggcgggucggaaugagcugggagguggggggugggagugggacacuguccagagcccaaguucuucccagccagagugucagucugauuggggcaaaucccccugaagucuauugaaccacccagcugcuuguccccagucaugagacagcucagagaagaaggcaaaaccuccucaggccacuguuucugagagccacugaaguucaaagccaaguguaugacuuuguuuguccauccacuucuccuuucagagucagugcugcccuccucucacgccaccuggacuagaggccuaggugacuucccaggugauuccuccauuuaagaggacuuggccuucccuauacucauacagcuucacuggguagcuuccuuuccagcaguucucugcuggcuuccuaccagucccguugucgggcugcagguuuugaccuaguuuggcugacugacucuucucuaaauagcuugguaaucaagcuacaggccugguuaggaaccuuccccgccacauuccucugggugugucuaacauccuucugaccucugccugaaaucacuccuggagaaaugcuguuuaaauaaauucugcgcguccagauucuccuggggucaacuacgucauugucuuuucaugcaggcuugcuuucuuccuuucuuucuuucuuucuuucuuucuuucuuucuuucuuucuuucuuccuuccuuccuuccuuccuuccuuccuuccuuccuuucuucuuucuuucuaucuuucuuucuuuuguucuuucuuucuuuuaaauaaagaaacuuacuaaaguuguuuucuucuagaauaaucucugccauuuccaacuuaagagaugaguuuguacugagccuaaaauauagcaguaaauacaggacaaugccagggcucagcaaagaagaagcugcuggcaucaggaagccaggcguggugguucacauuuguaacauccccaacuccaggagucgcaucuucuuuuuggaggcaaaaggagcacuaugcaugugugcagggguagaucaggguaccccagcccugcaaugcucuucugcaccaauuuuuccauuuuuuuuuucgucucagagauuucuauguuggaaaauguugggaagacaugaagagcccucuguuuuccuauugaucauggugaccauguagugaccaaauccaccacagggagauuggcagggaucacaugcauggccaccuugguucccccuuccucuuagaaggagaaugugcauauugaggucagagggcaauguccaagaguugauucuucccuuccaacagguagauccaaggauucaaacgcaagucauuggcgccuuuacuguugagcaucuugcuggcccuaaggccuccauuuuaauguaguucaacguaagacucucuuuaugaaguuacugcuuuucccaagucucccugauggauuuuuacaacagauucuguugugcuuuguuuauaugaaaucguguaucuaaacaugaugccggcuuuaguucgugcacuuuucguuuuucuugucuuauuucacugggcuacaacaucuuagccacauuaagucagggaguacuuaccaacuguugugguuuggucuguugcuauauauugugaugcuagauuccuuaauguaaaaauaccaguuaaauuaaaaaaaaaaacguacagccaauuccuggagggaagagaagaaggcagguuuugaguuaccugguuggggguggggguacagagagaggaauaaggaggaggaagaagaggaggaagaggaggacacagagaggaggaggccaccauggaagaggugaaccaugagcagauggagaaacaggagaaacagcaaguauuugcgguacaccacugaggaaucagucagaccugcauaagaaaaguagauuagagguuaccccccaauaauugucaaaggagugucauucauucacaagcuagacuugguuaagauuaaauuggcugagcuacaucagccccuggcguguuacaugagcuuugcuaguaggcuuggaggugaacauuggaaauauuuucugagcagagguuaucuggacucuuuucaacuagaaaguggcgugggaaacuauuuucuaagucuucuugucucuaacucgauuacacagagauucaaagccagagacacacacgaaggacguguugacaccgacacaaaccaauguuucaugccugcuccucugaagaacgugacagcuccguucucagaacacucuugaacaggguauauucucccuccucuucuuguucuccucaacuuggaugccaguugugccuucuggucuccuccaaagccagcaugacuuacagaaggcaagaggugugcucccgagacauggauuuauggaguuuuucauguuaacuuuucacugucuuuauccccgcuacaacuuuacugaccuugaaaguuuaacuuggaaaggccgcuggagaauccuuccaguauuaacugguuuucugagugauugauuuaugucauauuucugaugucagcaguagucucaagaguguugcuggcuucugagaaacaguggugcccacugccaagcucagcuggaggucuucauuacccaaacacggggugauauuucuagacggucucuucugacgguagucacaaaggucagggcucccaaugaauaagaagggggugugggaggcauuauagccuccugaggucuuguggugcuugcuuguuucuggaaugugugggucaccccuacucugaccugggagggcuccuaacuauagaugccacuugugagcccgucccugccuugccuuguuuuaccuuaacuguccuugccacucacuaggcacaaauguguuucacagagccagcuucuuaucaguaaaaccaaagaugcuuccgauuuccuagaaggcauccucuccucggcuauucugggaccucagguccaugcaaaucuuucacaugugugcagugacucucagcccugcugagccucugcaccugauuuuaugucuccucccacaucuccagucccuccacaagggaggcuuugcguagcaccuuucuucuucaaagacuucuucaccaaagugccagacuaguaaacauccuucuaacaguagcaagucccuuugaaccccaaggagagguggcccacagccugggugcugucucaccccacuaccccacaguacacaaucacuauggguccugggcacuguaugcuagaagccuggguuguggccuucaacagucacacaacugcuucucuacauaguucuuacuauaaauaauuacauuguucuguucuaagauaaggucuuaucgggagggaggcccugaacuaagugcuuuaggcauaugaccuuaaguuaccuuuucugaggccacaggaagcaggaacuccauccuccuucaacugcccaggaaaccaggcccagaaaguuaaguuagugguaccagguaccacucgccaggccgccugacuccauugcuucucugauaguugcacauaugaugacagaucacagaaggaauugugugcagugugcaaaaaugccugagcucagagcccuaggguaauaucugagacauaaugcagcuaaccucuauggagcugggcaggacauucuaugagguugagcugcagacgugaaaccccgaagaggggcugggcuuuugaagugcuugcuguuguuggcuugucaaucacagcaggccuugcugugcacauaucagaaggcgcuagaguuacaugccaaagauuguguccuagguccuuucuuuugggggacccuccccaguggagaucaacacauggcacauggagggcagcuuccauucucgaguagagaagacucccauuuccucucuacccaccauagcauccacgacaugcauuugagaugugugucaccaaagcaaccccauugccagguagaugugucauguaggaagccuggacagaacugucuugcugaguauuguaagacugauugagaacaaucacaaagcagccacaugccaggcaggcaucauuugcaagugguugacucaugaaaagcauugguuguaggaagauuggcugaugcuaagaagauaagaauugcguaauuuauaaaguguuaugucagcucuauagaaagacauacagcuggaaggccagaggccaguggucugcucgcaucagaucagccccacagggagcagcccucugcccauuuuccagaugcaagccacuagaguucuccuuguggcgcuguugaguucucucgugcugcgaguauggagggguucuugguucugccccacaguguccacucugguuucuuccccuagcuauuaccacagcuuuggcacauaucccccaggaggugacauguaccuugaagaaaaagaaaucuaggaaggauucuuuguuucuguuuuuuuauaugauuucacugcguggucuggauuggcuuuaaacggucauucuccugccucaaccuccccuaugccgaguguugagacauuauuaaauacaccuuucuucugggagauuuaaaguacauuuaaaugguugguagguaccaucuccugucuuuacaaugugugcgggacguaaggaagagagguagcuuuggcaagcaaaguucaaagguugccauggaagccuaacaggcugcccacugauguugacuccgcauuuuuccggugccaauaggacucgcacucuugcccccagauggccccuggggugcuucuccuuccuuucagccuacagcugcuuacauguucccagacaguuugggauuuuuuuuuuuuuuuuuuuuuuuacuuuuauccuccaggccauucugaauuauuuucuccgcuauucuggaacacugaugcugagaauuaagagcugaccauuuccucuuuuccuggaaaauacucgaauggcucucugauaauacauuggguugugugucucaggcaaugccagcccuucaugaacaugcagggagcuauaacgaugccuuagucggggggcgagcauaacagugcuauucaugcgaaccgaugaauuaaaaaagugggagaugaauaugaaaaggauguugaauaagcaaguuuuuaugggggccucagaacagauugcaguuuggagauuagccugggagccuggcacaguggccauccucaucagagcugcuggugccagcuugggcuggcuucuccugccuuuguuucugaccccagugacaaccagccaagucagcuugauuauaccacugaauaugaugucacaccaacaaggaaaugugcagcuguuacauguccuggagaagaugggucuuccucuaucugcacuccagguucugagaggaacucaagcaaugggguguccugcugagagcucagggccuaccccaaaacugccugguucugggaccucagcuucucagcaccagugcuaucuggagccuugagcagaggaggauucuuuucuucuauaaauggacaacugcaggauuuccuacccagugguggcauuggccucuguguacuucccugccauccccugcuggcuccucggccaguuacaacagagguuccagcaugcaccugugagcaguggucauguguggauaguucagggaggcccugcaguguguucucuggggacacaagauguccccaucagucuucagagcggcuuaguaaagcauucaucuaccaaagauggaacauugggccuggggcucaguaugagagcacacaccaaagacaagcagguccuaaguccauuugcagcaucaguacuugauugauguucuggauauuaaaugugaccaccaaaggagaugcuucuaaaacaagcaucaugauggcagcaaggccuuggaguuacugcucuuuugaggcucaagaacuacacagaaacucuuccaaaugagccaucuaccacugugugaguguuugcuacuaaguuauccugaauucauuuuuaaacaaaagcugggcccuuacugaggaagcuuuacacguguuuuauauucucuaaacaugugcauaguuggcucagauacucagacacacaaaaaucucccaccaacuugaguaaaggaguauucaacuaagccauucagagggcuuguccaccuuaaagugcacaaagagcaaaaugccuucggaaaccagugacgagaagagaguggguaaaauaaaacugauuccccaaagcaugcuggggcugcgggagccacugagcccagagguucugucagcaccagacgggaaccggugugaguccagccagucagcacaugcuagaaacuggccucuggcggagcugaaaugggcaccucagagguccugugugugagacugagaguaugcagucccuccugcggcugaggaaggaguguguauugguuccuuuugugccgccaaccacagcaccugaccgcaacagcucaaaggcagaaagauggauuuucaguccaucuuucuguuucagucucucgggguagggaagacguggcccagaucaggucacagcacccaggggaugugaggggauuuacucguagugaacaggaugcaaagcaggagaaaacccaggcacaggagaaaccuuccaagaccuguucuuagcgaccugcuuuccccaccaagggcccuaaagguuuugaagccucccaaaaugcugccaccagauagggaccaagcagacaacacgugagccugcgagggacuucucauacucaagccacaacaccuggcuuccaugauuugugggccucaguuuugcaagggcaccugguuuucugugcccugaagacaugagcuccucugucuccauccuauuccggccuccccggccccagcuccuggcugcuggccucaagcacaugcugaacaagaggccaggguuuuguuuggggcuuuguucuggucuugaaacuacagggcaguuucuaggagaguugugugacccaugaaaguagaagugguacacugaagagaaauuggcagccagugguuggcagaucuagaccugccucugcuucugugggccaggcuaucggcggcagccauuaauacucauuaauagaugaggggaugccuagcaacaucucuucaggguaccgccuggcagagaugagccugagauggagcucagaggaaguuaagcuauuuuucugaguagaaaaagagaaaauggggguuguuuuguacacaggaaacuacagcuuacuuacaaggaccaaagccaaucacuggaaagugcucaugggaggagggacagcacguccucacggcaguuagugaguuuuccagauggagggagggucuucugggucucagaaccuugguccucagugucuguagcaugcagccuuucugcaugucggaagcccugcagggcucacacaucuuugcugcugcugccuccuucccguuugacggucuagauggacgcucaguggccucugucuccacuguuugccuuccgcugucggccuaagacccagaugaugagagaaagaauggcccaaaauagcucuucaguaagaaaggguguccaaucccagcacucaggaggcugaggcaggagaauuacaacugugaggagagucuggcuaggcuauauagugagaguuuguguuggcagggcacggguuguuagucaucucuuccaguucuaaaaaauaaaucuuaaacuugagugcuggggccugaaccacaggguuuaaaccaguguuucucagccuuccugauacugccacucuuuaauacaguuccacacuuuguggugaccagcaaccauaaaauuauuuccauuguuacuucauaacuguaauuuugcuacuguuaugaaucauaauguaaguaucuauguuuucugauggucucaggcaaccacugugaaagggccauucaacccaaaggugcugagacccauagguugagaaccauugguuuagauggagccugacccauaauggccuuuuaucagguuugauggagugagaauucagggagguacuggagccuacaaaugcugucuucuagccaagcauaggcuauccguagcuauucagacacauuccagagauugaacaaggaccaggauguguugguguauaccagugauguguuggguuucugaugagauguuucuguagagcacuaguacuguauauacugauucucuuugucuuggccuauggugacacuuggguccugggagggauaggagaggcugacuguaagacguucccuugacuucagaguuugcaaaccucugguccagcagcgaccaaaugucacuggcaauccaggcuauagauacaacucaguguggcugcaucuaaauuagcaaccaucugcaggcuagcuacuguuuucaagguuaccucauucugaagauguaaagagaacaaggagaggccagggagucuugaggccaguaggacuauaaagagccaggguuacacacugggacuccucuagagaaaggaggagugguauggcccuugguucaaccuaacauccuucuacaacaaagugcucugguucuuuguguggcgccauccuaagggcuccugaccagcaccaccccaggaaccagucuaguccuucaggacaauucugccagaagguagagcccuucugagagucucaagauucuuugucacaacuaguugggagagaaacaagagaaguugaaggucuugugcggaggugggugugggggucucccugaagccugggcuguuaagucaccuaagccccuaccccacccccguaugugcacgcacauccucugaccucccugauccucuggucuccaugggcugucugcugugcgaucucagggucucaggggcacugcuggcacagacuucaaagggcauuggucuuucaucugccuagggugcuuggggguugcuacugaccaaaggaagauuguccauuaagggaaagaccuuagcauaugugcaggggucacggcaggcucccucagccuggacauuuauggcaugugagggagccacuguuccuggcaguagcuuccucccuggguggggauuugggugaaaggaagcacugagucaugacaaggucaagguuaggaaggaggcaggcgggaccugcuccgugcagggaacagugaugucacugccuacaaggcagagcccggugcagccacagacucacaggucagccgugaggagaaucccucagacacagccaacugacucucccuacucugcacccuccacacccacuccccuaaaagcacuguguccucugcuugugacacgguaucgccuaauccagaagucucuguguugggcuuccuggccagaaagugacaggauccaagcccaaagacucagugugucagaccuugcauaaacaagccauaccugcauguagaaggaacuggacaugugaccgacauugguuaagcaagaaauucauucagauaaugcaaagaagcaagugcagcucagaucagagucacccucuccccuguguuggugucgucugucugccucuccagccuccccugcagcuuguccugugugguugaguguccgugguucugacugacugaauacugccacugggacagugcuagggacguaugugcuuuuagcucccuggcucgauggcauuaagaaugcuguggagaagacacuggggcuggggacaacauugguggcacuugccaaugggaaagcaagaauccagguuggaagagucgguacccuaaugguagggcacucugcuggcaggcacaagacccuggguucaaaaauucaccagcccaaacugcucugugagaacccuuccucagucuggagguguuuaaacuuuaucaguuuccucuugcucccaggucugaggcugccaggggugacauuuccuggcuuuuguggaacugugauauagacucuguuuugaaaggacaggaacauaauaaaaacggauaugaaagaagggccagaugacaucacuuagaauauuugaggaagucccucuuggguguuuacagacccaauauauuaguuguuugugcuugauaaggguacuuuugauacguacagagaauuacucaguauaaaugaauuuugaucuugggcucauagcaacaccuagaaaauagaggucuuggcuuaggucccaaaagacccuggcuuguaaguugaccuuaguuagggacaagguucagcaguuaaguugcccaaaccaugccuaauccagauuccuuucuuaaagaaacaacaaaccaagggaccuauuuauuagagauaaaucaacaagcugaguguuucuccaaaucucaauccagagacaaaaauaguauguggaacuuaagauggagauagugccuuccucauguuaauuucauuagcugguuauagacucaugcaugcuagaugcaagccauuggaugaagacuuaaaacauccuccugucuucaugaacaguagacucuugguggaugaaaaucucaccugcugugagcugcggacaagggacagucugaccccgccccucugugaggggcaggggauggccuggccccgccucucgguggguaggaauaaacguggaaugaacaagcuugaacagagaagccuccagccucagcccucccugaccccacacucucuuggguucaucuccuuucagucuccuccccucaagacacgaugacagauucuaugugccauguaaaugaggaaagugaaggacaggguuuguuucucgaagggcuauugggcagucauacauuccuccaaauguggccugauucacagccaacugcgucccuugccaugagauggaccaaauggacaccccaggcagggcaaagacccccagaaggcuggaggcccaggggucccaucuauauguuccucuuugaguauacaaggcuggaaauucaccugugugcauggacuaguucaguagaguagacagaaauagcuccugacaguucacugcccugguguagaacuucucaacacaggcucauuccugaacaugugugcagaugaacacucagaacaagccccccaguggaucagcagacaaaacuuggucuaagccaacccagggccaacuugauacauugguugauacuacaaucuagggaugcauccaaugagaauuuaaauaagccaagccuucugcaaggggugugggggccaagagaauaggacccaaaggggacuguuggugaucagugucuggaaucccuguccugugaaagggagacgggacaaucacugggccucccuagauaaguccgucgagcagaauucauaagguccaguuucagggagagacucugccucaaaacuugaaguagagagcaauugagaaagacaucaaccucugaccuccgcgggcacaugcacaggcaugugcaccugcaugugcauguacucacaaaugguuaguggggagucugguagacaauucacacagaggcaguagcacaaugcacacacugggugugucugaugggcacucuccucuccuggaccaagcccugcuacaguucugaguagagaccacgggccuuccagcauaaugagcagacugcuaaagagcaugaggucacaacgaaggaauccuaagucaucacucaugugugaggucauacacaugcccuuccaaacaccaccagggcugacaaccucggcuaagcauacccaggagaaaaggcagacguuacaucccagaagccaggcaagcagguguuuccaacagcuacagcauggugucagaguuccaccaguccuggggccccuguggcauggacagagcuugcaagaugaacuugcgcauaucaaauacacagccugcccaggcagggccccuaccauuccuuacaugccgauacaaaccaaggcacuccaugccuggaccagccuucagugugcagaacagaaauguuauuguauugcucgaaauguugcucggucucucccguucuguuccucucagaucuuucguaaaauguauggccagaggcuagugaaccaagcucauagguuaagcauauuucucuggggggugggguggggaacagucucaaggacggaagacggauccacuucucguuuaugagcuauguuaaauauucguuucagaccuauaugccaacaccaacauucacauuuuuauuccuggccagagaacaccaagaacuaacaugccacgaaaauaauuagaauuuaguguaggcagacugugaggugaugccuggauucagcguuaucuugauaggccgugucucucuggcugaacagcaccugugcaggauagcauaaauauuuaagaacauuuauucuggauaugauuuguggcaccccugaggcaucuuccaccuguaauuacauccacagccuccgggaugaaggcucuaagucccuaaucagucucaacaccgagaacaguaugucucaggcuacaacaugaccacugucaacagcucacauaaggagaccuuaaugaugucgggcuccuucuccacgcagugggaauaccuuccuaggaaagugugcugggaauuacaucccggggucagcuuuauuggaguuuuggccucucuaacucauccuugcugaaggacaguuggcagauagcuugaugucaacagaaagcuuugguuugugcguggugucuucuguccagccuggcccacaugaaggacguucacagcagcugaagguggaggugaccacgcaggugcacacaacacagcaagaugccauguccagcuguccuaucccuggccuugggcagcacagccacucuucgugcuugcugcaggcucuucccagguucugggcaugcuaacuuucuuagcucucagugccaaucaccaccuucccgccccugcuuacacuaggucugugauuucccuaacaaagcacuauuuuuaacauauugggagacuaccuugucuuuuaagcuccacuauuacuuuaauuggguugcuuuuauuagagcccuagcuacaaaguccaaagacauggcauguucugccuggcccuguuuucucaugggccuuguuaguuuguuagaaugggaguagccuucggaugcagccuuguggugugcuguagcagauaucucuaugccugaaauggacgggcggagacaagaagcgaagcuggugucggucugauuuccuuuuccccaguguucugagugagucuugacuacacagggugguggagggcaaaggacauuccaaggcuggggaacaacaugugcacguuccuuggggaagaugcaaagucagggguguucuuguuaggugccuuuuaaauccuugacauuccaucaucgugggaaaauauuuuacagaacacucgguuagagcugaaaaggcaaggaggcuuuugaaaguggaaggauaacagagacgaggugguaggugaugggagagaaaaggguucugucccagagaccaaggagaguggagggacccaaggggauagacaugcagcugacucugucuugugagcuguaugugagguggcuccaaacuaaaggauuucuaucagaaguacccacuggccagacauggcaauagggaaaugggaggggugacagucuaagagaugaaggggacaaaaggaggugguuuucaaaaauugguccauggacaggcucagaaaaaauuucuagagaucaguagagugucuucgagucaugggugucugacugugacauccuggcugugcaagcauacaacaguacgcccaaggugccugcuguauauggaagauuucaaaaugguaccagcugugugucaagaugagcaagaggggcuuuuaggaccacuggcauaucugcuccccaagauguacugagggacaacagaaggaaccccaugccagcccugcuaugcuccuggaaacgcagguuugggagcaagggguuaaaggaaggugugcugugucuugcuuccacgcagauuaaaggaaacauucuugcuugaugagcauuuugagcucaggcauaagucagcucuuggaggcagguaagcaagacccuugcucagauuggaguuugcuuauagauucucacauacacccaaagugcaaugaaaauaaucuugauuugccuuagcaggugaccauguugccauagcaauuauaaagagcagguagcagaaugggcuuuaggaaguuagucaguaggaaugagaaaaucaaaggaagagcuggagagaugguucagcaguuaagagcacuugcugcucucacaaaggaucuugguucuguucccagcacccacacuaugcagcuuacaaccacaacauguagccccaggaagcaucugacaccccuggccucugugggcaccuacagucucauacacauaccccacacacagacacacacacauaaucaaaauugauaaaauaaauauuuuuaaagugaaucagugccuggcaucuuuaaucccugcaugugggagacaaugguaggcaaaucucuaugaguucaaggccaaccuggucuacauaaugagucccugucuuaaaacaaaaccaaacaaaaaacaagaaaacaaaggcaacagcauucagauuuuggaugccauguggggcuggagagauggcucagcaaucaagcaugcguacuguucuuacagaaaaccugaguuuaguucccaacacccaugauaggcagcucacaaccaccuggaacuccagcuccaggaaauccucuggccuccauuaacacuugcacucacaugcacacacaaacacacacacacacacaugaauacacauaaucaaggauaauaaagauuaagucauaacaaaaagguauuaguugcuagggaaggaaacccguggacugcagacauuuugugcugcagacagaacauccccucacgccaugacagcugucaccugcauuucugauguuuuccguggcuccgugcuggcccuuugccccguuccacccagcugaccacaccuguuuggucacugacuuuugccucuugacuccucccccacagccucuccccagggccguugccuggcuuugcuaaguuucaaccucuggaugggaugacucaagaugaggaaucucaaauccccacccugcacuuaaaccgcacagcaaaggagccccagcucauccugguagugaccccguugcucuccgaagcaaggggacccgugcuucuggauagcaggcuagagguggcuugucaagcuucucccugcccacagcaggagggcagugcgccaucuuaccuguuaaaggggagacgcacuugggcugguuuugccuccauuagggaagcuccuaaacaggaagcagccgaggccagaugagcaugcgugacaggaaaugccacguuccccucuccuccaucugcccaaggcccacuugucuccaccugcaguccaggcccacccacaccugagaucauccuagccuugggccagguguuuucugaggcagugucuggcucauaccuccuuggcugaaagcucagccuucauuccuacgucugcagccccaggcccacaagcuaggcugucugucugauguuaaugaccccagacuuggacagcaaagagucucuaagaagccaucagugcauccucagcuccugugggaugugggcgacuggccucaguuuggaguucagcaggguuagggcguucuccacccacugucagcagccccuacccacagucccugucugccauuccucacauucaagcccaccagcccaccucaggccgugaucagccaucauggaauuagugguguaagucgggaagcguucuggaaggcuccuucagcacccuuuucccagcacggcucucauguugccuugucagaagcagauugggucuagaaagcaccaucuuggaaugccucgguggcuauguagcuaaagcuugccuuaaacuccugacccuccugccucugccucccaaaaugggugucauuucccaaaacucagaugaggcauacaaaugugcugccguggggacagcaaggaggacacgugcuccacaggugcacaccuaggacaauucaagagcacccugcggccguaaccaucauccuggaaguucuuuagugcuccaucuuccugccucucuuguucuacagaacggccugaccucucccuucucugugagaccaccccacccauccaugaaugugcaagguaacaguggccaugccaccuucugcccaguuaucggucgccuaggugagcagauagagcacuccugcccaucaucagccuuucugccuagcuggcaacggucucaggaugcucuaaaguggcugcacucgauucgggugcccuggagaugcuuuuaaacaaaggcagugaguuggcuggaccucugggccgcccacugugugcgccacagagauuugcguuuccuuuccauauaccuugucuugcuaauaccauguuggaauuauuuccuuaauuucuaaagcugcaugugcggaaauggcuuauacuuccuguuuugauaaacuaauagaacuuuacagggagccuuguucccaaguuggcucuguccccuuagucggccuguugcuggauuaaagagaucuuuagaacgcccagcuugacuggacuugugacaaaacaaagacuuguauagauuacauugccugaaaauaggaaacauauuaccuuuggcaguaaggcuuaccucucaaguugcuagaauccguuauucaagacuccucugcagaggaaguugggguuggaugcugggggcgauguguggugggaucucuguaaguucccuucaaagcugcucuuuuuggcuggagguguacuggcuuaaaaauacuuccuuggacaagauguuucuuggaacauguggaggacaaaauauucuuuguuuuaggacagaugaguuuuguucuuggaucuucauauaaauuugaguaaucauuacuuuuuuuaaugcacaaaucaaaaacaauagccuguacuuuuuccccuuucaugaacauauagugugucagcuuuaaacgagacucacaucugcaggaaccugggugcguuucuguugauuuacgccgcccuuacuguacaugguuggucugcacaaguagcuagagaaauugucuugaggccuuuagaucacuuguggguuuuauuuuuggguauuaagagcaucuucaaugcccuggguguagaugccgguggaaggaaggaaggugcugaaugccucgcguggcacucgggacugaguagacccuauucaccaggcacggaggaaacucuuccugucugucuugugggacacggucccuggugaaggcgaugugauacucuugucuugucacugccaagaacugcuggaaggaccaggagccagcgccacucacugugggaccggaugugcucuuaaucuugcagcugcuagcacugaucucugccauacccugacacauuccauuuauagauggcagaaccagagagccagcagcuugaggcaugagaggcuccgauagagccugcaaggagccugggucaggaagcuagagccuggcuuuccuuacaacauguuaucacgucuggccuuccaggggccaacggcucacugacaacccaaagcauguauccagagugguguagggguauccaggauggacaugguaaagauacagggagucuuagauauuugcaaaaauaaugguggagagagagagagagagagagagagagagagagagagagagagagagagaugcuguccaguaccugcccauugcaccuagaaacuuacagacaagugcagugcagucaggauccuccacaaaaggccucuuaggccuucacuuugcugcuaaguggcuggguuauuccugugacuuccaaccaggcagcagugcuauguaccaauucaggguaggauagaacucagcccagagugaagagcccucaaaggaaguauuuaagaaagagaagaacugaaauucauuuguccagcaucaaagaccugggcuauagaacucucuuaauuuccgcagggaacaaggucagggucagagaggggacuaaggaggcauuuccuaggaaggauaaggcucagggucacuuggccauggaucccacugaaccuguaggagauccuucugcuucagugacagacccaccuguugaugaggucaggcaugcucaggugguacgcccacauguggaccuguuccuugauuaaccaaucacagcauucucuuuucacaaugucugcgugccugcgacuuggaaaugggaugaggugaggaggcagacuguggccguguuccugacuggcucuacaccggcacuccacacuuaggguaucagagcuacagagagcacaguugucauucagggaugaccuauuugggugacaaucccuaucucuagucuaucgucucuccucacguuucaccuaugaagccaccuccagauccucucuccucuaccucacccagcaucuuugccacugcgcugcuugacuuucugaggacuguggcguucugcuguucucucagcugcccacacaguccugcuccugggacauuugcaggauuucuccccaccccaugacuccugcaugccuaccccagacuuggcuuuacucccacauuaccagggcuccacaacacagcauauuuguccaagcugauggcaaggagacguuagugcccccuccccuccgcugauagccacagccagucuucugucuuguuugcagagcugaucuaguaggcaggguucggcaucucauauggcggaugauuggaugggcuagugugauuucuccaggaaggaguugaugauugacaucccuaguccuugcuauguuugguagcgugacccacagacagaugccagcaaggcagccugcauagggacagcauuuaggcaagucugagugagucugucaaguaugcuuuuacccaucaccuccuucccggcuuaguuuccagauacccucuuccucaaaacguuguaccacaauucaagcgauguccaucuaggcauugacuuauauacuuaagcagucaucucuacguauucacacacgauguaggcagggacuaugucuaacaugucucugcuuuaugccagagccuagcacacuacaucguccacaguaagcaguuagccgagggugagacaauggcuggcaugugcaagugagggacuucgugagugugaaugagagagaagagugugaaugggaaaugcaaguccacaagugagcgaggagugaaugaacuugucaagagaaagccaaugauuggccucagccacgcuugcagcauccagauaguuugcuuucagaguacuggauacccucucacaggacaacaagcccacgacacaggcuccuuacuggucccagaaucccgagggaggacaugugaggcuggugucucagggaaugagacuuucauggcaacuuuggggaucuucggugaaaugccaccuugggccgugaguucuuuuuacccugcaauugaugacaucccaaaagcagucuggccagcucagcugaauggaugugggcagcccacagcacccggugagguaaugggagccuccccauucuaggaacuucaucuuagcugcuauggccagguacuccuggggcccggguuuuaaccugugauuuuuguaaaaugagaaauauaaaaugcuuagagaggacucauaaggggaagcucacucuugagaggauagaaauaaaguccaggauggucuccaucacugagguggugagcaggcuccgcaggauggucaagggagaaggaaccaccauuuuuauuaaguacucggcaggaauuaggauugugauuuguccguggauagugccgagcaguggaaucaagaaucagacuccaaguguggagcgauggcucgugugugcugacagaguuccuuuuggaggcaggggacagaucuccagacacacggcccacaccaguuccccucuauccucacccacagucuugggaaggcauucacaucuugagaauguuccagagccccacauccugcugggagaaugcagucauucaguccagagacauguccggucucuaagaguccgacuggagcacaugcucugccccagugugucaauauuucuguuuguccuagagaccagacacuccaccugacuuccugagggcucuuguagaugcuggaauucauaagagagucccugcaggacaggugagauggcuggaagggcccauggcggaacuggacugaggaacuggacugacgucuaagcugccucccggugcuguuuggcccucaguucaggagacagagugcuccaacugauauugcuaguuucuacaauuaaauucagggacagccccaaccuccagacuaggaagccugucggaucaaauugaaaccuuuaaaaucauuucaacuauucauuuauauacagggacuuggcaaguugcucuaaaaucaaaauuaaaaauacccugugagucggcagcuggagaauaagagcauaggucuuucccuucucaauugaagccuucccgacacguucccaauaacuccugagugaauuguuggugaaugagaggcaacugccaagauaauugucuagcuggguuaugguuauaugacccauccaggcucgugccucagugcccagagucuuugacaaaacccacauuucaacuuguacuuuauuucuagaaauauuaucuucaaaaccuggacuagaugagccacagugugaaugugugcugaagacacacacacacacacacacacacauacacacauacacacacacauacacacacauacacacacacauacacacacacacacauacacacacacauacacacacauacacacacacacauacacacacauacacacacacauacacacacacauacacacacauacacacauacacacacauacacacacacacauacacacacacacauacacacacggucugauaaaagcauagauuccuauuucaaaggcacuaagguauuuuuauauauguuuacucuuacaccaugggccuccugcuguuuuauuaacucaagaaagagcucugagagaacugcuucuuaaaagaucugagaaugcugggcuuuuuuaaaauccaucagacaguagauuagguagagaaucaucauggggcuccaacuacagggcaguggggugagaucgcuggaggaaaugucuguacaaaaaaagcccgaaggcucgcagauccccaagaugaacugcggccagauggugcugagucagaugucgguggcggccugcauacccaaggcugcuuguggauggauccugggcucugcaagucauguaaaacaggagaagguccauagcaacacgguuggcaucuccacaggaacacaacgggcuccugugcgucuccccgaguccuuccacuucguuuuugaggcuuaacccagaaugaaaacucugcauuaggacuggugagaugggcucaucagggaaaggacuugcuaccgaaccugaugaccugaguucgaucccuggaacccacaugauuccaaagagagagagagccagaucccagagcuguucaccgaccucuccauaggcaccaccagcaaaauacacaugugcucaaaaauauaaaaguaaagaaggcaguuuuaauucugugguuaaaagcuuuaugacguuagagggguacugucaucuucugggccccgcuugcagaaagcuuggcugagugaaugucagaagcaaacaauaucuacguacacugccuuagucguaacugccaacagccugggcucugugagcuggacggcagcagacuguggccaagaugggacagacugagucucugcgcuuacaugcucucucgcucuagcacggggaagggcuguccuaaccugucugugggguaucauggggaccacagcuggugcuugacuuagguaagaagaggagaaagaucuucauaaggauacuuaauuuucaguguccugugggcauagucugagagagaaaguccagcccucccagcccaaccccagccgcacuccagccccacuccuggccacuugauccaggcucuccauucuuucaucagaaauguugggauagggacaaggaagccagaaaauccccugccccagggcccuagagacucaagaagcuaccccagcuuaccaacccaccauuuaggaaaggcucauuccucaguuuacccuucucaccacaaagagcauggguguuaggggaagaaaaauggggguggacuuuccugaugaugcgucuacccgaguugcagugcuauuggggguaucaugcugacagguguauuuccgaggccugucuccucacaagcaucuccuuuugccauuccaugguaggaaccagaguggucacaccaaccccucccaccauggcucacuugccuucaaaucuccaggucacugagaaucucccuccuagacucugcaauugcauuccccugagcaucccuggguuugaggaauguuuccucugguccuugcguuuaggcuucugguucagcaucuggagucagugauccucccaaggcuguggccggcagaauguguugugccagcaucaaacuuuugucucacucagggucacaagcaugccacagugguguccaguauggacaacagugagacagcacaugccugggacagcacagugguggggacucuguaucuacaucugugcuaagaggggcccguggaccauuuugcaugaaggcuugauguuagaguaaggacauacacagagggauaugaugacacucuuaaacuugucuugugucuuguuucuacagggugugaagaaguuggaugugcccugcggagggagagacugcaguggggguugccagugcuacccggagaaaggagcaaggguaagucaagcuguguaaaauaauguuucuugaagcuguuugaaagugccuuaaacugaccgggcggaccacucuuuaugaugauacaauauagcuaauucccuuucaccuugcaauaagucacaaaaugggcuccagucgaaccacugcccuauuucucauggugauggauacacacaaacucaaauguagccacagggacuuggcuccagagaccccuagguaccaaagccugagaauacucaaguuccuuauauaguccagccccaaggugugcuuguccucugauguguucauucucaggguuacuugcaacaaugugucuaaaugugagacauuugcaggguauauuguaauguuuagggaaggaugguaagagaacacugcugugcugugaggacagaagguuguuuuugaagauuaauuguguauguguuaauacagagauguucuagacucgugauuuacgugggcaaauauuuuauaaagaaacuuacauuauauaaagcagaacauggcugccccagugaugcagcaugggugugugcaaacuugagagcuuugggaauuguuccgugaacaagaaucccaaaguugaagucacuuguaccuugagugugcuugaugagggucacuuccuagacaaguaagagaaggucaccugagcuaucaccauggcacccgaguggucgccauggcuuccaguaggcagugaguuuaccauuuccuucagucuucgggugauugcuuuugcucuauugcccuuaaaacugguguuuccguuucaggguuacuuuuuuacauuuucguuugcuuuuauaguauguguuugaauauuuacaugcauguaugcaugugugcuaucugugugccaugcucacagguggccagaagagggcaucacaucccccagaacugggguuaaauguggcugugagccaccacaugagugcuggaacugaacuguguccucuguaaaaacagcacauucucuuuauggcugagccaucuugccagaaagaugaacuuucugguacacacaauacacuaaugcuucuuuuuuaaaagguaugugugaauccuauucaucauuaagcaauguguauuuuuugacaauauuauauuugucuacaauguucugugaccacacucaccccuccccucccucacccccacucccacauuuucccuccuccuuuuucucaaccaguuccccucccacccuccucucucucccucucucucucucucuuucuuccugucugccuuuugcagauacuauauaggcuuauuauuguaugaaccauaaauguuuaaauuaguagucucagcauugggcauuuuauuauauuauagacugaaaacaaaaguuuacucuugcucuguuuucagacauguuuaacacgugauggauuuuuuaaauaaauuuagacucuccaacaguuaauguaacccagacuauuaacuauuucuucaagucguauaagaugcaauuaaaccauuuuucauuuuauaaaggagguagucuuuuccccgggguagauggagcucaguaugugaucauaagcuuagcauccucaaggucaggaccuaggcuuggccccuaggccaguuugcaugugugggguuguggagaguaguguuccacacagggccacccuugccugcuacaucucucuuucugggaccacacccugccugccucaccuuugccucaccaaagcagcuguucagcaaccgugugugcgugaugcuugucucgcagcugugaaucaccauggcucuugaggcuccagugagcuucacccaggucugucuguccccaucagcauuuagagcagcuguucccacuccuccucugcagcacagcccuugugguugagguccacacacauuccauauugcaucuccacaccccccuccucaaaguccugcaggagcucuugaugaccagggccuucuguucagaugugaaggucuuugaugacuuggcugacugaagacuguguuaacgucagagaucacaggugugcaugaggagccccaguucugagagcagagauccuaaguuuaagguuucucaacuggcacugaggcccuuuggggacuauuagcuggagaucauuugucaacacuuuaaaaggacagacauauauaguauaaauaauguuuuacuuauuuauuuuugcacagcuuuuuuuauuauuauuauuuaauuuguuuauuuugagauagagucucacugugucuuccuggcuggccggaaauucucuauguagaucaggauggucuugaacucauaaagguuuuccugccacuaccucuugaguacuaggguuaaagguguguacaccaucacucgcagccucauuucuugauauuuaaaaucuccuuggucccuugcuauagauuuuaccaagggugagaugguuugugagugauggggguguccgaccucacacacugcuccccgggccaggaacaggcucucuaagcucugacugacacagccuccuuauauggacacaaagcagaucaauuggugcugugcagauaucuccagaaccaggcaaaggagaugguuagaccccggaggaugcugcauucugccuccugagauaagcuggacaagagcccaaggaacaguuccugcuuggcaugccgaacgggcuaugauuacccagagcagagccuacagaugagagguuugcgggaugucucucugaggguguucuucccccuaaaggccacucaugcugucugaacagacucgucugcagggcagugugcgcucacaugccauacaguaucuucuuagagguuccaggaaggagcugucaagggccucaucauuucccagugucccucccgaaguaaacaccuggcucugguuuagccguggccacauaaaauaggaagcuaacucuucucuucaccugaccagucuggucaucagagcuuagccuaguguggcuuacuucucaucauuaggcagaaugucaagacagaggcagugacacccaacgugggacuucaccuuaguggcguccucucaauaugcccaugcucacugggccagccacacagcagggcacacucccaugauucaaucucauccuugcaccugugagaggacagaaagauaccaugaggaugcaggcucagucaucacacgacaugcuaauccaaguagagcacacuauaugcugcaggguacgacagagcuggcagggagacucauguugacacugguguuuuucugaaggugucacuggacauuuuaucaaagguauuuucuuccccuggccaacuauguguguuaaucucaaacaaggaugaagauaucgaauccguuuccagguacaugcacgcagaaaggauuuguagcauauucacccacacguguuucugcagaaagcagggcuacuucugaacugcucuuaguucuauaauguuuuucuuaaauaaugcuauuauaaaaauaguggcagggcggagccugacuccagggagccugugcauggugaguucuuucccacagcuuccccuggggucacuuaccauauauuuucccccacggugcugcuguagcugccacgcagccucccugcaggcugugugcucugcuaacucagccuuauauggacaagguacccuuguuacuguguucucuccauggugacagccaacagcagaaacucugucacuggauaacuuuuggacuccgaggagaaaucacaaaugcacugugguccaguuccaagagaaugcucaaguuacagagugagugggucuguguaaaauccauagagcacaauucuccaccccgugugcugagcugcagggauuggggguggggguggggggucacugcaucccaccagucucuagaaaauuccugugaggcacaggacuggagcaggaagaggcgggacuguagcagggcucucugucccccucacucccugcucagaccaggagcaucgaagcaggaggcuaaccuuccucuucuggugaauuacgacacacauaguucuaacagaugguugaagaccuccuaaccugcccuuucuuauauacacugugaagccagcaggcagcccaguggaaaacaugcagugaauuccaccacagaaauguccaaagccagggcaacaugaucuaacagguuaauaaacagaaaacagagagggacagcugagcuccauaacucuccaagguuggucaagagcaugguucccaaucccccuagugcugugagcauuuaauaccuuuccucagguaguggggaccccugucuuagucaggguuucuauuccugaacaaaacaccaugaccaagaagcaaguuggggaggaaaagguuuauucagcuuacacuuccacauugcuguucaucaccaagggaagucaggacuggaacucaagcaggucaggaaguaggagcugaugcagaggccauggagggauguuacuuacuggcuugcuuccccuggcuugcucagcuuguuuucuuauagagcccagggauggcaccacccacaaugagcccucccacccuugaucacuaauugagaaaaugccccacagcuggaucucaucgaggcauuuccucaagggaggcuccuuucucugugauaacuacagcuugugucaaguugacacacaaaaccagccaguacagccccaaccauaaaaucauuuucaucgcuucuuauuaacuauuugcuacuguuaugaaucauaaguauguuuggagauagcgguuugccaaggaggucacgacccauggguuaauaaccagugaguuugauuuuaguuuuuuggguuuuuuuuuggggggggguuguuaguuuuuuguuuuugguuuuugguuuuuucaguuaguuagccaugauccucuaucauguaauguuugaccaugaauucugguuaaguccauugccuccauuauuuuuuuuuuuaauuuuuaaaaugucaucauugcgugugcaugaugugggugccucaagucaacgaggaaggcuuagcugcugcauuuuauauucuaagacucacccaccccacccugggucucugaucugggagacaaagaguucucauccucccaggauuccuuaaaucuaacaauguaaaccaaagugaaagaaaccaggaaaaauaguagguacgguggcugaccuugguagugccuauugaaucccacagaguaaaguagaucaccauugugaguucgaagccagccuagccuguguacugaguuccaggccagccagggcugcacagugggagucucuuuaaaaagaagaagcauaguagggaggaaugacuugucacugagucuuugccauugaccgugaggaacagagacucugagauggaaaaaacaaaccuagaucaggaacagaaagaacagaggccacagcagcuaagagcagccagccauugacagggucuucucucuaagaaagugcgcuguggcuaugcccucuucacugauagguugguguggguggcacagccacgccauacacccaauagaagucaccugcaauguuucagacagucaccacaggaaagggcaaaaaaaucauucauagauagcaaacacacaagcuagcuuccaggucccuaugaaguacgagggcuacagcuuggcaaccugaggguuucauggggacagauauggaucagggccaugugcccucaaagcgcauauggugcuggacuuugaaacauccccagcuuccucugcauauggggaucuacacuccagcaccacaggaccccacuccagcagcuacaagcaaggccuucaucugugagcagcagaagguguccccaaagacaaagggugcuucgugcguuucaaggacaaagugggguugcccacaggggaccugagagugugaggguugggaaaauuaaguuggaaagagaagaggaaaggcuucaugagcccggaggacgucugcaggggacgucuaggaagcuuccuugagggcauugcuuaacugaaccagggucacaguccgugaagggaagcugacuggggcuagcacuuuaggcuccguucaaauaugggucucauuugaaucuaagaaaaugcugugaaggaccuaaaaccuggcucccacacaggaaugggcuacaggcagcaguaagugaccaccaugggaguggguuacaggcagcgcguuugucaggcagcaccaaggaacccaaaccacccaagcguaccaagcagucugaggcucuguguucauauuccugaaaugugugcacuuaaaaagaguuuccuucuaacguguuugaucagcagugacugaguacugaaacaugauauugagcaggcgagacagacguuagaucuuaccuuaauugauaaacucaagugaaggaguugggccagcccagggcacagugucccaggggucaguuguguccuuaaggucaggucuggugaggagaggcuggagggaggaacaaagggagaaggaaagagaaugaacucuuagucaauguguaagaauauccuagauaguguaucccagggaaacauggaacaauagaaaaccaggguucccuggacauucgaccaggauuugugaccuauucagcucagaucuuuaccaauaagaucugaucucaaaaguaaauaagccgaggcccagcuguguuaggccacugacugaugagcucucagucuucccacagaaggaguuccugggagguuggagggggcgaggggggucaccuagcucucugccucucuccaaggccucuaagaggcuccaugugucucucuggugagaucucugccugucugucugguaguuuauauccuggggacuuuggggauccaacugccucccacacacaggaacucuucauuugagcaagagggacugugagcagcuguggaaaugaguuaaucuuucugcaagggaauccccuccacucuauccuaguguggcaauaguuaauaugucagaaaacgaugggaauauuauucaggguuugauacccaaaaacaggccaguauggccaucuguauaaaaggaaaaaaauauagccugucaugauggcauauaccugugaccccagaggcaggaagagcggguccucaaaggcagccugggcuacagaaagaaaaaaaaauugcuaaaagacaaguuuugacacagguucacugaacagaggcacagagcaucgcuguagcuagaacaccaugguuggcggauggugugcuuagaacuggguggggcugaggagcaacacaugccugguacacucaagcuccaugguucggucaccagcacccucccugcacacacacacacacacacacacacacacacacacacacacacugcacacacacacugugcacaugcacacacacugcacacacacacacacugcgcacauacacacacugugcucacacugcacacacacacucgagagggaaaaugcauuuccaucaucugaaaccaucauccccuuuaccugaacuuaccuaagccuuacucuagguuuguucuuaucagcaaaaggcauuauuaaaucaugagaaauggggaaaucuuuggugcagguuuggccuuaacaggagucauucacuuccuggcugucuacuguaacagcuaagccagggcacaauaaaauccaacuaaguggccacacaggacagagacacagccaugcgcaguggcacucugauacagugggggcuguccccaggaacugcagugcuuagauauguuuuuuauccucgucccuucagaugagcucuguacacucauacgcccugacaguacacuggcagccucugacagauucccucauaguuaaacaucuugacuccugaaauuacuaaaggaggcagcugcuucagaaccgccucuuagaauccuuccuggauccccucccuggagaucagaaagagccacugucucccgagccacagaugcccucuggaccguugaacugacaucagaacaagccaacccuagagaaggaaucuucuagcucagaggaggcaacgaagggaaaaaauuaacccuuucagugccugguuccugguggcagauguuuucugaaaaacaggauagaaaguugcagccaugguuuggaaguucggcagcacagacagccagagaaggcccaucugagaguucuuaucacuccuccauaggaagucaacauccauaugguccacugacuaagaaaggcagcugggggccagccggucuucaccgguucccacaggccacugauuaccgaagcuaaaggaaacuucuuguaaaccagacaggggcucuggccgcggacggcuucccuuucccaccucugcauggaauguuuugacaaguugggcauuaaagcauuuuuucucccaugggcauucaagcauuuuccccucucugugagagaaggcgcgcugcugucggggccuuuguuucucuucuacacuaguucacgcuuaacaauuacgggaucucuaaaagggccaaaguugugagaaaguguugugugggguuacaagaaacuuguguggcuuuaucucccucagggggcaacugggaccacugggucucuguauggaaggggugacgcaguuugucugacaguccagcuggucacaaaggcccuucagaguuagucugugcaagguucuauacaagcauccuugcaggcuggcucugaccggugacugcaggagugaagagaauguaacagagucuguacaguuaccaagcuacucuccucauuuuauuuuagacauaauuaaaacaauaaccagaggagaauauggcagaaaugacccaccacacaacucuaugccuucuucucccagggacccuuuaacuggcucuuucugugcauguaugcaauggauucugggguuaaaggucccugcuccaguuucuccaucucugcugcaacaagaacugcucucuucaauauucaaaggaaagaagccacauccaucuuguguuucugucauuggcaucagggcaaauacuaaauuaauuuaucauugacagcccugggaaucucagaacuguccuuagaagcuggccagccuguggcccugagcaguuuacccuucuggcauccccgagcucuuugugguggugaggacaagugaccauucaaguggccagaugucugacucauaugggaagcacaaagcggccuuccaaaugccacauguccccacugauuagagagaucaaaauaucccgaguccagcccagacagacacugauguucuagaagaagagaugcaggaacagcgucucgaaaugcugcgccagacgagcauuaauuggccagucuccccuuaacacauagacggcagaaaaagacgcauucacuagaggacaaacauuuacauuucccaaguacuuucuggaagguuugggaccacaauagaaaaagaaagagagaagcaagggaguggaaacaauuagcguagagugggugagguaugcggcucucuggcuccccugacccccucagcauuggguuuuacugcacuguugucuuugggaggcacagaacugaucuucaacccuaaggccuguuuuaaauaaagaagcagaugguuugagguuggguucuccauaauaaauacugaagaacacuggaaggcccagacuccuugugggaauaacugcauuuaaaaagaugcauguuaugugcgugacauucuuguggcuccugauaacaacugucugagaacuuuagauuagauccgugugccacagccaaacaggccucucuuggguuuggugaaagugccugugugugccuucagcaccagcgauaccuguuggguuggcauaaaauccauucagaaaaaggcuguucucuuuuguauguccuguuuuaggcuucucauugcagcccagcccacagaaucagcagaucuuauuuaucagugagaauacagcagucccaaagggcaagccgcgugaaccccugggugucuacugugugccccaagcuguauguaccauagccagcuuacaagaaaggagcaugcaugccauuaaucucagcccuuaggaggcagagacaagcauaucucugugaauuuaaggcuugucuggucuccugcucuauguaguuacagaacagccauggcuacuucuccucucuggagaaagaggaggaggaggaggaggagagacagagacagagacacagagacaaacacagacagacagacacagucaugaagcaugugcagaagccaaccuuccuaacauuuuacaaauacucccacuucucugcgcacagugaagaaauuacuaguguagaccaucaacagggcacccagcugcauccuaagaaagagaagaagaaagcucagagucugagggaugcucauuuguuccuagauggcuccagagauggaaaucugacagacuuuccugguaaccuaggaggaaagggaaaagcagaauaacuucauaagcuuucaaagugagaucccggcagaacccaggggggaaagguguugcguguuccuggucuacauagagaguaccaggacagccaaggcuacauaagauacccugucacaucaccacaaaacaugacagcucguaaaugcugggcucaaaagccucuuggcugcaggauugagcucuucugugggacugucacucaacauggaguccccacaugaaagcucacagcuucacucaaaaaaauaaaccuuccaaggaugaggugggcacggcucagugcaacaagggcugcuggcugugcaugaaggcuuagguagggcucauucccaacaccaccggcuagagggagaaacccaagggcagccaugcauuagcaggagaagcaggcucuuugauucucuugucaguuucuauuucucucuagauacucucuccucuagccauggcucucgagcuugucugcccuccauucugagacccugaucaucagauucaguucucuucagcaucugcugccucagcaguagggagacggacagacaaacagacagaguagaguagggcaaaccucucccugaagaccagaaccaugcuucagaaacucugcuuuaauuucucaccacccugaccaaauaugcucauauauuucuaccaagauagccagaugugagggugcacgccuuuaaucucagccuucaggaaacagaggcagaugaauuccaggccagcugaggcuacagaguaagacccagucucguaaauggguagauagauagauagauagauagauagauagauagauagauagauagauagauggauggauggauggauggauggauagauagauagauagauagauagauagauagauagauagaucaaucugccaaaacagacuuucucuauaagauuuuucuccuuuuggucuucuacuguggcaguugccuuugaaccucagucuaggaugauccuaagcccuguugaauuauuaaaaaguguaacugcaguggcugguaaggaaacgaguuggggagguguucuucuccccuuagugcucucucucucucucucucucucucucucucucucucucucucucucucuguguguguguguguguguuugugugugugugugugugcgugcaugcaugccugccuacccaucucuuucuguaauucugucuaucucucucaucucaaucugacccaauucaaacacagacaucccaugaacauggccauggacaaagaaggauguuucuaaaugugaauugccacugguauuuugggggcuuuauuuugaggcuagcauugguagacaggguauguggcugucugcauacccucaaggagaaccaggaaacaaagaaauaaacagaaaggacuuugugggugaaaauggccuccccagugcagaaaaugaaaacgacuucuuugguagagagaaauaugacuuaauaaaaaggguucccuucagaaaugucaguuaucuuggaaggagagaugagucaugggaaaagccaaagccaauggcagagcugaauaaguugucuuuugacauugacauuuacgggggacaagaccuauccucaugaccaagagucccucccagcagcugcgagauaggaagggacucucuggcugccaccaugcuuccuauaacuaagacaugugcugcagccagcaugcccaguacuguagcuagcgucugcaugcugugcaugugugcaugcaggcauuuacauacaucgugcauuaaagcauauacucugucuuuccugaucaacagcuuaccaucauagaaaauccuuuuauuggcuaguguugcacacuaugggaguuguauuauuuuuagcacuugucugaaacuuuaaaaagaggcacaguguguacuuauuuaauguccugagaggcucuuugaauacacuguugccuuuuaaaguucaucccaugucugugucagacccggaguagcuuacugacugcuguuucccagcucguccugccucugccugagcuucuccugccacagccacaggcacugagaugggaccuccagacgcacugagacuuugcugccuguggucugagauuggcuguacccugagaugacucuucaguugucaccaugucccuuccugaucccuguuugcucuuggcauugaaccacaugaacuccagacuuauuuggggagucugcucacagaugggaaagugggccagcaaagccaaaauuaaauucuacccuaggggagccgcacauacaguccuccucuguuuggcucucuacugcccuccaaucccacuccagggguuccaacuauuuucaccucaguucgcagaugcugauacuguaaaugaaucauggacuccuuuauuuaauacucuuauuaaaucaacagugaccauugaccucacuguacccaacacacccucaggcucaggguccccucucagagguggguccuuugaacaaggggccuuaugaccucgaaugggaguggaauaggcacaaaggcuugcccagaguccuucagcauaauuuuuuuaaugguaaauuuugucugugaagaccuaggcagacucccuguccuuccuucaagugacuucugagcagggcacaguggaauguggaaaugaaaaggccaguccugcauagcuggguucacugacauccuauucuuucaaccaaagcuagcaguauuguccuguugucugaaauuuaaaccuuuuauuguuuguuuaucucugugauuauuuuuaacacauguuguuugcagaagauggcuuuuucuugucuauaaaaaucuuaucucauuuugccaaagaaagauaaccuauaaagauaaaucuuccaauuuaaacaguggcuauaaugagagguuuuguuuucuuuuaaacaaugcuguauucaaaucccaucuuguggccacuacaguaaagagugcauuauuuuuaacagucaucugaaaaaacaauuagugucuuguuccacuuuugaggugaacaugagcaaguguuuccuguaccuucuuggcagguuuggcuauuugucucuuguuugugucuggguuucccgucuucguguucacaauaguguugugggaagccauuguucugacucacagcaucucauuuccaaaauucagauggguccugacguacgugagcuacaguggaauauuuauuccauuucuuacuauccauacgguuuagcaacuaaaaguuuauuuuuuaccacaucaccuuucuccgggguagggugucccuuaccuguguguuuguuugguugguugguugguugguugguugguugguuuuucaauuaaaaaagaaguauaaugacuuggucaugaguuuuccaagccuaggauauuacucauuugggguacccauuucacauuaauaacacauucgggcuucagaauccucagagugacuuggauccucaaagucggggucccccuucuuccggucuccugaaagauacccaguacgaggcagcacaucugcgaggugggacggugucaguauccacuuucuuucccuccgagaaccucagugcucaucagacacgguguacaucuucaagagugaacuuccccgugccuggcuagaguaucuccucucaagcucuuuggggaguggaauauuggacuacaauucuucgaaaaggaaaaucaaaauaccucagagagcauugcucacagaacagucaacuguuccucggccuguacucaguaggaaacccagggacauagaguuugagcugagcgcugugcuuucuccucugcauugggcucagccacaugcacagggucucccugggcuaagcagcccggccugccgagacucagcucucaaguguuaugacacacaugugcuguaaacgccugugucuucaugcuuaagaacucuacgagucuuaccucugugagagagagcucauccugucuucacgccugucugugcaugugccagucggugcccuccugccucugcacuuuccucacccucuuacuugguggcacaugugccagaguggaacaccacuugacuuuacccuugcaugaaucccugcuugcccaggcccuaagaaucccagagaacccaggaagucugcaacuugccguauccgaccaagcugaaaccguaccacaccaaucaccagcgcaccguguuugcuuugagugcuuggugugaauuacggggaggagaaggcggcaugccccucguuacuauggcgaugccagggcuuauugggggugcuuugugucugagaaacuccgauggaucuugugaaguaguccccguuucaguuuugaggaaauuaaaugaaguaaguugcccagaaucacauaauuggagaauccaggaccaaaacuugaacugagauccagugcuggccccaaugagcauccuuggauaucugagccgaucuuacauacuugaaacuuagugguccaaaguuguuccugcagccuuaaccucauuucuccaugggugguuucuuuuccuaaacaaagugucugagccagggaggagaagguucuguagauugguucuccagucuccccacccccagugugcacuucucuugccucuuggagacagcgcuaugguagaaauuacagucauccggcuccuggcuugcucagagcgucaccugagugugcaccaggaggcuucugcaaauauggccagcgcucccuccgagucccuugacaccaugauuucccuaacuccuucuuuccugcaguccagcccugcacacugcaccccacccccgcuccuaaccuuagccccauuacgccaccaccgucucaugaaaccuucccucugagagcauuccugagcucaagaacacccugaccgcccuggaaggcucucaagccuccuccucuaagccaagggugguacccgcagcucugccaggagcucuucugugggggcuguggguccaggaagucauucuugcagccccugguucucucaggccuccccguacccaaggggggguggggggagacgucccacagcaggccaaugugcaugugugcugcagaguuugcccuacaguuggacaccaguuugccauccggggcugaaaauuacacucgcugugaggaaguucaucucggagucuaguuccugcuccgacauacagaugcccgggcacucagcacacaggcgcacccuucuccuucagguucucccucuguaaaacggggcagcaugcccacagccgcuaccgugaggcuccucccucucccucaccccauccccacccccgaccccaucuugucauaaaaccugggauacaguuaaacuacaaugcauagggugaccccccacccccccaaggcagagcugaccuaaaggacuggucucccggccaucucuagcaaaauuccuuuucuuccaucuugccaauuucuuccauucaucaguguuugcugucagguacugugccucagauguagaagccagggccagggcaggguagcacuagcaacuuucccaccauguggcccucuucccacuccguagcucagaaauggacuuaagaauguccaugauagugcaugcaaacaaacucuguccuacaacacugggguccagggcuggcccccuuccggucuccagaggcauuugccaugggcuacuuggucucuccuucaucccugagauggugguacugaaagaacacuaucuuggagucuacuacacuaucuugcaugaaauagcucucccgugggagcggggcagagguagcccuguggggacacagcauccuccuccuccuccuccucuuccuccucccuguuaccccagugggugcaagagccagagcuaacucugccugccuuccugcuccaggauggacccuucugagcugucuccaaccaucaggcaguuuccuuggccaccaccaggaugacagauagagaccccuucacgaguucugcacauaccaacccaucucuucaagaacaguccauccaagacuuuagcccagcuagaccagaccugugucugguaagagcugcucagucccaggaagucuccaaccaggggcagguuuucaaagaaacccuuuggaaugcuuuugucuugaaggagaagcugaaaggggccgcaggucuuuuccacucccacgcccacacagcguuuuaccaggcauuucguauuuaauaggaagauuucuuuuuuaagaaaccuccccugugccauugacuaaucuacaguaaugaugaccaccuguacaagugacuccaguuuuuaaauuaaagaguaacaccuugaauaugcuccgagcuauaccuccaugagcuaacuaacucauuggaaucuccgguucccuuagagguaaucuaggaauugguuggcuucuaucaaaguuggcagcuccuuacuugcaguauuagacaacaggaggugaaaagacuccccaaagaccucauugucucuuaaaaccaagaaauccuggugcccccucuuccucuacaccccgccccaagcacagugacccaacccaaccacagccaguucaugcacacacaucuggauaacuguguuuccucagaaauguugaaacuuuuaaaaauuaaacaaauccuacagagaaacaauuguuaaauccguuguucaagggccucugguaugagcgcgugcuucguggcuccugccacaggaagggauugucccagcaaugcacaggaauggugucacagccucgggcacagagaugugagucucagauaagcaccuucuuaaugcuucugggauuuggguugaggaaugcuccggguagaguagaggccaagcuugcacacugucggggucaucugccucacuuccaggcagugacagauaaaacguucaucguauaaagcacacugcuaggcucaccccgacaucuuaucauugauugauugugguagauuuuauacugucaccucuucgugggcuuuauuuuucuuucuaagggcucgaugcaucgaucgcuuccuucaaagggacacuuuugcuuuggggcugcuauggucacauugccuggcuuccccagggcucaguccucagaugagaaaacagaagcagugugguggucuagaaggauuugcguucaucagcuccuacucagagccaaggugcuuccuuccacaacgaagccuuuccugaauccccaaggucuucacacaggugcucugggacacuggaggaccuuuuuuucugaaaacagcuauaacauggcuuuagcaucuugcuggugagccaaauggaauaaauucuuuccacggcacauauaaagacuuaaggaggagaagcgagacuugaaguuugcacagaacaaugugcaccggucuuccgccugcuuccccagagagagcucugaaucacagccuugcugaugaguaaguacagaagcaggugcuguggacaacaggcgugagucaccuuccuccuuagauacuugacaaacauacccgcuuuauuuauggaaagucuucacaguugcuucacaaauuacucaaagugugcaugcuaacguguguguacaagguacgaaaagugugucacaccagguaaagaggaguaaaggcaucaggagauaccacucugacaacugugcugaagggcucucuuaaauagauaugguaauagcaaggaguuuuaccaggagagauugacagcacacacacacacacacacacacacaucucuugauuaauacucagucauaagagguugucauuuauggccaguccagugucuauaguagaaacugugugcacaaguucuacuaaugcucuuaacucaccucagcauuaggaucccagucaaaagccaggcaugguggcacacacauucagucauagcgcuuaggaggcacagacaggauuuuuguaaguucaagaccagccuggucuacauagcauuuucaaggauacauaguaagacccuaucucaauaaaguguguguguguguguguguguguguguguggagagagagagaauuuggcaaaacaaaauuuuaaacuuacauuauaaagaccacuuuagaggggccacacuaagaauagcccguuuauuuuuuucaaaugcuuagaaagaaaggugcccaaguccacagugggauucuugugguggugucuggacugacugggaugggugcagugggggagcacuauuuuccuguugcuugguugaguuagucauaagcaaccuucuucacauggcccuugggagcccagaggaagagagggaaaggagcugcauuuagugguuccagaaagugcuguuagacaaaccauauucuuuaggagucugcauuuggaaacuuuguauccauuugacaaagguucaucugcuauagugcacuuguggcguugacggcaggcuuccuggguuugucucaagucaaaaagagauuuacuucauuugaauauucagauuggacaagguuauguauacacaguaagccaaaaaauuaauacggcaagacaaucgaugacuuucgucuccccucauuuaaaccgaugaacucgggcaccaagaaagucacucaauuuaaggaccugccccacugugaagaguauaaauucuguccuuuuuacucuauacaggaaauauguccaaacaaaguuaaugggucugugaucaucccaugucagaagagagaucagaccugcccauaaaggaacaaagaugccagucuuuauacacacuagguagcaaucuuaaguagacuacaggaggacuauguagaagaaagucuggagagaaaguucuaccaacagcuacugucuugacaguucaacaaggauuuugaugcccuguuaaaguaagguggacucuagagucuuccuucucucuucaguucugugaugucacguguaugccacacgugugccagagccaucgcucaguggugugagaagcccagaaguucagauaaugcucagucguguuagggaauuuccaacgaauuggcuucuuagaagacacacuuggaugugucugccagugugagcauguuccaacaggaagagaaucauagcugauaaaaauaaaaacaaaacccucacacacaacccacucagccauucacagccaugucaucaaacccuuuagggguauugaucucucuguuaucugcaaauauaagggaagcguguuccccgugggaucagcaugcggauuagaaauagaguuugucagacagcuaguaagucaugagcugcaggggacagagagggccuguugcugccccaugcuauuaauagcuauaagagcuauuaucgccauucguugcaucggccuguccuuauguucuguauuagcucucagacccagugagcaucguuguguaagcaucuucacaggaaggaagguccuggucugugauacacacaucucacucaucacaggaagccggcccucugugcggccuucuggguccagggcuucuacgaaggguucugcuaaaggugcagaagcgaggagguuggauguucccugggaaagaccuuugcccagaaaacuuacuugaauggaccaucucaauacccaaacacaccaagugugccacuauagcuggccuuuguaugucaugaggaaaagccucucagacauccagaaaguccugagcuggaugaggucaugugacuggaauuccggagucgggcugacagaaacccaccagcuucagccgacugucagagugggagaucuuucuccacacaggugggcagcaccaccacaggaaaaccaccuacuaaccacauuggccgcuggccugcagcaucccccaccgaccugggcaguugccugccuggcugcugguggcaccgaauugggaaggagcacacguggcccaacccugacagagcccugagcucuuuucuaaguuuagaaggcuucggagacuuuuugguuuggguuguucuaaauucacgucagccugggagacucagaagccaacacugaagccaaaugagcagucuuuccuggcggggacacaagaccccggauugaagucaggcaucugaggcuucucccucccugggggcagcaacguacagcagccccccucccccacauuccacccccuccuggcacccucagagggcucugcggagcacuagcuggucaccuaguucugacuuuguccugcaccgugcucaaggcccuuugggucuguuaagaagugauguugucacagcauuaagggugugagccuuugcuguugcucgccugccuuccaacaacaaccccaggguugugugcaaaauccaccaauuguaugagcagaaauagucuuccuaguaucccuaagucaugauuauauuuaagaaaauccaggggcuaguaagauagcucagugguuaaagagcacugacuucucuuccaaagguccugaguucgauucccagcaaccgcaugguggcucacaaccaucuucaauguguucugaugcccucuuaugguaugucugaagacaacuacaguguacucauguacauaaaauaaauaaauagaucaagaaagaaagaaagauaaaauaaauaaauagaucaagaaagaaagaaagaaagaaaggaaggaagaaaggaagaaagaaagaaagaaagaaagaaagaaagaaagaaaggaaggaagaaagagaaagaaagaaagaaagaaagaaagaaagaaagaaagaaagaaagaaagaaagaaagaaaguuaguucagugcuaccuuuacaauauaacaccaaaaauccccaaggagagaacucagggccgaggcuugauuugaacagaaucccuaagaguauaccucaguggccaaagauaaacuguuauguucuuauuuauaugccccccugaaacccuagacagcucauaauagcucggcacugccccugggcagagagagucccaggcccugccugcaucugucuccuccaggaggcuccgccggguguggcucccacugcagacaccacuacuggaaaagggaagguuucugggcuucuggcacugccuccuccccucugcccgaaauccaagauuuauuuuuacccauugaaugagaaagagagcaaguccugugauccaucacauucggcgcuguugaaacauuucuaagcccacgagcaagauaaauugcagcugggaagaacguguuuauagaauaggaguuuuuauccgucggacagcagugcguuuuggucuuaaaccuggcacccagagacaaaacuuccacauggugauucagcagaaugccccgugccccacgcagacaccagggucaacucauugccugcagucuagcuuguggguggcacagacuccaauuuuuauauaacucaagggaaaacucugacgucagagcccaugggugauggacagcaucgcccaaacuucaaagaucuguuugccacugcuucccggaccucccugccucucagagacacacuccucauguuacccugccagccauguauugagcggucucugcucugcacccuacgggagugcucugcucagggcucuccugggauucccacuuccagccccugcugagugagcaugaacccuucgaucuccccucuagggugcuugaagcuggguugcccagcccucagagcuucuggcuccaggcccaccuucccuuguuuguggcaccuucacuugggcugaaggugaggagacaagccuccagcucauucagggcauuguucuaagccagugugaagcuguauuggagaccuguagagacagugcaggagccagacaccucaccgcccagcauucggaaguagcuaugccucaguguuuaacaagggcugugucccccgccccaccccacauacaucauauauacacacacgagcauuaucuacacacaagcacacauacacacacauacaugcacaccacacacacacaagcauacucacacauccacagagaaagaggcuuagcuggagcgaauccacuuuguaauugaaaucaccggcaugagcagcagcaguguagauaaauaucagagccaugagaccaguuucugaugggucagcagugccucccuguaagaaagccuugguccuccugcauuugccuuguggccuaccagaucuccuguccacggcaggcuggcacagguugcccacuucccacucagcgugacagcucuuucccagucuaggcaucagagcaaaguugaccccggaagcaggcucccacggagcauccucugggcuggcuacuucagugacagccacacauaguuaaagucuucuuuguugcguacaccgaauacuuuucccuuuggacauuucuagagcuaaaauaaauuuaacaugggcaugguauuguguaccuguaauccccacauuuaggggguuaaagcgagagggucaggaguucagggucauccaaugcuacauaguaaauucaaggucagucucuguuacaggagacuguuacaugccuuuggaaauaccgauguuuaguaaauauguauuaguuaaacauuuccaaccagcauacugugugcugcuggcucaagccaauucagcuuuauuaaguaucuguuuuacuugauaugggguaauguguggaauguguuauucacaugcauuaugugcgccucacucuggucacaaggaugucaacaguccuaaggcacaguaccccggcaggacccuugcuguuccucuugguguucucuagaaaggucagagaacaacugcccuugggacuuucuaggucaaauggcagccccugaagacuacagucccaagagcuuaagagauucaucuuccaaggaagacagcaaugccuucauucccacccccgcucccccacacacacccaaggacauaaugacccggccaaacagccucagaaaguagagccaggaggacucuggacaccuggagcaccagguagaggugagacuuagcauuagguccuccaggcugccaaccgcuggaggaugcuccaucaaaaguccuguuucaaaacuccaaugguggugagcaguccgaucugugacuucugaguucaggcuggcuacuccacagagcaacggaaacucguccuccggcgacuggggagcuguucucacagccuuugacuccauugauggugauucucaaugacguucccagcauguuccucggagaggaauucuauacagagcauugagcaugccugagaggcccccucaggcagccgaggaccccagagagcuccccucacaucaagccuguggucagugaguccucguucccaugggacucugaacgcuugggauuauaaccaaacuugaaucaaauccuuauuuauguaucgacaacuauuuucuaaacagacauguauccguggaagccucuuguuugugucuggcgguaucuuuuccugcuguuuauucaauauucgggucacaaguaauuuauaaauguggguaaaugaguggggucaaaaauuauuuuuagggcauuuccucauucguggaaaaaugugucuacuuuuaguagugcuguggucaguuuuuguuguuucucuuugcuuuggguugaauuugaaaaaucucauuggaaacugugaguccagaauccuacauugauugaagaaguuuuccuugaccccuacaugggucaaaguccucaggacauagaucuggugacucccgcccgagcuuugcagcaggcugggacuuuggguuugcaaaagaaguaccuuccaccaagucaguaaccagacaagcgugcccaggcuagacuuagcugccugcugcugcagcgucuguggcuaucuccgagcuuuggaaguauucauuccugcuaauggcagaucuuuaauaaugggucuaaccaugaccugucccagugacauugcauaagcuccugaacaccaaaggaugcagaguuaaaacccugcccuguagcuaaugccuuacuaaccaaguggucagcgggauuacggagaaauggagcaaucucugguaaccugugugugagaguggagacaaccaauggccauagcuccuuuggagacuuucuacccaucccaggaggggccaccucacuucucagucuacacaaccugugagcgcugaugacugagucucuagcucacuaaagaaaaaaccucuuaaucaugaaucaugauaucauaauaucauaagguauuuuaauaucuuaguucuccuuagaugcccauaaaacuugagcagucuguaggcuucuguucuggaucucucucucucccucucucucucucucccucucugucucucauacacacauucuguuucuucucauggugauuuauuaagauuuccaacaauaauuggugcagaugacaaacuucaacuuaagauucuaaaagaaagaagagguugaaauccuaacagccugaauugaucagugagggggaaaaaaaaucuacaauuguggucaagagcgcccauguggagcuuguggcauauuccaaagacuugcaggcaguuccaagaacgucucuggaagcugacugcugugggccguucaucugcagaggggaagagaggugagccaggcucggacagucacccucuaaagcaauacuucccaaccuguggaucuccaccaguuugacaaacuuucaucuccaaaaguauuuacauuacaauucacaacaguagcaaaauuacaaccaugaaguagcaagggaaguaguguuaugguuggggucaccacgggaagaacugcauuaggggguggcaguguugggaaggcugagaaccccugcaggaucccucccaguucugcuugucuuccucuuugcaaugccugugacuuguucacccacagauggugucccuuccccagcagagagaagcccauauuagugcacggccugccucauuccuguuuucccaagggauuccugagaaucccuccacuuccucucgcuccuccccacccccuaucuaauuguggcaggaauaauuaucggauauuuccugcccuggaagugucugcucuucugugggagcccccauauccucuuccuccuuuaacggccaauuagaccuugccuaaagauguggagggcgauuuucauccccagaaagcgaaauauggagauuuauccauacguccaggaagaggccauagcagguaacugauugguuggugucugccccagcuguagggagacuuacaagggaaagauuuacuggaagguguagauuaggauugagaaggaagccuaccaucagauacugagugucaacuggaugacuaagaaccuaggcugcucuucccuugagggacguugaucuagauaaccauuccaaggauggaagagacagccuagggccauccacacucaggaaaggcuggagauaaaccgguugagguugcuggaggcaacuguugugagguaaaccugagucucuuugcaguuuucgggcaagcucacuugaaagcugaccaaaggggguggugaauucagaaccugaagccacgcccccagcagccucugguguaagugacgucaggaugacuuuucugugagcgcagcccuuacgacucaaacccacauaacauaaaacaacaauccugcugaaaugcguugggauggugagggagugaggcuuuuaguauuagguuuugauucuucgguguucaucuauauuuucugcuguccuucgagacaggccaaagcaaacucccauucuaaagaaaaggcuguccucuugcccgacucaagagccgcgcugugcggcuccucggagagugaguaacauuggcugccccucuccaguggcaguuacaugacagugcugauguccauuugggacccaacuggcacagaaagucccaggaagcugagcaugcgggaauaugaauggugggguggaaacuuccugaagagagauaugcuaaggagacauugugucccucccuauggcuaucgggacuauugggacaaagggcccaaggaacuugaaguugcggguuucuucucugugcuggagaaugaacacggggauuccuguacacuaaacauacgcuccuguaccuaaacacacacucuacacucccagccacagagcaagcugaggcagcccagucucccauucagucuuuagccaacaaccagcuuccuguugcugcuugcuucccaccaagccuuagcacacucggaggugacucuuuucccaguggcugaagcaucaccugcuauugcugggauuggaugagaucccacuaaagcauucaacacagaaaccuagguccauccacgccuccuggccacgcaggccuccuggccaacucccaccuccucuccgguccugccacuugcucuccuagauuugguugucaguuaaaagcucauucaaacacaggucaaaaugaaaccauggaguuuaaaggcacacagggaaucgccacagccugcuagaaaugcacagggaaagagacaaccagggagcaggagaacccugcaaggucaguuuacaaaaaaaccaaagcccuuguuuccuccacagggccagcacaugucuccuaggaaauuagagcucaagucacuggcuaagaggaugccagguuggccagcauucucccuacaauggcccagagagacagcuucggggagcccugcagacccaggguuuccuccauguagaaacaaguugcuucucuuuuaccugugaugggaagcugccaugcuaaguaagagaaggugucaggggguugguuuacugaacacucgugaguuucgaaccaggggugugccaccauuuuggggccucgucagucugugggcucugccccacucuccucacucgcccucagcccauucgucagucugcggucccaugagggugugacaccauccuuccuuuccucacucaccagcuagccuagagguugggaagguacacacagaaguugcucugcuccugcagucagagggucaagauggucucagaagaccacagguuggagaugggaagccuucagcuccugccacaccccggaucucccaaaccacucaucuggggacuuacuugcccuuccucugagguaggaaccccaggcaugaugagaucuggccaagcagaaggucugugggcagagagcaugcccuuugccuuaggggaauaccacagugcuccauccccuuuucauguuuaauuuauacauuuuaacaucuuacauacauaugcaaggacggcucuucacaggaacuucgugcacuacacgcuaggcacucgcuguaccagcugaguucagcccuucccaucccuuuccuaaacucugccaguaaucccagacgauaaguccugaacaucuuguaauugaauuccaucagaaauccauucaaagucacgauaggaauuucccuuccaccccacuucucuugagagagagcacagcaggcagucgcugccggcaggugagaacgcaaugacaucagccuuagaucugcuguuccuuaagaacaggucuguaaacugcacaagcagaucucagagaagcgaccuuguaaaugcgagaauguucugugguuuuauuuuuugguucaagccaagccccugaauucuccaaguccugagccuugccagccacaggcugaccaacaugacuaaugcaaguuacccacggucuuaccauccuugggcauaaagccgcuccagcuggagcaagccugccaagcgugcagggagcccugcuaacgguacaugacagucggagggcuuuggaaacauuccccgagccagcugucuauccacccccacaguugucugucuggagauaaggcucccaugcuggucacucagagaugcgucacaggagucuuggaugcugcucccagcagagcucugccaggcagguccacagagagguggccugugcugacccggaaccaaaaagccacccccacaguguccugagcuauccuuugccucuguguuccagaucugucauucauucaaaugggucauuagggaugggcucuuuguuugugggagcuugcuuaguguggggggggggggggagcagagagagagagagcugagagaggagagagagagagcagagagagagagaaagcagagagagagauuacaaaugaguuucuauuucuccuucccacuuagugacggauacauauuuuccauuaguaaagcauugagcucuuuuuacuuuuuaagaacaguguagguggcauauuucacaaucuuggcaaggcagacaagacauuuggggaguaaaucaaagcuggaagccagaagucuuggccuagacuuggacugccacuuagggaaguguagcagagggaaucaggugagaggacagagggagacugcaaugagccuccuggcuucccgguguauaaaugguccuugguggagaugggagggagugggcuggggugagauccgugcuggauuuagaaguugagggagaauggagggcaugagacucacuccucaagcuuauuuuuuuuucacagucacuaauuucuuuuuuuuuuuauuugacuuuugaguucaguaggagaucucuaaagcgagacuucagcaacucucugaugaguugagaagagaggccgcuaccagcuuaagagcagccuuagccuaagaaaagagcuguccacacuggcaagccugacaaccaucaggccucuaggaugaucagcugcuggccagaggcuuugaugcuauucuuagaacacaaaagacugaaucuacgcagguuuuacuccuuuucccucuguguccucuuccuggccccuccuuggaaauucauuucccuggccauuuuacaugauaaggaagagacuggguuugccauggggaaacacauugccaauuuaaauagcaucagugaagaaguggggauuucagagagucuggagucaccauugcuuagaaauggaauggaggaauucaccaucacuggugcguggaagcagacauaucuggcccagagaggguggcaguuggaagccaucaaccaaguuagcauggcauggcuucauuacagcauccuuuggaucacguuccuagaaaacuauuuucuuccuuagguaugugaaauaacuccccccgccccccaccgcccaacuuagagaauuuuauuaaaaaaaaaaaagucaauugcuaauuccugccaaauuuugguugugaguuuuuugguuuuguuuuguuuuguuuaauuggcagggagaguaaaagaacacauacacugugugcagcagcucagcgcuuggcauucugggaacaguuggaaaaggaggcuaagaaagggaaagagugaggggcacuagggagaagccaaaagaaagcggcuacccaccuacuccaggucccuggguggacaacuccugugucccagcugcaaaauuagauuaagucauguguuuaaagcacuccuagcucucaagaguugggucguccuuggaaacauagcaguucuaggccaucaugggcugcacugguuuuuguuuuguuuuguuuuguuuuuuaagaaaaaccuccuuggguuacucaucauaggucacccuaagaccuugccagagacacugaccccaucugacuuggggacaugaggaccaggcagugcgggucaaccugguggguguuuaauuagcccccaagcuuggcuggccccgaacuauaguucuguaaaucagaacucccucgcugguuguuuucccacaaaugaccaaaaacgacugggcugagccuagucuugugaaauccuuccuccuccgagguguguaauauucccugggugacacaguccaguuuuaagaaagacaugggaaaaaaaaugggacuuuucaaaaaucggguacguuuuugggagauuugccaugaaacuguuuaacguguaaauucccacacaacugaccuaaugcaguuuaaucuggucaugugugcaccccaucaucuuccuggcaggaaagcuguaagccaccugcuccucuaggagggaaacugccuaggugcuggcagggucuguguggggcucacucugguugucugaaaccuggucauuucagaaguucccucuguggcucagaccauuaaaauucucaguggcuugaguaauguucccagggcuaaaagcaucuuauguccuugaauaugguccacguuagcaacauauccaguaagcugguggagcaaucugauuagauugccagagccccagccagcuggaguucuagacuuuaacaagguuuugagugggauguuugugcaagcucauccgucacugaccagagaguagcuuccaucuccagcuccuccuaaaggacauuuuguuaauacagucugaaucuuccaugcaccaaucuuuaugcggaagaacguucuccagcagaugcaauauuuaaaugaaauccuacauguuuccuaaacauuaauucacucaucuucuguccaguagaggccucugacuucuugugucugaguccccauuuuucaauguuuauguagaaacacccuaacccaagaaaagccauugugacuccaacauugucuuccaaagggagggaaggcuucaccucuuccgguccuggagaaacuguuagcagcugagagagauagggaaauaagagggcagaaugcacagcaggugggaugucugucacagauuuuccaaggcagugcucugagcucccugggaagggucugaaggucgccaugccaauaagcuuugcauuuugugaguuuagcagaaaacugcucuuuucuuaaaucaucuuguuucccaagaaggagauacagacagcccucgaggcuuccaaugccuccuaacagaaaacaucugcugaacuuccggaauguuccucgggccuugagcacacacccacacguuuccagcucuuuccuaaccaugaaguuggcuuccacagacuuugguuuuacagccaacucuuccacccaguuguugcauucacccucgacuccagcuccguuucggggguugauuccaugguggggcuuagcucucuguugugggacagaaagaggcagcaucuucauagagugucugcugugacacucaugguguuaacacugacugcgucacgccagcuuaagauggucugacccacgcauuuuaagaugaauaagaacauaaucgagcagcauggagcauuguguggcccaaaggaacuccagaaagggguuccugugggaaugaagugcuuuuguuaggcuucuucaaaguucuucuuuaguuuagaaaauccucuuuggguacagcaauccuuacugauggcucuggguguuuugcucggcucugcuuauauucugaaggauuguugguccugagcagugguucccaaccuguuauucgugaucccuucuuggaggccacaucgcagagauccugcauaucagacauguacauuaugauucacaacaguagcaaaguugcaguuaggaaguagcaacauaaggagcuguauuaaagggucgcagcauuaggaaggcugagaaccccugcucucaagagucuuagaaacccugucucugugacuaagucacuguucuagucuauguggccaugugaccaaacaccucagacuagagaacuuaaggucauugcuugggccuuggagaaaugcaguuaagagcacuugcuagccgggcagugguguugcaugccuuuaaucccagcacucgggaggcagaggcagguggauuucugaguucgaggccagccuggucuacaaagugaguuccaggacagccagggcuacacagagaaacccugucucgaacaaaacaaaacaacgagcacuugcuaguuggucuagguucccagacccacacccuucuguaacugcagcucccgagaauccagugcccuucccuggccuccaugggcagugcgcacgugguacucauacucacgaaagcaaacagcccacaccugaacaccacagauucagugucgagggaggagucacugcgucccaggcagugccuagcuccuguguccucucauggacaggguaguccacuaacccguuuaugaagauccaccuguaaccuucacaccuucugauaacaaaaccuucaaugccacuuugggggugggggguggggcacagguauucacuucagcaugugggcuuuggggaucuucacauacucagaccagagcaguuucugccaggugauacagcuuagcaaacaguauaacggugguggauuuaaguugcuuccuuuugcuaucuggccuuugacgcuaucacuucugggucaguucagugcuucugauauaaaguuaaauggcagaguaugcagccagaggagcugggcugaggucugagggacaguagcguuucaagagaccacggagaaaucccugcaugaaagcuaagagagaagagacaggagaggcccaucagggccaugcgccacccugccagcucacaggggacacccaccugccauacucacacugaggggaacuggcaguguccacugggaacugucuugucuguugcuuuguggaaagguacacuaacagacagcgacagccagggcucuucacagcaggagauaguacugugguugaucgcugugcuggguagacugcagccagcccacaguggucacaguucugccucccagauucuugucuggugugucagauccagagcagugcuacuguuuugcaugaaaaaaaaaauuaauauuuggaucacaggaaugguugccaaacugaauggcuaguacauucccacaaucgcauaagccauaauuccccaguguagaccagauaguggguuacuauucauaacccuaaaucucugagcugaagaggccugagcacaccagaaagcucccccuagauauguugaaagcuuucuagggagucauggccaaauguggcccucaguguucacagaggaaggaccccugaaggcuggagcuguacuucaagaucagcauaccgccuggucuuaaagagguuacaggcugaggacacaccagcaaauuaggagucauaguuagaaaccauuccaugucuagauaccucccccaaacccaggcaaacccaggccacccaguugcuuucaaaggggaguuuguacaacuggaaauggguuucuacgauaacaguacuuuaauaagaaauuuaauuugaauuauuugugauuuacaaauaagucagcuguuuucccucuggcaccauugacaaucaacuuuuuuuaaaagauuuuauuuauuuauuaaggacacuguagcugucuucagacaccccagaaaagggugucagauuucauuauggauguuugugagcuaccauaugguugcugagauuugaacucaggaccuucggaagagcagucagugcucuuaaccgcugagccaucuccccagcccccggcagucacccuuuuaaaccuauaacuguguauauacaagauggggugggguugugccacagugugcucaugaaagucauagacaacuuuguggaauaaguuuucuccuuccauucucguaugggucccagagguugaacucgguccauaagacuugcuugucauacaucaucagccuugccugucacacaucaggcuucccugucacaagccaugucaccaucucacuggcccaaaguccauuuuuacaccuucuaaguguaagagacauauaacaguccaccugugugugcgcacguguguacuuagauaacuaggcauguggaucaaugauaaagauaaauagagacgguggauacguggcagagacugacagaagauagagagaggcguggauggauggagguuggauagacauuucuccugacuccauuuaaccaagcugacugcucgguugucuugcuugcuagaagauaaaugaagacuggucuuccaugcuugccuagccuccaggaggcugguggacuuuucugcaugcaugucagggaaggaaagcucucugacuaauccugcaaagggccucugguguccuggaagcucaccccaggagccacgcugggagugaggacggagcagugacaaggggacgcuuccggggcguuacaggcacuaaaggagggagcacacagguggauauaaauagacaggauccaugucaaauagcuagccaaguugacuuugcaaccacaacagccccacccccaagcgugugguccaggcacugcacuggcccccucaagaugcaaaacaggcacagaagggguuucauagggaaguguaagaucagcuaagaaacuaggugcagaucaaagagggcuuaucccaauaucaucucagagaagaagcaaggagcgaccuuuucaggaagaaagauguguucacaacaucagggcaucguuagaaaccaucaaaauacucaaggaacgccauggguucuguaguggcacagguuuaagguaagcguaacacaagagugcccuugacuucuagaccagggaguuguccaggcaaggcaaaggagaagcucgcuaacggguuauuaggacccagaggagaggacaagagagacggacagacuggggaaacacaggacagcagcuacagugaagcaugcuggguccuuggauuuaagccaaaugcuagcagugucucuacuuguccagaauuggacuccagaauugggagaaagaaggguuacggcaggacaauggugccggagggaauuuagacguucugugguuagggaucugcggaugcuugggcagaguccaggagaaggguaggacauggagagugaggugagguguccuaccagggcuucugacaagaacugaguuuggcuaacuccagagauaccucugauggcccugagccagcacccaggagaaaugcccguuuaaggaggaggacuguggaacaggguaaaagcccucagcuugagaacauuugccuccuucauaggagaguuugauccaaggaacuccaagagccagcucucccuggcucaaguuauagaugggagagaggaaguggcuuuggaaggugucugggccauaucugaaugaggagccugugagccccacagaacgaggacucacagucacagcuggccaugggacaucaggggagucauggguccacugcucuccacacuucugccaucuuagcuuuccugugagcaugauugguguccccagcaugccagccuagccaagcugaccucgcuggaccauccuugggaauugggauggagcugccuaggaaugaauggcuguucucaugcagacaggcuccugccccauugcacagcaaguuaagacacagcagggaaccccgaggacauggagcugaggacaggcacacacacgugcaugugugcucacacaugucgugaauauguacgcucuuguagaaacagucuccuuaagaggcuuaggucauuugggaaggauaucccaaaugccaaggaaaaccaacaucuguaauggaaauccugccugagguccauagugcaccaucucccuggcugcucacuaaggaagucagguggccucaucuugaucacggggagguuaccaaccuuuacagaccucaggaggaugagcuguguucagugucuacugccauuucauugaagaaaauugcuauucuucuucauauauauauauauauauauauauauauauauauauauuccauuuaaggccgagcacaaccaugugauaacuccaguuccaagggaucagacacucucuuuuggucucaggagcaccaugaucugaaguggugcacagacagacauacauauaggcaaaacacccgugcacauaaaagauaaaauaaugaagaauuuaagugucauuagaggaaaggauugguggagagcccgagauggcucagcaguuagcaccagcuguucuugcaugggaaucuggauucuucccuucccagaauccucguggcugcucacaacagucuguaacuccaguucugagggguucaccagucuuggggggcagggggucuccucgggcacugcaugugaauacauucauauauggaggcagauaaaacacucauacauauaaaaguagauaaagucuuuagaaaguaaaagggugucgauggggcucagucaauaaagugcuugcccugaauucagaaccacauccaacccccaguuccuacuguggugucaggaagaucagaaguucagucauccauugcuacagggugaguuugaggccacccugagcuacacaaaacacugucuccaaggaagaaggaagggggggguugucaugccuccugagucauucucuggauugcagaaggaugucacugggucuccugucugcauaacugauccaugcauuagcuucccacagacugagaugggagguagagcuccuauggucuguguuuauucaggauacguguucagugacaucagaagggucauccuagaugagaauccgagggaggaagugcagagacaccagacucacuuacagaaccguaguccuguaagcuuagccucuuaaucacuguccagaagacacgcuuaaccugaaggcugcgacagugucauaggagagggggguaccccaaggaccaccucaaggacuggcaggucuuaucuuaggacuccucccaaagaguagauccuucuaaaggugcaaggaagaaaggcugugugugauguugugugaucugauguggacugucugccuuugaccuucccagaauugaacgucaacgguuagggcuggaguguagcccaguggcaaaauacuugcuuaacauauacaaggauguggguucugacuccagcaaggggugggacugggacugggaauguggcuccauugguagcuuguuucccuagcaugcacaaggcccuguguuggguucccagcacugcagaaacugggcauggggcucauacuuguaaucccagggcggguagaugcuggaggauuagaagcccaagaucauucuuggcuagguaacaauuugagacuagucugagcuagaaacccugucuaaaaaaauaagagcaaaccaaauauacuaacaaagcccuucagaggccacauggguaugagauaaaagagacagagaacuccagagcuguuccagaagcguccuuaggcccuuuagggcugcagucagcaccucccuggugaggugaggucucuugguaggagguauucucaagcuuuucuuuccaagugccauucaugugccuuaugguggcuccuccaccucccagcacggaguucuggccauucaaagaccacaacauccugccuucucagauagggugugguggucaagugacaugaacagucaucaccgaugccucggccacccacagacuuuccucccaguccaucgucugugguccaucuccuagccucuccaccucagaagucacuuuuauacccuuuuaucuugucccuaauccauaucgccaccagcucuguucuguucugcucuucuucccccauaccuguccugccuugccuggcuucacaccugagucccuuucuacaggagcaugccccaggcugccaguggguuuccagaaccacauggccaucuccggugagagcucacucucucggaauguacaaggcugguuggccacaccccccaccucaguuucccucagagaaugagcauagugacaauauguguccugaguuuuacaggaauuaaaaucuaauguguuaacaaagguggaaauggcucuuagcaaagauccaaggcuguuagguaugugcugacucaguccuggggaggaauucauucuaaugucacuugaagucauuguugcaagugcugucaggguaagcaugggagcaggcucccagugucaguaguuggcauacuuuacuuuaacaagauuaaaagacagauuaugaguuauugacuuaauuacucuaagagaagugggguaugauagccccuuggacuaacuggaauuaggcaaucacaguuuuccuugggauuauccccaagggagguuaacaaauaagggacuugcccucuguucccuagagcugagucaugugacccuggaaagacucaaaacuuucaagccagaggacagguuuccuaacuucgccugcaggcugagaaugacugccaccugguguuggcuacuggaacugcacuauuaucccccuuggcccuguuccuuccaccaggaauguugauuucauuucaaauuuucaaaacugagauauccaguaaacauuaaaauuauuuccuuuuuaggcuuuuacagacuucugucaauacacaccccuuuuccucuacaacuuuugacccccugugaaccacagcggucccacuaagguccuacccauugcuaagcauguucaaguucagcucagucaugcuuaaagcagccagguucagacauuaccggccugagcuuucuggaggaggaacacccagcauuccagagccugccucacccgcgccuuggcugcccacgauauuucauuaucuaaucagaugcugagcagggucugauacucaggccuccuuccaugagccuggguggucuccuugaugacuucaucaugagggcccggggagcauucugucugcuguguagacagagaagccaaacccucuaaggagccaacaaucagcaguuccccggggcagugcagggcuaagacaagacuuuccugaauggcuccaggggacuacagaacugaauggggcugggacaguaaggguggcagccuucucugaagggcagcgcccccucgguugaaccucagaaacugugauguuacuauaguggucuucaaagggguucaggcuaaggauguagcucaguggcgaagcucuuaccucgcacacgccagacucugggcucaagccucaaaaaccacaaaaaaaaaaaaaaaaaaaaaaaaaaaaaacagaaggaaaguguucuaaaaauagaacuaggggugaauugggaggacugugagugaggcagagccagauaugugagcagccagccauucggcagacgguuuguggagcaagaggugagagccagaugcugggaacugcuuaggagagacgauuaagggagccgggccaccaggccaccacuguaggcucacaagugucaggcaucagcaggagguuuaauaggagccugacagggagucccuccucuaguucaggacagacuuggcuaguuuagagccuuuuuauuuucagcagaauuuggaggaucaaacuuuuuaaucuucuccacuauuuuguuuggugguguguguguguguguaugugugugugugugugucuaagaaauuuuuuacaagcccaaagucucaguguuuucuucuacccguuuugcaggugggagcugcggauugguuuagcuuuauuauuucucucucucucauuugagucugagccacuacaaguggaugucccugaguuggguccugggaguaaaagcugaaugucugcuucaacguguguggauuuaauuaauuaacuaaucaauugugggggaggggcucacgugugccuuuguguguguauggaggucagaggacaacuuuugggcaucaguucucucccucccccaugugcgucccggguccggaacucagaccauccaucuucagagcaaucuccucuaccagcugagccaucucaccaagccagacgccauuugcuuuuuaaccacaaucuguuaaauagcuuuggaaaguagcucucagucucuugugucacguacuguuagguggguacucucucguuucccuugcaggugacauaacacguccacacacgugaaccgucacccucaugaacaguagacaguuccaaauccuagggcacagaacacguguccuggauccugaaggagcccuuucugccaucauggacaucuugugaauucgccaguguaugccaucagcuugcagaaauucauuaggacuuaggaauuccccaggaucgucaagagucguggucuacugcccucagaggaagggagagucugcaaggggcuggggaggguaggagggucuggggcuggugcccaugaaaggugaggcaggaagagucgguuuaggaaggagaggggauuuccuaccauucauccuuugcgucacugggagucuauucugcucuacccggaaaggcugcagccagauugaacauccuggugugcaggggccgguucuguccuuggggguggguguuugggcuuaucuggccuuuguccaaaauguccugucgccucugccugcacacguucugaugacacuuggccccuuuuccagauguaaacuuuuccaaauucgggagcauucucaggagccuggaauucuaagcacaccucuuacuuagccauauaacuuaauaacauuggcuuugauuggccuugccguccaccaaaaaugacuugugaccagguacacaccaggugugacuccagaaagggaaugauggggggucaagcggacaaaucccuuaucccauuuauucugucuucuagggauguuuaauuaaaguuaauguuuagcugacauaauggggguguuuguuuguuuguuuuuggcucugcuugacucaaugagccagaccugucucugagcuagaacuuaguccuaaguuucuuauuuuaaagauaacugucuucucccuuaagggccauguggagggaagugugggacaugcuguuauuccgacagcaaugcacacaagaaccuaggaauugugugagacagagauucaggguuccggagccaugccagggacaauguacuucuaguaaauucagcaugaaguuagaaugauuccacacggagacgcagagcggaaagaggugauccaggagccaggcaggcagcccgcaaugcugggcuuuucugagcccaguuauggcuccucccgacugguacucagcauuuugucacgccacaaccguugcugcgucuaagcuucuggcaggccacuuccugcaggugcacaguggagugaugguguucacugucccacucccuaggaggcccagcccuguggauagaacgggacaggaguggagggugcacacacaaccuuauagguccuuugaaaaguguccccagguuuguaacauauauucugugucccugcaguuuggaugggaugggggugugggaggaaggagauuuucaagggcauagcaggaauuugaagagcguuguagaucugggaguucggggguugacauguaggcacguggagugggcaccuucuguugggacagcuuuauuuuuaaccucuuuacacacaaggagaggaagagauggaaauaaguguucugagcuggaccuuuccacacaggacagcaguggcugauuagcacaaagggaaacccuccucaccugugugugcagcugcuccuggaacuccacagagcacuuccccgccgggcaggacauccuggggaaagccccagccugccugccgauccaaacauaccucccaagagcacagugaggccgugugccaacgccuaguuaucccacaaggcaggguucagccuagcaacaggagcuccagccccagaggucaggggucagaacccacauucuccccagacacacacacacaccgagaaacgcagccugguccaucaucaacuguucaaaauugacaagauuggcuagagacaccgaagaagaaagaacguguuagcuagggugaagcaaaauuggggcauuucugguagggcugugaacugauccagccacugagggaaaaguuuggucagaaacuuaaauguguaauugucugagauccacugaguccugggaauugguaccagaaaccuaggaggaacucaggcggcaguuugauacacgugcugacagcaagacuguuuguuuauuuauuuauucaucauuacacaagugggccagugagauggcucagcaaggggaggugauugaagugaaacuaggagaccugaguuugauaccccaggacccauauguaaagauaaaaagggagaacuaaccccacuaaguccagaucuccagaugugugcuauggcacacaugcccagguacacacauacauacguguaaauaaacaaccaaaagguagagccacucaaauaugcccacuggcugaugaaaggacagacugcaguauauccauacaguggaauaguauucagccaugaacaugaaggacuggucugugccacaacauaaacgagcccccaaggcauuacgcugagugaaagaagccagacucaaaaggucucacaccugucaugugauuucauuucuacugauuuauagaagagggaaccaaagagacagaggccaguggguggugggguugccagaggcuggggagaaaggggacugcuugcugggucuggauuuccuucugaggccacgagaguauuuuggaucuagauaaaggugaggauugugcaaaccugugaguucagggaacacacuggguugugcaaggcgaagagaugacaggaagcuccagaggaaacaagacuagaguucacaccuaacuuagacgccccauccaagaagugcggguuaaaggucugcugacagcggagaaaacugagcucauggagucgucugugucggccugccaauaggguuugaacgugcgggauaaggacagccucacaagcagguucugugguagccaggaacuguuuuccucaguucuagaaugauuauccccacugacacacuugcaggcugcaaacaguaaagaugccacuguaaggaguaacacccccccaggggucacaguaaacacuggcagggguuggccuccacauggcggaucccaggaaagcuagauccuagcagcgccacaaacuaaaacaagacaaacgugaccagaagacacccauagaagucggagccaaaacauguucuuuucccaagcacacaagcagcaacuaagccacagagcuucagggacagcuucaggaugucccugagucuaccccgacagugccacuguccucguagcaaaccacacggugggaccggccucguguuuguaauagucuucgaggaggcugagaugcauaaaccccaccccuacucaccaugcucagccugccccacccuggcugggcauuugcuaguguggaaaggcuggaagaugaaacucagagaccacugcagacucuccuuggguugaggagguagggugccugagcucugggguaggucucugaaucucccccaucagucucugucuucaaugagucgggcucuuccauccacagacccguggcuccuacaaggaccaguagaggagagauaugaacagcuuugaguaaggucuuugguaucuuuucauuauugguuauuucauaagcacauguccucagagcucauccccacuggagcacgugccugugcuuucuguuuaagggugagugauauuccauuguauggaugugcuuugucuuguguagcacccguaugccuuauauuagggaaaucgcugggagcauuucacacugaagagacuuucagaagccaagcaaagcugacacucaacugcaaggugacguugggucgcucaccaccaaccucacguggcacacccucucauuuucacacugaagcuguuuccccucaagaucucugaugucauuccguagccagcagcagucccuccgugguggcccugguagaagauggucauuuccauaacguuccuaaggauuguggagaguggggagagucguuuggaaagugacugacugagaacgugugccugucuuccucugugauccugaacauguguuguucccacagggucagccaggggcagugggcccccagggguacaauggccccccaggguugcaaggauucccaggacuacagggccgcaaaggagacaagggcgaacggggaguuccuggaccaacuggaccaaaaggagaugugguacgggucauggcuaggguccucugcucuggguaggcacugaagguccuggcugggguccucugcugugggugggcccuggggcccuggcugggguccucugcugugggugggcccuggcgcccuggcuggggucauggcuaggguccucugcugugggugagcacaaggggucauggcuggaguccucugcucugggugggcacaaggggucauggcugggguccucugcugugagugggcccuggggcccuggcugagguccucugcuguggguagacacuggagauccuggcugggguccucugcugugggugggcacuggagaucuuggcugggguccucugcugugggugggcacaagggguccuagcuggagucaugugcugugggugggcacaggggucauagcugggguccucugcugugggugagcacuggagauccuggcugggguccucugcugugggugggcacaagggguccuggcugggguccucugcugugggugggcacaagggguccuggcugggguccucugcugugggugggcacuuggagauccuggcugggguccucugcugugggugggcacaaggagucauggcugggguccucugcugugggugggcacuggagguccuggcugggguccucugcugugggugggcacaggggucauggcugggguccucugcugugggugggcacuggagguccuggcugggguccucugcugagggugggcacagggguuauggcugggguccucugcugugcgugggcacuggagguccuggcugggguccucugcugugggugggcacuggagguccuggcugggguccuccuucugugggugggcacugggccuucuguuuuuguuaauuguucugacucuucacagggagcgagaggcgucucuggauuccccggugcagauggaauuccuguaaguguuugggaagaugagaagguuaaacauuguguguguuccaagcaaugcauuuauaacuuaaagaaaccuuugaaaggagccggcuucccuuugucuauggcaucacgggggcgggggguguucagugcacucucucuccuccuggauucucgacaaacaauggacaaagcauuuccuuccuggagguuccuauaggcagggcuccagaacugaaucuacuuugcuaaaguugagccuuguuaaccgucaggaggauagagcaugccucacagaugcucugugaagagcaggucuugagaguucauuugccacaugggacaaucugaauauaaaauggcccagcaagugccagaauagaacgaaggccacuucugcagcuucugcagcugcccagacucuuuguaguagcugggcauaagggagucaaaaagagaguuauagacagggugugguucaugcuugucucccagcacuugggggggcggggggguuaaaacaagaggauugucaugaguucaaggccagccagagagagagagagagagagagcauggcuuguucaugagaaaaucucaaaaugcaauaaaaguguuuuuauaagcuaguuuacuuuaacuucuugugggagggaaaaaagcgccugacucacagggcucagccaacagauucccaggcggcuuccuggccagaccugagcacagggggugagugugucgaucacauguccugccagccucauucaucuaaggcugugguagaggcguggacccuaugaaccucacccguguucacagaugucugucacaccggcacgccucuucucucuuacugugcacacacaaagagggagacuuguccccagcuucacgaguagggcuagcuaaguaccaggaacaagauccagggaaggaaagucugcucuuuaccuccugaccaauaaguccugaaggaaguggagcagaaagaaagcagccaugcucagcagaacaugagcccagcauagccagguccucggcgucacccguagagugggcuccacugcagccuggaagaaagaaguaacagccucauuacgugggaucugaagaaaagggcagagugaagaauccaugcguuuucagagauaaacaaaucauaaaaacauuuuccacacacagccugagacuaaacugcccauuuuuuuaacuacuucuuggaacucuugcguuacccagccuggaacucgcuuaagauacaucuuugcuuguuuagucauucauuccuuccuucguccauuuugaguugucuuuuccuuggauuugugcuggggguguggcuuuugagaacauuucccacuguuuugugggucaauuacgugaaaacucgacuguucacacaccauucugcuucccaggggcauccagggcaaggcggaccccgaggaaggccaggcuacgaugguugcaacggaaccaggggagacgcggguccacaggggcccucuggaucugggggcuucccuggccucccugugaguauauucauggugugguggucugcuuagccuggaagucugagugaagggcaugugucagugugacugagccaaguauaaugugaccuugacuccacuucccagguucagcccaggagggccaccugccaggccuuguccuuguuaucauagcugugaaagcugcuuugccugcccacuuuuuccacugaauguccuggauucaagcacucuugacuguuagguggaagagaagagugacuugguguuauguucucacccacugucuucuaaggaacacgccaucuccuccucuaugcuaagucaaguaacaguggaugguuuaaugauacaacuaaaacuugaaucuugucccaguggcuauuaggcacugaggaguuauauuaugggauuccuggggacccagaaggaggucggauucuccagcaucuaccaacaggcagauacacaacagaaauacguuuuuaauaggggaggcuuccugcgguuguucacuuugugaccccauucuuaggauuuuugcaaagaauucugcucauucagaaguguauuugcaaauucagguuaggcuaacauuuugguuaagccuuuguuuucugaaaacacgcugagguguuuacccuucacugaguuggugucucuggcuaacggcuuccaccuccaccuuguagcgccugugcacgcccucccccccccccccgccaucucauuuuuacguggcuccauacucgugguuguaccuuaaggaaauuaguacuggaggugccuauguaacccauggggacacugggcacaguggacagaagccgauggccaucuguggucaucauggccaugcuggaagauaauggguucuucuguguuuuucuuucuuaugguauaucugcuaauuuaggggccccaaggacccaaggggcagaaaggcgagccuuacgcacucucuaaagaagaccgugacaaauaccggguauguuugccauaggugggaggcagaacucggucaucccauguaaacuguaacaaagccaguuagaaauuaacuccagugacuuaagaagcaaugcagggaaggaauuuacagauucacagggguaacaaggcugugauuaacuugggaucaucauauuucugugugggggugugcacagucuccccuuguucucagugucucagaccaaauaccucagucugccagggcuugugcaugccaugcuuguuugccacagaggggaaugaauccaaagaugcucaaagccagucaacucuuagggaaucaggagaugccucagucagcacaaggcuugccgugcaaauauaaggccugaguuaaagucccaaaacuguguaaaagagcugggcagugcccuauacucagucccagcacugaggagguagagacaggcaggucccuggguucaauagccauccagaguugccuacugaggaagcuccagacuaaugagagcugucucaaaaaacaguuugggugucuccugaggaauaacaucugauauugacuucugcccucacaugcaccugcaugaacucacacacacacacacacacacacacacacacacacacacgcgcauacaacauacacaacacaugcacacacaacacacacaugcauacaacauacacaacacaugcauacaacacacacacaacacacacuaguaauucuuaauuuaacccuuguuuccucucaaccagggugaaccuggagagccuggccugguuggcuaccaggugaguaccauuuucauuagggaauuccaugcagaacuuuaaaaacaucuggaguagggagggggcuggagagauggcucggagguuaagagcacugacuguucuuucagagguccuauguucaauucccagaaaccacaugguggcucauaaccaucuguaaugggaucugaugcccucuucugguguaucugaggauagugacaguuuacucacauauauaaaacaaacaaauaaauaauaauaaauuaaaaauauauaucuggaggugacacccccagucugucuguccucaagucauguucucauugucuguccacagggaccuccuggccgcccagggcccauaggacagaugggucccaugggagcaccuggaagaccgguaagucccugcacccauaacagcucaccuguggacauuucucuuccacccacugagugccacggagcaacaggcuaguucuggcuagggccccucccaucauguacagcucuucaggcuccauauuaacuauggggcuggcccaucaucccuagacaaagccuaccaaaugcuccacuaggucaguaagaaagaaacggacucuuucuggaccaggccaugugcaacaggugcaucccaccugggccauagccacuguagaaagggacacauuaaaugucacguauagagucccugaguggaggccacaggucaucccucccucccaacaucaugacacggaaaaguguggugggcuugagcaggaugagggaaagcucgccagagaggagaaggagccauucucagcagugagacaaauagccuuccaugacacacagagaguccagcuccaggugagcgaccgucucccagaacucgcucucagggugugugcucacagcccgagaggagcacacgcaauuuccuccagaccauaauagucuguuguaguaaugauucucauccuuucaaaacucuugugcaaugagaaagcccuucugucacaacacuguggcaggcucacccaagacaggaugacagcggggcgggaugcauacuguucucccugggaguggcugguucacuaauauagcaauagcuguguggcuuaggguuuuccucuaaauagagugcagaggggcugggaagguugcucagucagggacgugcuugcuguguaagcucgaagaccugaggcccauccccagcaccaugcaaaaaagccgaauauggcaucacacgccuguagucacugagcuggggagguggagacagcaggaucccugaaacuugcugaucagccagacuagcugaauuagcaaguagcaggguuagugugacacccugucucacaaaaauuaggcagaguaugaucgaaagauugaggaagaccacuggcccucacacaugcccacacaaacaugccacacgcaugcacacacacacacacacacaugcacacacuuccacagaaaaguauacaauauccaaagaaguacaguucagagaaccuuagaaugcacauaggcagcugcucacucuauggaaccgaccuauagaucuguucugcucaugagcauuugcaaauccaccaccaaaauguaccaguguccuaugggaguguccagggagagcagaggagucuggcuguggucacagggccugggaccucacaaagcuuaggaacaggcacaucagggacacggguaaagucacaagcccaaaacacacaagcaaaccaggaacagcuguggguagagagaaucccaucccaagggcacugaccccgccuuccucuuggcuuuucauccccccaagacacauguggggaagcucugaccaugcuggccuaaguggacaucagugauuuucccaggaccuccaagcagaugucaucugagagcugggagcgggggcagggggaaguccagcuuaugcaugucuuuguaucucugcagggaccaccgggacccccuggacccaagggacaaccaguaagucaguggggaagaggguggggagggcucuuugaugauuaugucugcauucuuugaccagagaacaacuuggcugacaaguguuucugguguagauuacgcuaagaacuauuguguagucuaagacuugauucuuaggaagagacucaguggugugucugaaaacccaucccaagcccaguguggggaugcuguuuguagccccauaacgucacugugacuaugugcaaaucacaccggugagccacaguggcagaugcgcagcugggcagucuagggcaacuccuauuuaacugcagaagccguuuuccaggcuggaaacaggggacacuguguuuguuuguggggaaugggagagccucguccuagcuggauacagugagacucagaaccuaaggucagcacuagggacauguccagugcuacugagucaggauagagagcagagccacaccacuuccaugacaggguacuuguuacuuuagugaagcaccaaccauggagucugagagcagagccaaguuugucauaaccugggaaaggcggacagcuguccaggcucgguaauguugaugaggaaaauaucugaucagagauccugggauccagcaggaagcuuggaagaaccuugcacugcuccauauccagaugcaggucuuccaguucccacgccugccucauaugcggucccauuucugugacccccggugaccuuggcugccacccaccuccauaccccuuaggcuucccuccccuccaacagaguuuccagcuggagcuagaacuugaggaggcuccuggauaccccccacauucacccccaucagacagcccuaagcauugugggaagggccuacagccaaggacagcggaagccggcagagcugcagggccaaggaagcaguggcccagcccaggcucuggccucagaucuccgcuggcugcugcaaauacaaacagccccccucacccugggccaaaucacuuccuggcaacuccgacaagcaucuaugagcaggcaugcuguagggacucacacagccgccaugcugugcugugcuuugauuucagcuccaagccagguggcgagggaaagcagaauuuaauuaaagguuuugcuuuuauuuuuuuuauuuuuucaagagauaucuaagcauuggaggaggcagauaguagacugcagagagaagcugaaggaguccugugugaugccugcucugcucgcuguagcaauagagacccugggaaagagcaugagggcaaaggaaagagcgccgugugaacaugugggguggcuccucacaucgauggucucagacggucgggagggcuaacuccagcccggcugcucccuggaggaacuguuagauaaacacuggcugagacacaggccugacuuugccugagaaaacaauccaaacagccacauaaauaugaaaugcagucaguguuaaguccccuaaaaucauuaaggaaaaaaaaguuuacaugaaguuagggugguuuuuaucaaaaugagaugaccucuagauagagagucugggccauuaucugggcugugaaagagcccagagccuguagaagagcucuagcccucccuuggauggccaagugcuaaugugacaggugacagcacccuuucagcucuccgcucgccccucgggccucccguaggcagaggaccaggagaggcacuuggcuccugaaguugagagaggacguggcuuggucucuuuucuucuaaaaacuacuuugguuucacugugauucuugauucuuccaaacucauacacaccaucucuguuuccagggcaaccgagggcucgguuuuuacggacagaagggugaaaagguaaggagaccgaugacaggaaccagugagcaucgcugcucagggugaccugagaacacaguuuacauacaaccauggucaaaugccaagucacccacaccccagggacaaugguggauuagggaagacaaaacugugaacagucuaggugggcagagaucccaacagggaccugugacuuccacccaucuucaggacuggggaguggagauguccccuaagaaugccuucuaacaugugggacccagagaagauuaaagggcucagcugaagcguaagcuggaaccagcucagggaacagaccacauggcugcccuggcugaauucacuaagggggaaaagauaaagaacaaaacacauaaagaugugaaguccccuacaaugaaauaucccacaguaauuaggucaaauaaugggagggagggccuggggagaggucacuggugcgagggaauggucucauggaagacuguggaggugaacuuacagucauccacaagaaggcauuauuacucagauacugauaaacacucggaagccuucauggguccugugaucucagucuuugaacaugcuacucaaugcccagaacacauggagaccuucgggagaugccccggcacuuagucugcugccgugccugccacaugguggcugagcucaaacuuagaguguuguuuacugguagaaacagcaaaagaaacaucaguuggaaucuccuguguuuaucaguuucugagagagaaaggucgugaguagggcauggggccggccauugcuacucaugugggccagugucugcugcuacagacacaaccgcagugaaagucuccucaagauauuuagucuagccuuggcucguuagaguacacagugccuuuugcuucuggugaccccagcaaagcccaaaucuaucaaaucuuuuguagccugcagaagcagguacagugugggaucauugguggccucugaccuugacauacuaauucuuaacaguugacaacggggaaggugguucacaucauguuagucugccauuauuucagugugguuauuuuauuguugugauacaaaguagccaugcaaagccaaaccaaaccaaaccaaaccaaacagugccugugguaagacugggcugacccucaaguucugugcccuccugauucaaaacugucacuuuugcugaacacucugcagggugacauaggacagccaggacccaacgggaucccaucugacaucacacuuguugggcccacaacaucaacgauccacccggaucuguacaagguaaagggauggucauuuccaguugaccuaggagaaggagggggcaaaggucacuuucuucauuuuuaugcaaacaguugcaucccaagacaggaaagagcucacugccaauuugguauccaugggagagaaccagaucagauuugcacaagcuucugggggggacuggacaguuucugucagccagaaggaggugcuugcgagcugcugaguccugaguauuaacagcaaagaugggccaaaggccugccaguccaaaauaccgugaagaaauucuauacugcuuuuaaagcuacuuuggcuugagguguuaguauguuccaacugccuuuuccuacgaagaccuuauuugacugaguguggucacuggggguccucugggcuggguccucccacacugggacacaugugggcacucgcauccaucuccaugaauacucagaagugccugcgcccuguggcuggugcaaauaacuagcugcucagauggaaaagaggaaggcucccaggucgggcacgucacaaaucgccuucugaaaauucuagaaagacagucccuguuugcauuugagacucaaagcugcagcauucagaaguuauugauuaccaggaauucaucaagauuguuugauaguucaucaaauacauucuugccucguagccuaagacaggaucgauguuuauguacugccgaugucaaagacuagagcguuucuuacuccguguauucuucacagggugaaaaaggagacgaaggagagcaagggauacccguaaguucaacgacgacuccuucccucccuccugcgaucgcccccucuucggggcuccuguuggaacgauggggugugcucuggucucaacccuuguguucuuguacacuucucuaugugaggaggcaucaugguuacaccgugcauuugauuuaaucacguggauacuuagcauuaucugaagcuguaaguggggaguugagggggcugggacggagucaggauggccucugcucugggcccggaggucacugccaucuuguuuauccaguuugacuaagcuuccuaguucuuccucacuguaguggugacugcggcaucccagguaaaggugaucagcucugugcucucucuacccccaucccgucacuaaggggccuaggaaggcugcagacuggccagugcuacccccaucccgucacuaaggggccuaggaaggcugcagacuggccaguggugaggucagcuccaggcgccucucacacucugguuucucucuccuagggcguaaucucaaaaggcgaggaaggcaucaugggguucccaggaauacgggugagccacguauuuuauaaccauguuugucugacugguuggcuuuuugcuuuuuaaacagauuuucuguuuuuagaucagucuguagguuuacaaaaaagcugagcaaaaauguugagauuuccaugguccuacccugggcacagccagccaguuagguauccaccaccagggauaucucucagauguguuugcuacaacccaugaacccauguuccccuggugcugaaguuuuuaaaacacugugccugcccaggagguuccuccugguuugaggccugacuaaucuuuguaacaaucugaggaaaguaucuaagaugcaaguucauuucuggacacccaaagaguccgauaaaaacgucucucauggggaggcucaucuguaaaaggaaggugucaucuucagagccaugagcgucaacagccaccucggcacuuggggcuggauuuggcuaccugggguugaauguggccgccugccccugcucuuccaaaccuugaaagcacaaggcugcuugacuguuguuggaacuugguugccugcccuaaaucuuuauugcuuguguuuucuguucaacacaggguuuuccuggccuugauggagaaaaaggagucguaggacagaaaguaagucuaauccgcgaaauguucugggacugaaaccuuguauauauaaccaguggaucucagaaagcagcacuuguccccaaagcucacgugggguguccccugcauccacaggcucaugacugauuguuccaacugucagagaccuuaguggagcauuaaccucugucucagcuucccucgcccaucuguugcuuucuccacagaacccaucccaggucucugccacuagguuccccgcccugggccucacacccugucauugucacuaaaagguugucagugggugacugagguuccuccucuauuucuuagagaucuacacauacuuugauacuugcuuguguuuaauaauaacccaguugcuuuucuccuguggucuggcaaagaaaaagaaacuguguaugaaaaaaacuuuuuacagguccagacaagauucagcaacaacuaaauaccagcugaagcagaaagcacacgaagaaaugcuuuuaucuaauuaaucacuaauuaacuaacucacaacauucauuguaugcaugaauucagccaaucuacugcagaguccagcaccguccugucacccacaguggacaguccuggggucuggcuuuagaucugugcaagccuccagggucaugugaccuagcaugcucaugacuugaacuugacaacgaaggaauucugagcaaauuuuugccauacuguccugaauuucauccaaugggcgagauguagggguuaucacacuucaauauauacacacccaaacaugucaggaagccacaggguugcaguacacacaugcaccaaauuuacucaccccaggauacagccauggcuccagucagcaccagagugcucacacagggugcucagggcucauguuuccaccaggcuguccugucagguacgccaaaagcagccucaaaacccuagauuccccugagcccugcucagaucgccacagcaaguagccacaugacacugaagagcccagaggcugaacuaagacagagaagcuauguggcuguuuugggauagcagguaggcuugccuccuggugccauggcugacauccguggcucuagcuagaggccagauucuggcauugaccauguacaauggagaccgccauuacuacuguucuuguuccuucuccuuguagauccuaaacucgggcuggaggccacacacuaacuagacccaacuuccuaucaugguaguucuugcuaagagugucccugaaaguaacacagcagaggcaagagcuguccccugcuccacagccaaggccagaaugccacuggcuuaaggguagcaaugagcagauucuguaucgacaacuaacagacagacaggcauuaggccuaaaggccagccgagucagagucaauguaugcugaggugggcagguggcacguugucaccuacucuucucugaaacagaggagcuaucacgucugcaaacauggcucagcacagcugccccuggaacuagaggcccaugaagacuagaauccaucuguaacucuagcccggaaucugacccucucuucugacauccauaggcgccagccacccacaugguacuggcaagcccuggccccuggcccacccccacccccgaugcugcuaccuagguacagcauaauagguccagcuuucucucuguaacuuggggagaagcagccaucugugcuuaagugggucaaaggaagaaauaguuuacccaacugcaaaaauaggggaacaggcagacauacacaaaugacucaucucgcugcauguuaguacaaaccacauuguccaaauggccagcugcugccucccuacgagcuuuccagaugugcuggcccucgggggccagaacuuaaaggcagcuccaaagagcugccugcgugcguauggugacccauuaaagcggcaugccaaagagggaggacucagagaaggccaugcucccggggaagccccagccucccuacaagaacaaagagccuucuucacaugccugugugcauguacauagagaggggaggggggcacauguggugacacacaggcauagauaccuagaaaaguaaauagcuccaggcagggaacaggaagauaucuugugcauuugguuguaucauauuuucugaaaaauaggcaauuauuuccccccucguuugggggaaaccuguguuuaaugacagcugaggcuucucccacccuggacuuacuauagagugugcucauggagaucugguuuccuggggaccgugcacuggccacagucuuuguguagugugaguguggggcacaggaaaaaagccaucucugugugugacaaggccacuggaccgccacagagcuguuuagacuccaggaaucacagcuaccaggugugauuuuccagcuacaugggaguuaggagcaggcagcaaggcugugaccacaagccaggcauguaaugacaucaucuuuaagucacaugauguugcaucuuccugcuccauggcccucuuaggcggauccggggagaagucguuccccagaggccccugaguugaauuccaugagccccaguucuuugccugagugagggaagaccuaggauccagagaugggaacacauccaaacccaugaggcagggccuccugcugagcauuugagacguucccugggagccuagcgguaaauaugcccuaguggugagcucccuagagcuacugagggccucugcuaguuacuguccuuaagggcuuaggguucucaaacaacauaaaaucaacugguuuugaacauucaacuccaccucgugugagaggaccagggucagccacagcccugcaaaagggggggaaaucagccgaccuuaguccaccaagcagcacguaggcuccugcggaucuguaaagccccuggacaggcccguuguuagaacccuggcuuggcucuggcagcuuugccaugugucaucuuuugaaagaagaaugaacgucucaggucuuacaugucuguccagcuuccucacccacugcacuggagaaaacuggaggccaaauuaguguuaaggguuuguuuuuguuuuuacugagaaggaaaauuccaaaucaacagacucugaggauucuguuugguggcaacuggagacuuucaaaacucauuaugaaggaagaguuuagcucauggagcagauguggcugcuacccugcaggaggagacgaauccugcacagugucuugcucauucagaugcugaugugggcaacggaaggagcagccgucccauuacacggucccaugggggcagaugggcacauccguagcgcaaguuacccagucccucaacacuaacaaccaagggaaaaauacuaaauaaaacugcaagguuaggaggguggggcgcgcuggaggaugucuccguggcugggaguucuugcugcucuuguagaggaccuggguucuguucccggugcccaguuggucacucagagccaucuguaacucuagcccggaaucugacccucuccucugacauccauaggcgccagccacccacaugguacacaugcauacaugcaggaaaaaugcucacacacauaaaguaaaguaaaucucuuauuuaaaaaaaagugcagcacaagggaaggaaaagcuguuugacaggcccugcaggccgaugccacaguugcuccugcuucaagcagaggggcuugaaaaauaucugugcauccgaaaugaggaaggugaacaugaguuguggggucauugaggggauucuugguggcugcauuggcugggcugguagaggugccaugggguugguuucuggagcccccccucccugcagcuagaaauaauaaccucacaucucccauaucucuauuccagggaagcagaggccuggaugguuuccaaggccccaguggaccucgaggacccaaggugggugacucugauaaugauguccugcuccuggcuuagacagcacggucagaggagacgaucccccuagagggggcuugcucuggguugcucagcccccucagcaugcccagugcagcgggaggcuggcuuuguagcaacaagguggggagggaccuccaguuccugauggaggguagagcuugugugguuaacccuaagggcugagaggaaagacaaggugaggugauccaggguagcuaggagaggacccggcccuguggguggcccuuccugcuagaggacaugucuguggagaucagggaaaugcguggguguaucuggagauuacaggaggcugcuccacagagcagauggugcugggcgucccagcgucuccaugcugccuccccccuuaaccagaugucucagacgucagcaccaugaaggucugagacgcagaauccuuguagucucccaggcucucuggcauccauagccccggcaagggcuucacggggagauccucacgugcugugguguuccuuuuuaugucugucuggugguuaggaugcagggacucccugcugccacauuguagagcuguugccauggggacaguccagguuugauugugagaaaacccacacuauuaaacuaacucuauauucugugcacuucugggcaauauacaaggcuauucucacaguguuuucucuccccaccccagggagaacggggggaacaaggacccccaggacccucugucuacucgccccauccaucccuggcaaaagguugguacaaacacuccaguguaugacguggccucacauggacccucuucugucgguaacaaagucauaagcucuccagacaaguucuuuaagugacucagagacagcccagcuucccuggagguuucaaaaggagucacuagaaauggucacuuugguucuggcugacaacacucaacuaccacccaggugugacccuaucugugagcaaggggaaugucuucauuucuaggggaugcacagggucuuguuuuuagcagccagaaugccacugaguccgcugaaaucacugaaaccacuaugugucuuuuugguaucuucugugccucgauauugucuuacauuuaacagaaucuuacccugcugggcugugaacugggggccccuguauuuucagcauuugaaagcucucugacucucuucuguauauacauuggacuuauugggaaguuggaugccugaaauggucuguagauggcacccuugcuacuaugguacaggcuuguuccuaggcaaugaucugauucuaacugaugggaccugucuugguugcaggugcccgaggugacccaggauuccaaggugcucauggggagccaggaagccgaggcgaaccgggagagccuggaaccgcggguccuccaggcccauccgucggagaugaagguaauggcguuucauagcaucugaacauaccuagucucuggauauggaccuguaguaggcuuugcuggccacguggcuuuccuguggcucuaucugucuuucucauggaguggucucagcucugaugagaugaagggcacaugcaacaguaaccccagcaagguuagauuaugaccccaaugggugauuagugauaucugguccccagauggaagaacuggggggggggggggggugucauccaaugaugucagcaaauggucacaaucccaggccauuguggaagcuguaaaaguugacaaguugugaagaaacguaccaaggccaucgccuucuucuguuaacuaaacccugaugcuuguuccugguggcaggcccucugugacaggaaagccagcacagcccuuaccuauggggacacucaccugcugaaaaugcucuuggauuucagauucaaugagaggccuuccaggggagaugggacccaaaggcuucucaggagaaccaggguccccugcacgcuaucuuggcccaccaggagcagauggaagaccagguccccaaggagucccuggaccugcaggcccaccuggaccagauggugaguggcuguguucaccuggagccuaaccaagcugguucugaguugauccagugggcuaaugagugaggguguggugggcauucccaggguccacacaggaacuagcauaacagcuaucacauccaucuguagagaaucaauggucccacagguccugcaugguaagcuguggcugcggugacuuagcaggaaggcacccacugugagcugaaaucccugugcuugggucucugcaagcgucuucuuccuuaacucacagcuccucugcucugcuucggcaaucugggucaacuucucugucacugcaaagccaaugucacaggagauagcuauugaugcaagaaaggaucgcugcauaaaggaaugguggccacugacagggggcacaggagacccagagagucuguauauauggcagaugaggaggaagguuuggccagccugcugucccacagcaccugacuuagccagggugaugccccauagcaucugggauggucccugagucagccaggguagcauuuucagguugugaugguccaugccauccuuaauaucaagaacgcuuaucuacugagugguaugugugccauagcuuugagcuggucauccacaaagcccggucucuucagcuauagcauucaguuacacauuagauguugaaaaauuccucaugggaacauuucaucugcuggaaagacuggcuuuugaggcacugaaaggaaauaugaggucauuuucucuuuccggaguaacaucgacccacuucuuuccaaaaugauuucaacucccugacaucaccuccagcagcaaucucuccucaagucguucuuucagggggcagggcaaccuauuugcucauggguaguguugggguuuaguuaaacuucaaguucagaggcuguuuuaauugcuuugggaaaauccuucucugcaccaucuccagagggaaaguuguuaguaucaucucuuccauagaaagaaauucuucuguaacacagacgcauaggaagccagucacuuugcuucugcucauaucccacaguaacauuuuaacuuaacaugagccuacuugcccaguucucuuucuuuuggaagauagcacauucguuugaaaaguaaguguugauauuuucuuggaugaugcaucugagcaaagcuaucuuuaauguuuucuauuaugcuaaagguaauuuuuaugauuuauauuuguuaauauugacaggaaaauauuuaucgaugacauguguaccauaaaaaugucuaugagccuguccuuccuguguguagugucuguaggguuuuccccacaugcgucaaaaacauaaacgauaccaugaaugaggacauugucucugucacucuauccuaucacaagcauccaauaucuucauggaugaauuuugcucacuaagugguuuacagcuucaaugacauaaauaaacuaacagaagcaaauagaucuagacagcaaccuguaguagauuaccagcugauaaggggauguaugcagaaaagggacucauguaagaaguuuaucaacuaaaaauguuaggacauccaguuuaagcccuucuugcauuguuuccucuuugagacacauuguuguuuucucugugcgauacauuguuaccaaaucaacugcuccuacagcaaacucuuaagugaaaacuagccaaccaacggccuuuugaaguaugcucauaguucggauccacccugaaauuaguacuggaaaccaggaguccuaccuugcucagccuuucucagaucugaaacguuuggagucuucucucagaaacugccuuugguccuauuuugugugcugcgguugcuggaagccagaaugcuuagucauucagagaaucggagcgaacauugaugccagcugucuuucggggugaaaggcucugcuggcgccauuucuaguacagcugacugaaucagcuauuggcuucuucguggaagucaugcugagaucucccacgucccaaaaaauguauuuaaaauuaugaaugaauuacguagaagaaaacaacccaggggagagacagaggucgaaucuacacggcucaacugugccuucauaaaggccuuacuaacucccaagaaagacaucucucuuuguccuuggugcagguuuuaaauggcaauuuuguccuuggugacaggucucuaguuuuaaguguucauagaguccaggugauaauccuucuauuuacggucugcuuuucucucugucugucaggagggcuugacaguuuaggcuagagcccaacccaaaccuaagcaucuccuggagggguuccacgggcacauaggcagugccugugcggaaaggcuuuccucggcuccauaguaccuguccacuauuccuaucucuggauacuuuguaggacuucucaguggcccccucucccucucccucucccucucccucuccuucucccucuccuucucccucucuaacugcuucucucucucccucccucccccaccucucucucuuugucucucucugccugucucugucucucugucucucuccucuccucucuuccccucuccucuccucuccuccccuccccuccccuucccuucccuccccucuccuuuccucuccucuccuccccuccuuucuccucuccucucuuccccucuucucuccucuccucuccagugggaacgcagcccugugaaaacaucaccauuccuccucuguacucugagcuacagccaugaaacuucucacuagaaucagcagcacugggucucaagaaugcccagagcggagcugcagaucuccacgcugucacucuccucuuugacccacacauucccugguaccacuauuccuccauagcgucuguacuugagccaggagucucugggcaccucacucuccacacuggacucacaguguguggugcagucucucuccuuaaaacacuucaggacucccguugcccuuaggaauaaaagcccaagagggucuucuccccuccuccaugacaacacuccuccguguacccuuuacacacucccuggucauggcuccauacuguuaaggggccauuuggucccuccguuccauuucuggagagcccuucagcuccccgccuggccagcucccucugucagccacaguccaugccacuuccucagaagaccccccuggacaccacccauucuaaaucagcugcucccagcuucccucucacggugcuagcuagaaucugaaacuucacauuuguuugcugagcguguuagcugugucccugcaucucagcugucagcucgaggcaggccagcuucccagugccaacacagcuccuggccugcugccuggcguggcucaggagcuggcuugugguggaugaaugagugagugagagacuguguuagaugugaggccagaucagauuacacagaacaaugcccgcuggucucuucuacaaaucucugcuucccuaggcgcucccaaaccaucccaugccuuugaagucacugccuccuuauccuuuccuguguagccacaagcaccuaccuuguccugggguauucgauggagcuaugaccacuacuagauuuagcagcaauaaggcuugguggcucauaccugucauccugacaccugggaggcugagaccagagagucaccauaaguuuggggccagccugggcuacagaguaagacaaugagaagcaaaggaguccagagguacucagcuacccugcagcacagccaaucucgccuggauacgcagccuuggauccaccaccagauggcagucuucccaaaggccucuaagaauugugaggucuuaguggagucucaucuggucaauugauauacauaugugcaauuauuggggcacuguagugacuaauaacucugaccuuuagugaaaaaaaaagugaaccuagaagaggaauauuggggccaaggucauuuagugaggucaaccaugcccaguaccaauuaggagaauuccaguuaguuuccaggacccccauguuugcagguuuacauguguguucaugugugcaggagaaaggagaaauggggaggucugagaagagaugggcaugcacuccagaaaggggacagagggagagcugaguuuaucuuaaucccacaccaacccccccacccccccacacacacaccuugggggacauucucugaggcugagcagagaugcgcggccaucagcaacauggcugaaaagucaaauucuucguuuggacugaacguuccucaaaagcaaagacauuggucucgauacauugguagaaaagcuaaauuugcaggcucuggucucuguuccauccugagggaccauggccacauggcuguccaagcuucugucuuggaggugcuggugugggucuggagaugcaaggagcugggguagacuuggcugagaggcugcacuggaccugacugaucuggccgacucucacaaaugcuuuuguccuguguguuuuuccguaggcuuccuguuuggccugaaaggaucagaagggagagugggcuacccgggaccuucagguuucccaggaacacgagggcagaaaggauggaaaggugaggacugcagggugggaaggucaggauggugaccccaaccuagcccccaugucaccuccucuugcaaguugaccccgcccccacccuucauucacuucucugaggguaaaggaugggcagucugaucugaaaucugaaaugcuacagaaucugaaacucucugagaaccaauaugccaauauggcacagcaaguggggaaucccacagcuggcaucacucgcugggccgcagccaaaguggccacaccaaaacuuguggguaaaguuaacuucgggcuguguacaaguccuaugaaacaccuuaugucuggaugaggacuacccgugaccucagcacguauaugcagcauaaaaggcacucuaaagccaggcguggcagcgcacgccuuuaaucacagcacucagugucuucucccaccagccccuccaccuguccucuaccccugcuaguccaagcccagcuuaacgcaugcaacccuguccuaaucacgacaggugaagcuggagacugccaauguggccaggucaucgggggucuuccgggacugccaggacccaaagguuuucccggugucaauggggagcucggaaagaaaggcgaccaaggagacccaggccugcacgguaucccuggguucccaggauucaaggugagagaagagcgcccccugcuggcuaggguuaccuugcagcugccaggugccggugccugaggcgagccaaacaucguucacacacacuaucggcuuuuuuuuuuuccuaagaugugcuuuugaaaacuuuaaccuguuggacugagauagcgcaagccacuauguaaguuagacauaaaguuaucacuggacccagagguuccauuccaggcugcagaaagggacugcagcccugggccuucucaaguauaugcacuguguguggaauggcauuauacauaagagccauuuuguuuuauagaaacauccaaaaugcccacugucugauagguaggagagagaaaaagugcaugcccacacuaagguaugccguccuucacagguggagcacugggcacacugcuguguagagacacaggugcgcgugcacauaugcacagccucaccaugucucccaagccagccuucaaccccuggcaaugcucccauuucugccucccuuacucugggauggcaguguguggcaccacagcugaaugucccuaucacuuaagaaugacacuguuucaucuuagugccugugauacuauguuacgucuuagugcaggagaccgugccagugugaucgcagaucgcagaucugcggcuagccuaggcuacaugagcaagacccugucaaacacacauauacacacacagcaaaaggaaaaugaaugaauguuuuaaagacagugccuccccucuaagucugaguguuguuaacguguucagaaaagauccugaacuggaagccauaugcuccauccuggagaaucaagucagcuguucgucugacucauuccuagaagcaaauggauuucacucggugccucugaaaccuauaaauagcccacgugugccuacugcccuccugugugcacacagcagagggcuuuucuccaaccgccucugguuguguuuguuguccugaacuuaauuauaugucuguguguacaacaacccuguguaaaaggauccccuaggaugugugugugugugugugugugugugugugcugggggaguaagagugugggucuguggaccugugugauugugaccaggaggcugaugggauagauggauacagauaaauggguuguugauuggccaaaugauguguaggaaugccuggaauaguguucugugaucguggcugguuaucugaucagcuaguuggauggauggauggaugguugagagagggagaaacuaauacauaguugguuaucuagauagauuauacacuugacuaguuuguuggagaagauagguugguuggcuguuuauaaugauggauggauggauggacagauggauggauaacgauugacugauuggcugguuaguuguaguauuugugcuguauagccuggaagggugguugaggcacaagagcugguccauaaacacccacugagcaccacugugugucuguaugugagcagcuguucuaaacccagaagcguuucccuucucaauaagccaaguuccccuggaauucucuagcacaaggcaguccacgagcacauguaacauuccauucaauuaaaccaacacucaacaguccccaacucuugcaaagagauaguuaaucaagauacaccacaaguaacgccuagcacacaaaaguccaaucccagaucauuucuacccuauggagcugcagggaccucagagcccugaaggaaacugcugucugaggcaugucuucccuccacguugucagccucgcuuugcaaagagaagcuauuguucucgauuggucacaucuagauaggaaguggccgugucuucuuuuacagguuuauuuauuuuuauuuuaugugguauggguguuuugccuguguuucgauguggagagagagagagagagagagagagagagagagagagagagagagagagaguacaguacccacaaaggccagaagagggcaucagauaagcaccaaacaucuuaagcaucuuuccaucccaauaaaugauccuuccuucccguuauccuacagguucauuaccuguuuggauucuaaugaucguaaccaccuuccugaagcccacgggcaggguuucuuccagccuuguggagaguucuuuccagcaggcaauuguccacaaaaugcauaacucaagauccuuuaacagucugaaggaggaagagacauccguguguuucuguccacagggagccccgggcguugcuggagcuccuggacccaaaggaauaaagggagacucuagaacaaucaccaccaaagguuagugcacugugacugagagcuucucggcuuaauuaacaaucugugugggugucccuggcuggguagauucacgugccaaucuuuaccaggggagcgaggacagccagguaucccugguguacacggaaugaaaggugaugacggcgucccaggacgggaugggcuggauggauucccuggccugccuggccccccgguaagcugucgccucgcuccagccaacccggccccacuccucaauugcuuccuguucuuuggacaucucgggagucauggacuugcccuuggcucucacccagugcccaggacaaguccauucuguuuuaguccgcggacaucaugucuuuaaagacuagugagugaacugggaagcacagggugaacgcuucaaacaguggagggacguccauuauggucucuguggaauaggcccuggguguugucaggagagggucuucccuguucccaggcagaucuuagagaguuagugucccuccauuuucacaaaucuugugggcucuagcaagcuagagagaaugacgucauaagguaagaacaaaaugguggggcuggagagauggcucagcgguucagagcacugacugcucuuccagagguccugaguucaauucccagcaaccacaugguggcucacaaccaucuuuaauggggucugaugcccucuuauggugugucagaagauagcgacaauguuuguauauauauauauauauauauuguguauauaugugugcauuguauauauguguguacauuguguguguguauauauauauauaugcauauguguguguauauauauauauauauauauauauagagagagagagagagagagagagagagagagcaaaauggcuugcccagaugccauccugugcuguccacucuauggucucaggugacccuaugaaaugggaaaaugggaaaaugggaaguccugcuuuguugaccccgccuacacuagaaaggcuaaauauggaugcacaugugcuuugaggguccuacaaacaaagagagacuuggcccaaugacuugccauaguacucucuuaucuuugaauccaaaggagaaaguaaugucagggcaggcuggcuucuccacuccugccuaucagaagcccacacccuuacccaugacucuguaggcaggcuaggacacucagcaucucauuagccauacagagcacugacauuggggccacacugggcacaacccugugagcccugccccugcccacucaccacuccuaccauuaucccuccaaguguccccaccuggcugaaaucaucacuacauggcaugccacuggacaggacaccuagccuguccccuguagaugccccucauucuaagagcgcauggcuccuucuugucuaacucccuuuccucuaaugauugaugucccucaugaauagcaggcaugucacacaugugacagaaggacacgaguuccuguguccaugguccugaguauaaaugugucucccaggcugacccuccacugugcugaaagucagugcuuuaagcucuaacuucgacucagucacucgcuuagaugcuuuccuuccagcugaccuguucuugaccugcagcccagaauuccagagaaacggggaagggcaaaggggaaggcauggcuggcucaaaugucuguauguguuugaagguaacugggauucucuugcagggcgauggcaucaaaggcccuccaggggaugcaggucucccugguguacccggaaccaagggcuuuccaggagacaucgguccuccaggacagggcuuaccagguccgaaaggcgagcgugguuucccuggagacgcuggguugccuggaccuccgggcuucccugguccuccaggucccccaggaaccccaggacagagagguaugaaggaguuguccccuuguccuccugaguccuggggcagucagcauaucuguguccccgacgucucuagauucaugcacaugugaccagggacaugugugccaggcaggaacaucguguuccacauuuguucaugacauauggaacagauguguacccuaggcucccuggacccaccauccucucugcugggcagcuguaauguacaacuucuuugggcaaaugaggccacccacacccagccugcacagcagcacacgcuugcacacacacaugcaggcgcgcacgcaugcacacacauacucaaacaugugcacaggcauggguaagucgauggcuuccauuaauucugacuuuggcuccuucuuuguuugugucucuccagauugugacacgggugugaaaagaccuaucggaggcggccagcaaguggucguucagccagguacaagggagagcaaguggcucgagucuguguuacuacucuagaugguaaaacgugggacucaauggcaagugacccacggcagccaggccugugcucuccugcagacaggcaagacugacuccuagacuagccaugcucguaggacaucuguccuuacuaaaggaugcucagcagagaggccagcugagcaccaccauccuaggccccaggagcaucugcagcacugcugucucagucacuguucucucgaugugaagagacaccaugaccaaggcaacucuuauuaaagggaguguuuaauuggguggggcuggcuuacaguuucagagguucaguccauucucaucacggugggagcauggcagcacacaggcagaccuggugcuggagaaauagcugagaguucuaaauucagaaccacagacagcaggaaaagagagacgcugggcuugagcuuuuaaaaccccaaagccuaccccuacugacacacuuccuccaacaaggcccuaccuccuaaccccucccaagcagcaccugucuuaaccaaagcacaacaccagguuuaaauuugcaccugucaaagcaacuuaucgcuguggcuaaucccgaauaauugaaauucacaaagaaaccaaagagucucuuuagagaucauaaaaugugccuuugcaaacagauguuuuccgaugcaagaaaccuguguccuugaacuugugggaacccacaaugauccgacuagacuaucaucuccaugaggaaauaguauuugccaacacaguaccgguuuucaucagacugacuucauuugcacuuuauguuaauauucugacuucuuuuacaugaugagaauucaacuuuuuauuuugaucagagccaggagucauuaggucauugaguuaaucuggacauuaaaugguagccagucugccuggcugcuucugaccacugugauacucaggcaaugagcaucagcauggaugucauuuuagcucacccgccucuccucugucaccagguugcauugaaggccccacaggaucaccuggccagccaggacccccaggccccacagguaauaugcagccuucauagccugagguuuuggcuuccaaucuuggguuucuuucuacuggcccugaaugccuguucaccucugaacaccucacuucccagggaggccagcucuugugcacacuguaaagaaucuacacagagggguuggggaggggucuuuagucucaccacucuugggaggcagagacaggcagaucuacgugaguucaaagccagccugguguacaaagcaaguuccgagauagcaaggguaaaacagagaaacccugucuugaaaagcaaacaacaacaacaaaaagaauauaaccaguaagcaaugggcccugcucugucuggggacauaccuuagagcuguccuaggccgggcuccccagcuccaacacuuccaaguugcagggcagaccucacugguucacagaaaagcugaauucgcaucccguuguuucucagggggucugaucugccugugguuuccuugggugucuaggugccaaaggcgucagaggaaugccaggauucccaggagcuucuggagaacaagggcucaagggcuuuccaggagacccaggucgagaaggcuucccagggcccccaggugagucuacacagcugguguccuuacgcucagggaauggcucaugggugucaucagguccaccccaggacaaucaucucccaggguuuaauaucacagugacugacacuuggugguaacuauggcccaugcucuccuugccuuucaccauugauauuguacuggguuguggcagaggucuuauggggagcaggaggcauggcguggggaaaccucagugaauaguauagugaacauauccuuccuuuaccaccuuccaauaaugccauuguguuauuaacccauaaagggauuaacauauugauuaauucagugcccugguggccucauuguuucauggaauaccaaggugcacuucacuaagcagauuugccugcaugcagguauaugcacccugugcaugucugguacccaaagagacuagaagacauuggaugcccuagaucuggaauuaaggaugguugugaggcacuauguggauacugggaaucaaagcaggaguugcuaaugcucuuaaccacugagcccucucuccagccccccccccacuggaggggggucccuuaguucaaauggguagauaguuaaggguaagcacacagugccugggguggcagugcacacuucuaaucccagcacucaggagacagaggcaggcagaucuuugugaguagaggccagcccgguugaaguaucgacaagcuacacaaugagacucuaucucaaaaugagaggaaaggauggaccaucuagagacugccauacccguggauccaucccauaaucagcccccaaacgcugacaccauugcacacacuagcaagauuuugcugaaaggacccugauauagcugucucuagugagacuacgcaggggccuagcaaacacagaaguggaugcucacagucagcuauuagauggaacaccaggcccccaauggaggagcuagagaaaguacccaaggagcuaaagggaucugcaacccuauagguggaacaacaauaugaacuaaccaguaccccccccccccggaguucaugucucuagcugcauauguaucaaaagaugaccuagucggccaucaguggaaagagaggcccauuggucuugcaaacuuuauaugcuucaguacaggugaaugccagggccaaaaagugagaguggggaggggggagggggggaggguuugggggacuuuugggguagcauuggaaauguaaaugaagaaauaccuaauuaaaaaaauaauaauaauaaagaauauuggguucagagucugaugaucacucauggugccgcacagaacauccccgugauguuccugucuuuggcuguccaugguuuuccugcucacacacacacacacacacacacaccugcugauuaccaucuguagguuuaggguccuuuugcaucauucuguucauguuugauacagagaagccugaaagcuaacagugaagggauucaaagagguuuacagacacugagaggcccagguuccuagagggcagcgggcagcucucaggcugcagagacaacccucccagagucaguucauaccacacccugccucucaucaacacugucucaguacaugaucguguagaccugugacuauggguaccaccuuugucuuguuuuaggguucaugggaccccgaggauccaaagguaccacaggccucccuggcccagauggacccccaggccccauuggacuuccaggaccagcuggacccccuggggacagagggauuccaggagaagugcuaggggcccagccugggacacgaggagaugcuggacuuccaggacagccugggcugaaagggcucccaggagaaacaggagcaccgggauucagaggugagucacuugacaaauggaaaacuacaccccagcugcucugaggugcaguccccagggugagagcagcuuccuucucaggggcauugguaagaagccuacaguggucuugcuugguuuucacucagucccgguacacaaaagaagaaauuucaugugcacacaugcacacacacaugaacucacaugugcaugcacaucacagcauaccaaaaugugucccauuucuagagacauguuaauuagcuaccuaguauaaacaaaacuuaagguuuuuguuuuguuuuucaagauaggguuucucuauguagcagagccuuggcuguccuggacucucuuuccagaccaggcuggccucgaacucacagagauccgccugccucugccucccgagugcugagauuaaagacaugcaccaccacaccuggccaaaauuaaaguuugaacaguaaauuuaaguucaugugaaggaaaauucaaccaugaaggcuauuagcaggcuucucauaaggacuaacauuuguagggaaaauagcaaaauguuuaaagaauaaaaagcaaagacugguagcaauacaugcuaucgacagucaaaugcacaccacuauagcccaugccucucccggccccaucugcaagaucccugguuuugccuccaugugaggagugauucuggguagacaggcaguuuagugaauuggugcgaugcguuaaaaauggucgguguuugcuuuggcuugcuacaucaaggacuaggguauggaagaagucaucuguagcacaaccguggaugcaggcacugaaccccucacucuuccucauagcucugccuugggcugggggaagagaauagaacacgcccccaauguguacauaugauuggacacuuuauucacaaggccaucuaaauguuugcaaagaaaauacuuuuaagguuuauuuuauauuuuguuuuuuuccaaugagaccaguuuuucuauauuuuuuauuagacaucuuauuuauuuacauuucaaauguuaucccuucccgggauccccuccguaaagccccucccccugcuucuaugagggugcucccucaacgacucagucacucccaccucaccacuuuagcauucccauacacuggggcaucaagccuuaacagaaccaagggcguccccucccauugaugccagauuaguccauccucugcuauauaugcggcuggagccuugggucccuccguauguauucuuugguuguuuagucccugggagcucuagggggucugguugguugaucuuguuugugggugugucugcagaggguacgagugcagguacacaaggaggccacaagagggcaucagagcccuuggagcuggaguuacaugggugcuggaaagugaccuugggccagcagugcuaaaccuuaaccacagagaugacuacucaguccuuaaggauauuuuuuaaugugacugaaugcuaauauugccacaccuaaagaggaaggacuuauggugcagcaccacgaauuucgcuuuccuggaauauuuacacaguagcaaagaggaaagaagcauucaaggcgcuggccucccccuugcagaggccagacuuccuguacuccuaacugacgacuccuuuugauauuuuuauagacugagugugaccaagcccgugaugucugugaagaucucacagcucugucucugacucuugcaggaagccaagggaugcccgggaugccagggcuuaaaggucagccaggcuucccaggaccuucgggacagccaggacagucugggcccccaggacaacauggauucccaggaacuccuggccgagaggggccuuuggggcagccaggcuccccuggccuuggagguaagaccccagcaccccagaagugcauggaaaccauugcccucauuggugcuaaaaaaccauccugacauggggaaucccucaaucuguguucaaaggaacccccaacaacuagaaaggguuccaaaaacagggccuauacuucaucaaaaagaauuuaagcagccggagaggguagcuccgccuggccaccuguccuguacguccugcucugaugaggaugacauucggaaugggaggcagaggggagggaggagccgggguggagcugucuuuagggcacugacagacaauggugaggugccggacacaggugcggucagcacaaagcugacccacggcuuuugcaccucaugagccaacaaaugcuuccuaaauuuuguuuuauuacgaucuugugugguaugaucuaaccacgcugcccaggcugccuucaaacuucucaagcaauucucuugccccgacgcugggacucuaggugugagccacugcauccgccuuccugguuuuuuacucugcucauuaugaacuuuucuuuuuuuguuguuguugguuuuuuuguuuguuuguuuuuuuguuuuuugagauaggguuucucuguauagcccuggcuguccuggaacucacuuuguagaccaggcuggccucgaacucagaaauccaccugccucugccucccaagcgcugggauuaaaggcgugcgccaccaccgcccggcagcugaaauguuuuuauuaggaguguaggaguguggcagggucacauauguucguucguucuuuuuuucuuucuuucuuucuuucuuucuuucuuucuuucuuucuuucucuuucuuucuuucuuucuuuuuuuaauuuauuuuuuauauguaaguacacuguagcugucuucagacacaccagaagagggcaucagauucccauacagaugguugugagccaccaugugguugcugggaauugaacucaggaccuuuggaagaucagucagugcucuuaaccgcugagcuaucucuccagcccccugaaguuuuuuuuuguuuuuuuuuuuaaugaauaaagguuuuaccugugccauaacacugacaacugagaggauucuuaauggaauauucacuccuaaacuuuaaaaagucucuaauccuccuguauucccugguuugccacagucgggaaguaacuuuacagaugccuucucugucucuuuaggcaaaacugugcucacagacucccucuccaccccaccacugccugagaaccaggccuuuccugguguccuggucucaggggucccuauagguggcuuugucugugucaaaacuucugccuggaccgcagugaagucagcuuuccugugugccacgcugaugcuuauguuuucaaaguggcaagugcugagacgccaucugcuaacauguccccaagggcucaccagcuccuagucccacacaugaucuauaaacauccaggagaagaaaaaacuacaaaggcccugcucucacuaagccacacuuuauuagguagauggucucaucgagagcaagcuuguguuuggccaggguaaagcaggcagaggcuggagcugggagcuguauaucucagaggccaaggaucaggcagauagcacacgccugguauagaggugguacuaaagugggggagaggacacauaagaaagggggcaaccagaacagacacacaagugucuaagggcugagcuaagagcucauuugaaagagaggggcaguggugugggugaggagauuggcagaggguagaaagaauaccaagcugggggccauuggaggcuagacauagacaaaugucuucagggagggaucuaaaacccuccagauccuuacuacagggaaggacacuuuugucugccaugauggagacugaacagagaaucaggaaagagcaaggccccgaagcaucagccucucugcuaacccugcgucgccguaccgggugggucaaagccggcgguuuccugcugugcuccauggaucccuguuuaggaaacaaggagccauacccagggagagccacacuggacugucccucacagucagcccuuugucacagggaccuccuagaaaccuaucccugcagggcucacaggcugaaauguaagcugaucaucuucgucgggacaguuuucuguuuuccuccaaggaaauguagcuccucgaaggcaccguaaggguuguaccuaugccguuuaauuuugcuucucucucucucugacagguuugccuggagacaggggcgagccuggugacccuggugucccuggcccugugggcaugaaaggucugucuggggacagaggugacgccgguaugucaggcgagcguggucacccuggaagcccuggauuuaaaggaauggcagggaugccugguaucccugggcagaaagguaaaugugaacccgggcaagggcuucccuugcuggggcugagucuguccccgggggcccccacaguuggcuggaagcugagcucccacaccugcagggcaggccuggagccacagggcccuaggaugacagcuuaccuuaccuaggaagguggcauucccucaggguuaucaacacagguaaacuucuagacagaaccuguugaaaacagguuuagaucccagggaaugguguuuuuauugaaugccuggccccuggaguugaauucuuuuuuuuuuuauucauuuauuauauguaacuacacuguagcugucuucagacacuccagaagagggugucagaucucauuacagaugguugugagccaccauguaauugcugggauuugaacucaggaccuuuggaagagcagucagugcucuuaaccgcugugccaucucuccagcccuggaauugaauucuucacacacacucaaacaauugcaagugauccuucauaugaguguaagcugcuggaaacaccuuaggaaccucugcucaggccuuggcaucugccaugcugugagcagaccuggggcugguucaaaggccucaugcugucuuccaccugaccucugugggcucugcagacagcugggcccuaugcccucuguguguuggaaagaguucccaggaaucccugcucaggguaagggucuucgcaggcucucaugugagugacauggccgcagcguccaggauacaggaagacuggcaugucccacacgcuuggucccuaacuuucuucugcucuuccuccaaaggugaucgagggucgccuggaauggacgguuuccagggcauguugggacuuaagggaagacagggcuucccagggaccaaaggagaagcuggauuuuuuggaguuccugguuugaagggccugccuggcgagccagggguuaaagguauguccuugcuuaagauccaggguucuccguguuugguaaauaagccagacuuagcaggggaaaauauccaaauaucauauuuucucucauauggagaaugaauauccauagggacacguguguguaugcaugugugugcaucugugugcuuaugugugugcaugcaugugcacauaugccaugaaaauacaaggacaggaauugacgaggaagacaaacagccaugaccaaagcguggcaugcguguguccugaugaguccugcaaccuuguacaauacaugcuaaucaacaaacaaacgagucagguaugauggugacaaccaucacccugacuacuaaggaggagcaggcgagaggcuccaaaguugaaggccugggugggauauauagcaaacuccaggccagccugaagaacuuagugagaccaugugucaaaaugaaaaugucuaaaaaaccauaaaaggugaaaggugucaccugcuaaaggccaggagcagagcauagagucagcgggugcgucccagugagugcagggcugcagguccaccuagaagcaccacacacauaacaacaacaaaaggaugcuccucccucagggaacagugcuccucagggaacagugcuccaccuucaaggcagcccuugcugcuuggagggauccuggaccucagcauuccaaagcuggaagcugcaaacacacaaucagaugaucccagcuacaagucuccugccaucucccccacauacugacaguggaucguacaacccuauccaaagcaaaauuaaugggucuguuaagaacuaagauugccacaaagcccauuccaucauaacuggaccguagcaagugugagcugcagaggcaagagcggggaggagugugcuuugaaacagaggcaugguggugcacagcuuuaaucccagaggccgggaagcagaagcagguggaucuacgcgaguucaaggucaaccuggucaacauagugaauucagggacagacagaguuacauagugagacccuaccucaaaacaaagaaaucaaaccacaaagagacacacagacacacagagaaagaaaggcaguggggugggggggcagaggacagcuggagaugauuccagucucaaucccuggugaaucuaagguuagauuuggugauggccccacagcuaaguacacugaaaaccaccagacuccucaccuuaaaacacugagcuguagcccaguguaacggggugaagugcagcucuugggagacagaggcagucaaguuucugugacgucaaggcuagccugguacacauacugaguuccaggacagccaaagcuauguggugagaccuugacucagaaaaacagaugaacaaaugaacgaaagaacaaaugaaugacaaacagugaguugugugguccauaaaucucacaucaacaaagaugcuuaaaaagaauggauggaaaagaaacagagaaaaggaagccuagagacaggcucugugugaguuggggacccaccagggcuacagaacaagacccugccucaaaacacugaggagaaaauaaucuuauggguuagggcugggacuauagcucagucacaugcaugccaaucagagcucaaucccaggcaaagaaagaaagaaaagaaaaaaaguucccaaaauccaagccuggucuugaacuccuggguucaaaccuccaacuucauccccucaguagcuggaauagcaggcugucuuagucaggcuuucuauuccugcacaagcaucaugaccaagaagcaaguuggggaggaaaggguuuauucagcuuacacuuccacauugcuguucaccaccaaaggaagucaggacuggaacucaagcaagucaggaagcaggagccgaugcagaggccauggagggauguuacuuacuggcuugcuuccccuggcuugcucagcuuacucguauagaacccaggacuaccagcccagggaggcaccacccacaaugggcccucccacccuugaucacuaauugagaagaugccuuacagcuggaucucauggaaacauuuccucaagggaggcuccuuucucuaugauaacuccagccugugucaaauugacauacaaaaccagccagaacacaggccuaaucccacugugccuagcuaaaaguuacaauuuuaacagacuuguagcaaaauaguucuuccaagauuuuaacccacaccuguguucuuaaauaacuuucaugcuaacguagauauuucaggccauggagcagaaguugaucuuuuacaauuuuaauuaggaauaagcauggugacgcgugccuguaaccccgggacuuggaaagaucugugugugaugaguuccagcagucuagacuacguggagucuuaucucaaaagaaaacagaacaaaaggcuaaaaauuaguauuaaauuagggggcuagagagauggcucagagguuaagagcaccaacuguucucuuccagagguccugaguucaauccccagcaaccacaggguggcucacaaccaucuguaaugggauccgauguccucuucuggugugucuggagauagcuacaauguacucauauacauaaaacaaauaaauuaaauuaggaaugcaguugcccugugcucugaggccuucucucccucaaggugacuccugcagccucccagggcugugauucuccugaauguucaucccugagagcgacacccgaagcucugaggacaaaaccaguuuagcauuugauucccucgccaucccuggggucucaggacaugucggaauucuguucccuuccaggaaaccgaggagaccgggggcccccaggaccaccuccucucauccugccggggaugaaggacaucaagggagaaaagggagaugaaggaccaaugggccugaaaggguaucugggcuuaaaaggugagacagaggcaauuccauagccccgcccugccaggcuuccuuuguccuuuaagucuuccccugccucgugccucaucggucuugggguugccccucuucugggucauggucucuagcucugggcacuggaugauauucucagaguaccacugcgagcacagggagaauggcccucccugcagcacgccuaacuccccugcucuuccuacaggcauccaaggaaugcccggaguccccggagugucuggauucccugggcuaccuggaaggccuggcuucaucaaaggagucaagggagacaucggagucccuggcacaccaggcuugccgggauucccuggggugucuggcccuccuggaauuaccggguuuccaggauucacaggcagccgggugagugggugccucuccgcucagcuucuccacugagauccacuccccaccuccgcucugggaucagugcacagauuuggaauuagagaagagugugcugagagccaccagcuaacacaagaacaaguucccuucccugcgccugucaguggccgccugaggaguacccagcagccaccacugccccgucccgucccggguuuucagagcaugaagccucaaugugcuucugcuucauuuugucuuagggcgagaaggguacuccaggaguagcaggaguuuuuggcgagaccggcccuacuggggacuuuggugaguguucuugggacaguggaagcagggguucgccaucaggccugagggcagcuggagccagacugcacaggugaagcuccaacgcuaauuagagcagcaggaaagccucccaucacccucucuguguguugcaggugacauuggggacacuguggacuuaccagggagcccaggccugaagggggaacggggcaucacgggaauuccagguacaugagugauuuuguuucuucagucaccaacagcccagagcaugucucuugggccuggacuuguggaguauuugcuuacgucauaagagacugcaaugaauggcugaggucuucaaagccagugugcacgaaugagucugaaucgcuuacuuaauuggaagacaagcucaggaaaucucugcccagugccuuuugggggugacuguagccagaagcagcccccgugucugggaggcagcagacacagcacacacgucaaccugugucacucgugggaagcacacucgugccacccagcaaaucucugcuuccaggucucaagggauucuuuggagagaaaggagcugcgggugacauuggauuuccugggauaacgggcauggcuggagcucagggcucuccuggacuuaaaggacagacagguaagauuguagccacaguggccagccaccuuugccauuugcuucuccacggcaaucacucaccuccaggagacuguacgugcuucccacucuccugguucuauguggagaccugcaaugcauagugaagcaacaugcacugggauaaccccuagaaaugcggaauguacacggccagugacgaccucaugagaggugcaguggaggccugcacugccugcaagaucucuuaccugcacauuuccccacaggcuuuccagggcucacagggcugcaagggccacagggagagccuggacggaucggaauacccggugacaagggugauuucggcuggccaggcguaccaggucuaccagguaaggcauguucuuuccaggagagagacaagugacaccccucccccaguacucagcggggaauugccagguugcaaggaucagagcuucucugguggauacugucucagagccccaggggcauacaggggcagguaugucaggauuaauuauggccucaguagacuccgaguacugguuugcaucuguggaauccacuggcugaaggccagaugcucuccuggggaugugcuuagaggaaagugaccugaagacuuggucacucgacauaguauauuagcagaucagcacauacacaguguccucauguucuguugcuggcugccaugagccagguuccaagaccuugagacaaaacccugggauccugagaccacacccaaccccuccaacccaccccccccagcagucaccuguguucugugccugagaaaugggcaggauggaaguaacaccgggcugucugcucccagcaaaacuuuauuuuugaaauuacauuuacugggugucacauacacagaaaacugacuggguucaggguaugccaugguccuugugaguaagaaggucaaaggucagcuugcaggggugaguucucuccuucuaccuuguagaaacugaacucugguugucaggcacggaagcaagcacccucacccacugagccaagucacuggcccaagcacagcuuuuauaaaccagcugaugccaugacgggcaucccagacacaaugcccuuguccuccgccaacucuaagaauccugagaugucugaaaaguauuuaugcauaggaccgugggucacaugagugacagucugcauguuggaugaagggcagggcugcccacacauguaacacacguguguaaaggaaagcauuguuagaguuguccugggaccacucccagccacagcccucugcuguccuacccgucacggcuaauggugagccaaucuccuacagguuuuccugggauccggggcaucagcggauugcacggccugccaggcaccaaaggcuucccuggaucaccagguacucaguggugccccgccccaccucagugcuggaaaagagggcucgggccugggauugccagacuaccugcugccuucuuuacaauuuauaaaaaucaugcaugcucaguggggaaguuuuuuaaaacauauuuaaagccauccuauaacugccauuuggccauacuuuguagauguuaauacuacuaagcauucguccaccugcagagaaauucacgcauucguguucccgugaacacgugggcuccaguuucaaugggcaaaugacagcaauccuggugaggcuguggcagucacggugaggcuguggcagccauaguggggcugcaacagucacaguggggcuguggcaauuauugugaggcuauauugcuguucacugugccuugagaaccugaccugugaacagggaauauuuuuaaauaaugucaaguuuccaaaacccaauaaggacagagcaugaacagccaccagaacaaggagacccgggaugggguccccuaacauggcuacugcugugaucucacacccucugcaggucugagguuuccuguccauagagagaggguucuaccaugcucucuguggcaucccuuuugagucucagauccuacgaugcugagaccagagcuagaagacauuguggcgacugccucaguuucucuacuucucacuacgaggacugucaugccacacggggcaggccaccccccccccaacaccauggauagagcugacaccaaccucugcuguugaaauuuugucacagguguugaugcucauggagacccaggguucccaggccccacuggagacaggggugaccggggagaggccaacacacuuccaggccccgugggaguuccagggcagaaaggggagcggggaaccccagguaaguagccauguugucuccaugagcagaacucacaguuugugacagaugcuacauagcuaagguccuccgaggagaauccuuggccaugaacucuucgcuugucucuauuauuagacucugugacccagcuuauuuuauaccagucuuggcucucuuuccagcccgacucaguuauugaaagacaccugcucuccuucccuccuucccuuugguaucagugucccugaacagggaguuagcuauggucauggacucuagaauccccuccucaugggcucugacagccauucucuccuggcaaugucugaggaccacgcccucucauggguucucaagaggcaugguggccggcauggagcuaacgggaccgggguuuagucuccugagcacagucgagugucucuuccugucccuaggauacauauuucacccuucaacagcaccgucccuagagagaacgacacaggaggaaauggggcccuucaaagugggcaggugguacuaaguuaacuuccguuuucuuccuaaggggaacguggcccagcuggaagcccaggacuucaggguuucccugguaucucuccaccauccaacaucucugggucaccuggugauguaggcgcaccaggaauauuuggcuugcaagguaagcaggggcugggguggcugacaggccuaggggagcaguuucauuucacacacugugcagaaaggcaagggaacagugucaucaccacccagucacccacaccacaugaucccugugacaucauaagacaggaugaggcauguaccugccuagguggccucagaaauguccaguaaaacuuucuuaccaaccacauccaccaugaccuagcucaguauuaaacagagauggaguggggcugcagagauggcugagcgggcacugacugcucuuccagagguccugaguucaaaucccagcaaccacaugguggcucacaaccaucugaaaugggaucugaugcccucugcuggugugucugaagacagcaauggaguacucacauaaaaaauuuaagaggagagagagaaacagagacaggaacagagagagagaaacagagucagagagacagagagagaguaugagaaauaugcaggagaggagaugaaauaaagacaaagcugccaacuaggaauuacuuaaauaucagguugcuauagacauuauuuaaaacguucaagaggcacaggcagcccacgugaccacugguaaaagacaagcaaaaggcaguuuacacacauugcagcacaauagucagccuaggaucgaguuucugacauacccacuaugacagggaugaggccagaauguuucauggaguuucuaccaaggauaagcaucaugugcuucugcauauagaaggucccaggagcauuaaacucccugagagaaugcugaguucaauucccagcaaccacaugguggcucacaaccaucugaaaugggaccugaugcccucugcuggugugucugaagacagcaauggugcacucacauacaaaaauuacaggggagagagagaaacagagacagggacacacagagagaaacagagacagagagagaauaugaaaacuaugcaggagaggagauggaggaggguccaggaggguguggaggguugagguuuaauagggacagaguccacugaggaugguaacccucccacacugugacuuuuacccucaggcuaccaaggcccuccaggaccaccugggccaaacgcacuuccuggaaucaaaggagaugaggggagcucuggagcugcaggauucccuggacagaaaggauggguuggggacccagggccccagggccagccugguguacucggucuuccgggggagaaagguacaguguggggccggugcugugggcagagggcugcagaaccaacauggugcccuggucuuaacuguccugucuucauugcagggcccaagggugaacaaggauucaugggcaacaccgggcccucuggggccgugggugacagaggccccaaaggacccaaaggcgaccaaggauucccaggugaguggugccugggggugacagcucaggcuaggaugugccccauucucuaaagaguggagaggaaagccaggcgggcugcccgucaucuuagauaugguucucugcuccugaaaucacagcuucucuuugucuugcaggugcuccuggcucuaugggguccccaggaauuccuggcaucccccagaagauugcuguccagccuggaacgcuggguccccagggcaggagaggccuuccuggggcccugggagagauagggccgcagggcccuccuggagauccagguagagcucuaucuuugggcccugggaaaaggcuucccaucccuuuuucucugugcccaccucuguccucuucagcggcacaccacaccgcuaagaaaaauaacacccacuuaucugaugucucacaggcuuccguggggccccaggcaaggcugggccucagggcagagguggcgugucugcuguuccaggguuccggggagaccaagggcccaugggacaccaggguccaguuggccaggaagguaugugacagacggcugaugggacagaagcucugcugagggugggaacacccugcguggucugcaugggaggaacagaccuggcagaguugggacacaaaagcucccaagcccagaugcaggcucaacccaggccuggccugggcgcuguaaagacuguaucgucucuuaaaauuauugguacaugugcaagagggaaugggccaggagcaacagcaauuugcacacccccaaaagauuuguuuuaaucaacccaagcuuagcagcagcagcaaccauacuaagacaaaaacaccagagacuucaccagugagucaaaggacagugaacugcucugugguggcagcuguggucagccacggagacacacauucuccagcagggacauaucagacuuaguccugggcaggcaggggacugucaaggggaagggaguccuaagagaaagcagauauacagggugugucucagagagaauggugggcaacggggccaggcagcugcugauggccagacuagaugcucucgcggcaucuuggguagaacagggcccuuagugacaguuacaggaggcgggucucacucuuucuguggagcauucuaacccugaauaaucucgcucgcccugagaugcugcucugagaauagccauccuuggggaagaggccuagcuguaggggugguggcauagguacuggcucuucccugacaccucuuacccuaaggggccccaguucugcuaugcagcuggcucucccuggagaguauuccuguagccacugcgcuuuccgguccuuccuguacauguuugaugcugauguucuguugucuucuugaacugauuugggucuagaaagccugaggcccaagccucggggagaaaaaagaggcagaauccuaaacuaacugggaugcuguccucugcccuggcucccggggguuucacagcagcugaacaauauccacuuucucuuggucccuaggggagccaggccguccagggagcccaggccugccagggaugccaggccgcagugugagcaucggcuaccuccuggugaagcacagccaaacggaccaggaacccaugugcccugugggcaugaacaagcucuggaguggguacagccugcuauauuuugagggccaggagaaagcgcacaaccaggaccuagguaggcacugcugucaagccccaacuccguucccagguucgguggugcugacugugagauugugagccccagugacaagcgccucucagcugcauggcccaccaccuucuccaggguaggagaggcugagguggccauggagacagaaaucuuacuauacccucagccucaggaccccacacagggcuuuuaacuuaagauagcauccaugucucauuaguuagucuagccaagcacugcccuccccguugcuuuuggacucaaaccuaggaucauggauuuaaaucaauucuucacacagaugcaaaacaaacaaacaaacaaacaaaaauaccagucaugugugugugugugugcaugugugugccuucaaaggacaugagcaugaugucaaagaauuuuuaaaaacuacgaaacacacaaguggguggguaucucugccuaccaucccucagagggccaaagugcacauggaagccuggaguauucuguaugucaguguuagugacaccaaggccaucagcuccuagauguauaccaacaagaugcuaccacugugggcauuccugacuguggccccuuuccaacaguaaguuuuacaaugcauuggaaaaagggcaaacaagaauaggacccaaaacagccauaggaacagggggaugagagcaggccucagccccugcugguuugcugaggguggacccugucugaaagcuuugcagcaugagaaguaacacaugccccuggccaggcacagucagaguccaguucugugccucauggccgcacagcugagguggaggcagggcuauauguccucaugugcuccucacacaggacuggcaggcuccugccuggcacgcuucagcaccaugccuuuccuguacugcaauccgggugacgucugcuacuaugccagccgcaacgacaaguccuacuggcucuccaccacggccccucugcccaugaugcccguggcugaggaggaaaucaagcccuacaucagccgcugcucugugugcgaggcuccggccguggccauugccgugcacagccaggauaccucuauaccccacugcccggcuggguggcggaguuuguggaucggauauucauuccucaugguauguaucccuucuccauucucugagcaugguaccaaguggaaccuuccccaucuaccuccuagcuggggcacagaaaggacacauauuaaauaaaccagggcugaagauuugagcuccauggguaaaguuuggaucuccaagaaccauggaaacaccagugagguagagcuugccaugcuguaucugugccaggagacagacagugggaucccacucauucccuugcaggcuagacuauccaaaaagcgccagauucaagguccaacccccuucucagaagaugagguggaaaccaauugaaaacccgugaccuccagauaaucacauacacuaaucauaauuggcaauugcccaaguugugugucauacaagcgcaccuagugcaggaguggaaggcugucauucagcuggaccugggcugagcugugugcuaggcaaggggcuagcuucaugcagugugaggaucgauuugccacccuaccuuuacauacaagaugcaauguuucugucuuagcaacaaagucuacacuuucugguuugcugcaguuuaagugaauggaagaauucucuuucagacucuuucuggacuauagaacacuccuucccagcacgugcuggcuagcuggucucagcugcacccagccaugggacccuggagucuggacucuauuguacgcagagccccagcuccggugggacucacuccggaugaucaguuucucuguuuucuuuuacuuuugccuuuuuuguuuuugaaagagucucacucuuuagcccaacuuauccuugaauucuuggcaauccuccugccucagcuuacaaacaugaguuaccacuggugguggugaaucaugccuuucaucccagcacucaggagguagagauggguagaucucugaguuugaggccagccuggucuaaagaguaaauuccaggacagccagggcuacagagagaaaccuugucuccaaaacaaaaccaaaaaaacaaaaacaaaacaaagaaaaaacaaaaacaaaacaaagaaaaaacaaaaagaaaacaacaaaaacaacacaacaaaaccgcgugagcuaccaagaauggccuauuuugaguuguugauuuuugguuggugguugguuguuuuuuuucaucuacuggacaucuugaauggauaguuuaaccaaaauauagucagucauaucuacagauuguaucuacuucuugauuguggcuuucauugaacaaccagccauggaugcuaagguucaugccaugccugcaucuacgacacccucccccaacaucaggaccagucccuucagucacccugaaggcagagcacccuccccagggucuaugugacagauauuccuguuauugacuuagcaaacaagcagggaccaaacagggauggaggauguggcuugguccagcaugcacgaugcccugaacuuuaucugcagcacugaccaagcugggcacaggagcccaccugugagccuagcccccgggaagugaagguagaaggcaggaggggaagaguucaaggucaaccuaagccacguauagagucauguagaguuggagacuggccugggcaacaggaaagacuguuaaacccaggagugcuguugcgugcauuugauccaagcugcuggagacccuaagagaggagcaauuauuugagucuaggacuucaacaccaacuagggcaacauagugaguuucugccuugaaaguauguaauuagcacaguuggccguagugccuggguguuucgggcaugugaccucuaacacacuucaucuccugcucucucugcagcacacugcagccggggaugaaggcgguggccagucacuggugucgccgggcagcugucuagaggacuuccgugcaacgccauuuaucgaguguaacgggggccgugguaccugccacuacuucgcuaacaaguacagcuucuggcugaccacgaucccagagcagaacuuccagagcacaccauccgcugacacgcucaaggcuggccucauccgcacgcacaucagccgcugccaagugugcaugaagaaucugugaggcucccgcccugcccacggcagcugugugggaaggccacguuggugcuuauccuucuguauuuguuucaacuuuguuugagacaaugucucacuuuucaucccugccuagccuggaacuauguaaccccgggcuggccuccaacuuguggcaaaccuccugccucagcuucccagaugcugggauuaugggcaugcgccaccacacccagcuuggugcuuacucuuaacuuauuaccucagaugcugaucccaaaguugaucuuaguguuuucaaacuaccaaagcaauucugcaccagcacucauuccaaccgucugucagcaagugggcacuagcuccuccgggaucuaccagccuuggcucacagcccugcuaacacccaccuuggagagccaacaccuaggagcaacccacggaccucuccccauguaggacauaaacaucaugcuaccagguguccccaacaauagcugucucugugucccugugcuuccccuggcaacaggcugcucaccuuccugcagucuuccuaaaaugaggcagagucuaggggacagcaaaggaaucuauggccaaugauagcugagcucacugacccauuuccacccaaggaugcaugcagugugcuucugucuagaccugguuucuuggaggaggagaugauagcacuuuuuucuaucaaauccauaacugccaccucccaagucccuacguguuggccccugccuuuuuaagacccugacggcagcuggcacacagcucauggcucuagccaaacccacagcaaaggagacaucucucuagcccucaccagcaucugcuggaagguacacuuagcaaaucauugacaguggcguccuacaaccugugucacccuaaacaccucccuccacaaccuguucccugcggcaagcuguucuauggcuuuucuguguaacaccauaaauaaaagauauucuaaggacuugacuauguu

SEQ ID NO: 4291 - RNA, 18709 nt, Mus musculus
gugggugggcacaggggucauagcugggguccucugcugugggugagcacuggagauccuggcugggguccucugcugugggugggcacaagggguccuggcugggguccucugcugugggugggcacaagggguccuggcugggguccucugcugugggugggcacuuggagauccuggcugggguccucugcugugggugggcacaaggagucauggcugggguccucugcugugggugggcacuggagguccuggcugggguccucugcugugggugggcacaggggucauggcugggguccucugcugugggugggcacuggagguccuggcugggguccucugcugagggugggcacagggguuauggcugggguccucugcugugcgugggcacuggagguccuggcugggguccucugcugugggugggcacuggagguccuggcugggguccuccuucugugggugggcacugggccuucuguuuuuguuaauuguucugacucuucacagggagcgagaggcgucucuggauuccccggugcagauggaauuccuguaaguguuugggaagaugagaagguuaaacauuguguguguuccaagcaaugcauuuauaacuuaaagaaaccuuugaaaggagccggcuucccuuugucuauggcaucacgggggcgggggguguucagugcacucucucuccuccuggauucucgacaaacaauggacaaagcauuuccuuccuggagguuccuauaggcagggcuccagaacugaaucuacuuugcuaaaguugagccuuguuaaccgucaggaggauagagcaugccucacagaugcucugugaagagcaggucuugagaguucauuugccacaugggacaaucugaauauaaaauggcccagcaagugccagaauagaacgaaggccacuucugcagcuucugcagcugcccagacucuuuguaguagcugggcauaagggagucaaaaagagaguuauagacagggugugguucaugcuugucucccagcacuugggggggcggggggguuaaaacaagaggauugucaugaguucaaggccagccagagagagagagagagagagagcauggcuuguucaugagaaaaucucaaaaugcaauaaaaguguuuuuauaagcuaguuuacuuuaacuucuugugggagggaaaaaagcgccugacucacagggcucagccaacagauucccaggcggcuuccuggccagaccugagcacagggggugagugugucgaucacauguccugccagccucauucaucuaaggcugugguagaggcguggacccuaugaaccucacccguguucacagaugucugucacaccggcacgccucuucucucuuacugugcacacacaaagagggagacuuguccccagcuucacgaguagggcuagcuaaguaccaggaacaagauccagggaaggaaagucugcucuuuaccuccugaccaauaaguccugaaggaaguggagcagaaagaaagcagccaugcucagcagaacaugagcccagcauagccagguccucggcgucacccguagagugggcuccacugcagccuggaagaaagaaguaacagccucauuacgugggaucugaagaaaagggcagagugaagaauccaugcguuuucagagauaaacaaaucauaaaaacauuuuccacacacagccugagacuaaacugcccauuuuuuuaacuacuucuuggaacucuugcguuacccagccuggaacucgcuuaagauacaucuuugcuuguuuagucauucauuccuuccuucguccauuuugaguugucuuuuccuuggauuugugcuggggguguggcuuuugagaacauuucccacuguuuugugggucaauuacgugaaaacucgacuguucacacaccauucugcuucccaggggcauccagggcaaggcggaccccgaggaaggccaggcuacgaugguugcaacggaaccaggggagacgcggguccacaggggcccucuggaucugggggcuucccuggccucccugugaguauauucauggugugguggucugcuuagccuggaagucugagugaagggcaugugucagugugacugagccaaguauaaugugaccuugacuccacuucccagguucagcccaggagggccaccugccaggccuuguccuuguuaucauagcugugaaagcugcuuugccugcccacuuuuuccacugaauguccuggauucaagcacucuugacuguuagguggaagagaagagugacuugguguuauguucucacccacugucuucuaaggaacacgccaucuccuccucuaugcuaagucaaguaacaguggaugguuuaaugauacaacuaaaacuugaaucuugucccaguggcuauuaggcacugaggaguuauauuaugggauuccuggggacccagaaggaggucggauucuccagcaucuaccaacaggcagauacacaacagaaauacguuuuuaauaggggaggcuuccugcgguuguucacuuugugaccccauucuuaggauuuuugcaaagaauucugcucauucagaaguguauuugcaaauucagguuaggcuaacauuuugguuaagccuuuguuuucugaaaacacgcugagguguuuacccuucacugaguuggugucucuggcuaacggcuuccaccuccaccuuguagcgccugugcacgcccucccccccccccccgccaucucauuuuuacguggcuccauacucgugguuguaccuuaaggaaauuaguacuggaggugccuauguaacccauggggacacugggcacaguggacagaagccgauggccaucuguggucaucauggccaugcuggaagauaauggguucuucuguguuuuucuuucuuaugguauaucugcuaauuuaggggccccaaggacccaaggggcagaaaggcgagccuuacgcacucucuaaagaagaccgugacaaauaccggguauguuugccauaggugggaggcagaacucggucaucccauguaaacuguaacaaagccaguuagaaauuaacuccagugacuuaagaagcaaugcagggaaggaauuuacagauucacagggguaacaaggcugugauuaacuugggaucaucauauuucugugugggggugugcacagucuccccuuguucucagugucucagaccaaauaccucagucugccagggcuugugcaugccaugcuuguuugccacagaggggaaugaauccaaagaugcucaaagccagucaacucuuagggaaucaggagaugccucagucagcacaaggcuugccgugcaaauauaaggccugaguuaaagucccaaaacuguguaaaagagcugggcagugcccuauacucagucccagcacugaggagguagagacaggcaggucccuggguucaauagccauccagaguugccuacugaggaagcuccagacuaaugagagcugucucaaaaaacaguuugggugucuccugaggaauaacaucugauauugacuucugcccucacaugcaccugcaugaacucacacacacacacacacacacacacacacacacacacacgcgcauacaacauacacaacacaugcacacacaacacacacaugcauacaacauacacaacacaugcauacaacacacacacaacacacacuaguaauucuuaauuuaacccuuguuuccucucaaccagggugaaccuggagagccuggccugguuggcuaccaggugaguaccauuuucauuagggaauuccaugcagaacuuuaaaaacaucuggaguagggagggggcuggagagauggcucggagguuaagagcacugacuguucuuucagagguccuauguucaauucccagaaaccacaugguggcucauaaccaucuguaaugggaucugaugcccucuucugguguaucugaggauagugacaguuuacucacauauauaaaacaaacaaauaaauaauaauaaauuaaaaauauauaucuggaggugacacccccagucugucuguccucaagucauguucucauugucuguccacagggaccuccuggccgcccagggcccauaggacagaugggucccaugggagcaccuggaagaccgguaagucccugcacccauaacagcucaccuguggacauuucucuuccacccacugagugccacggagcaacaggcuaguucuggcuagggccccucccaucauguacagcucuucaggcuccauauuaacuauggggcuggcccaucaucccuagacaaagccuaccaaaugcuccacuaggucaguaagaaagaaacggacucuuucuggaccaggccaugugcaacaggugcaucccaccugggccauagccacuguagaaagggacacauuaaaugucacguauagagucccugaguggaggccacaggucaucccucccucccaacaucaugacacggaaaaguguggugggcuugagcaggaugagggaaagcucgccagagaggagaaggagccauucucagcagugagacaaauagccuuccaugacacacagagaguccagcuccaggugagcgaccgucucccagaacucgcucucagggugugugcucacagcccgagaggagcacacgcaauuuccuccagaccauaauagucuguuguaguaaugauucucauccuuucaaaacucuugugcaaugagaaagcccuucugucacaacacuguggcaggcucacccaagacaggaugacagcggggcgggaugcauacuguucucccugggaguggcugguucacuaauauagcaauagcuguguggcuuaggguuuuccucuaaauagagugcagaggggcugggaagguugcucagucagggacgugcuugcuguguaagcucgaagaccugaggcccauccccagcaccaugcaaaaaagccgaauauggcaucacacgccuguagucacugagcuggggagguggagacagcaggaucccugaaacuugcugaucagccagacuagcugaauuagcaaguagcaggguuagugugacacccugucucacaaaaauuaggcagaguaugaucgaaagauugaggaagaccacuggcccucacacaugcccacacaaacaugccacacgcaugcacacacacacacacacacaugcacacacuuccacagaaaaguauacaauauccaaagaaguacaguucagagaaccuuagaaugcacauaggcagcugcucacucuauggaaccgaccuauagaucuguucugcucaugagcauuugcaaauccaccaccaaaauguaccaguguccuaugggaguguccagggagagcagaggagucuggcuguggucacagggccugggaccucacaaagcuuaggaacaggcacaucagggacacggguaaagucacaagcccaaaacacacaagcaaaccaggaacagcuguggguagagagaaucccaucccaagggcacugaccccgccuuccucuuggcuuuucauccccccaagacacauguggggaagcucugaccaugcuggccuaaguggacaucagugauuuucccaggaccuccaagcagaugucaucugagagcugggagcgggggcagggggaaguccagcuuaugcaugucuuuguaucucugcagggaccaccgggacccccuggacccaagggacaaccaguaagucaguggggaagaggguggggagggcucuuugaugauuaugucugcauucuuugaccagagaacaacuuggcugacaaguguuucugguguagauuacgcuaagaacuauuguguagucuaagacuugauucuuaggaagagacucaguggugugucugaaaacccaucccaagcccaguguggggaugcuguuuguagccccauaacgucacugugacuaugugcaaaucacaccggugagccacaguggcagaugcgcagcugggcagucuagggcaacuccuauuuaacugcagaagccguuuuccaggcuggaaacaggggacacuguguuuguuuguggggaaugggagagccucguccuagcuggauacagugagacucagaaccuaaggucagcacuagggacauguccagugcuacugagucaggauagagagcagagccacaccacuuccaugacaggguacuuguuacuuuagugaagcaccaaccauggagucugagagcagagccaaguuugucauaaccugggaaaggcggacagcuguccaggcucgguaauguugaugaggaaaauaucugaucagagauccugggauccagcaggaagcuuggaagaaccuugcacugcuccauauccagaugcaggucuuccaguucccacgccugccucauaugcggucccauuucugugacccccggugaccuuggcugccacccaccuccauaccccuuaggcuucccuccccuccaacagaguuuccagcuggagcuagaacuugaggaggcuccuggauaccccccacauucacccccaucagacagcccuaagcauugugggaagggccuacagccaaggacagcggaagccggcagagcugcagggccaaggaagcaguggcccagcccaggcucuggccucagaucuccgcuggcugcugcaaauacaaacagccccccucacccugggccaaaucacuuccuggcaacuccgacaagcaucuaugagcaggcaugcuguagggacucacacagccgccaugcugugcugugcuuugauuucagcuccaagccagguggcgagggaaagcagaauuuaauuaaagguuuugcuuuuauuuuuuuuauuuuuucaagagauaucuaagcauuggaggaggcagauaguagacugcagagagaagcugaaggaguccugugugaugccugcucugcucgcuguagcaauagagacccugggaaagagcaugagggcaaaggaaagagcgccgugugaacaugugggguggcuccucacaucgauggucucagacggucgggagggcuaacuccagcccggcugcucccuggaggaacuguuagauaaacacuggcugagacacaggccugacuuugccugagaaaacaauccaaacagccacauaaauaugaaaugcagucaguguuaaguccccuaaaaucauuaaggaaaaaaaaguuuacaugaaguuagggugguuuuuaucaaaaugagaugaccucuagauagagagucugggccauuaucugggcugugaaagagcccagagccuguagaagagcucuagcccucccuuggauggccaagugcuaaugugacaggugacagcacccuuucagcucuccgcucgccccucgggccucccguaggcagaggaccaggagaggcacuuggcuccugaaguugagagaggacguggcuuggucucuuuucuucuaaaaacuacuuugguuucacugugauucuugauucuuccaaacucauacacaccaucucuguuuccagggcaaccgagggcucgguuuuuacggacagaagggugaaaagguaaggagaccgaugacaggaaccagugagcaucgcugcucagggugaccugagaacacaguuuacauacaaccauggucaaaugccaagucacccacaccccagggacaaugguggauuagggaagacaaaacugugaacagucuaggugggcagagaucccaacagggaccugugacuuccacccaucuucaggacuggggaguggagauguccccuaagaaugccuucuaacaugugggacccagagaagauuaaagggcucagcugaagcguaagcuggaaccagcucagggaacagaccacauggcugcccuggcugaauucacuaagggggaaaagauaaagaacaaaacacauaaagaugugaaguccccuacaaugaaauaucccacaguaauuaggucaaauaaugggagggagggccuggggagaggucacuggugcgagggaauggucucauggaagacuguggaggugaacuuacagucauccacaagaaggcauuauuacucagauacugauaaacacucggaagccuucauggguccugugaucucagucuuugaacaugcuacucaaugcccagaacacauggagaccuucgggagaugccccggcacuuagucugcugccgugccugccacaugguggcugagcucaaacuuagaguguuguuuacugguagaaacagcaaaagaaacaucaguuggaaucuccuguguuuaucaguuucugagagagaaaggucgugaguagggcauggggccggccauugcuacucaugugggccagugucugcugcuacagacacaaccgcagugaaagucuccucaagauauuuagucuagccuuggcucguuagaguacacagugccuuuugcuucuggugaccccagcaaagcccaaaucuaucaaaucuuuuguagccugcagaagcagguacagugugggaucauugguggccucugaccuugacauacuaauucuuaacaguugacaacggggaaggugguucacaucauguuagucugccauuauuucagugugguuauuuuauuguugugauacaaaguagccaugcaaagccaaaccaaaccaaaccaaaccaaacagugccugugguaagacugggcugacccucaaguucugugcccuccugauucaaaacugucacuuuugcugaacacucugcagggugacauaggacagccaggacccaacgggaucccaucugacaucacacuuguugggcccacaacaucaacgauccacccggaucuguacaagguaaagggauggucauuuccaguugaccuaggagaaggagggggcaaaggucacuuucuucauuuuuaugcaaacaguugcaucccaagacaggaaagagcucacugccaauuugguauccaugggagagaaccagaucagauuugcacaagcuucugggggggacuggacaguuucugucagccagaaggaggugcuugcgagcugcugaguccugaguauuaacagcaaagaugggccaaaggccugccaguccaaaauaccgugaagaaauucuauacugcuuuuaaagcuacuuuggcuugagguguuaguauguuccaacugccuuuuccuacgaagaccuuauuugacugaguguggucacuggggguccucugggcuggguccucccacacugggacacaugugggcacucgcauccaucuccaugaauacucagaagugccugcgcccuguggcuggugcaaauaacuagcugcucagauggaaaagaggaaggcucccaggucgggcacgucacaaaucgccuucugaaaauucuagaaagacagucccuguuugcauuugagacucaaagcugcagcauucagaaguuauugauuaccaggaauucaucaagauuguuugauaguucaucaaauacauucuugccucguagccuaagacaggaucgauguuuauguacugccgaugucaaagacuagagcguuucuuacuccguguauucuucacagggugaaaaaggagacgaaggagagcaagggauacccguaaguucaacgacgacuccuucccucccuccugcgaucgcccccucuucggggcuccuguuggaacgauggggugugcucuggucucaacccuuguguucuuguacacuucucuaugugaggaggcaucaugguuacaccgugcauuugauuuaaucacguggauacuuagcauuaucugaagcuguaaguggggaguugagggggcugggacggagucaggauggccucugcucugggcccggaggucacugccaucuuguuuauccaguuugacuaagcuuccuaguucuuccucacuguaguggugacugcggcaucccagguaaaggugaucagcucugugcucucucuacccccaucccgucacuaaggggccuaggaaggcugcagacuggccagugcuacccccaucccgucacuaaggggccuaggaaggcugcagacuggccaguggugaggucagcuccaggcgccucucacacucugguuucucucuccuagggcguaaucucaaaaggcgaggaaggcaucaugggguucccaggaauacgggugagccacguauuuuauaaccauguuugucugacugguuggcuuuuugcuuuuuaaacagauuuucuguuuuuagaucagucuguagguuuacaaaaaagcugagcaaaaauguugagauuuccaugguccuacccugggcacagccagccaguuagguauccaccaccagggauaucucucagauguguuugcuacaacccaugaacccauguuccccuggugcugaaguuuuuaaaacacugugccugcccaggagguuccuccugguuugaggccugacuaaucuuuguaacaaucugaggaaaguaucuaagaugcaaguucauuucuggacacccaaagaguccgauaaaaacgucucucauggggaggcucaucuguaaaaggaaggugucaucuucagagccaugagcgucaacagccaccucggcacuuggggcuggauuuggcuaccugggguugaauguggccgccugccccugcucuuccaaaccuugaaagcacaaggcugcuugacuguuguuggaacuugguugccugcccuaaaucuuuauugcuuguguuuucuguucaacacaggguuuuccuggccuugauggagaaaaaggagucguaggacagaaaguaagucuaauccgcgaaauguucugggacugaaaccuuguauauauaaccaguggaucucagaaagcagcacuuguccccaaagcucacgugggguguccccugcauccacaggcucaugacugauuguuccaacugucagagaccuuaguggagcauuaaccucugucucagcuucccucgcccaucuguugcuuucuccacagaacccaucccaggucucugccacuagguuccccgcccugggccucacacccugucauugucacuaaaagguugucagugggugacugagguuccuccucuauuucuuagagaucuacacauacuuugauacuugcuuguguuuaauaauaacccaguugcuuuucuccuguggucuggcaaagaaaaagaaacuguguaugaaaaaaacuuuuuacagguccagacaagauucagcaacaacuaaauaccagcugaagcagaaagcacacgaagaaaugcuuuuaucuaauuaaucacuaauuaacuaacucacaacauucauuguaugcaugaauucagccaaucuacugcagaguccagcaccguccugucacccacaguggacaguccuggggucuggcuuuagaucugugcaagccuccagggucaugugaccuagcaugcucaugacuugaacuugacaacgaaggaauucugagcaaauuuuugccauacuguccugaauuucauccaaugggcgagauguagggguuaucacacuucaauauauacacacccaaacaugucaggaagccacaggguugcaguacacacaugcaccaaauuuacucaccccaggauacagccauggcuccagucagcaccagagugcucacacagggugcucagggcucauguuuccaccaggcuguccugucagguacgccaaaagcagccucaaaacccuagauuccccugagcccugcucagaucgccacagcaaguagccacaugacacugaagagcccagaggcugaacuaagacagagaagcuauguggcuguuuugggauagcagguaggcuugccuccuggugccauggcugacauccguggcucuagcuagaggccagauucuggcauugaccauguacaauggagaccgccauuacuacuguucuuguuccuucuccuuguagauccuaaacucgggcuggaggccacacacuaacuagacccaacuuccuaucaugguaguucuugcuaagagugucccugaaaguaacacagcagaggcaagagcuguccccugcuccacagccaaggccagaaugccacuggcuuaaggguagcaaugagcagauucuguaucgacaacuaacagacagacaggcauuaggccuaaaggccagccgagucagagucaauguaugcugaggugggcagguggcacguugucaccuacucuucucugaaacagaggagcuaucacgucugcaaacauggcucagcacagcugccccuggaacuagaggcccaugaagacuagaauccaucuguaacucuagcccggaaucugacccucucuucugacauccauaggcgccagccacccacaugguacuggcaagcccuggccccuggcccacccccacccccgaugcugcuaccuagguacagcauaauagguccagcuuucucucuguaacuuggggagaagcagccaucugugcuuaagugggucaaaggaagaaauaguuuacccaacugcaaaaauaggggaacaggcagacauacacaaaugacucaucucgcugcauguuaguacaaaccacauuguccaaauggccagcugcugccucccuacgagcuuuccagaugugcuggcccucgggggccagaacuuaaaggcagcuccaaagagcugccugcgugcguauggugacccauuaaagcggcaugccaaagagggaggacucagagaaggccaugcucccggggaagccccagccucccuacaagaacaaagagccuucuucacaugccugugugcauguacauagagaggggaggggggcacauguggugacacacaggcauagauaccuagaaaaguaaauagcuccaggcagggaacaggaagauaucuugugcauuugguuguaucauauuuucugaaaaauaggcaauuauuuccccccucguuugggggaaaccuguguuuaaugacagcugaggcuucucccacccuggacuuacuauagagugugcucauggagaucugguuuccuggggaccgugcacuggccacagucuuuguguagugugaguguggggcacaggaaaaaagccaucucugugugugacaaggccacuggaccgccacagagcuguuuagacuccaggaaucacagcuaccaggugugauuuuccagcuacaugggaguuaggagcaggcagcaaggcugugaccacaagccaggcauguaaugacaucaucuuuaagucacaugauguugcaucuuccugcuccauggcccucuuaggcggauccggggagaagucguuccccagaggccccugaguugaauuccaugagccccaguucuuugccugagugagggaagaccuaggauccagagaugggaacacauccaaacccaugaggcagggccuccugcugagcauuugagacguucccugggagccuagcgguaaauaugcccuaguggugagcucccuagagcuacugagggccucugcuaguuacuguccuuaagggcuuaggguucucaaacaacauaaaaucaacugguuuugaacauucaacuccaccucgugugagaggaccagggucagccacagcccugcaaaagggggggaaaucagccgaccuuaguccaccaagcagcacguaggcuccugcggaucuguaaagccccuggacaggcccguuguuagaacccuggcuuggcucuggcagcuuugccaugugucaucuuuugaaagaagaaugaacgucucaggucuuacaugucuguccagcuuccucacccacugcacuggagaaaacuggaggccaaauuaguguuaaggguuuguuuuuguuuuuacugagaaggaaaauuccaaaucaacagacucugaggauucuguuugguggcaacuggagacuuucaaaacucauuaugaaggaagaguuuagcucauggagcagauguggcugcuacccugcaggaggagacgaauccugcacagugucuugcucauucagaugcugaugugggcaacggaaggagcagccgucccauuacacggucccaugggggcagaugggcacauccguagcgcaaguuacccagucccucaacacuaacaaccaagggaaaaauacuaaauaaaacugcaagguuaggaggguggggcgcgcuggaggaugucuccguggcugggaguucuugcugcucuuguagaggaccuggguucuguucccggugcccaguuggucacucagagccaucuguaacucuagcccggaaucugacccucuccucugacauccauaggcgccagccacccacaugguacacaugcauacaugcaggaaaaaugcucacacacauaaaguaaaguaaaucucuuauuuaaaaaaaagugcagcacaagggaaggaaaagcuguuugacaggcccugcaggccgaugccacaguugcuccugcuucaagcagaggggcuugaaaaauaucugugcauccgaaaugaggaaggugaacaugaguuguggggucauugaggggauucuugguggcugcauuggcugggcugguagaggugccaugggguugguuucuggagcccccccucccugcagcuagaaauaauaaccucacaucucccauaucucuauuccagggaagcagaggccuggaugguuuccaaggccccaguggaccucgaggacccaaggugggugacucugauaaugauguccugcuccuggcuuagacagcacggucagaggagacgaucccccuagagggggcuugcucuggguugcucagcccccucagcaugcccagugcagcgggaggcuggcuuuguagcaacaagguggggagggaccuccaguuccugauggaggguagagcuugugugguuaacccuaagggcugagaggaaagacaaggugaggugauccaggguagcuaggagaggacccggcccuguggguggcccuuccugcuagaggacaugucuguggagaucagggaaaugcguggguguaucuggagauuacaggaggcugcuccacagagcagauggugcugggcgucccagcgucuccaugcugccuccccccuuaaccagaugucucagacgucagcaccaugaaggucugagacgcagaauccuuguagucucccaggcucucuggcauccauagccccggcaagggcuucacggggagauccucacgugcugugguguuccuuuuuaugucugucuggugguuaggaugcagggacucccugcugccacauuguagagcuguugccauggggacaguccagguuugauugugagaaaacccacacuauuaaacuaacucuauauucugugcacuucugggcaauauacaaggcuauucucacaguguuuucucuccccaccccagggagaacggggggaacaaggacccccaggacccucugucuacucgccccauccaucccuggcaaaagguugguacaaacacuccaguguaugacguggccucacauggacccucuucugucgguaacaaagucauaagcucuccagacaaguucuuuaagugacucagagacagcccagcuucccuggagguuucaaaaggagucacuagaaauggucacuuugguucuggcugacaacacucaacuaccacccaggugugacccuaucugugagcaaggggaaugucuucauuucuaggggaugcacagggucuuguuuuuagcagccagaaugccacugaguccgcugaaaucacugaaaccacuaugugucuuuuugguaucuucugugccucgauauugucuuacauuuaacagaaucuuacccugcugggcugugaacugggggccccuguauuuucagcauuugaaagcucucugacucucuucuguauauacauuggacuuauugggaaguuggaugccugaaauggucuguagauggcacccuugcuacuaugguacaggcuuguuccuaggcaaugaucugauucuaacugaugggaccugucuugguugcaggugcccgaggugacccaggauuccaaggugcucauggggagccaggaagccgaggcgaaccgggagagccuggaaccgcggguccuccaggcccauccgucggagaugaagguaauggcguuucauagcaucugaacauaccuagucucuggauauggaccuguaguaggcuuugcuggccacguggcuuuccuguggcucuaucugucuuucucauggaguggucucagcucugaugagaugaagggcacaugcaacaguaaccccagcaagguuagauuaugaccccaaugggugauuagugauaucugguccccagauggaagaacuggggggggggggggggugucauccaaugaugucagcaaauggucacaaucccaggccauuguggaagcuguaaaaguugacaaguugugaagaaacguaccaaggccaucgccuucuucuguuaacuaaacccugaugcuuguuccugguggcaggcccucugugacaggaaagccagcacagcccuuaccuauggggacacucaccugcugaaaaugcucuuggauuucagauucaaugagaggccuuccaggggagaugggacccaaaggcuucucaggagaaccaggguccccugcacgcuaucuuggcccaccaggagcagauggaagaccagguccccaaggagucccuggaccugcaggcccaccuggaccagauggugaguggcuguguucaccuggagccuaaccaagcugguucugaguugauccagugggcuaaugagugaggguguggugggcauucccaggguccacacaggaacuagcauaacagcuaucacauccaucuguagagaaucaauggucccacagguccugcaugguaagcuguggcugcggugacuuagcaggaaggcacccacugugagcugaaaucccugugcuugggucucugcaagcgucuucuuccuuaacucacagcuccucugcucugcuucggcaaucugggucaacuucucugucacugcaaagccaaugucacaggagauagcuauugaugcaagaaaggaucgcugcauaaaggaaugguggccacugacagggggcacaggagacccagagagucuguauauauggcagaugaggaggaagguuuggccagccugcugucccacagcaccugacuuagccagggugaugccccauagcaucugggauggucccugagucagccaggguagcauuuucagguugugaugguccaugccauccuuaauaucaagaacgcuuaucuacugagugguaugugugccauagcuuugagcuggucauccacaaagcccggucucuucagcuauagcauucaguuacacauuagauguugaaaaauuccucaugggaacauuucaucugcuggaaagacuggcuuuugaggcacugaaaggaaauaugaggucauuuucucuuuccggaguaacaucgacccacuucuuuccaaaaugauuucaacucccugacaucaccuccagcagcaaucucuccucaagucguucuuucagggggcagggcaaccuauuugcucauggguaguguugggguuuaguuaaacuucaaguucagaggcuguuuuaauugcuuugggaaaauccuucucugcaccaucuccagagggaaaguuguuaguaucaucucuuccauagaaagaaauucuucuguaacacagacgcauaggaagccagucacuuugcuucugcucauaucccacaguaacauuuuaacuuaacaugagccuacuugcccaguucucuuucuuuuggaagauagcacauucguuugaaaaguaaguguugauauuuucuuggaugaugcaucugagcaaagcuaucuuuaauguuuucuauuaugcuaaagguaauuuuuaugauuuauauuuguuaauauugacaggaaaauauuuaucgaugacauguguaccauaaaaaugucuaugagccuguccuuccuguguguagugucuguaggguuuuccccacaugcgucaaaaacauaaacgauaccaugaaugaggacauugucucugucacucuauccuaucacaagcauccaauaucuucauggaugaauuuugcucacuaagugguuuacagcuucaaugacauaaauaaacuaacagaagcaaauagaucuagacagcaaccuguaguagauuaccagcugauaaggggauguaugcagaaaagggacucauguaagaaguuuaucaacuaaaaauguuaggacauccaguuuaagcccuucuugcauuguuuccucuuugagacacauuguuguuuucucugugcgauacauuguuaccaaaucaacugcuccuacagcaaacucuuaagugaaaacuagccaaccaacggccuuuugaaguaugcucauaguucggauccacccugaaauuaguacuggaaaccaggaguccuaccuugcucagccuuucucagaucugaaacguuuggagucuucucucagaaacugccuuugguccu

SEQ ID NO: 4292 - RNA, 2581 nt, Mus musculus
cauuggaaaccucucucccugaaacuauaccauacuauuuccggguucguuuguuucacuuaaaguaucuuauuucuuuaucauggaaaagggagaagacagaagcaaauuaaucgggaaaguccaagacgaaguuguacacgcacuaaaaauaauucacuaccuaucuuaaaaaugccaguacaggaagcuauuccacucacgugacuugcgcaccagccaagacucggcacuggguaaauaaccgugagucgaggaggcugggcgauuccaacucuacuucccagucgccuuacauccagcagagugguccaacgcucucugacucaguuuccucguucauaaagaagucgguaauagcagcggugcucaacucccaaggcugcuuuguacaccaaaggagggcacccugagggggacauuaaagcaccuaagaagcgagagucguacugaucggagaucucucccaggauaacccgaaucuucgcgaagacgcacagagugcugcugaacuggagauuuucucaaucggcaaagcaaggcaagugggaacagaggugcaaugaaugucacagcccaaaguggagaccccgcggcugcccacagacgacuccucgaccccgcagagccccgaagcccgccugucccggcggcgccgcccucaccugcggugucccauauggagauguugaaggaacgccacugcuucagguagaaggcgccgcccacggugcugaccguguccgggaagcgacgcuccauguagcgcugcagcagcgacguuuuacccacguucaugucccccagcaguacgaucuucccauccggcuuccgcauagccgcggaggagaugaccccugcgcuucucggucacccgcccaggaugccaggggacgcggaccccggccuccagggaccccgaacucuaguggcccuggccugagauccgaacucgaugaagugccaaagaggaagcgcgccacagcucuguaccggagugugaacgcagcccugcgaccacgugggugcccggccgccacgcccaccccacgcccccugguccgccuaggccccgcccccagucuucucccaagccccuuccacacuccccaucaccccugccucguuccuauuacucccuaucucuccuuccccaaauucccuuucucugccugcuaaaucucagccccacgcccaccccuccccauucuuucccauucccccucccucaaggaccguccugcguccgucccuauaaucccaaacuccguuccuccuuuauuuuucugcccuucccagagcccuggccccuaccucccgccccagcuccuucccauaccuucuccaagcccuucuccagcccagccagcccuuuccuggaaccccucuccacuggcccaacccacgccagccucccucuucccgcaccccugacucuagcagggcuacaguaccgcuuuuuuuuuuuuuuuuuacaguccccacccuuugaaagccuguaugucgccaaguuuggagccuaggaccuggguccuaaggugaaaguuccagagcgccuuccuucggacgcuccaguuccuccaaaagcccggguagccgcggagaggcccaggaccugguguuugucuagucacaggcucccuuggcucuguuucgcuucccagccugugcccagcgcuccuccucggugcaccuugguugcacccacacagguggagaguugccuggcugggaaagucccuuggaagucggcuaagauuuaagggagaauguggaugggucggggacaccgggaggugccugcuagguucgcuuuuuacuucugcaagaaaccuugaagggaaaacuugacuuugcauuugcagugacugcuagaaaacagcuucccuuucuccuauaacagagaaccccuaaaaccaaaaucuuccuccaggggcacaagcaugcagggaggcggaggagauauuuggggcugaguaaagcccacuagguccaggggagggaagggaagggagacgacucuccuaguagcuucucccucugcaggugcagagauuccaccgaggcgagauggcuacgccugccucaagcacccugccugagaacugaggaccguugcucuagggaaugcgggugggaaaguacguucuggggcguggaaugcucaccagcgcgugaaaccagcucccucuaagccccaggcuucugcuagccgcccaucccaccccaccgcauguccucccagggaaauuuaaguuacuuccaacuuacuaagggcuuguugcaugaaaguuacagggccaggcuggaggaguaaccagacgacaaguccccagaggcugagagagagagaaauggguucuguguaaacaucuaagcuaggaucaggggguggcaagagucccuaccccuaucacccuucgaggaucuucugguguugaguucuucuaauuuucucagaggugagacauccuaauuucaugauauaauagcugagagagguuacuucccaauggagauguaguuaaacagaaaacaaggaaaaccaaauacuuaaaaauaaaacaacaugaaagcccug

SEQ ID NO: 4293 - RNA, 2581 nt, Mus musculus
cagggcuuucauguuguuuuauuuuuaaguauuugguuuuccuuguuuucuguuuaacuacaucuccauugggaaguaaccucucucagcuauuauaucaugaaauuaggaugucucaccucugagaaaauuagaagaacucaacaccagaagauccucgaagggugauagggguagggacucuugccacccccugauccuagcuuagauguuuacacagaacccauuucucucucucucagccucuggggacuugucgucugguuacuccuccagccuggcccuguaacuuucaugcaacaagcccuuaguaaguuggaaguaacuuaaauuucccugggaggacaugcgguggggugggaugggcggcuagcagaagccuggggcuuagagggagcugguuucacgcgcuggugagcauuccacgccccagaacguacuuucccacccgcauucccuagagcaacgguccucaguucucaggcagggugcuugaggcaggcguagccaucucgccucgguggaaucucugcaccugcagagggagaagcuacuaggagagucgucucccuucccuucccuccccuggaccuagugggcuuuacucagccccaaauaucuccuccgccucccugcaugcuugugccccuggaggaagauuuugguuuuagggguucucuguuauaggagaaagggaagcuguuuucuagcagucacugcaaaugcaaagucaaguuuucccuucaagguuucuugcagaaguaaaaagcgaaccuagcaggcaccucccgguguccccgacccauccacauucucccuuaaaucuuagccgacuuccaagggacuuucccagccaggcaacucuccaccugugugggugcaaccaaggugcaccgaggaggagcgcugggcacaggcugggaagcgaaacagagccaagggagccugugacuagacaaacaccagguccugggccucuccgcggcuacccgggcuuuuggaggaacuggagcguccgaaggaaggcgcucuggaacuuucaccuuaggacccagguccuaggcuccaaacuuggcgacauacaggcuuucaaaggguggggacuguaaaaaaaaaaaaaaaaagcgguacuguagcccugcuagagucaggggugcgggaagagggaggcuggcguggguugggccaguggagagggguuccaggaaagggcuggcugggcuggagaagggcuuggagaagguaugggaaggagcuggggcgggagguaggggccagggcucugggaagggcagaaaaauaaaggaggaacggaguuugggauuauagggacggacgcaggacgguccuugagggagggggaaugggaaagaauggggaggggugggcguggggcugagauuuagcaggcagagaaagggaauuuggggaaggagagauagggaguaauaggaacgaggcaggggugauggggaguguggaaggggcuugggagaagacugggggcggggccuaggcggaccagggggcguggggugggcguggcggccgggcacccacguggucgcagggcugcguucacacuccgguacagagcuguggcgcgcuuccucuuuggcacuucaucgaguucggaucucaggccagggccacuagaguucggggucccuggaggccgggguccgcguccccuggcauccugggcgggugaccgagaagcgcaggggucaucuccuccgcggcuaugcggaagccggaugggaagaucguacugcugggggacaugaacguggguaaaacgucgcugcugcagcgcuacauggagcgucgcuucccggacacggucagcaccgugggcggcgccuucuaccugaagcaguggcguuccuucaacaucuccauaugggacaccgcaggugagggcggcgccgccgggacaggcgggcuucggggcucugcggggucgaggagucgucugugggcagccgcggggucuccacuuugggcugugacauucauugcaccucuguucccacuugccuugcuuugccgauugagaaaaucuccaguucagcagcacucugugcgucuucgcgaagauucggguuauccugggagagaucuccgaucaguacgacucucgcuucuuaggugcuuuaaugucccccucagggugcccuccuuugguguacaaagcagccuugggaguugagcaccgcugcuauuaccgacuucuuuaugaacgaggaaacugagucagagagcguuggaccacucugcuggauguaaggcgacugggaaguagaguuggaaucgcccagccuccucgacucacgguuauuuacccagugccgagucuuggcuggugcgcaagucacgugaguggaauagcuuccuguacuggcauuuuuaagauagguagugaauuauuuuuagugcguguacaacuucgucuuggacuuucccgauuaauuugcuucugucuucucccuuuuccaugauaaagaaauaagauacuuuaagugaaacaaacgaacccggaaauaguaugguauaguuucagggagagagguuuccaaug

SEQ ID NO: 4294 - RNA, 41856 nt, Mus musculus
gauggaugcggacccgcgcgggagggcagcuaucgacacgcaaagggaccaccacucccagcauccucggcgccuccacgcgccugcgccuuccgcccccaucgucccuuugugucgccucccggugcuggguuuagaauggccuggagacaaaggggcccccgaggggugcucuuuucagcgcggagaucuacggugggcgggcuggcgggagcagcucuucucugauccuaacuagcucuuccccucccugccgcaucugaggcugcccauguccucgucacacugaguuggcagcgggcaccgcagugugcuucccgcaggggagcacaaccuucagcuucccaucccgcccuucccccacagcugccggauuuagggcuuucugaaaagcccgggcagagcgagggguugccuaggcgacgggccccggcggucccgcccucuuccugccuaggcaccgcccuggggcggagccuggccuguggucgccacauucgcgccuuuguauggcugggacuguggugcggcuguccuauucgccccucugagucccagguccucaaucuugcucggccgccugggcgagagcgguggacccgcugcuguggccucaggugcgcagggcuggugauggcgcucugccucgccugcggugucugcugcgccgggucagcucgcagccuucagccaucuggaguuugccguguuucagccucaggcauucauccuccggcagaacaagacucaccgcuucagaacuagaggguguaauuggaaaggauuuggaacagguucaggaaacacugugaugcccuacccccuucggcaggugugaaaguacuccaugcaaccccgugacaucuacgacauuuccaacgcuguauaucuuaaauagagucuuguggagggucauaacgcagccagagacugucaguugaguuagaucguucagauugggucguuugcuucugaagcacagggcagugcauuucugcaggaggaaguucgcuuggcugucuggugcugguuuuuacuagcagaaccaacugcuuucagcccuagucaaaaccagaauaaugaaguuuuuccacguaauugccagaagaaaauaguugcacaaaaggcuaacugcauggcuugagaacacgacguguaauuaaguguggagagggguacagaacugaauaugaaauguggccuuuuccucagaucuuauaaccaguuuaaaggcacaauagcaauuaagaaacagguauuuuagucgcagcgugcguugggccaugaaugaacauuuaucuagguuuaaugaagauuaggaauaguugaccuuuuccaaagauaaccaagcuggaguuugaaccugguuaucuuucagaguuacauaugcuuuaauaaccauuccauucuguuuauugaauucauggacacacaaacccaaaagguauuuuauucaauugaccagaauuauuucacaagugccugucacaugcuaacuacaauguuuuuacauucuggaaauagauuggcaauuguguacuaauuagcuuuauaaacuggcuuucugagcaagcucaaaagaccaauugauaaaauuaacuuacaucaagcuuuuguauauuuauacuguauagaaaagcaaaggcuagggagauggccgaguuaaccugaauuaacccuugaaucuacauggugaaaggagagauugaacccagaucacagaguugguccucuggucuccguguaagcaccaugucccauguacccuccugcuccauacacacuaaguggauaaauacaauuuuuaggaaaaccuauuucuguacagcagagacuagggaagcaaugaacaucaccccaaagagagucuggcaaaacaugaaugagggacuccuugcaaugguuucuguuuggaggugucucccuugcaaggcuuuggggacacugggcaaccuccugcuaaaugucuacuuuucucacuucagggagccugagcugggcuuccauuuacagcccagccuguaacuacaugcguaguuuuguuuuaugugguuguuuguuuguuugagacaggguuucucugcauauccuuagcuguccugggacccuagcucuggguacuaggcugacuucauacuguaugcaggcuuuuugauuugauaagaaacaggccuggggccagcaagauggcuuagcuggaaaagaccaucaagcuugacaacuugaguucacucccugugauccccacaugguagaaaggaacacccccaauguguccucugacuuccacauugucauacauauauaaauacauguaauuuuuuuaggaauggugacuugaacuggguuuucucugcgguauuacugugauaaaucacccugauucaucaauucacccaaucagucugugcacaaggucaauacacaggcggagugcacgguuaagcaccagcgaguggguuauauuuaucauuuucugguuuuuuuuuaagaucuauuuauuuauuauauguaaguacacuguagcugucuucagacacuccagaagugggcaucagaucucauuacagaugguugugagccaccaugugguugcugggauuugaacucuggaccuuuggaagagcagucggugcucuuauucacugagcaaccucaccagcucauuuucuguuuuuuuuuuuauuaagauauuuuauaaucuguguauggguguuuugucugcaugugugucuguguagugugugcacgcagugucuguagaagccagaaggcagcaucagaucuggaacuggaguuacaggcaguugagagcuguggaugcugggaaucaaaccagaauacuauggaagggcagccaguccucuuaacuccugagccaucucuucagucccuacaauuuuuuuuuuuuuuuaaagauagguuaauacuauucuuuaggcuggaccagaacucccauggagucccagccuggucucaaaccccugaagaguuuuagcuugagccucccuucagguucuaggaucacaggugggagccaucacacacaucccacaaacgucugaaggacucuccgaaggcuuaacaaggagcagacuuuuugccaguugagguggaacacaugagagucggcuuugcagcagacagaaaacaccauuguugguuuugaaaucaugaucuccuguggccaagccaaacaugccagccauucaaaaucauggaagguuuggcucccagacuuccuagagcuguuuuucuaaacugccggccccggcucuuccccggcuucggcauucuggccugcggguucuggguuuuaaacaggcacaccucauaucagaggcaacgcuuucucuaucagggaucucacugccugcauaggaaguuuuggggguacuuucucaggccaagcuccuugcugaauuugcgggauacagcaaggaguucaauuuacaguuccgaacugaaggagagggacaagcucacacuuguaguccccaaacugggggagacugaggcaggaggggcuuaaagccagguaggcuagagucagccugggcuacugagugaaaccguugcucagcaacuggggugcaggguacagaaagagaaguucacauugccauagaagugagacaaauaagugcacacacauuuacaaugacaaacugccacgauggcagguaacugugaggaagaaugauauuccuggagaacuugggacauuuggagaccacgaauuugacuaccauagugcauagaacacagucuguauuaccuggaagucuagcuucgggcaagcaguuagaggacagaacuuucaggaaaaaaguagggaacaacaugucugccuaaucauuugccuuucaagagagcaucaaagaaaggggggaggccgggcgugguggcgcaugccuuuaaucccagcacucgggaggcagaggcagguggauuucugaguucgaggccagccuggucuacaaagugaguuccaggacagccagggcuacacagagaaacccugucuccaaaaaccaaaaaaaaaaaaaaaaaaaaaaggguggggaagaccaaaaauacugaaagaccugagcaugcuuaguaucagacagacuugacuggacaagcaaaggacucuuuacuuuuguaagccaccaguaggggugcauuuguggggguaauuugaauguaacuccaaacaguccucaagagaugaacgauagacuucugcucucguuuucauuuguuuuuaaggcagggucucuugcagcugaggcaggucuugaacucauugcugcuccuguaucucucucccaaaaucuuugauuaucgauggaugccacuauuuugacucuaaaaaguuuuaaaugauuuauucuuauguguaacgguauuuuugccuggaugucugucugcggaccacaugcauguagugucugaugaguccagaagaagccuuggccccucuuggaacaagaauuacaaacuuuugaguagccguguggaugcuaggacucaaacccggguccucuggaagggcagucguuucuccaacaggcauuuccaguuacagguucuugaggaaaggaucauuuccuggugugguucuuucauucuaagcccauagaacaguaagaaguacacaaauacugcauguacaggguugcagacagcaguuugguauguaguauugaucuacacguacugauuguggcaagguacauacuugcagauaugcuguacguaugaugggguacaggguguguuaaggcgcacauauugagguguuuaaaugaggacaugaugaccgcgggaugguguauaguguguuggaguggugugcugagauuggguacauauugcggggcacaccgggucccagcagcagacacaaugauguacaccgagcccaaguuacccauaaggaaaggcgaggagaucugcgcuaaaauggggaaggguucgaaguucccgccucucuuccgcugccaccgugcccaaaugccuaaauauugccagacuucaggcagaguguagccucuuccgggagugggcggagccccaugaggaacgggcguggcuucugguucgcccggcugggccuggccugcaggaucuugccuuccgccuguucgcuggaucuguccccaauaugcugcgggcgcgcgggccugggcccggcgcucugcugcuccgggccgcgcugggucucgggcggcgcgggcggucauggcaacggccgcaaggccaggacaccggcgugcaggugcauaacagccucacuggcaggaaggagccgcugauaguggcccgcucggacgcagucuccuggugcgugcgccgggagaggcagggcggagcgaggcggggcgggaaggugcgcaggggcaagucaauucugaaagccugacguggucucccgagcgucacuuaaacaccgcgcguguucagugaagguuguuaaggaagacuuagggcuccuuuuacauaucucacaugguggaucuuaauauguucccagguauagcuguggaccgacuguguacgaccaugcacaucuuggccaugcuuggugaguuuccuagauuugaaccuuugacaaagucagaggguuauuuauugugcaaagaguaaacuguuagcuuguuuuauaaucuguuaagugaacugagugaugauugcauucugggaauugugagacaccggaauguuggucucuuuggucuucauagcuguuuggaguugcauacccauuggaguuacugugaaggaauagagagugacccguuugcgaauuagauguuucuaagguugguccagagacccgaauccaacagugggggaucauugccuggucuuggacggaucacauucuugcuggaaucaugguucuuauuuugagugaagacagaaaugacaacaugacaucuucauggcaguuucuggaaaugucuaugaagugccgcuuagcacagcgcccccaaguguucuaagugcuccaccacugacccacugaccgaauacugucuugcuagacuccagggagcauuggagcaguauuuguugacauuucccaucucuugauauuuuaguuguugucuugcacuuuuuuguuuguuuguuguuuuugagacugaguuucucuguguagucuuggcuguccugaaacucacuuuauagaccaggcuggucucaaacucagagaugucccugucuuuguuggaaugcugagauaaaagguauacgccuacugccugacucuugcacaguuuuaauuggguauuuuuaaaaagauuuauuuauuuauuauauguaaguacacuguagcuguccucagauacuccagaagagggcaucagauuucauuacggaugguugugagcuaccaugugguugcugggauuugaacucaggaccuuaggaagagcagucagugcuuuuaaccacugagccaucucgccagcauccuuaauuggguauuuuuagaccuaaaugaaacgcaaguguggaggccagaggacauccucagaugucauccucaagugcuaccuucugucuguuuugagacagaaucucucacugccuuggaaguccacaaacaggccacgcuggccgggaagcucguccccaggguccaccugucucugccuccagcacugggguaguggggacaauccgagagaacaagagugguaaaaagcucuuguugcuuggcagugguggcgcacaccuuuaaugccagagcucuggaggcaaaggcagguagaucucugugagcucaaggccagccuggucuacagagcaagcuccaggacagcuaggacuacacagagaaacccugaccuaaagcaacaagaacaaaacagucuugacauugaguuuuguaucaggauuuuuuacacacuuaaauacaugcaaacucauccaacagcuuuaaucuuaaaaaaggcaauacagugucccaaacugaugugauugcuuuuguugcgucucacaaggcccuucugggccuccaggugggacccaguuuguaagaaaguacuuggcuuaguucccuaugaaccaagcaucaacuguagaacacuguuuggaaguuacauaguagcguguuauacuguaacccauuucuuuucaagaauaaagcugauggggcccacaagauggcucccuggguaaaggcaccucuuguaagaaccugaugaccugagguugauccccaagauucacuuggugaaaggagagaaccaagccccgaaaacuguccucugaccucaacauacauucugcacaucugccucuccugugugugugagaggcacacauacacacacacacacacacacacacacacacacacacacacacagagcauucauaccacagacacuauaguagcaguaguaaacauuguguccuggagagaugauguaaugcucagaguacuuguuuauagaugaacuaaguuccucccaucacccacaugauggcucacaaccgucagaugcacacauggugcacauacauacacacaggcaaaauacaugcacaugaaauaaaacaagauaaucaaaaauaacauaauuuuuaacagcugggcaaugguggcgcacaccuuuaaucccaguaguugagaggcagaggcagacaggucucucugaguuugaggccagccugguuccaggacagccagggcuauacagggaaacccuguauggaaaaccaaaaaacaacaacaaaaaaacuagguuaaaaauaaaauacuggucagguagugguggcgcacaccuuuaaucucagcacuugggaggcagaggcagguggaucucugaguucgaggccagcuucgucuacagagugaguuccaggacagccagggcugcacagauacagagaaacucugugucgagaagccagaaaauagaauaaguaaauuaacgccguugauucuguguguugaagacagccuggcaguguuuuucuuucagcuccuauguuagauuugacauuauccggaggauccugaccagaguguuuggaugcaauguggucauggcgaugagcauuaccgacguggaugacaaaauaaucaagagagcuaacgagguaagcagccucccucacauugaccggcaagccgguggcugagcggccguucccugccgaggcuacuuucauguauuccuaguacuugugacccuuuaugugucccgaagacucuucuccaaaaaaaaaaaaaaaaaccagaccgagaugguggcaggucccaccgagggaaguuaagucaguggagagcggagaagcacccccuccagggguguccacuguccucugacccuuguccccgucccucccugugaugagugccucacuccagcucuaccaagacccccugggcccugacucuggccuuggacaccccuguguuccgaugccucauuuccacauuucucuuguuuugcuguuagacacaagcucuuauccugucgcccagguuggccucuguagcucagaucagccucgccuagggagugcugcagucuugucucuugaccaccaggaggugcauaugugucccucaccaucacagucuugggaacccagagccacggauggugugggccuuggagugggcccauagccccaggcuucugacuucagcucugugcaggcagggccuucuuauggugugcaugcauggccucuacuugaggccugcugcagagagcaugucuuuccgcacagguugacugccuccucggucugggccccacaccagcucugaagacuuggugggagagagguaguuaucccaggaagcaagcaugaggucaggggcucucuggguucuuccacugauugggcauugugcccugaaugccacuaucaccagagggcuuucccuuuucagugaggagacauuuucugaaauguuugugggauuuuuguuuguuuguuuuggguuuaguuuuucuuucucuuucucucucucuuuuuuuuuuucuuucuuuucuuuuuuuuuuuuuuuuuugagacaggguuucucuguuuaacccuggcuguccuggaacucacuuuguagaagaggcugggcucaaacucagaaaucugccugccucugccuccugagugcugggauuaaaguuuuaugccaccacugcucagccuguguuguguuguuuuguguuauguuuuuguuuuuuuuuuuuuuuuugcaagguuucauauagcccaacaugucuccuaacucucuauguagcugaagaugaccuugaacucuaaacuccacccuucaaccucccaccuuccaugagccgggauuacaggugugagcuaccacacccgcugcucuucuggaacuuucugcucauuuucacaccugaggguuacugugaaacuguccaguccuuuguguuucugaagccugugggacauuaauaccucccacagccucucuuuccuccuuuauuuuugagacugaauacuuguaacauagaccaggcuggccuagagcuccaccugccuccuccuccugugugcugggauuaaagguccacacccggcuuugauuuucuuaucuugaaucugguggaggucugaagggaagcugaccucaguggugggaacaggccucccagaggagucuugggagaccuuugccccuuggaacauguguggaaaccccucaugagacuucucuuguguccagcuccacagugggcagcugcuaucucauucccuggccuuugugaagagcaccuacugggggacaggcucgggcugccagccgcaggcgaugggaacacugcccaugaugauaucaagauccacccacauuguagcaugaguuagaaguccccuccuucucauccucuucuuuguuuuuguuuguuuguuuguuuguuuguuugcuuguuuguuuugagacaggguuucucuguguaguccuggaacucuguucuuguucuguaggccaggcuagccucagagucacagagauccaccucccucugccuuccaagugcugagcucaaaggccugugccaccaccacuugucaauaccuucuuguuuauacaugugcauauguguuguauauuuccuuucucuggacauagccauuacuguugugaacaagagcagcugggaucaccuuagcacgggacucucuguaaggucguucccucuaacaugcccuccugggggagaagggaggcccucccaucucuggagguccccaggucucucacccugacauugcugacuggagcaggacccuuuguuggugcuucugggcaguaaguuaugcaggggguuucauagugcuuggcgagucacccgugguccugcuaggggccucgguaaacucacuggcucaccuuggacuugaauauaaucuucccuuuggcccacaccuucucuguguuucuuucugucuccccacuagaagucacaugacacucugugugugugugugugugugugugugugugugugugugugcaugcaugcauacacaggacugauguuugguagguuuuaugcauuaucccaagacagacagcuuggugggaauuaaggugucugugcccuucucccuagagggucccucccuccugcccccuccuccugucugccucccaucuaaggcccauucugcccucugucagacaaaggcugcggcagucagacacuguuguacagagcuuguauaaacagaugauggaacauccagaguccagaaauacacauaguaauuaauggggguuuguuuuaugauaaaagauggcauuucaaaucacugggguugggggaggcgaaucauucaguaaauaguguugacaguuggguagccaucuggagaaaauacaaacccaaguuagauacaguccacacagccgacuuaaggcagaugagagaugagguauaagaagggcagagcccuagauuucucgcagaaaucccaggaugacucugugccuucccaaggggaaggguuuuucgguguguuuccgagugcagauccauuuauguagggagacugagaaauggaaaugauuggaaaauauaaaucaaguuuucagugugccgugaaugaccauacaguugagacacuggaaagggggagcuggagagauggcucaguggcucagagcacagagaggaccaugcuuugaaaccccacccaccaccucccuccacuuccacggggcaggucuaccaucuguaacucacuuccaggugaucugacgcccucuucuggucacccugggcauugcaugcauguccuacacagacagguaugcaggcaaacauccagacacaaaauuuuuuauuuauuuauuuauuuauuuauuuauuuauuuauuuauauguaaguacacuguagcuguccucagauacuccagaagagggcaucagauugcauuaaggaugguugugagccaccaugugguugcugggauuugaacucuggaccuucggaagagcagucgggugcucuuacccacugagccaucucaccagccccagacacaaaauuuaaaaguuaaaaaaauaaaaaggcaugguggugguggcgcacgccuuugaucccaacacuugggaggcagaggcaggcagcucucugaguuugaggacagccuggucuacagagugaguuccaggacagccagggcuacacagagaaacccugucuugaaaaaagaaaagagacuuaagagaagugaugaaagaugaaagguaucaagaucaaaauaaaaaugaaacucaauaggaauacacguagauuuguacagaaauagauguagauauguacaguaccacaguggguaaauagaagggguuugggggcaucuggacguguguguuccuacuuucucagaauuaggagggggaaagaucaaagcagaaagcucuuugggaguauguugugcucuacagagggaacauggcugcucucagagccaggggcucaaucucugcucagcgacuaugcggugcuuguauaucuaucucaucuggacacuccaucuucccagcagucuaaggggcuguguugcucagugaugguccuggggccacagaguuggaaagaaguggcagccagcuccugggccacacccacuguccuugaagucagucucagugguuguggcuacugcauuagagcccugucagucuguuggccaccaggcuccaccggugccacugagaaacuugacagggauuuuuuuuuuuaagauuuauuauuuauuauauguaaguacauuguagcugucuucagacacuccagaagagggagucagaucucguuacaagaugguugugagccaccaugugguugcugggauuugaacuccggaccuuccgaagagcagucgggugcacugagccaucucaccagcccuugacagggauucuugaugcuccagagcagaaaugucuuauuucaugaaaaaggaaauguguuucaagagauaguugggugugcuuuaggcaggcccagcacacaguaggugcugcauaaaugcuuguugaguguagguagauuguggaaucuuauacaaguuguguaugaagucugcuuuguuuguuugaaacaguuuugcuauguugccuugguuaagguggaacucacucuguagaccaggauaaccuugaauucagagaucugccugccucugccucccagugcugagauuaaagccauuuacuacuuaggcagcccucaguugcugguaaccccucagcagggguggagccucaccuacuccucccccauccaugcugggaucaguuacaagaaugcugcuucugggccagaacgucuguguccccugcucugcucuuacagacccaggucccagcacuaaaggccugugugcccagauguccuccuguggcagccaccugaagguucgggagcucagguuagccccauccgaggacaucgguacccuuccugauuacuguguccuguucccuuuucucuaaggcuuuuuuaaaaaaguuuaauuuuauuucuuaaccauuucuucuugcuguggcuaaggugagauaggaacucauuuuuuguccuuuggaguagaugcuugcugcccugguggagggugggggcugguuuaucaugugguagaaaugaggcuguuacuuacccgcugucugcagggguggccuggacugccaccaggggucuuugggucuuccagaugugcugauguccuugucugaccucuugcagaugaacgugacgcccgcuucucucgccagucuuuuugaggaagaauuuaaacaagacauggcagcccugaagguaagcugugguuuuuacacuuuguaaaggggcagugguagcugucccacaugaucuaaagcagucaguugcuagugccugcauccgggcccugugguggcaagacugaagaaaggagcagaucuaggucugcagagugggcccugugaugagcuuagugggaggagccccggggcagcaggaugagcuggguucuucuccuuagggccugaaagagcuugugugaauaaguuagucuguacucuugccaggacgccaugguuuaucuuacauuccuaucagagucgggcacauuccuggcaccaaggucuagcugucuggcuccucguuccccuccagugccugugucuguugagagucgguagggaaacaacgcaggaaaagccaguuggcucacugggggcaucauggcaagcaugacuuaggauggccgccgcccccgucuugcuaagucugugcguggaccuugagcacggaaaucacccguggugcccacggucucugcuuccucccagguucugccgccaacuguguauuugagagucacugagaacaucccucagaucauugcuuucaucgagggcaucauugcucacggccaugcauacucgacagcuacagguuagcaugaagguuaaucucuggggggacgcuggggagaugugagaugcagaguaugcccaggcugaggagugcagacacauugccggcuggguugaugugggcuuggugcugggucugcaacacugguccaguucauuuuuaaaacauuuuaauuuuuauggauguauuucauuuuuauggauguauaugugugugcugaugugugcucguggagggaggcagccaggggcugagguuacaggcaguugggagcugcccgauguggguaucaggaacuauauuuggguccucugaacgagcaaagcacucucagccacuggucgcuccacccagagucuauucuuuuuuuccagauuuuaaauuauguaucucaggguuaggguuauguguguuauaaucaugcaugugugcaugggcuagugccuauauacacacauacauugggagaucagaggaggaugucaggugucuuccucuaucacucucuaccccguuuuaugugcauacacacuuguguguguguaugugugugugugugugugugagugcaugcgcgcacacucgaguguacuguggguauguuaagugcuaugaaagcaguguguauuuauucaggccacucagccaagcaguuagaagaagaaggcucuaugcagaguauucacagucugcagagccacuuaaccagauaccaggugucuuagugaggguuucuauagcugcagcaaaacaccaugaccaaaaaguaagcugggaaaggaaggguuuauucagcuuacauuuccaugucacuguucauuauugaaggacaucaggacagaaacucaaacaggacaggaaccaggaggcaggagcugaugcagaggccauggaggagugcuacuuacuggcuugcuccccauggcuugcuuagacugcugagcuaccaggaccaacagcccagggauggccccacccacagugggcugggcucucccccaucaaucacuaauaaaaagcccaguugcugggucuuacggaggcaguuuucucaccuaggcucccuccguucagacaacucuagcuugugugaaaacguaaggccagccagcacaccgcauaaagacaaccuggcaugguucuaagcaguuccucuauuucaagcugguugccugcccugguuggcagucauuauacugggagaacuguggaagaugcugccuucgccuccagacacaagcggccuggacaccagguugccugcuguguggccgccccccaccccccccagcaucuucacuagcugucugggagcuccuuuuuuuuuugguuuuucgagacaggguuucucuguauagcccugucuaucauggaacucacuuuguagaccaggcuggccucaaacucagaaauccaccugccucugccucccaagugcugggauuaaaggcgugcaccaccaugccuggcuaccacaaaacaguuucuugagacagacuccuggauagcuucccgcucuccucccacauguaauauguggaaaagcaauugcaacacgugugcugagagugcaugcgguuaggagcugaccgcauggcuaguaagguuccuuucaucaggaaaacagcagcauugcaguauuggcaccgagguaccacucugcaaaaccaucuuagcaggggugacaccaaaaguuccauggcgguggcugagcuugucccuuaggaggccacccagcauuucuucauacagauucagcuuggaucauuagaucccagguuguagagcagggaccugugcuugaaccacaccaugguagccaccgcucccccccaccccacuuccugagagggucucucgcuaagccugaacuuucagcuaggcugacuggcugacuggcgagcucccaggguauggcucucuuuaucccaagcacuggagaugauacagguguguggagccacaccuggguuuuauguggaugcuugggauuugaacgcugguccccugcuuuugcagcaaguacucuuaccacugggucacagguacagggccaaguauggagccagguccuugccccuggccacauauccccuagagccccgucucacaguggagggaacgugccagggcuugcacacaggggaagcacugacguuucuauguugucuacuuuggcauauuuagaauuuguccccaaagaaaccauuugagaaaacugagguaccguugcagcuuauuccagugcaggguaacuguuguugggguagaaagugaccauggacuucugcuucagagaacacaagguguuuccuuggcugcuguucugcaggagugaaugccgucugcaugugcaugcaugcauccguccgucugucuguccgcccauccugucuucaaaaacagcaucucacuguguaguucuugcuagccuggaacucauagagauccaccugccuuccuucaaccuaccuucgccugccucugcugggauuaaaggcuugucugugcuaaugauacccugccuuaggccuuguaguccugcauguuacuguaaauuuaauucagaauaucuuauguucacucaaacugcgguggcuugggcuuugugacaguuccauggggcuuagcugcagugugaucuuugaacuacuugugaaaacugucuauucagcaaacuguuaacuucagcaaggcaagcgaaggaugcuugccugucugcaaagcaguuucuuuuugagcauuucagaguguguacauauaggagguagcucaccuggcccuagacuaacccaucuccacucugccuguaucuggggcuaguuggccugggugugaggguaggggucuagcucagcagcggacucugcaugaccagggcacuaaggagcaggucaagaugcuacuugguuagcuggcugugcuuucaaagccacccgaccuucuccccucccugcagaaaccacugucuccccaaaagcucagacuaaagcacgggcacuuguuugugucugccaagcacagaaccaccucuaucuuaaaaucccguguguugaaggcagucaguguucccgggaaggacagaacagguauaaaucaguaagcagagagauugaggaaaagggagagagaaacaccuguaggguugagaauugcuccuguacaugcuuucuaguggcagucauggaugguggccuucagaugacuucagggagcacccucgaaacgcaccgcuucugucagcacacacuagccuggaucacugcccuccugggagggagcuagauugcaggcuggguguggaagcaguuagugcuguugccggcuucagcucccccgcgcccccuccuuuuuuuguuuguuuguuuuugguuuuucgagacaggguuucucuguauagcccugguuguccuggaacucacucuguaguccaggcuggccucgaacucagaaauccaccugccucugccucccaagugcugggauuaaaggcgugugucaccauugcccggcucccccagcuccuuuaucucaugcuucuggaaguacacccuggucugaggcuguccuuccugguagagguucuuucauucagucugaagaaguggauggucauaggcaucucagcagaacaucucaggggcacacgcagagaguaggcaguguugguguagaaguugccugggcagagauuagugucuuugugugugugugucuuuuguuuauagauaguacuguguguggugcugugcauacacguguguguuacaugugcaugugugugcacgugugugugugugugugcacaugugugagccugagguagauguugagugucuuccugucgaccuuagguuugagauagggucucucacagagccugaagcccaucgauucagccaggcuggcugcccagugagcuccaugggucucccgucucggcugggguuacuggcauacacucccaugccuggcuuuuuaugugugugcuggagauuugaacucggguccccauucuugcauggcagacuccuuauugacagagccaucucuccagccccaagaauagugucuuuaaauuagcaugcaaggaaaggcugaagaacugaguguggggguuuuuuguuuguuuguuguuguuuguuuguuuuucaagucagucucucuauguaaccuauuguuucguuuuguuguaaugauggagacucuguguagcucaggguggccuuggacuuguuuuccugggcuuauuggcauauccuuuuaaggcuuuuuauucccugcccccccaccuccccgccucccucccuuccuucucccuacuaacuggaccuauggaaaccuuuugcagagcccgcucaguguguucucagguuaugcagugcccggggauuguuaaggaggcgggcugcucuuuucuguucuggccugaugggaccaagcaccauccucugugcugagcuguagcugccuguuaccguuagacuucgcuuuaccguuagacuucuuggaugugcugccuuggacgggaggcacuaaacucaugacucuaucaaacaggcagcgucuacuucgaucugcacgcccgaggggacaaguauggcaagcuggucaacacgguucccagugccacugcagagccagguaggugucgaugugugccccugugggccucagccucugagaguuaggucuggagcugggcaggcaugggcugccuuuggguccuuaacccugcucuggaguuaaucuguuuccaugaacagaugagacuugcaaagacaguuugaaugguaggucagcaucccaugccucuguccugcucuuccccgggccauguuguuuguucccucuccuuguggaauuuccuuugcaugggacauguaugcaugccauagugagacccucgucuacugcuugcuguuauauacauaacagaaguucccaagguaagucugucuauuccugugucguuugugguuuaacaguuuguuaggucaaaguagucauuuuuuuaugaagaagaagaaauaauaaauauguagaacuagauguaaaccauuaaggauccugggcauggcagcaggugccuuuaagucacugcuguaacucaugaccugcacguggcucccuggcuacuuuguauccccauagcuucuguaacauuucucuuguauuccucccccacuuugccuucugcuguucuuugaaagaaccaucucugguuccuguuugcucagagagacuuuccuggcuguguuacacggccuuuccucuaugccaugugcuuccuucuucauugguaauuaguuuacaggcuuaggcuuagucuaccucugagugucuguggauagaaacuuguggaugacacaugcaucacccaucuaauuuuuauuacuuuuuuuuuuguuuuguuuuuguuuuuguuuuuucgagacaagguuucucuguauagcccuggcuguccuggaacucacucuguagaccaggcugcccuuagaaguaacagagucaaaccaagugccagaaugugccaccauacuuggcuuaauuuaauuuguaauagccuuguuuauuuggcucucagaaauuauauguuacuuuuacccaaucaauagccaccuguugagccuucucucuaacaaagcauucugggaucuccauaccuaugggugguggguuaagauaggcuuggguugugccuugcaggaagagggcuuugggagaguugcaaguuuuggcagaaucaagcuaguuuggugauuugaauuugauugugaacuugccgcacggcagagggagaccuggaccuucggauccugcuuuucucccccaagugcuggggcugcagauguggcugcagaugugggccuccaggcccagcuuuugauuuuaucuccacaugaugugcuuauaaaaagauaaagagaggagggauauguucuauggauguauggugaguuugggggaaggggaugucucagcaggcccaugccaaggcaucccuucccugagggaccagcccuccgggauauaguauagaauggaguuuauucagggcauggggaggggaguuaacaggguaguagaggcagagagagagagagagagagagagagagagagagagagaacgaacagaagaggaguagaggcuggccaugagcacauggagagaggggggaagaggcaaggggguagagugggagcaagaagggacgagcaagagagggaggaggagacccuuuauagugggucaggccuaccuggcuguugccagguaacuaacugugggguggagcuuagacagaaugcuagcaccacaggcuuuguguuuucagugccacugggguucauagcccaacaaagggaagguacagaauuccuauuugaccucuucuugcucaguccuuucauccccuagagcagucaggacaucaguaagccccaucccgcuaguauguaguucauguuagcacgccccuugggauugagagucugugcauuuggguaaaugccccgugucuuguuccuauggcccagucauaggaacagugcagugguuuccagcuucaagaccaucugugcccaguuuuccugucucugcuaccucaaacccgagugaccuuuuuacuauccagaacuuuguuucuccagaguguugcaaaguuguacacauucagcagcagcuuuuccagguuggcuucuucccucagucacaggcuuuucuggcuuuauggagacagucuuguuugcuacuguguagcccaaggugccuuaaucuugaggaggucuccuuuccucggccuccugaggacuggacuuaggcaugaccacccuggcgagacccuuucaagcuuuguagaucuuugcacacuucaguagcuuggcucucacugguacuaaguuacggaugcucucuugucugugugccuacugucugugugcuugaguuucuuugaaguccaucuugacugcguccauauuugggcaguuagggaucaggcugcuguggcgagcauccgugugcaggauuuugugacuguuuucagcaucuuggguaaacaccaaggcgagcgauggcuuugucacauggaaaaccugcuugguucugugaggcauggccaacacgacucccaaagcggcagcaccgcccugcuugcauccccugcagugagugacaggugcucccuccaccccgcccccacccgcccacccccaccugccucucacuguuggaagugccuuauucaaaagcacaguguguguagagguuugaaauuggggauuaguguuuagcaaaacaaaggcgcagagcccuccugucuccacugcauggauuugucauuuuuagaacaaggcuuuucucuccaaauuuugaauuguggcaggaacugaauaggaaggauggagaagugggucuugcuccugacuucuuucuccuagguugcaguccuguggucacccagugacauggcccuggccugggguacuugaauuaugcuuuugcaguggcccugcccggcccuggucccucgguggcaacccuucccaugacagugcuugccuccccuccucaccaucgaaagugcccgacugagguugucucuggaugcuuuguauccccagguccucuagaacauucccccugcaucccucccccauaucucccuucccauuccucuucuguccccgaccccauuggcucacugggauuugcaggcuguuucaugguuuccccuucaugccacauucuucauacagguugauaauuuaauuuacggcuuagcacacuugugagcaucugcagauguggauaaugcacucauugccaaaagaugacacggaacaguccuguuagcaauccuagcauacauuuuugacugcagaaaggguuucugugacagggguauuccagcucugucauuuucuuguuugcuuccuggaguacuuuacauagacaggcuguuacuugguuauuucauaguacaguuucugugggaccgguggaguguaagggaaggguuggcgagaugguucagugguuaacagcuuuggcugcucuuccacaggaccccugaggugauucccagcacccacauagcagcucccaacucccuguaaucccagucccaggagaucugacacccucuucuggccucucaagacaccacaaauuaagggucuagagcagauucuuguucucugccugugaaagaguuaaagagcaggaacgaucuugugugacaguugggaaauucucaucacagaaugaacagguaaagaaaggccuuucuuaauuaggggcgaggaaacacacuuaggcgcauucacagaggaaagcaagccaaagccaaagccaaagccaaagccaaagccaaagccaaagcccagcuucuccgugagggcagggccuuugucuucuuuccuaauguaggguuugucagugugaagacagacggcauggccgaugagcacagacuguuaugugucccggcgcagcccugaacuuguugaacccgugcauuagcagagggccugcugcugggagacacaagcuuacaagaucuuuguucugagaugcgcugccugucucagguugggagggugcggaacaccgucaauaccuggucauggccucucuucugcugaucaaggagucugucuaacuccuaguccuucgguccaugcagucaauacacccccacacaaagauauaaaggaagaaagagcugguuccgcucaaagcugcccuuagucuuaggaaccauuaggcgcuugcuaaaugcgggcuuguuuucuuccauaguaaggugcucuuuacugacucuugaauuugucauuggcucugugcuuucaccagccuccccgucacuuucugauguggcugggcgcucugugaggugagcucccuccacauucuggagccucugcgauuucucuagugggaaaugaacggagugggcacugagaccucucuucuccgccccucucagcagucugagaacaaaacuguguuauguguuacagugaagccgguguugccaaggcucugaucaugaaagcugucacucaagguuugggggcccuuucuguucaggugccagucguuacggguacugagauugacagguagcuacuguccucuguugguccaguagucugccugguuagaaggcuguguguguguguguguguguguguguguguguguguguguguguguguuggcacuggcagccuuaggcuucauccugccuguugccugucuuggauuuguuucuagcuguuucugggagaaauccucuguuugaggacauuccuugugcuuucugggcccuacaggguguucagggguagucaggguguucaggguuaggguguucagggguauucaggguauucaggggguacucaggguguucagggguauucaggguauucagggguagucaggguauucaggggguacucaggguguucagggguagucaggguguucagggguagccaggguguucagggguagucaggguguucagggguagccaggguauucagggguauuuaggguguucagggguagccaggguauucagggguauucaggguguucaggguuaggguguucagggguauucaggguguucagggguagccaggguauucagggguauucaggguguucagggguagucaggguguucagggguagucaggguauucagggguagccaggguguucaggguuaggguguucagggguauucaggguauucaggggguacucaggguguucagggguauucaggguguucaggggguacucaggguguucagggguauucaggguguucaggggguacucaggguguucagggguauucaggguguucagggguagucaggguguucaggguuaggguguucagggguauucaggguauucaggggguacucaggguguucagggguauucaggguguucaggggguacucaggguguucagggguauucaggguguucagggguagucaggguguucaggguuaggguguucagggguauucaggguauucaggggguacucaggguguucagggguauucacgguguucaggggguacucaggguguucagggguauucaggguguucaggggguacucaggguguucagggguauucaggguguucagggguagucaggguguucaggguuaggguguucagggguauucaggguauucaggggguaaucaggguguucauggguauucaggguguucagggguagucaggguguucagggguagucaggguguucagggguagucaggguguucagggguagucaggguguucagggguagucagcggguagucaggguauucaggagguagucaggguguucagggguagucaggguguucaggguuaggguguucagggguagucagggguauucaggggguagucaggguauucagggguagucaggguauucaggggguagucaggguguucaggguuaggguguucagggguagucaggguguucagggguagucaggguguucaggguuaggguguucagggguagucaggguguucagggaagcuguaugaguagaaccagcccugugucaaacuggauauuuggggacauagguaacccugccugggucagccagcuugcuagaacagcacugcuuggucauuugcuuuugcacguugcaaaagaaaccugcccagacucaucucuuucuuggaaugacugucucucucugcugcucuggccaacuccugucuguuccugccaacuuugucccacaucaacgugcugaaacccuguguuacacugggccuuuugugcccaugccagaccauugauagccugcaauccccaaugguccucaccuuguacugugcucugucuacgcagagguccagacugacccagugaccucauuuguugauguguguaaguagggucaacaaauccaugacagccacgaaagugugaguugaguaagagcauggcauuuaggagaggucagaguuugucuaggggacuugcugaacccuuuugggucugucccuggggggucugacacaucucugcuugcuccuugcucucuuggcuuuuguccucuauccugaugucaccuuugcccuguggagauugucauuguggaaaaggucacgaaggaacucggucucucaaaaguggcugaacagaucuggccaggcacugggcucuggucccuuggcaguaagugcccugguauuugcaggcucuguggauacuccagcucugcucugccugcuggcguggaggcgucaguccugcucacccacugguuaggaguggagcacuguaggaggaaccggagauuucugagaaggaagauacacagagcggaugugccauugucauggagagagcugcacuguggcuccucacucagcaacccccugucaccagcaggugacucugacaagcggcacagcagcgacuucgcccuguggaaggcagccaaaccucaggagguguucugggcuucgccguggggagacggacggccuggauggcacaucgagugcucuaccauggccagguaaacccagugaaugucaagccaggugugacgacgacgacgagguugccuugcugggggaaagagcaaucaggaggcuagagggugcuacuggggccaugaggaggaaugcccagccuagcccagggugugcccagccuuccuguuuaguauagucucuggcuagcagaagcgaugccugccugccauacagcaacagguaccucauggucccugagagguagcucaggccugagagcauguaaguggcaccucugaaaagccauuuugaggacacauaugugcccaugcuguggccagcucaccucuccugagugcagaaucuuccgcugacucaggaguagccccuuugccagcugggagggugguacuacccucccuguucucaggcaacccugugcuucccuagggcucugacagcuucagcaguugguuccugcucccucccugccagcccgguagauccacgcgcagcugaguagacacauauuuuauagccugaggagggcugcggggagugagcgugcgcuguggacccugcugucgaggcugcucacacgugcuugcgcucugcccugcagugagguguucggaagccaccuggacauccacaccggcggcauagacuuggcuuucccacaucacgaaaaugaaaucgcgcagagugaagucuuccaccagugucagcaguggggaaauuacuuccuacauucuggugagccugacuugaugcaaacgucuucucugguucugucaacucugccuuuggaaguccauagaucugcuggcagggcugggagaugaguuugacugaagucauuguuuggguuuucguagguuaucuuuucuuucuuuuuugucucauguauacaauguaucuuaccauacugaccauaccacacuccagccuguaaagucaguuuacucugucagucuuguguugguagccauggcugcagcaaacuagugcaaaagccccguccuguacagaagacauuuugcagugccccccuccaacuacuccccagcccccacccccgccauuguuugccuuuuagucucuuucuacucuuuuuuucugauagguuccuugaggcuugagggacuagauuuagggcagggcccucgacagacagucauuuaccucagcacuuugugagucugugcugacuguugcccacugcagaaaggggcuucuuuggccaaugcugagaguguauuaauauuuagaaggccguuugauacagugcuguuuagcaaaaccacagagguaggcuccuggcuagggccugucacuccugagccacgggcuuuugacaagguuuacagcaucaggcacaaauucccuucuguggagcaggcuucaaauccaaucagaaaguggccagccaccacacugguuaaaugcauuaaagagaaucucagaggcaccaaaaugcuuugauguuacaguaaggaaagaaaacucacaaggggcguuuccccuuggguucauuugacugagaaaggcccaugcuugaauucucuacuacugucccugugaccuccaucugucccuaguuggugguuucuggcuagucugucuaucgugcgucuaucuaugcucccugaucugaguaggauaacugugucuuguauguccaccaaagaacuuugcucugcacuuauugaaucgcguagaggauguuauagaaaucuuuuaccaguuuuacaaggcagugaguuauuuuuuccagccaaccccagcugacccaggagcacuugguaugacaaacagcccgucauaaaguuauaucugugugcugcuuucaacauguacagugguuuuuuuguugaauaaggucccuuugaaucugcuugcucuuuuaggcaagugauuauuauaacaugcaugcauucaugcaugcauuucucucugugucagggccaugcuuauuuagugcuuauuaaagcuaugcauuuaggccgggcaugguggcacacgccuuuaaucccagcacucgugaggcagaagcaggcgaauuucugaguuugaggccaagccuggucuacaaagugaauuccaggacagccagggcuacacagagaaacccugucucggaaaaaaaaaaaagaaagaaagaaaggaaaggaaaggaaagcuauguauuagcuuagguuguaaaguugauuacaugagaaauccaaagaaaguuaguuuggcuuugacauguuaaaggcaugcuaagcaaacaggcugaguauacagcaggcuaucagcugucuuaaaugaucucaaggcauauuauuaacuuggcugugagcucccguaaaaguuccagugucuuugaauguaagagauauucucauaaauuauggccagaggcuaccauaacccugugccacacugcagcagugggcaugccuugccuagugggucaguguggcagugugcagaguucacugcugggagaugccacuaauaacuccucucccucagagucagcauagugccuuuuaguacugugaagguagcuggggguggcuggagagauggcucagugguuaagagcacugacugcucuucugaagguccugaguucaaaucccagcaaucacaugguggcucacaaccaucuauaaugggaucuugacagccuuuucuggugugccugaagacagcuacaguguacucauauaaauauaauaaauaaaucuuuaaaaaaaaagacaggcaaaugaccaggaaguacauggagacagcuggucacugcccaggaaaugcgaaagagagagagagagagagagagagagagagagagagagagagagagagagagagaaaagaaaaaaagaaacucauuguguaguccaggcuguccuugaacucaauuccacccaccuaauucagucucucaagaaguaugcaguaccauacuggcuuuauuuagaagaaggaggaggaggaggaggaggaggaggaggaagaggaggaggaggaagaggaggaggaagaggaggaggaagaagaggaagaagaagaagaagaagaagaagaagaagaagaagaagaagaagaagaagaagaagaagaagaagaagaagaagaagaagaagaagaagaagaagaagaagaagaagaagaagaaaaguagcuagcugggggcaggagucuuucagguccagcacuggggaggagcagaagcagacucugugagucugagaccagcuuauagcauaaccuauggaauagagagacucugaacuuggugaugucagaauucacaguggucagcagcaaaaugcacauguugagucugcugaaggucacgggguccgcacuguccuuucaaauaacagcucagaugggccaggcagagacagacagcaugaauguuuggcagcagugggguuacagagugccaaacacaagcaucuacaacaugggaugcgugcaaaugcaguuuuauugucuuagaauuuggaggcugggggacauuagaugcagggucacucuggggauguggcuucagaaggaaagaggcugcuggaccccccaugucuaccgaccuauguucuugaccuccugcgaaucucaguuuccagauacugucaguaccaugucugauguuauauacaguuaaaggcucauaguuacaguuuaucggagagagcugcuuuguucauuucucaguaaaaucagccucuuagcacccucugagugaaggucuauuugcaaagagggaaaaucuucugacugggacagcaagagccuccucuggagacaggcuuuguugagaugcaucccauaguagaaguucccugcguggguuugguucccuccugcguuucaugcaccugugauaaaaugacaaacagcuguggagaagccuggacagacaccugaggcagaaaagcagacagccacaccccagacucagggcuagacaggauagggcagggacgcaugggugcaugagggcuguguggaccuguuauuguacccucacugagcaguauuguccuggaagagcacacacugcaggugcagguuccuguccuguauccuguggggaaacacaggccuguggcuacacuggcccagcugugucuagcuaggcucagggcuauagacagagaagcugaacucccuucuggugcccugguaacugugcauggguggggcgggcucagggcugccuaaaagagccuguaccuggaguggauauuucucuuuuuguuucaggucauuugcaugugaaaggcacagaagaaaagauguccaaaucccuaaaaaacuauaucaccauuaagguaacgucaauagacagugccuuccugcgugaguggcugauggcugcuaggggccucuguagggugaaaucacaucacuagacauguagucugaccuagcccugcaugggcugccuccagggaauugcuccuucuuguuucaaggggcagggcacuuccuucaggucuguucuucucuuucuuccuuucucucucucucucuuccucccucccuucuuccguuccucccucccucccuuuccuuccuuccuuccuuccuuccuuccuuccuuccuuccuaacuuccuuuuacuuuacuguucuuuccauucuuuaaauguuuaaaaggguuaucuuauuuauuuuuaaagauuuauuuauuuuauguauaugaauacacuguaacugacuucacaccccagaagagggcgucagaucucauuacagaugguugugagccaccaugugguuguugggaauugaacucaggaccucuggaagaacagucaguguucuuaacccuugagccaucucuccaaccccauucuuuuauucuuauugcaacucccaacaacuaggauguuuuccuacaaccuagauggccagaguccccaacuaucccacagugccacugucucaucuggacucugaaugcugcccuugugcccaaaauauguuuuauagcuuuucauucuuuuuaaaaccagaaccggugacagucugugaacuuugcuuggauacccaggucucuugacguucaggcugauuugcgcucuuuuauggucuaugcagauccucagcuccuguuuuauauucuguaugcaugugugcauguguguguguguguguguguguguguguguguguguaggggggagagaugcaugcaugugagggaguuaugaguaguuguuuuguuagacacccugugccuggcuuuuccucucucucuuugcugagucauuucacugucucuccuguauguaucuuacugaugcucacaguaaugcuuacggugacgcucacaggcaugcuucuauuccgugggauggauugcgucaugagggcugcuccgucaccaugcccuccuccuggguuaugcucaguaguggcgucuggccacuguguuacagaugaccaccagauccuuccaugguggaaggcuuggcuuccuccucauugcuuuggggaucugagccaggaggccgugcuccccaggauccaggcggacucuggccuggggggguggggggggggcuaagguagggggagagcucuggcagguuaccgaggggaugagagagucuggcuaacucaggcugcuagcucagcuggcagccauggcuggagcacaggaaggccaugggagguuagaugugggguguuagagggagaccugcuccauugcucuaacacaguggaucuugaugagcagagaagguccauccaugguuugaaggcauuuauuauagaaaggugggcgggggggggggggguaggaagagaaguagaggacagccauggccacauggggggggggaagggaaggggagaaggagagagagguaagagucaaggagagagcaagagcuuaagagagagaggaggggccaagcagccccuuuuauagugggcuaggcuaccuugcuguugccagguaauuuuggggaggagcuuaccugguuguagccagaauaccagguaccagaagcuugggacauugucuacgugacugauagucacaggauuauggaguugaguugauuguagugucaggcaguuguuucugggagcauagcuuacaggucugucucuuguagauuuuuuucuacugggucucccgaguaagcaucgcucaaccggaacacaggcugccuuucacgguccaaccguacaugagaaacaagucaugguauuucaucuguagcucacauucuugcuuuguauucuuacccgcaugguggaaugggcucccuguccucugaccuucacacacuggagcaugugugugcccacauacauauacacacuguucaggggacuaagggaaggaauaagggcacagacacgcuuggguauugcagccugugaaugguugagcuguaggcauggagccuguggaugcagaaggcaggauagagugacauuuauggagaugacacaucagaggccaugcacacauggugugccuggacagaacucugacaaggaguaaugaauauaguuuucaugaggaauaaacauuccacuguacuaaauggaguacccaguuuugaugucuucuauagggucaauagaagacuucuggucagacuaacaucauuccuguuaauuucucacagaauagcagguggaucuuaaucguguuugucuauuaguuguguggaguuuuucuucccucuccuguagugguaguuaaacugcuuuggcucucagcaggucacaugcacacacgaaccugcccaggagcuaccugguuugcaaaugaaacacacacacacacacacacacacacacacacacacacacucacaugccaguuaauuuuaaaaugccuuggcuagcucaaagccugggcaguuccaaucuuccccacagcuagcacacauuuccuuccuguaauccuggcuuaacgcucucuaauucuucauuuuaucuuuguugcccuggcuccuucugggcagcccccuagucuuugcuugcccaagacgcuucugggcagcucuuuugggggcugcauuccuucucaccuacauuuuagaugauuuuccucugcgacucuaaaucugaucaucucccuccaaaucaugccaauuccucucuuuucucucucccagucucuagcuaaucuaaaaguccugccucagucuaccaggccacuggccauugcuucuuuauugaucgaucaaaacccaacuggggacaaggaccuucagcuucuugguuuugggggcuggguuaauucaaagcauuggaaccgauccucuacccucuccucgacucuccucucauuuuuuacuuuuagccagucuacguuugcccucggcccaugguucuguagggugaggugcuccugccgcacaguuaaggauaucugucagguuccuggugguccuuguucuggugaccaccgugagcuuagucuaugucacaguugacuugaaaguucacuuucuagaaguccaguggagguggagcccaugugggagccucugccccugggaucccucugcuggccaugcugucuuuccaagcuguagcucgcucgcuugcuuccuuuuaaaauucauuuauucacuuuauaucccaaucgcugucccuccaccuccccaguccuuccuccuuccccuucucuucugagaggguggaaguccucccagguaucuccccaacugaguacacagguugaggugccuguaagaugagauuauauaaagugguuagcuagugagggccugccuugccugggaaucuccccagcacggggguuaucaggugccagcuccuucucucuauagguucucuccaugguggcaacaucuccaagaucggcugucaccguaugcugccgccuggccuccuggcaggucagcucuuuacuuugaguucucuggcccuuauuuacacaggugacaucugguuucacucucaggugacccugaccagguugugugauggaaccagagaaguauagacacuuggugacaucucaguacagagcagggacacacugaacaauagugucugugagcaccuuuguccacagcaacuccccgauaucaccccuccuuuucuguuccugaggacucugcaggacugcaggcugucggggcggagccuccuggacuccuguuugcauugcugcuuugacuccauagcagagccuuccagaggcccaaaaggaaaacaagaucugccucucagaugugaccuccauggugguacaacugacccuguccacauucugcacaagggacuuuuaaacagagucacccagcuuccuuucuggagcaagguagagagcacagcuugcagguuacuccaggucugaaaagaagacggcggcuuuuagaaaaugagaggccuucagagaugaaacgucuguaauguuauagcuguagauugugcugauuccacaaaaaaaauaaaauaaaaaaaauggcagaagggcagagaagacaugggaugcagaauggguccaggccucaacaccccaggccgucguggcccuuuuugcuggacaugccagugucaggagcccccagaugagaugacugcagccauaggcuccaaaagggaagcucacaguuguagcuguugugcaggaagcucugugcuuagcugacaucugcaaaggguuucuaaaacaacaguggaagaaccccagcucgccuggugcuguggcaguugggaggacucaguagagccccaugcagccucugagggaagaggguacugguuuucagaucuguaagccucccuucuggguccccacaguugugaugcgucaccuuagcaugcugugugugaccucuaagcucauccagccucguguccacccaggaugccgcucuccuugguuguauguccacacugacagauggggacaugaacaggacacaggcugacagagucacgcuugguaguaugugcagcaugguggacaaggggucugagccagcagguggucuaugaauucaggcaacagagaaaccucauaauaauggggcggugcaugcaggagauggcacuugaaauuguagggcugucacucaccaaggccacauguuuaucucauguacacuugaaugcaugcagacauucacuuacccuuaugcauacucagacacacgugcaccuacguucacugcauaagugcacacacacacuuguauacauucauacauaugcacacauacacacucagauacguguacacauacauacauacacucaugugcgcuuauaggcacacacaaacuugucuaugcauucacacucauguacacucacauagauacauguacacacucacauauccacagacacagguacauauguacucgcagauacacacagacacagagacauagacacagacagacagacagacagacaggcagacacacacacacacacacacacacacacacacacacggcagccuggugaagcccagagcuuugucaugugauguaagcaugagugaaacacgugggauccaagcugacaccauaccgugacacucugaugcagugugcauacuggccuggcacacugcucugcuggcagucugcagccgggcugaccugacuguggccacccuccuguccuuggcagccaugggugggucuagugcccccgaucauugguguggucuugauacaugaccgccauccuuaugcaguuaguggacugggauccaugccugacaaacucagaccaucuacccccaucucugcugaauucuuaccauggcccaaggcggucauggaacccaggauuagggacuggccaagcggccuccuacugacucugggaaguugaugaagguggaagaguugaggggaggcagaccagaaacagcucuccucaacuugaggagucacaucaaagguuuuuuucacugugccugggagcccacggggagcccagagagacaucauccugugcacuccuguggggggugauggguggggaggcucugcucuuccagaggaagccagugcagcucugggacgggaggcuaacuccccagugcaaccugcauuuccgccucgcucuuuuauuacaugguuucccucuucccucugugccccacuggcucucaaauucaugaccucuuugucuuuguuauuacguguguguguguguguguuucuaaaccaaugacuacaacuugcucagucuuuauaauguuacugauauguauguuuucaggacuggccguuugguauuagccaacuggugugcuuuuccuugcggaagacuauuucucuugcuuaaaacauuccuuaguuacuuguaguucuuuguguaugguugaggucuccugggcugccaccuguccgaguuagccugucuuuuguccuuguucagaccauguuguuacaguuguguuggugagacuuuaguugcagcuucugugguguuucuaggagacucaaucucacagcaaaauucugguccucuagcacuuaaaaccuuucuguccgucuuccacauugauccccgagccuuaggggcaggaacuguguuguagaugggucaguugaaacugggcuccuucuuuuagguuuccaucuguggcaaagagacguucccuugauagcuaguuuccaguagccggugggccuaaguccaguuaaggcgaguuguuugauacuaccaagguaugggcggcauuaucauguccuuggagcucuuguggcccgcaggcaucacagcuggcuucccugucuuggaagccugcguagcaccuucuggucuucaaggaaggggcuuucaggucagauaaauaauuucacgaguaaucugcugcagagagguggcugcugagggucacaaacuuagagcauccucacuauucaggacccagcgcuaugacacggggugggcagagcccucagucugaaccugagcugaugucagccaguucuagccuugacugagcucuugugcucucuucccguccaguggggccuggugcaaacauggcuucucuuuuccacugugcgcauugccccugucagucagucacuaggccuccugguagcagccagugccccucuccugucuaugucagguagggccuggugcacagaggugucggauauccccccagcccuucccacagguaugaugaugaccaugugaaggaugcuggagaagcgucugggaaaccagcggugaggguguugggcacagcaaggcuugggugagcacccuccacgucacgcuguauguacaaccccugcaucacugcagccagcacgaugacccgacugacagccgccugucuccccuuucuaggacuuccugaagaccuucuccccugacgucuuccggcuuuucugcuugcguaccaacuauaggucaggugaguggcucccaugugccagggguuggcagcaugccagccugggguaagccuacccaggcagugugguugcuucauuccccggggacugacuagagacacgauacuggaggaagccucacagggaagggacccagucuuggugcccaggcgaggcugcucuucccagaguccacagucaugucuucccaucuacauacaugucacugaaacaaauguugcucaggagguucuaggacagccuuggguagaaccuguucgggggcagagcccguaugcccaggcagcccuuuggccacagcacugguugccgcugggucucgggugcugugcuucaggguacacaggcacuuccucagggccaucucuuccuuugcagccauugaauacagugacaguaccuugguggaagccaagcaccuccugcuggggcuggccucuuuuguggaggaugcacgagccuacguaaaggggcagcugaccuguggcccuguugaggaggaugugcuaugggagagguaagcagucacauggacucaccgucgcucaggggacagguggccgggaugcagaggucagcaggaacccccaggagcuggcaucuacucagccccacuccccucugguccugaguccugcacaggcuguggucaccuagagcugggcacguuuccuucuuguuccaggagggaggggcgccccuucaguaguugacuauuacaaaaucacccaaguagauacuaugcauccaacaagugggcagguucccuucacucaacaauuuuuuuauuuggcuagggugguaacuaggauuuuguuacaaaaccguaaacacaaccuagggaggucccugaguugaaauauuuuuacuucuuaggaaaggauauuuguguauccagggcuggugccaggccaggcuggggcaccagagagcccuuugccugccuuaucaucacaggugacucccauaucccacuccaggcugacuagcaccaagaaggcggugaaagcugcucuagccaaugacuuugacacaccgagggcagugaacaccauccuggaccuugugcaccaugcaaacagacagcucagggcggucuccaagguaacuugaagggugcugcggaugucagggcagggcuuguccuaaggaacgggcacugaccccaucaaucagcgagacuccucccaaagcucccucguaugugacuucuucacaagcucagccugcugcacguuuagaucccuccauuccguaguaaacacaugaaugcaggcagcaggugaaucggcuggggcggcgcagauggcugugucgcauggcugccaccaugagaguugagcaaccuuccugguggcuuggcagcguguggagggguugguguuuguugaaacgggaaguuagguuggaucaguagcucaguggugaaguguuugccugaguucaaucuccaggauccacugcguucccucuccaaagggaaaacagccccaaacaaugagaaguugucuguugagaccuggacucagcugugucugucuccugcugaagcagcuccagggggacccagcucuggcucucagugagcaccacgggaagccaucgucccugucugcucugcucccagugcucccagugcucccagguuggaggcaccaccuccuuuccccaggacuuauacuccuguaccucagggucaggaagucaccaacccuggguucagccugggccgucuggucucaaggcuuuccagggugcuaccacgggagcccccuauaauggcagcacuuugguggccauacagaucauaggagaccuuuccuguggugacacagggcgcuaguccugggcccuuucuuggcuaaugcaccauuguggugaauggcuccagguggccaugagguuuuggaugcuugagucgauucccagacuugacacuugucaguaccacaggcgggcagugucuccugaccagggcuccauuuccacacaagguaccagacagaccaugguaccuuucuucugaguccccuacauggucaccgagggguugaccauucugucccagcuuguucaggccgacauuauaugaccugaagacaaccaguaggucaacccagccauacuuggagaagcuggcugugaguggcucuagaguucuugaauggcagcugccagcugcagccuccccuugacucccaggcaucagccccugugaguccuacaccacuuggccacuucuggggagaaggcaggcacaagcugauuacagagcagggacagauuggcaccugccacugcaggaugaggcuuggcucacaugggucuacaacagugacugaggcccagcagacuuucugagacccgcagcucccaucaucacugucccaucaccaugcccgcagcucccaucaucaccaucccgucaccaugccccaugcacugucccccgugaccaucaucaucaccgucccaucacuaugucccaugcacuguccccguggccacgcuugacccacaggacccaggugugcaaguacagccacgcugugagaggcggguaagcuggggcacaucaccagcaugaugucugcacucuaguguaggguuugccagggagccuggccaaagcugaagcagaaaugcccugaccucacuucaaugcucuugcaggaagcuaguggcccaaggagucccacuguguuuggggccaucauuuccuacguugagcaguuuuucgagacuguugggauuucucuggcaaaucgacagguacauccauugcuuucaaaugcuuuccccagaaacugcccacauguuacacacccuccucgggaaaguguucccugaagggugccuaauuccugacuuauuggaggagcacaguaccuguuagcugaccuccagcacugacuggcucgcagcagcauuggaaccaguguucugcuccauaguacagaaaggugccugcaaggacaucccccgcccccugcgcccccccccccccacgccagccaugcuuaugugggaggucccauccugucuggcugugugguauuggcucuauguucuuggcagggauguuagguccagacucuggcugugcuuaggacacuugaguucccugucccuucuugugauguucaguuguaccaaauagaaagggcaagccugccagguccucccacagcccuccccucccucagagggagauagaugccuuggcugccugauccacagcagagcagacaaguuuccuggucuauuccaguucaguuaagugcaugacuuauagcauccauggggcuggccauggucccuaggugugucccaguccucuggaugucacugcagaguuucuggguuaguguccaugcaggucucucagugcacagaggggaggugugugugcacuuagagcacaugacuguaucuacauuagcuacugcaccuaucuggauacugauaggguccaguggcccagggucacuauucacucagucccagccccagcagauuuacccaggagcugcacagggcaggcagcucuucucucuggguggccccuccucugugcacacaacuccauucugcuggcauucucuggcgcuguguccccuuuagagucccuuugcuucucacuucacucugccauaccugacagcuuuaggcugacccgaaaggacauagcaauggcucagccauuguccugccuguagccaggcugugccucugucguggucagcuagaacaucacccacagcagugccagcccugccaaggcuuaugaauuugguagccucucccagggucuccggccggcuuccagagaaaggugcuuucugcuuuaacaggggacuaccauuuuguccccuuagccaguguuuauacagccagccagacugcuugaucucaguaugcucgcgcgcgcacacacacacacacacacacacacacacacaacuguauaacuguugcugagguccaggugggacaugggucaaaguggauuuuaccagcuuaacgugggccagucaaggcauaaagucuugcugagcugaucuugcuaguaaccuaaccucccccgaauauucuccagaaagggcuagcaucaggaacacugauaaagacuucccagaauauagucguuuguggucucccaggcuguaccgggguccugccuugcugggcugggcagacucaucccucggcauguggcucaguguguuucaggagacagcagcacaguaacguugcgcugugugguagaugaacucgugcgcuucaggcugaagguccgccaguaugcacuggacacacccggggcugcuggggaggcucggaaacggcagcuccaggaaaggcagcccuugcuggaggcaugugacacacuccgacaggaccucgucacccauggcaucaauguuaaggugagugauacugcaaauccaggcagagcagugucacaggagacagugagggggcagacaguggcuagucauugguuucugagagacccacucgaggcagauguggaggccgggaggggaagguguguaagcaggaagaauugcaaaacucaacccucaugggugaggagcuggccugucaggcaguguuaucccccccuccucggcaucccucugcccccucugccuccacugccucugcuuuguaauccaucaccucgaauaagaggaugugaugucuacccagaaccuucuccuucaggacagaggcagugcagccuccacaugggaacugcuggauccaaggacaagacaccagaaaccuggggaccgaggaugagguggcugcaucccaugcgcugccauacccuggccuucugcucuuuugugaugaaaacuuuauauuaaaguugccaauuguggcuguuuagccaauaguaaagugggccuaugcugcccacugguguguauuuggaacag

SEQ ID NO: 4295 - RNA, 7683 nt, Mus musculus
gaugcggcagggaggggaagagcuaguuaggaucagagaagagcugcucccgccagcccgcccaccguagaucuccgcgcugaaaagagcaccccucgggggccccuuugucuccaggccauucuaaacccagcaccgggaggcgacacaaagggacgaugggggcggaaggcgcaggcgcguggaggcgccgaggaugcugggagugguggucccuuugcgugucgauagcugcccucccgcgcggguccgcauccaucgccagggagcugcgccugcgcguccacuuccgccucgcucggcuccgcccgcucgucccuccuggaagaggacagcucucuaguacuaggcgugcggggggcguugccgaucccaccacaccuccuucucguccagauuggccgcagagguaagagucgcaaggggauuggcugacgccguugccauuucuguucgggggcccuauuuauaccgcgcuaggaggcgggggaaugcaguuaacccagcggaggguggcucuucucagguuagucgguuugaaggcagcgaucuggaggcucguccggccccggcgugucucgaggagcaggcuagcaccccgcgguucccggccggcgugcggcuccgcccaguagguccgccaccgagugucaaacuccuaguaaaguuucgcgucgccggucuccccugcccaggcgaccccgccgcuguccccucggcgacccuggcccccagcgacaaugacaggccacgcccccgcgcgggccggccucgcggcccgccgccccccggcccgggacggugaggggcgugaaugcggugggggcggggccgccuccgggaggagggguggcggggcgcaugcgcgcugcgcgcggggcugaauguuucccaaguguuugaaacugguauuuggguuuuccacguuggacaagugcggcgaggcgggcggcggagcgcgcccuucccgcagccggccccgcucucuccgcucuccacgcugguggcgggugggcggcgguggccggcccucuuugggugugugcgcgcuaguacgcacggccccccgcgccgcccgccgcccgggagggggccugcacggccggcggggugugcgcuugagcuucggccgccgcggcccgcgccugcaggcgccgggguccccgcggccccggaggcggcgcggcaggcgccagauguagccgccggccagcccggccggagcggcgggggggcgcggaagggcgagagagcuuugcauuuugcagugcuguuugaggggggcgggggguggaggaagcggaaagccgccgaaucgccggggaccuccggggugaaccauguugaguccugccaacggggagcagauccaccuggugaacuauguggaggauuaccuggacucaaucgagucacugccuuucgaccugcagaggaacgucucgcugaugcgggagaucgacgccaaauaccaagguacggcgggugauggaugggcgggggcggccgcguccaucccugggucccggcggcgaggcugaccgguccugcuggagccggagcgcccgguagcguccucggagggcuaggaacaaaaggucuggagcgccuuugauacgccgagguccuuguguaccgagcuccgggacauggagaaggaaggagcgcgaacggcuggcugcaaggcugcgcgaccaaagcgcucuuuguagugaagugaugaggcggugcugcgggggagggggcgcggggcucggccgcguccucggggagggggugaaggcggccgcgcgagguggagugcuaugcgggcgccgcggccguagggcgcgggcaccgggcuagagagagggcugcgggccguacuccggcggagcugagugcggguccggagagucgccgccucccgccagguucugguucuaaguguuacauaaaguacugggcaguccugacucggggucgcgcgaucgcccaggcccugcucuccugggcccucucuuggcucuggacagggcuccgggccgacugcgaggggcgccggcgcggugugucuuggggaggaagagggugaaagggaggaucgcagccgacuagguguacgacugcgcugcgaucgguggacgcgagcugggcucuggcuggagaggagcggggcaggugagggaccugcagcccacccgaagacccgggcugcccagaguggcgaagaggcggagccugcgugcccgccgggaacuguuggcuguuggggaaacuuugcugugaggucagggggcucuguuuugaacguggauggccgcucggaguuuacucuuguuuacagaacugcgcagcagggaaacggaagaguugggggugguggagggccacugcccagcacugcauacagagacuugcuggggaaagcgccccugcgcgcucuauccgagaugcagcuucgcagcucgguuuauaggagaaucauuagcauauugcggaacguuccgccucugcggcccuuugauuggucgcaacaucccccguggaauguccuuaucauugugcuacagagucauuggggggcgggcaguaugggggcgggcuuugcucgggacucgcuccagucuguguuuccgcugucugcuuuuuuuuuuuuuuuuuuccucugguagagggccgggcggagagaggaggugaguugauuugaaugucuucgggucgcccguccucuggccuuggguuggcuccugucgcugcuggggcgggccaccgucgcuggcucugcgcgcugauugguguaccuccuggucuccgcccucagcgucgucgacucacauaggcuucgggcggggcggggcagggcggggcgcgcuuccugagucucguaggcuggaguggaucgcggccacuuuccggcugcgaggcuauggcggcgguggccuccgggaggaugcugcgcuuaccuucucugcucuggcuccccgcgggagccucugaucgcuugucgcguuuccgguaggcuugaaugagcgggagugccucugucgggacugcgggucugugugucccgugcuguccuccugcgggcucguguguccgaauggcucuagaauauucaaguccuugcucagaacuacuguuggcagaccgaguuuuugacggccgccuuagugcuucagauguagaagaguucgaaaggagggucuauguuuugguuguuguaaauggaguuuguugcuugaauuacuuuucaaauauuauagaaaauacccccaggaagcaaugccucuuucuuaagcgcaaccuuauauaaaguuaaaguggcuuaaaguaauuggacagauuagauggaacugcaggcccauuuagucacuaccuuuauccuuguugguacugaaugguggcccagcagcaggcugaggcugagcugacaggugccucccuguguggaaguagugcuguccuuguuuguugcuuuuaccaacauuuuuguuuuuaucaaauauuuuacguaggguaacuaaaaaucuguguuauugugugagcuccacaauagcuucugguaaguuuuugauggcauuuuucuccacaagcuucaccuggauuaaggcaggaagaagcagucauuuucauuuaaauuagcaacgggaagaauuacucuuuuacaaaauaccaguauaaucuuugaaacauugcugggugugauggcaggagccagagaucccgguuggagacaggaccggcucugauuguaugccauuuaacccaggauggagcucaaaaaacaauuugcuauugguuuuguuauuuuuucucauugaccuggaacucuuaaagauccacuugcccuuccuucuaguauuaaagguaugugccaucaugcuccaaaauguguaucuuagguugucuuugguaaguuaagucagucgacuuaccuagaaacuuccuuuuagauacuaggacuguacaugccuccuguguggggucuguuguucuuccaugaauaaugccugcagaaccuguauguagccuuaccuguugagagacuucagugucagcccuuguguugucuucuaggguuuuguugggguguguguguguguguguguguguguguguguguguguguguugaaacagggucuugauaaguagcucuggccagccuggaacucuaaagagguuugacccugccugaauugccguuuccugucagagaagcacagaguagggaggcggugaauuucuagguauccucucugacugccagcccguccacacaagcaucucuaguaauuccuuuaauagauggcaaaaaggucucaaggaaaaucugauaccauuuacuguuugagaaaaauacucuuggaguuuucugguaugucccauauuucaaaaacaaaauaguuuuuccuuagcgcacacagaauuucuuggaggugugggugguuaaucaauuuggcuuugagguaauccacuuagggcagaauuuuuuuuucuucuguucacuuuuguuuuuaaaacgaccaauguuuuuguuaguuucugacauuugaaguguucuuugacaucucuggcuggagauccuuugccauaguccuuuggacuacauccugcagcacccacucucuaggguuucccucugucagcauuuacccauuucucuaguuucuugucaugggucuuagacugauuuggcgucaguacaaagggucucugccuacuugacacacagagguucgucauacuuagaagcauacagagaugggcuuggcuccccuaaggcuucgcuaguguuaauuccacaggcugggcuguucccgugaagcacuguuaaugcgcaucaccccucagacacaagugccuucucaggcccuggcaguggacuacugcagagccgagucgagaaagcacccaagccuccaagagacgcuguguacaaaggaagaacucuguuucugaaacaugacacauguaacccaagcuguccucacaccugugaccccgacuguccucacaacaugccaccuucaggcuguucucacacuugggcuccuucugggcacaugaguccuagaauuaggaacuacacuaggcugaauucuguuuucuacuucuaagcaugcagacguauuuuuaguuuucuaagaaggauuuaguuuucaaaaugguauucuugaguacuugggagauagaggcaggcaggccucuguagguuccaggacaaccagggcuacacagagagacaguuuuuuaaaaaaugugaacaguagauuacaguauuaugcguuguaaagugaaaucuaucacuuugguuuuaaagcuggguugccuuguuuauugugaccaagcauucuuguuuucagcgacacagacuaucaagcuagaguagucauaggggaccagaagcagagggcuucugucuguguggcaucauggucuaaucuacaugcuuuucuguagaguauucuagacgaugagauaucguugaucccaccuggggagacagggauccccggagcucauuugugcuccagagucaguaagacugucucagauuagguggucagcaauauucgaacacaaagaaauacagaauaaaaacuuguaaguuagugcagagauaguugaacagaaauuguggcaauuguggcaguggugggugaaggaaagguucgggcugaagcacuuuaccuaagguucaacaucucaaccucucgaagugggacccauggcauacaccagucaggcacacuuggcuaagcuguuucugccccugugcugggaguauagaagaggccuugugguugggguggcaucucugcagggucccaguggguuguaaugccucucgcuucugucugcagagauccugaaggagcuggacgacuacuaugagaaguucaaacgggagacagacggcacccagaagcgccggguacugcacugcauccagagggcccugauccgcagccaggagcuaggcgaugagaagauccagaucgugagucagaugguggagcugguggagaaccgcagcagacagguggacagucacguggagcucuucgaagcacaccaggacaucagugacggcacugguggcagcggcaaggcgggccaggacaagucgaagagugaggccaucacacaggcagauaagccgaauaacaagcgguccaggaggcagcgaaacaaugagaaucgagagaacgcgucgaauaaucacgaccaugaugacaucaccucaggaacgcccaaggagaagaaagcaaaaaccucaaagaagaagaaacgcuccaaggccaaagcagagagggaagcgucuccugccgaccuucccaucgaccccaacgagcccacguacugucugugcaaccaggucuccuacggggagaugaucggcugugacaacgacgaaugccccaucgagugguuccacuucuccugcguggggcucaaccauaaaccaaagggcaagugguacugccccaagugccguggggagagcgagaagaccauggacaaagcccuggagaaguccaagaaagagagggcuuacaacagguagugaguggacacucacccguggucagugacacagccaccaguguguuuaugguaucgcugccuucguggaaguccgagggcagucagaugaguauuuuagagaauguuagccgugccuccucuccucggauggcggagacagccugcgucuucaugguguaccuuguucccagacugggucugcagagccgcaauuuagaaacuacaaauacagguucgaauuaaccaugucagcgagugucagacugauuuuggggguuggggagugacuuggaaguaagcuaacagcuguauaaagaagagauuucauuuggcuguuuugacaaaaauguuacgguuuacaaaaaaaaaaaaaaauuagccagguugcugaaguacaacaagcgugcuucuugcuaccauaauguauauccacacgacaaguugguggucuaaagucuaaauauuauuauuuuuuaaagagguaaauggguaaauuuuacaugacauauuuuauacauggccuauucccuaacuggccauuuuuaaugacuggguacauuuuuaauaggucagacacaagugguccaggcaguggguccgagucuugccuuugcuacccuaggucaugguguagccaccuuuaacuuauaugaaguguauaaauguacaucuugccccugcuguaucauaaccggaagugcagccuggugcuguuaugaagccaaggugugcauccugcugcgugugugagcuguauagauguugcgucaagaaauaaaugaaacuuggccaguuuguuucuuuagcauuuaauuuuaacauacaaauaauuuuaaauuuuugucuuaaaaauuuauacaccagcaguuuagacaaagccuuaagcaaauuguauauuauugaucucacguaauaaggaaguaggcauuauguccaugccagcaaauacaugucaaagguguuuagaucagagguuaggacgugacugugcuugugagguccagccccaccaucuguuuuuguauggccugugagcuaagaauggucucuauguuucugagugguuuuuaaaaucacauuucaugauacacgaaaguccuaugaaaugaagauuugcgugucuauaaauaaagacucauuggaacaccau

SEQ ID NO: 4296 - RNA, 7683 nt, Mus musculus
augguguuccaaugagucuuuauuuauagacacgcaaaucuucauuucauaggacuuucguguaucaugaaaugugauuuuaaaaaccacucagaaacauagagaccauucuuagcucacaggccauacaaaaacagaugguggggcuggaccucacaagcacagucacguccuaaccucugaucuaaacaccuuugacauguauuugcuggcauggacauaaugccuacuuccuuauuacgugagaucaauaauauacaauuugcuuaaggcuuugucuaaacugcugguguauaaauuuuuaagacaaaaauuuaaaauuauuuguauguuaaaauuaaaugcuaaagaaacaaacuggccaaguuucauuuauuucuugacgcaacaucuauacagcucacacacgcagcaggaugcacaccuuggcuucauaacagcaccaggcugcacuuccgguuaugauacagcaggggcaagauguacauuuauacacuucauauaaguuaaagguggcuacaccaugaccuaggguagcaaaggcaagacucggacccacugccuggaccacuugugucugaccuauuaaaaauguacccagucauuaaaaauggccaguuagggaauaggccauguauaaaauaugucauguaaaauuuacccauuuaccucuuuaaaaaauaauaauauuuagacuuuagaccaccaacuugucguguggauauacauuaugguagcaagaagcacgcuuguuguacuucagcaaccuggcuaauuuuuuuuuuuuuuuguaaaccguaacauuuuugucaaaacagccaaaugaaaucucuucuuuauacagcuguuagcuuacuuccaagucacuccccaacccccaaaaucagucugacacucgcugacaugguuaauucgaaccuguauuuguaguuucuaaauugcggcucugcagacccagucugggaacaagguacaccaugaagacgcaggcugucuccgccauccgaggagaggaggcacggcuaacauucucuaaaauacucaucugacugcccucggacuuccacgaaggcagcgauaccauaaacacacugguggcugugucacugaccacgggugaguguccacucacuaccuguuguaagcccucucuuucuuggacuucuccagggcuuuguccauggucuucucgcucuccccacggcacuuggggcaguaccacuugcccuuugguuuaugguugagccccacgcaggagaaguggaaccacucgauggggcauucgucguugucacagccgaucaucuccccguaggagaccugguugcacagacaguacgugggcucguuggggucgaugggaaggucggcaggagacgcuucccucucugcuuuggccuuggagcguuucuucuucuuugagguuuuugcuuucuucuccuugggcguuccugaggugaugucaucauggucgugauuauucgacgcguucucucgauucucauuguuucgcugccuccuggaccgcuuguuauucggcuuaucugccugugugauggccucacucuucgacuuguccuggcccgccuugccgcugccaccagugccgucacugauguccuggugugcuucgaagagcuccacgugacuguccaccugucugcugcgguucuccaccagcuccaccaucugacucacgaucuggaucuucucaucgccuagcuccuggcugcggaucagggcccucuggaugcagugcaguacccggcgcuucugggugccgucugucucccguuugaacuucucauaguagucguccagcuccuucaggaucucugcagacagaagcgagaggcauuacaacccacugggacccugcagagaugccaccccaaccacaaggccucuucuauacucccagcacaggggcagaaacagcuuagccaagugugccugacugguguaugccaugggucccacuucgagagguugagauguugaaccuuagguaaagugcuucagcccgaaccuuuccuucacccaccacugccacaauugccacaauuucuguucaacuaucucugcacuaacuuacaaguuuuuauucuguauuucuuuguguucgaauauugcugaccaccuaaucugagacagucuuacugacucuggagcacaaaugagcuccggggaucccugucuccccaggugggaucaacgauaucucaucgucuagaauacucuacagaaaagcauguagauuagaccaugaugccacacagacagaagcccucugcuucugguccccuaugacuacucuagcuugauagucugugucgcugaaaacaagaaugcuuggucacaauaaacaaggcaacccagcuuuaaaaccaaagugauagauuucacuuuacaacgcauaauacuguaaucuacuguucacauuuuuuaaaaaacugucucucuguguagcccugguuguccuggaaccuacagaggccugccugccucuaucucccaaguacucaagaauaccauuuugaaaacuaaauccuucuuagaaaacuaaaaauacgucugcaugcuuagaaguagaaaacagaauucagccuaguguaguuccuaauucuaggacucaugugcccagaaggagcccaagugugagaacagccugaagguggcauguugugaggacagucggggucacaggugugaggacagcuuggguuacaugugucauguuucagaaacagaguucuuccuuuguacacagcgucucuuggaggcuugggugcuuucucgacucggcucugcaguaguccacugccagggccugagaaggcacuugugucugaggggugaugcgcauuaacagugcuucacgggaacagcccagccuguggaauuaacacuagcgaagccuuaggggagccaagcccaucucuguaugcuucuaaguaugacgaaccucugugugucaaguaggcagagacccuuuguacugacgccaaaucagucuaagacccaugacaagaaacuagagaaauggguaaaugcugacagagggaaacccuagagagugggugcugcaggauguaguccaaaggacuauggcaaaggaucuccagccagagaugucaaagaacacuucaaaugucagaaacuaacaaaaacauuggucguuuuaaaaacaaaagugaacagaagaaaaaaaaauucugcccuaaguggauuaccucaaagccaaauugauuaaccacccacaccuccaagaaauucugugugcgcuaaggaaaaacuauuuuguuuuugaaauaugggacauaccagaaaacuccaagaguauuuuucucaaacaguaaaugguaucagauuuuccuugagaccuuuuugccaucuauuaaaggaauuacuagagaugcuuguguggacgggcuggcagucagagaggauaccuagaaauucaccgccucccuacucugugcuucucugacaggaaacggcaauucaggcagggucaaaccucuuuagaguuccaggcuggccagagcuacuuaucaagacccuguuucaacacacacacacacacacacacacacacacacacacacacaccccaacaaaacccuagaagacaacacaagggcugacacugaagucucucaacagguaaggcuacauacagguucugcaggcauuauucauggaagaacaacagaccccacacaggaggcauguacaguccuaguaucuaaaaggaaguuucuagguaagucgacugacuuaacuuaccaaagacaaccuaagauacacauuuuggagcaugauggcacauaccuuuaauacuagaaggaagggcaaguggaucuuuaagaguuccaggucaaugagaaaaaauaacaaaaccaauagcaaauuguuuuuugagcuccauccuggguuaaauggcauacaaucagagccgguccugucuccaaccgggaucucuggcuccugccaucacacccagcaauguuucaaagauuauacugguauuuuguaaaagaguaauucuucccguugcuaauuuaaaugaaaaugacugcuucuuccugccuuaauccaggugaagcuuguggagaaaaaugccaucaaaaacuuaccagaagcuauuguggagcucacacaauaacacagauuuuuaguuacccuacguaaaauauuugauaaaaacaaaaauguugguaaaagcaacaaacaaggacagcacuacuuccacacagggaggcaccugucagcucagccucagccugcugcugggccaccauucaguaccaacaaggauaaagguagugacuaaaugggccugcaguuccaucuaaucuguccaauuacuuuaagccacuuuaacuuuauauaagguugcgcuuaagaaagaggcauugcuuccuggggguauuuucuauaauauuugaaaaguaauucaagcaacaaacuccauuuacaacaaccaaaacauagacccuccuuucgaacucuucuacaucugaagcacuaaggcggccgucaaaaacucggucugccaacaguaguucugagcaaggacuugaauauucuagagccauucggacacacgagcccgcaggaggacagcacgggacacacagacccgcagucccgacagaggcacucccgcucauucaagccuaccggaaacgcgacaagcgaucagaggcucccgcggggagccagagcagagaagguaagcgcagcauccucccggaggccaccgccgccauagccucgcagccggaaaguggccgcgauccacuccagccuacgagacucaggaagcgcgccccgcccugccccgccccgcccgaagccuaugugagucgacgacgcugagggcggagaccaggagguacaccaaucagcgcgcagagccagcgacgguggcccgccccagcagcgacaggagccaacccaaggccagaggacgggcgacccgaagacauucaaaucaacucaccuccucucuccgcccggcccucuaccagaggaaaaaaaaaaaaaaaaaagcagacagcggaaacacagacuggagcgagucccgagcaaagcccgcccccauacugcccgccccccaaugacucuguagcacaaugauaaggacauuccacgggggauguugcgaccaaucaaagggccgcagaggcggaacguuccgcaauaugcuaaugauucuccuauaaaccgagcugcgaagcugcaucucggauagagcgcgcaggggcgcuuuccccagcaagucucuguaugcagugcugggcaguggcccuccaccacccccaacucuuccguuucccugcugcgcaguucuguaaacaagaguaaacuccgagcggccauccacguucaaaacagagcccccugaccucacagcaaaguuuccccaacagccaacaguucccggcgggcacgcaggcuccgccucuucgccacucugggcagcccgggucuucgggugggcugcaggucccucaccugccccgcuccucuccagccagagcccagcucgcguccaccgaucgcagcgcagucguacaccuagucggcugcgauccucccuuucacccucuuccuccccaagacacaccgcgccggcgccccucgcagucggcccggagcccuguccagagccaagagagggcccaggagagcagggccugggcgaucgcgcgaccccgagucaggacugcccaguacuuuauguaacacuuagaaccagaaccuggcgggaggcggcgacucuccggacccgcacucagcuccgccggaguacggcccgcagcccucucucuagcccggugcccgcgcccuacggccgcggcgcccgcauagcacuccaccucgcgcggccgccuucacccccuccccgaggacgcggccgagccccgcgcccccucccccgcagcaccgccucaucacuucacuacaaagagcgcuuuggucgcgcagccuugcagccagccguucgcgcuccuuccuucuccaugucccggagcucgguacacaaggaccucggcguaucaaaggcgcuccagaccuuuuguuccuagcccuccgaggacgcuaccgggcgcuccggcuccagcaggaccggucagccucgccgccgggacccagggauggacgcggccgcccccgcccauccaucacccgccguaccuugguauuuggcgucgaucucccgcaucagcgagacguuccucugcaggucgaaaggcagugacucgauugaguccagguaauccuccacauaguucaccagguggaucugcuccccguuggcaggacucaacaugguucaccccggagguccccggcgauucggcggcuuuccgcuuccuccaccccccgccccccucaaacagcacugcaaaaugcaaagcucucucgcccuuccgcgcccccccgccgcuccggccgggcuggccggcggcuacaucuggcgccugccgcgccgccuccggggccgcggggaccccggcgccugcaggcgcgggccgcggcggccgaagcucaagcgcacaccccgccggccgugcaggcccccucccgggcggcgggcggcgcggggggccgugcguacuagcgcgcacacacccaaagagggccggccaccgccgcccacccgccaccagcguggagagcggagagagcggggccggcugcgggaagggcgcgcuccgccgcccgccucgccgcacuuguccaacguggaaaacccaaauaccaguuucaaacacuugggaaacauucagccccgcgcgcagcgcgcaugcgccccgccaccccuccucccggaggcggccccgcccccaccgcauucacgccccucaccgucccgggccggggggcggcgggccgcgaggccggcccgcgcgggggcguggccugucauugucgcugggggccagggucgccgaggggacagcggcggggucgccugggcaggggagaccggcgacgcgaaacuuuacuaggaguuugacacucgguggcggaccuacugggcggagccgcacgccggccgggaaccgcggggugcuagccugcuccucgagacacgccggggccggacgagccuccagaucgcugccuucaaaccgacuaaccugagaagagccacccuccgcuggguuaacugcauucccccgccuccuagcgcgguauaaauagggcccccgaacagaaauggcaacggcgucagccaauccccuugcgacucuuaccucugcggccaaucuggacgagaaggagguguggugggaucggcaacgccccccgcacgccuaguacuagagagcuguccucuuccaggagggacgagcgggcggagccgagcgaggcggaaguggacgcgcaggcgcagcucccuggcgauggaugcggacccgcgcgggagggcagcuaucgacacgcaaagggaccaccacucccagcauccucggcgccuccacgcgccugcgccuuccgcccccaucgucccuuugugucgccucccggugcuggguuuagaauggccuggagacaaaggggcccccgaggggugcucuuuucagcgcggagaucuacggugggcgggcuggcgggagcagcucuucucugauccuaacuagcucuuccccucccugccgcauc

SEQ ID NO: 4297 - RNA, 24220 nt, Mus musculus
ccucucaaggcgcaggcuccgccccguggcucaggucccgcccucagugcucgcugcgcucggaugcggaugggacgcggcagcagcucgccuguccuuuguguucgaguggcggcagcuucgcaggccuucaccggcacauuccucuggccgaucagucgcgugcuuccuagcgacccaucaugucagcgggagcgggcgcggccguggaggcaggcuucuccagcgaggagcugcugucgcuccgcuucccgcugcaccgcgccugccgggacggggaccuggucgcgcucuguucgcugcugccacacacgccgcgcgcucaccuggccgcugaggacuccuucuacggcuggacgcccgugcacugggcugcgcacuucggcaaggugggcgcgggcacuuuaaggcgccauuuuccgcguggugugcuguuagggucagagcgcaccccacggugucuggagagcgcggucggcagcggcagcgcaaccccugagaguuccagggcgcaugugcgguaccgcgcggucugcgacccaggacggugggggguggggggcgcggaagcugcucagacgccgcgggcgccucgagggcuucaaggcgcaugugcggcgggcggcgcgcgacccaggaccuccgggggcgcggggaguguugggaggcggggcggaaaugggguccgucucgccggcucccccgaaggauccagggcgcaugugcacacuuguggcucuuccgagcggggcgggcagacugcaguugaggccguuugcgcggaggccgccgggcuucgggaaucguggcgaggaggaaacugggggccucgcgcuucugucuaauggaaaccgggugcagggcccccugaaggcacggagggaugggcgcugcccucguagccgggggugucaagucugcaccugcuauggccgacggcggggucgcggccaugccuaucggcccccucuccaccgggaccguccuguguaagcugcgcuaauuggccccguucuccugguguugaaagguggcaugcaguugggugcagguagucgcugggaauccaccuucucguggucgccuuaguuaaccugcacacagaagugcuucugcgccauaaagcggcaaaauucacgcuguacuguuuaccagaauuugaucuaaagcuaaaggagcauuuucacgucuacggagaacgaguuguagacuugacuuuggagaccaguauuguagcggaggcgaggacguuguaguucugagcuuuccuaucugaaaccuggauggucuuaagauacggaaccaucuuguuaacccguuccaacuauuacggaaagcucuuagaggcgaaaaggcugagccuuucaccccagccgggccauguguuacugcucucccuccuguagguuuccagcguguuucccuagguuguaccuaccagugaugcucagguuacccaguaauuuauggggcuuauuuauucccggaaaacuggccauugugaaggcuaacuaucuugcuuuuaccagaugccccauuuaaaaggacccuccacaauuccaaagccaguuuccuagguugaacacggcauagcuaacagguucaaauccuggcuccacguuaaagguuaacuaacugcuuuucucuugacaccuguucaucuuacugccacuuuguacuuguauguuucccuugggaaaucucaccagcgauuacuuuuugguuugguuugguuugguuugguuuuccgagacaggguuucucuguauagccauggcuguccuggaacuaacuuuguagaccaggcuggccuggaacucagaaauccgccggucucugccuccugagugcugggauuaaaggcgugcgccaccaccgccuggccagccaucacuuucuaacacuguccuaaugucuguuugcuguggacugugcaaguuuugcagccugccgaucaauaaaaacucagagaaucuguguuuauugaagugaccaguccuuuguaaggacaagcuuaccuugcuuggggagacagauaggagguucggggugcuguuuguucucaggaauugcuugcaaccaagcacagcuucuucacugccuguggucaguugaagagaaacagacaguccaaaauuggagaacaaguaaguaccgaagaaauuccuggccaguguaggcacauguugaaugugguggacucauagccagcugccagcgcagugggaccuggcuggaucuugucugcgcuugccagucuuugaguuagucaccuacugggugagcucagccguggugugacucuuuuauuauaguuaguuauuuaucucgcauacuugguuucuguucaguuuuaaaggccgagagagagagagagagagagagagagagagagagagagagagagagagagagagagauacagacugggcuuuggggcaguucagugugucgggguugugcacggugugggaaagucugacuauaaagaguuuacugcacuuuuuacaguacaguacaauuuguacaauuuuuacagcccgauguuuacuuaccaugagugugaacgccuuuauaggagguuuguguguguguuuuaagaacacuccacucagcauaaaugcuuuuaaaguuuugcuuagugauuggagaaaauuaacuuacugucagaagaaaauaaugcuagcaaaaaugccacuggugacuguuagagaauuuagguuguguccuauuaauugcuauacugacauguacuguuucuccucccaccuuuguuugaaguuggagugcuuaaugcaguugguaagagcaggagccucacugaaugucucgaccacccgcuaugcccagaccccagcccacaucgcugcuuuuggaggacauccucagugucuggucuggcugauucaagcuggggccaacauuaacaaaccgguaagaaggccugauugacacugccuuuguuuguuuuuccaguuccaguuauucacaugauacugcuuuaaauugggcccuuaauuagaguugaaugucuucaccugaggugagcuggaaucugucccuucaguuacuugugacuaauaggcccuuuccucuggaggcgugcacucaguuuauagagugcuuuugcguguccuguggcucccucagaucugauuugaugauuugcccaaggucacagcugauaauagaaggcuguuggcccacagcccagauuucuuggcuccagcucacuacugccuuaacuucauagacacugcagaaacauauccagaugugcaaaaggguggguuugcccuucacauacaaauuggguguagugacuagguguagaaaugucauuuuaagugucauuuccuuaguggaacacagaaugacuugaggaauuuuuguauaaguauacaguuagagguuaugugaacuagauuuuuuuuuaaagauuuauuuauuuuuauuauauauaacuacacuguagcuaucuucagacacuccagaagagggugucagaucucauuacggaugguugugagccaccaugugguugcugggauuugaacuucagaccuucggaagagcagucaggugcucuuacccacugagccaucucaccagccccuagauuuucuuuuaauauaauuuuagacucucuuaccuaaguguauuccaaaucuauguuuauguuauuagccuaucauagagaaacauccaguagauggucugaaagggagcagauggaauuugcugcccagccgcuggcagcacugguggcugauguuugucuaugugugacuacguguacaugccugcugaaaccagaggcauuaguuucuccuggagguggugguuguaagcgcucugaacugauaggggugcuggaagggaagcuuguacccucagacagaugagcugcccuuccagccccuuaaguaauuucuaauugccauccgcaucuuguaugcaaagaaccuuccuuuccucccuccugcauggcuauagcagcaguagucccuuuccugaagauaacuuagcuacucacauaaaauggcaaguguuuguuuggccaugguuaaaagccuggaugaaggggacccaccuguaucaggcaguuuccuucuccuugagacugacagagaggcccauuuucugucacugagacuugaguagggacagcuuuagauccuuacaugcuugcuuuccuucucugacaugaaucucucuuuugcaccgucaccuugcagggcaggggcuugucuguccgccugcuaacauccacacuguugcccccuggucucagcaggugugggcucgagcuggguccucugcucaccuggcaguccggcucuggacggcuuacuuagcaggcugugcuuccagcucuaccaaagagacauauauggguagucauucugggaaggaaaauaacucauuugcuguuaauauggaauuuagguacauauuaacuuuaaguaguuaacaaaauguaguuuagaaagguauaaagaaauugguacuguuuuaaggcuuuuucaaagcuagauguuccuuugaguuagcauuuaugguaguuucguuguuuucagcagaugcggaaaauacagacuugcagguguguccccguguccccgcuacgcucuggggugccuucccagagcaagucuuccuagccuuccuagccuuguuguaauuucucaacuucaggugcucaccuggaccuagaaugucuugucuccuuuugcuggcucuggaggucacuguagauguggcagugacuuaugcucuguugugggguagacaguuuguuugcuuguuucucaccuuguuugugucuacuuaaauuucuucuguuugcccuuggcaugucagcugccagcaguuccauggucagguuuguauccacguucuuuugaccgucugucaggugagacucagugcugcagguuuucaacagggaaguggagcuagucuucaugccgcuguauuuuggugccauuacuaacagccuugcuaaagacuugcagagcaucucugguugguuguaacuagcuuuuauuggacuggaacagggauaauaguauucaccagacaaaagccaacauuuaaaaaauuaaagaacagucuaaggaucugugggcugggaguuaacaaacagcucagugguagagcacuuguacagcaugagugagggccuaaguucagcuccagcaccagacagggugcuaaguucucggaucucagcccugguggggugggaucuucugcauuagugacugaaaaguuaccuggcuuugccuucugagccaugggagugaggaagggcacuguuuaaaguaucaguuguccucccugcaacuggccaggauuucuggugccucuuccucuuucuuuccugccucccagaguuugugaugguucuagccucuuaugcaugcacaccacuggguacuuuagaaauguaauggaaacuggagcaucaucauucagggaguuucuggguucucuugauugaagauugcuuccacaugcgccuucuucaaguguguaaaucacaaagcaagggcuagaaguaguccugccuguucucuaaccacuguuacuagucuccaucuuuuuugagaaauaguuugcuguguuccaaaauuaacuguaagauuuuuuuaacauguuuugcaaaauucucauuuaaaucuguuagcuuucugcagagaguaugugucugugguauaugaauaaucuauuugcaggugggugcguguaugugggagagggagccagagguggguguuugccacaguuucccucucccuuacucuugaggaugguuccucacugaagcuggggcucagcagugugacgaggcacuuucuuuacagaaacuucuucccuuccagccaauuuguguggguuuuguuucuuccauuuuucuuuuaaaagguggcuuggccggauaugguggcacacaccuuuaaucccaauguuagguggaggcuggucaaugaaucugugugaggccucccugcucuauguagcaaguuagaagacauggagaugugcaauagagagacccccaucuccaauaaagggggaaaaugaaggcagcuugggguuuugucuucuuuguuguuguuuuucugaguucacuagguagcuccuggauaaucauguggcuugcuuguuucuuucuuuaaaaaaaaaaaaaaaaacaaacuaaaaaacaacuuuuuccugaccagacucuugaaucacuuuuaaguccauuuagagccauuuggaacccuuguuuaaauaaguggccaauucucccuguguggugcugugcacugggaaggaccuugggcuuuugcuauauuuaugagugacccuuucccagggccagucagugagcauuugccccaccccugccuuuuguucuuuaucacagccaacugcuguucccaggaaccuugaagggggauccauuuaagugcuagggacacucucuccucagguguccuagaaggcccgugguccuugagucucugccuccucuugcucgcuuucgucuucugaugcacuucgugcguugguucuuacaaccuagaagcaucacacuagaaggguuuucucacuaacacaguaaagcagguucauuuuuuaaaaaacgacuaucacuuggaagaggcuucugagugcucacugccuucuguuggccuuuguguuugccuggcugaaggucugucugugcuacaaagccucgccugcccagcuuagguuuuccucucuuugcuucauccucugacuugaucgucuucuaacaugugguucucguucagcauagagaguugaaggugcucuugugguuuaguggcgucaacaccauagaagcuguagagggauagaugggaacuuuuaagauucuugugggcuuucucuuguccugacuguuuuaaugugaauuguuuuuugcuaguuauuuugaguuucuauacaauacaguugugccaagcuccaggauaaaaugcuuaguaaaucagcauugcuggcacgcacuaaccacaucaucagaacuggacaucucccaggucuucucucaucaggaucuuguagcagaauguugugggcagucugcccuguugccuggcuuucagccuccucucacuggugcacuguguucuauuccacuuuagguuuugcucacacuacuuuauuucagggacggagcagggugugugggcucccugcuucucacugugaaggcgugguaacccugaacauaugcauucuguuuuucaggacugugagggggaaacucccauucacaaggcggcccgcucagggagccucgagugcaucacugcccugguagggagcggggcucacaccgaguaagugucuucaauuauuccucccacuuagagauguagucaagauguuauauccagaaggaguguuuagagcagcaaaagccuuacaagucuuuauucugaaauuagcaguagaguugugccuguuuggucagguguuagugaagaaguuguguuggagugaccacuagcagaugcaggcuucauucccccauggcucagagugaggcaucagaguggcaugaaaagaacaguccguccaugagaugucauugacugugccacaaguagugccacuguggcaggucuucacacuugguuugcugggcucucauuucagacaggagagggguuggauuagaggagagugccuucgcaggucccuuuggcucauagucuugacuauuucuaagucugguuuccuuggcuaugagaggcuucauaaaagucuccuuugacccaaagcuucauagcgucuaguaaccuggagcugcacguggagagacugcaugcugagaggugagguuagaacguccuugagugaauucccggaacuggaguccaccuccucuuagagcagugcuagugugugagcagguuaguucagaaucguggucucauguagaucauuagcuagccguagcauuacacguuuauuuagguauuauauucauuuguuucacuauuuuuacauuauaaaaauuuucuucuacaguucacagcauuaacaaauggaugcgguuuuuucaccccaaaauguugaguguaagcuauagagagcuguaauaaccaaaaaaacugacaauaccagcuuuuaaauuuuuacuguaacuuaaugaguaauucauaaagaaaguauuuaauuagaaaccacuuuauucuaacaggaaaugugaacaucgagacuuuggaugaaauaagacccauaaaauuuaguuuaacccuuugguuuccauuuuguuauucugacuucauauuacaguaaauucuaaacauagguccuggguagcaaaaccauguauguuagaucauaugucuguccagagcucagcuuagucacugucuuagcuucaguuuccuucuuuauugccaaguuuagccguuagcucaggcuuggguguuuaauguuauauauauggccuggguugcccaggcauguuagcacaugacaguaauccaagcacccaggaggcugagacaggagugcaccuuugaggccuaguugcuaacaucugagagagacccuuguaacuuauauuuagcugggauguaagguaacggaaaaucaacuugauaaugugaauauguauuauauaaucguaaaacauuuaagaugagucucaauugcuuuaaaguuguagaaucaguuuuauucucuguauuuauauuuaaagacucaagcuuuaauaacaagcuuuaauuauaaauacagucauauauaacaauugauuaaauuauuuaauuaucauuuauggaaauaaugaacaauuaaaguuggguuuuuuuaaaaauaguuuacuuuuauuuuuuuucuaaauuauauuuuaaucgguccugaacauuuuauuacagagauguuuuaauuuuaauggguagcuuaauccuuugagccauuaaauaucugucacuuguccuuuuuuuuuuuuuuuccuuuaaguagguaucuuaaaugaguaucauauuuacaauucuguccuugguuacaggacccucaagugucucuuuucuaccagguguggcugagcauggccucgagugccagucugucccccaucucaguacaggagccaccccucgagacccugcacuauggugacugcccuggacugagcgcucacauuuuuugggaagggaauuuagcuugaacuaccuaggcaaaagcaauucuuaaaauuagaagucuuuggccuggacuuagaacacaaguagucauuauugcuauuguauaugugguuauuggguuuauaaucuagagaaaauguugcauuuuccaguaagcuaaaucgaaaacuacuucuuggugucuauucugcacauuuuuauaauugauccuguuuacucugucuacauaggcaguuugacuccucccaaauagcagugccuaggucuauaaugaugcuuacaaggccagauauaucucagcacaugauaggacuuuuucccccaaagaccaaaggucuuuacauuaguuuacauauuuaaaaucacuuaauauauuuuccauuucagaaugggucauaauuguucauuuuauaaucuauaauauuuaggaaauuaaaaacuuuccuucuaugaauagguuaaaagcugccucuuacugcuauuuuuaaauuaaugacucgguuuuuaauuccgacucugcuuuuuauauaugugcuacauuaaaguggccaaagacuaaagcugugcuuuuucuggucaucggguagaugaggguaacugcuaagugucuguggcuagaaugguuuguuaugugacugacuuguuaauguagguugcaacuguaagauaacacauuucagcagcugugcaucguauuaaauuuucuagcaucacacgugaguauguugacagacuuuuguuuucuucucuuaauuuaagucuugaguuuuggugccaaguuaucuuuccacgugagauugugcuucuggcuucugugguggugcuccgugcuugccacuguugacgcuggggcugagauacacagggucaaaucucaggaaugugggcacacguguccccaaaggaacucagcuguuucagcauggugaauuggggcggcucucaacuucuuaccugugcuagcugcugccucugcucugaguagacaagggcggcaaacaccaacaugggagagccgcccacuuccucugguaucagaggaacaauagaagguuggguuuuagugugauuuuuuuuuacagaaagacaaaaauuugcuauucuuuuaucauguuugguaacuuuaccuucuugaggaaagggaugcuucuaagcccaccugauacuaaaguaguauuuuuuucccucuggguagaaucaagguacccacacaugcaggcauauugugcuuuuucucugauucagucuuaaugggguggaaggcggggcugauagcaaucuuccccucuuuagaauaugacuucaucagaacuuguauguuuuaugauaggugaagugggcagccuuugaaauauuuacgguuaacccaagagugggcgggcaagauaaagcagggucugugguucauugucaagaggcuucaccucggaugaagugagcucaguugucugacagaaguggcuguaggccacagaugcagcuccuguggagcuguuaggcuuuuguacuuaggaagcaggugugucugcuucaccugagaggcagggcuagcaccgggacaaacauaucuugaacauacaaacacauaugaacauaaguguuuaauguguuuggucagaagcucacuuguaacuuuuuucaggacaaagccaagauuuacuguuagccccuuccuucugaugcugaagguuccuucgucuugaugcgucuguccuucagagcacugauccuguuagaugucucagcacugugacugaauuggucugaugcucuagcgcuccaaggaguucucuguacccucacacgcagccucuucucagaugcugcuaccacagauccucugcucuugcugcugccuuuccuccauccgggugggacagcuguguggcucugccuacaggcagaagcagucaguaugacugacggcgucccagaggugacagacaacuuaaauaagaaguagauuucacuauuuaacuguugcuuuuauauuaaauuagugcuuuaaaaacaaaccagcaacuuccaaauaccaauuuucucucuguuaaaucauacugaaacaugcuaaguauuuuaauguaugcaaacauaauugugauucacuugcaaugcuaaacaucuucaauaauguugaacuugaaaugaaaacuuggcaccaaauuuauucagguagaaacuuuuaaaaauuaguuucuuccuacuguuaccugaagagugcauugaugaaagucuccaugauaauguguuuggauaccaaaggguuaaaaauacacguguauuucuuuuacugcaauaacaauguuugcuaauguuugucuguacaaauggacauuuaguaaauguuuuuauuuuaucuuuuuuuuaaugaucccauguauuugcuuauuuccaucuaggaauaguuacuaauguauuugcgauacagcauacaaauuuuaaaguaaccagaaucgugaguugaugguuuucaguccauacuguuaaaauuuuguugaaauauugacauaaauuggcuucaugcuaaaguuacuagagguaacucuuaaagccagcacaaaaacagucaagguggcugcacacaguggcucagcucugugucugcuccugcaccucguauguguguauguauuuuuaauccaguguugccugcaaaugugaucccuuaugauugacguuuccuguguaugaaccaugcccguuucagucacgcagaagaugcugaaucuguaaaaacuacacgugucaauguuuuacagcugcguaauucgaauugacuugguuuuuucaaguaauccuagaaagggggagcauucccauagaaacugcugaaacugccacaggugcuucuccgaaaccuuacgguuguggcauugaauguucaguauggcuucccuucugcacacaagcauacuguugagguauuuguugcggugauugguuuuaaugcuaaucuaggaauucagauauagauucuuuagauuugcaugcuuugcuuacccuaauuuaugauaucuaccuuuuuauuuguaaacuaacaauagcuaaauucagaucagaacuuuaacagaaauauuauuuauauaaaaauuguuguuaauuuuuaauugucacauggcauuagcacaaagaaaguguuacaguggugaugugacacuaucuaguucugaaaacuagauauuucuugaucugugauuauuacucuaauuaaagggaacacucauuggaacggcuucucucuucugguauugugacacuguaaguggaaaaucaaaggggucuuugugacaauauguucuaaaguuccuggggagugguucuuauguaaguuaaauuuaauacucuguuuaaaguguuugagggcaguuugguucauuuuugccacuuuggcaaaauauuuaauguguagcucccaugugcuaguuuccugauucugaaacauucgcaggagggcucgguggcguagagcuugccuagcgugcucuaagagaucgaaccuaaucucucagugcugugaagauaguuggcuggagaacaguuauuuuccuguagcggggcagugagagcugggacugguagccaggaggaacaugguuugccgcagacugggcucagcagcagggaagucugagccugcugacuuccuucucaaagcugcuugcagagucucaacaagacuagcguuuuuaauagacucccuguuuucauauuuuuauauggguauuaggaccagagagaguggauaagaucuuucuuuaaaaguuuuagcgauuucucccagguaauuuaugucuguugauacuucauuagagucugugucuacaugaccuaguuagucagaaaacacucugguaaauguuggugaaucacaggcugaagggguggacuguuagcaagcacuugacccaaaguagacauggaggucauagaggaguugucugauucauucaugugccugccucccauggaacuuuggaacuuaggacgggaaaggugaaagugccuccuuaaacugggagcgcugcauagaggucaguuagcuuggaguauuuuacccaagaucgcagucccaccuguuaaaacacugaaguugaaaugugagcuaauaaagcaagcaaaugugaaaacagaauuuuaaggcccaagcuucuuucauuaaaaauuaguauuuugaugacuaagggugcaacucaaaggcagagugcuuauuguguguguggcccaggauuugauccccaacacugcaaaaaaagaaaaaaaaaaagcaaaaccuguuuugaggggauauaaguuagugcuuacucugauuuuaauguagcuugaagaccuugagagcagcucuuacucuguauguucccuggaucagauguucccugcugaucagugagggccucucacccaggaacagaguacauauggugaguggggaugaggaagagaggaaacaggugggacauugaacagaggacaaguggagagugguggcugugcucaguauacuggcaucaucaagcaggcccuccaacuugagacaguaacacaggacgccaugcuagaaucagaagggggcuccacauuccuauucucugauaaugccacaaguuacugccacuuaaaauugagcaaaaugagcuccucuguagcacuguguagcacagauuccaauguauccaguacacuguguagcacagauucuaacauuuucuagacguuuuuguuuccaguucauguuuacuucccauccuugaaaauccuacuggaggcucagcuugaccccuggcucugccugcugcugcaugggacagcuuaacucucacuuuuuugagcuuuugaguucaaaaguuggggagggccuuuaaacauguuggcucugguguagaggaacucuccaguguugucagcuacauggguagucaggggagcaaacuguuagcccgcuguaguuuauaucggaggauccuagugcauuuccauuucuuacuguugaauguuggccuuuuguuucuguauucuugaauuuugaugaacagaccauauucaucuauagaaaggguuauucggggaccagugagaugguuuagugaguucaaucccuaaaacccauuuaaugaaagaagacgaguugucuucacacacaugugcacacacacacucagauguaacaauaaaagugaucaucauaauuuugucuauagggcuggagagauggcucagcggguaagagcacugacugcucuuccaaagguccugaguucaauucccagcaaccacaugguggcucacaacuaccuguaauagaaucugauacccucuucuggugugucugaagacagcuauaauguacucauagaaauaaaucuuuaaaaaauaauaauuuugucuauagcauugcucuugaccuuucugaggaaauuuauuuaucacauagcaguuugcuugaaaaacuggacaugccuagacaaucuuuacucugcugucugaugaguuccacauguuuauaagaccugugagauguguggcuggguggggcacuuaaaacauggauaucauguuuuaaugacaagugggcuuguuugggccguguauucacucuuguuuucuuuuaauucauguaucaguaaagaugcugggauggcuacaucagaacucacagugcugaagucauagcagcuuuaguuucugcugguccuauacauaacugcuuuuuauuuugaagaaagugcuacugguuucugggauccucaagucuugccucuuuguaucuccucaagcugggcuugagggcuggggagauaacucggucaccacaguguuaugcaagcaucaagacccgaauuuggauccccagguauugggaagacagggagaugauacaguucacuggccagccacaucagugaauuucagguucagugggagaccuaucuacaaacacaagauggagagagauugaagaagacagucaaccuuuagcacacacacaccaacacuacaccugugugcaccacacacacaaacucggcuugagccugucuuucagauacauauuuccuuucucucucucuuuuuaaguagauauguuugaugaguaucuaaaacuuucugaagcugaagccuugugcaugcgaccacugacuggaaguagaauacaaggcugugauuauccuugugaacuaagaaccauuauuuguccccaagucuauaguuauuuuuaaguuuguuuguuuguuuguugccuuaacaguaacccuaacaagcgcaagcaucaggguuuggauugcucaucucucugauacaaagcgaggccuucauuucaucacgucuugguuggacgugaagaauagcuggcugaauagguauggaagcucuccucaccauuguuauauccaguacaaguugaugagcccgcaacuaacaguguugcuucccugcaguugcucucagagcaacacauguacuugccuucugagggagcuuuaacacaguggcuuucauucccucaguuuucucuguuccucuuguuuacaaauuaagcuguuucuuuccuauucagcucuuuggcuuaaacucucccaguacgucuuucuuucaucaaugacuuacuuuuuaguguuaucacuaaacaacacauacguuccuguuggagaguaggccucagccuaaggaaugagcuccuguggcaguacugcaggguuaucagagaaacacccacccaagcucuguagaaugccaacauguacacuucugaaaacuuuccuauggagggccaaaucuacugacguggaguugaccuugucucggauggggagccaguggcagcucacuuugucaggauaccuucugaacuuccacuuagagugucacauaucagcccaaaaucuggcuuguugcuaagcugugacuuugcauucagggagccgcuugcucugaaugccauggacaaugcugucaguacaugcuuguuuguauucauuuacucaguuagaggaugggcuuuagaguuagcugcaggagucagaucucaggugaagucugaaguuagaauaacucgagagucuucagacuaacauaagacacagcuuugagaagucaaacaggaagaugccuuuuaaguuuaguauauugauuuuuuuuuuuaacugucuuccaaaucagauauaugcaggagaaguuaguuagagaacaggcugauuaacugcucccuuaaugaagauuugcuguagaucuguuaaggccuucagauaguuuagucagcuuggcaggagcagacaccagggucaaaugcugugggauguaauucauuguuuuuguguuguacagccugagaaaugccaguggccugacagcagcagacauugcacaaacccaggguuuccaagagugcacccaguuucucuugagccuccagaaccaucaaaugagccguuucugucauaauggcaccuugaguggaggucaugagagcauacugcccacucacguuagccugggaacaaaccgaaagagaugccuggaagacucagaaucuuugggagugaagaaagcuagaaccagaggugagaucuguggguggugcgaaaaggaaaggggccuacccuuuuucauggcuaaagcaacuuugagaggcaucuuguaccaaguaaguaccuggagaguccuguguggggacuuugaaguacugcccugugucacacuguaauaugucccgcuugucagaaagggaaaugcagaaauaauccuucccgugucugcccuagcagaaugccaucugacacgacuggcuuuccaaagaaccaaaguuuccacuucagaggucaugguauauaauuccagaauuccaagccagaauagaacaugccuaauuuugaucuguuuauauauacccaacuuuucuauaugcuuauaaaguuuguuuuagucaagugaaaacaguagcuucaauuuuugucuacauauuuugugucuguguauguuuagguauguuaugugcauguaaaugcauguacuuuaagagggaaagaugucagguuccccuagagugggugagguagugcucgcuucccuuccaaacccaagcagaauaaacgugggucacugagacauccauaggcugcuuucucagauguagcuuagauugcuucuucagcaaugacagacuacaaguacaaacaccagugacaggagaguggggugguacacaugucaaauccaaacauggugucguuaggauugggagagaucaauuuugcgguuugaaaaguagaugauagcuauggugacugugugcagcaugcugaacagcuguucauaggcaggaggaagagagagccuguaugaagaugucagccaagaucuguuuuccuagcaacucagaaaaugagaugcuaagcuguagacuauggaagaauuucacuccugcucagccugcuggaucagugccuuccuauggugauaggcuccucugcccugugcugguauaguuccauccaugucuuacugcaccccccagaccuguuugagaucaacaaucauugaugguuuuaauacuggaggaagaguuaccuuccuauguuuuguuuuucuuggcugaugugagcuucauuccaugauaaggaaacugcccuagguuuggggcauggagaaugaaaaucuugucccuguucuccuggggcuuuguggcugcaggcagagaaaaugcccuucacauuuguuggcuguuuuuauuuuggggacagaguuucacuaugugauccagcugcccucagacucaugauccuucugucucgaccuucugagugcugagaauauagauaacaccccacaucugcauuucuagucaguagcuaaagagguauuuaaucuaauuuucagagaugugaacuugcacaaaaacaagaaccuauaauugucacuuuguacaaggccuguugagaugcugaguaugggucuagccucuagcagguguguuucaagagugcuugggguuugauuagagacaauaggcugggcaugagcauugaaccguggccucgcuguccucgcuguccucggguccuggggaaacaucacccuggggagcaucuguuaccccuucagcuggauaaucaauaauugggaaagacucuugugccucugaaaugaggacggccuaaagcugugaaauucucccguuaugaaaacuuugaaugcugaguugcuuuauuuguagucucugacccagaaauaauuguagguacuuauuaaaggaauguuaacaaguaugagcuuaugaguguguaaaugugcuguuugugaacacgcagaagggaggcaccccaggcucaaaacaagugcccaaggugucuguagccaacaguaaauaaaagauucuucugggcauugguggcacacaccuuuaaucccagcacuugggaggcagaggcagguagaucuuuuugaguucaaggccacccaaauugaguugagcuccaacccugucucaaaaaaaaagaucuuuugaaguaguuagcauagaaaauaauaggcuccaauguggcauuuucauacguguaauauguuuguguguaauggcccuugcuguuuuccccuucccucuagacuuuucccccaaguguguguguguaaaucuaaauuuuacauguaagaagcaguauuuuguuuuucagggucuagcuuauuuuauuuagacacggaaucuaaaaccucgugauaauguaguucauaaaauuuccugcacaugacauuuuagucucuuuucuuuugauugauacauacaggcuacucuguagccauggcuaaccuggaacuugcuguggcuugccucaaacucagaccugccugcuucuguuucuugguugcaugaaccacaccuggacagugauuucacucuuccugagugaaaagcagacugaaguaugugccagugaagcaauggguaguagcaauuuuuggaacuuuuuuuuuuuuuuuuaaaccauucuuacuagaauuaagaguccauuuguuagagaggggcugguccucacugaggguugucagguuuggcacagaugaggggagagugaugaugaugguggugguggugauaucuuugcacuuccacucuugggcacaggguggcagucuaaggaaggggagagaauguggcccagcuccuuucucccggguccucuggccugugccuguguguuugccuucagguuccuguauuucuucagggagcucaaucuggacauugcugggagugggagccuguggauaaacuguacuugaacauaacccuuugcauaaauuuuuuagugaaauuaguagaugaauuuuaaaugucaugauugcuuugaaugcuucauauuaagaauugucuucaguaaauuucauuaaacucacuuguggaggggguggugcaggaaaacuuagaauuaucugcagguuauacaacucucuguguuccccaaaagaaccaucugagaauuaagacucuuggcaucaagaaaaugagcaaaaaucuggaaugugugacuuugagcugaaauugcauauuuuuuauuguagaaaguaauuucacaauaauauaaagguuuacuagugaucuuugcuucuuuaaauuacuugagaguuguaaagcuuguaguguagauaaaagcgaugcaaagcacugucuuugcuuucuuuauggacacggaaucuaaaaccucguuuucugugcaguucccagccuggaucacgccaugccucuagcaaauggagaggcugaagaugaugccgacagaaugcacguggacagagagugugcugcuguaucaggugggacuggacaguuuccuguuagcugcaacaacaccccagugguggaggacaccaagcaacaggagaguaguucuguuggaccuaaagaaauagagauauauacuguuucagcaaugcaaaccccuugucguugcaagaaucaguaugcuuacuauuucugaguucucaaacuuugcacuuucuuguccagugucuugaagaaaaaaaaaaggguucuauuauaauuuuuggcacuuguacagaugcaagaauuaaguguuuuugguaaauucuguugcuaugaggacuagcgcaaucucccuguuagauuugaagcuguuacaugaugugccuugcuuguuucucaugaggucuacaguuacgguuuccugauguggccuuuggguggcucugcacaugcuguugcucauacucugaagggagugcagcaggugaacagcuagcucacggaaaugcugggaacuaacugugagggugguggcuguggcuugugaccuacucaagacaaguuugggauaacugccccacgcucuugguugcuuuggugucuagcauucccuugaagacuguaaaauacugaucauuuucugcagaguuuauguguuacaguguccagaagacuacaacauaacccuuacuuuaauguuucaaagucaaaggagcugaguuuucuuagacuuaggauuucuaaaaugcuguauuuauuuggcacaugccuuuuccccaaucuuugggugauaacaaaaauaccauggcuaauuuuuauauaaaaguguuuuguuaugguguucauuucuucacuggaaauaaaaggucaccuguguguuuccuaacccacagguaauauugucaagcccagaacuugcucugucauagguggugauaacuuuggccaaaucauuaaugcacugggugcucacccaugaacaguuugcucagagcaaauguucauuuaaagcaaugguuucugaaaucagcagaggcuguuuugccuaacagaggaaaagugguaaaagccagagccucuccuuuauggagacagcauuguucccuuccuggucaggcaggagaaagaagcucuucgcucuucucaugccagcaggcaggucguccuggaugucagaaggccacgugggccuucugguguuuuccaguacugucugacucaggaaacguguuggcacucccuagagauucuugccaauuccuagugugaaauagcacgcugugcacagaaaggcuguggagacagcuacccugcccugagaucugcacagacagaaauaaggaguuuccuccuuaaaugcaucucugcucuuuuugaaaagcugugagaugauccugucaucuuuuuaaugucccuugcuugagacccaucacugggcuugauugaucaucuccccaagcucagccuggcugccuguacccagugcuuuguacugaguggcuucuguccgcagcugagugaguggguguagaguggacuugggugagcuggcugucacugugagucuccagcuccugcccuugacccagacaaggcuaggcugccaguccuuugauuuugagauuacauaggggugccucacagccauauauaaugggaucugaugcccucuucuugugucugaagacagaucauaugaaugaaauaaaucuuuaaaaaaaaaaaaagaaaagagaaacugauguacuucacuugugcacuaacugggaaaauaccgucugcacagacguugauuacuuugaaauucacuguguuuuuuaugaguuaucaccuaaaaagguaauuuauaauuuaucuuuggaaaaauaguggauacuuuuccccauugagaauauuuuguuucuuugcuagucuugaaauacuccuuuucuaauaguggauuguuuaaagagaaaugcuguaauuuuaggugaaaaauauccucugaacagauuccaguuguuaaauaaauuaugauuacuaauaauuugggggaaaguugauuagagagucccugacaggacacaggcaaacuauaggacacaggaaacugcuggacgugggucuuccuccaugagccacuagagcugagcuuguguggaauaugucaugucucucugagcagccccaagcauugagaucaaauuuaauacuaccaagcaagagacgugaauucccagagagcaucaacauaacuuuucagcauaggugguuucugaaaauaacaggcucugagaccuuggcucucauggucacuguugaucuggauucaguaggaacuucucagcacugccuuugacccaagacuaagaagagcaacugguguaggcagucgcugcugaagcuccauucugugcugugaccgugcacugaguggcacuugugggauuguguguagaaauggguguugcugagacaaaagcaguucguuccucuaguaauuauguuugugcuuccugcacuggaaguggacccgacuggcaccauugggccuccucaacagauccacuccauuuguccuucccuccuugccuagaaaaguucugugaggaauauucccauggguucugaugggcccucccaggagugacuuaaauuguccucugagggucaccuuaguaguuaaguaucuacugcagugugucugcuuuugaugacagcuuuuguuucagagcucccuccaaggcuacugaaauccguauguuuauacuucuaaaucugccugagugaccuugaaaagggaaccaguguguuuaggagaaaaaagcaacaggauacaaaccaaagucuuuuauaauuguggcaagaguugaacauauguuagugucuccuuccccauuggucugcguuuuggugacagguguauuucuuaaugcagauaugaaaaacaguagcuccguguugaauacauugacaaauggaagugucgucaauggacauuuggacuuccccugcgcgaaccagcucaaugggauggagagcaggagucacccgugcuuaacaggaucuaauggcguuagcaauggacagccauuguccaguggccaggccucugucucugcuaaugggacugaggagccagaaaagaccaugggcauuaaccccgagaugugugggucucuccaucugaacgggagcccaaguagcuguguggccagcaggccguccugggugggggacauaggggagagcuugcacuacggacacuaccauggauuuggggacacugcugagagcaucccugagcuaagcagugugcuggagcacacgagcuguguucggguggaacagcgcuacgacagugcuguccugggcgcuaugcagcugcaccacggcuccugagcccagcguuaccucaguuccucugcagugccagcuugaggaagcuggacagccugugcuguaggugccucggcuuucugagagagagugaguccuuggauuccuucacguagagugcugcucugugcauagacccuucucauggcguggcaggccuccugcgaggggugcuuuggaggcuucucuuguuugacaccagccuuuuuuuuccccacaucacgagacauugccaccuuuuugugaauuguauuugaucaggacaguugggcaucgcucaccuuuacuguuugcuguagcacuccugaugacacagcuuuccccugugcaaggaccuuuacagugugcagcaaccccgggaagggggcugacugcugcaggugcgcucaguggucggaugugcuagccccuucccucccuguguagacugcugccugugucuccuuagaaacagcucugcccaggauggauuagguuguuguuuuuacuccacauuuauacuugaucucuagacuuuuuuaccacaaacaaugguuuccuuuauauacaguggauguugcuguuuguaggaacugucgggucagaauauuuuacuauggugaccuauuuuuuuguuacuguuuuuugaaguuuucugcuuaaagauauauaccacuauauauccaguuaacugagagaauuuuggguuucucuuauuaaagcugcauuaaauucgugauuuuauagaaauuagcuuuuguuuaggcaacuaguggcuauacagcaaauacccaaugacuucugauuuuuguaauaacuaucagugcaagugaacugugaggugacaaagccaauguuuuaagaguguacuagcauuuuguuuucaagcuguucuuuacaaauugaauaaagaaaaugcacugcugau

SEQ ID NO: 4298 - RNA, 1045 nt, Mus musculus
ucugccucccaagugcugggauuaaaggcgugagccgccaccaccggccagcuucuacuuuuuacuuaaugaaguuuuacuuuuucccuuuugcuauauauuuguuccuuguguauguuuauccuugaggaggcuacauaguagagauuaaaauuacuguauugcagaaacuggggccugggacucaucauccuccugccucauccucccagcugcugggauuauaaauaugccaccaggcuacauaccuuacauugcaacauuaaguagcauaaaacaaguaaucagaaaccagacaauugauaaaggggaauuguuaaccgggugaacacacuacacagccauccguucaaauaacaaacacucccugugaaggugauauugagaaauguuccagucuacauagacaagugugauguuuaauucacugagcagugacuaaugcgugggaaauaugagacgucaucugucugucucuaguucauaaucggugaggcaagagcacagcguaauaguuuugguauuacuugggugcuugcacugaauggugggcucuuguguuucaagcuucuuucacugagaaguugguuuuguuugacaugccauuggccuguaugugagcgcauccccuuaagcucuggaaagaggagucucauuuugcaagauaacagguguaccuggucagcuuuuccaacaagggagaggcacuuuccccugucuucuggggacugugagccugagauuuauacuuaagggaacucccuuggguguagaaucagaucuggaucaugugaccaacccauguucgccuuaaacauguucucaugugcagcguggcucauguggaugucugaggauaguuuugggaaccuuuuucuccuacuacuuggauuugugagguugucuucagcucaucagccuuggcagcaagcuccuguaccugcugagccaucucacuggcccaugcuuugcauuuucaccgugaauuuuauuuugcacacaguaucaaggucuaguaaaauaaaauguaauguuuggauucuua

SEQ ID NO: 4299 - RNA, 9361 nt, Mus musculus
cagacacuuguggaacacuuugauaaaacagcucguccauuaugaaccauugaggaaggcucagccaacuucagcgacuaaauaugagccguaguauccauccacauugacagguaagucaggacucuaagaucuguggggacaguuugaagaaucaguuuggugaaugaaaacagacuguggguaagugucugagacaagauuucagguggccuggauuggccucaaacuugcuccguagcuaaggaggaccuuugaccuuccaucuuccugcuuucaccucaugaguucugagauacaggugugaagcaccacaccuggcuuaccccccccccccaacccccccagugugguggcugaucuuggcugucaacuugacaugccugggaagaggaaaucucuguuggccugugggcaugucucugggggcauuuuuguuuuaauugcuauuugacuggugugugugugugugugugugugugugugugugugugugugugcagaccaccucugggcaggaugcauaaggaaaguagcagaucaagcaaccagaggcaggaagccagucuugcuccauggucucuguuucaguuccugcccccauguucuugcuguggcuccccucagugaaggacugugaccuguaagccauacaaaccauuuccuucucugggucacuuuugguccguguuuaucacuucaucagaaagaaaacuaggacacuauggaauuuuauaaaauauuuagaacucccuugucuggcuuccuaagaaaacagcacagauuuuccccagagaguguggcuuaaucuuaugaguauugcagugccccauccugcugugucucccucguuuguccuacacugugcuuauaaagaucaacuguuucauuacaaaucacaagugguaaugugacccaccugggugugacugcaggagcaccuacuuuggucgaaaguuccacagauuuggaaagaaauccaaauccagcuuaaugagugguuuuuauuaaauuuuuacuagguguguguguguguaugugugugaguguguguguguguguaugugugugagugugugugaguguguguguauaugugugugaaugugugugugugagugugugugugugugaguguguguguguaugugugugagugugugugugugaguguguguaugugaguguguauguguguguguaugugagugugugugugagugugugugagagugugugugugugagugugugugugaguguguguaugugagugugugugugaguguguguguguguguguguaugugugugagugugugugcaugcucacacacucauguauguggaguucagauguauauagaggucagaggacaacuugugggauuuaguauuuccuuccauuauguugguccuggggaugggacagaggcaucuuugcaugcuuuagaauuuuuguauguuugcuuaguuguuagagauuuuuucucuuuuacuuaagcagucuuuaaugaaagccgugcaugggaugucucuacuccugcaucuucucgaucgaucguuucuuccuuguauuugcccuucuccuuuccuacuugucgggacucggcuuuccucuccaggaucuucuugcaguccuuguccagcuuuagccuggugauaacgaccuugcugggguggaugcccacguggacgguugugcuauuagccuucucucgcuggacgcguucgauguagaugacauauuucuuccuguacaccuggaccaccuugccaaucugcuggccuuuguaguguccuugaacaaacugaacuucaucauccuuccgaaugggcauagaccgaaaguuauacuucugucucagcucuggaaagaggggaagacgugaucuuccuccgaaugugagagggcgcauugacaugccgcuugcaguucuuugcuucggucagaagucacgaagggauugaacuucauuuuggcggcugugauccaccgauggccacaaaaggaaagagcgagauuuuuuaaaaaaagauuuauucacuauuauauguaagcacacuguagcugucuucagacacacgagaagagggcggcaucagaugguugugagccaccauguaguugcugggaaucgaacucaggaccccuggaagagcaaucaguguucuuaaccacugagccaucucuguagcucuuagagauuuauuuuuauuuauguauauguggcaggggguggugucuguggagcacagaaaaggguuuuggauccccuggaacugguguuacagauuguuguaagcucuccaucuuggaugcugagagucaaaguuggguccuuugcaagagcagcgcuacugagccaucucuccagaccccuguuugaagggcuuuuuguuucuguuuuuucaaguguauuuauuuuagauauaucagcucccauuuuauguaguagaugucuguggaaaucuuugcagggucuauagucagcacauuagggaaccgucuuuaguugggacagagcucgcuccagcuccucccagugagaccucagagagguaagagagacccagccaggcuccagaagcucaggguagauaaauagagcccuccccugccccuuguggugucuguccugugccugacuuugguucuccucaggccucucucuauugucucgacagccaaggaggugaacacuugaucaaggguuauguuuaucagcaagaacuacucuaagaaaucauacauguuuuaugaagaaguuaaauguucucaacauaguuuuauacauagauauuagagggcuuuuuuauguaacuaaaacucuccagaguuacccaguguuugcugaucuuugaggagcaaaguugacuugcuucguaucugaggaugaguucaacuucggauccuucugucuguaccucuugagugcugggauuacuggcaugugccaccauguguggucuacacagugacagagaugggaccaagggcuuuguggaugcuaggcagucagucugccaucuguucuaaaauuaagcaucgacuuugccucggucuguuugugucacuaugacaaaauagaacagauggguaaucaauaaagaacagacagugauuacccaucaugcugugcuggaggcugggaagcugaggucacagcuucagcaaggccauuuguccagagaggaccaagucuugcucaagauggucuuggaguaauauguccucacaggguagagcacccugucccagcaggaagaguaggcacacuggcacaaaaccucuuuuugaagagucucaauccauccacaaggggaacacucaugaccugcccacucugaggucugcaccucaccucccucauugucuguggaagcucaguuuguggaguuuggaggagaucaagccaugacuaaaccgccugaaguucagacugugugaguuccugcuucuagguggauacuggcgugaaugaucguugucuucuugcugugcgccugaaccaaaauggacucugguauguguguguuggggagggggguguaugugucugucucugugugaguaugugaggguguguaugugugucuuuuuguguguguguauguguguuugagcacguguguacacacgagugagccaucaagcaagcaagcaagcaagccagcgagagagagggagagagagagagagagagagagagagcauccacaugcaugucuauggaugcacauaugaaagucagaagucaaccuuggauguuauuccucaguucaccauccaucuugguuuuuaggcaaggucucucaugguuuaggccaggcugauaggccagugagccccagggaccugccugccucugccuuccuagugcugggauuacuugugugugccaccaugcuuagccuuuucugccugguugaacucugguccuuaagcuugccgggcaaguacuuuucagacuaaaccauuuucccagccccaaggaaguuagauuuuuuuuuuaauauagauguugugcucuacccagaaaucacugugucuucucaaguaaggcuuuaucuagcaguucagguaagcauuggagcuacuagacuucugcuuucuuguugaaacccugccagagucacuuuccuccggcaccaaacucuaggagcaggaaggagagccccagcauagauagggagucacuuccuaucuggaaggugugaccugccugucuggggccuggggcuuuuagagcuggcacuaagauagaauuccaggaagcgagaugcucccuaguuccucuccaggcucugucacgucccuucucuccaaaccauccuugucacgugccucuaaauucucccccauucccuagcguagucuuucugcugugucugguccagcagccuuaaacaugcuuaaggcaaggaucugccccuuugcugaggucucugagucacccggacguaguucccaaucagccccaucaccagccuucugccucaaagcuguuuucccaggauuucacucugggguccaaguguuaguuuuuaaaaguuaggauucucucaaaagccacuaaacaauccauagggucuuucaaacugaggauucaaagacuguuaucaggcuuggccacuuagaggucacaauuucccuugcuuucccaugauauaaccuaggucaggguggcagagguggcugacacugccccaguaaccagaacaucuaucugggagggagcagguugucacucacaaugccagucaagguaacaggcccauucucuggggcaaggcccaucuuaggggaaguaccuccucucuguguguguguguguuuguauaugugugugugugcaugcacacucugcauggaggcugaucagaaugcuaggaaggauggagaggagacaauauagaagccucucccugugccucugcugaucucacaggagaccccaaacccagaggguuucugaagucugaagucaggcacuaccuccuggcaaaaaacuuuuaaaggcagagaaaaguuaaaagaacuguaucaaugaacagcuccaaggaccacaguaggcuuggacucuggagcauaaggucuccgaauguucuucugaugggcaaacaaagcaggcccuuuguagccuccaagccuguauggucaugacuaaacaguccagguaagcaugagcacuguugggaucaccccuaagggacaggaaagcacagucaucgcagcugggcugggagcagccuggggucaggaacgucugcaaagagaguugcagccuugauagguuuuggcguggcagaucugauagugagccguguccucugcuccguagugagcaacuugcccagagucacacccagcugucuggcccauccuuucccuuucucuuccuccucccucccuuccuuccucucuccuucccucccucccuuguuucuuuugugugugugugugugugugugugugugugugugugugugagagagagagagagagagagagagagagagagagagagagagagagagagaaugaaucucugguagcccuggcuguccuggaacuugcucuguagaucaggcuagccucgaauucauagagauccaccuaucuggguucuggaauuaaaggcacaaggcaaaauacuuuuaaagguagagaaaaguuaaaagaauuguacaaugaacaugugccuuccaccuagauuacaaaaucaccuaaugccugaccccuggagaugguucucagagcgcauaggagcacccauugcucugugauacauuccagggguguguuucuaauacucuuuccugagaauauuugugugacaguuauaccauuaugagaaugaaaauugcuuuaauucaauaacacuauagcaugcauuuugauuuuggagccgguuggauuuuacuuccugaguuucagacuugcccaucuccagugugccccaaacccaucaggaauuuugggguuuguguaaagaaugaagugggguuugauugcauauagaaugucacuguugaucagcaugugcugagcaagggggacgucccuccauugcugaccugggauguggcucugugguaaggcagagaucagucauggaugugguuccuagaccuccauccagucucacugaucuggguuugcccugaguccuucuccacuagaaaucacagcuuugugucggguccugaccugccguggucucccuuggacaugcuauugcuguuucuaccccuucuacucaacguaucucuuacacuguaccaacuggaauaaugauuacaugagccagucugggacaaauaaugacacuaggucucaauugggucaucuuuuuauuacuucuuaaaguuuauucucagucccuuucccucuguguucucccugucucugccugucucugucucucucugucucugucucucucucugcacgugugcaugugugcacaugugccacagaagcaucuuucaggagucacuuuucuccuucgucuuuguggucccaggagguugaacuuagaccaucagacuugucaccaagcaccuuuaccuacugaauuaccagucaucuugcugguccugggggacauuuuauuuuaacuugugggguuggagcucuggcucagcacuagagaacauuggcugcucuugcaaaagacccagguucaguucccagcaucaacagggcagcucacaacugucuguaacuccaguaucgggggaucucaaugcccuauccuggccucugagggcaccaggacacaaacacacaccgacaaaacacucauacacaaaaacaaaauuaauuucaacuuguuuguguuauguuuuugauaauguuuucauaucuuacauuuauuuuuauauuaaugaugacauuuuugguuuaaguuguuaucauuggugauuacuaacgaagucgauuguaacuucauggcuuucccccacagauagccuguauuuaccugcugcuuucuuguuuucuuuuucuuuuuuugucuucuguaggaggagauaguuccacaccaacaaucaacauuuaauucuuccucucacaucuuuaugccuuuuaauucccuggaacuuuacccaugaucccuuacugcuguggaauacacuucccccacagugaacauuuuuaucuuagucacaaggugacauuucccacuugaggauaugucugaccucugggaaguggcaguagggguuugaggaugucaccucuggccaguuaacaauaagcagucacgaagcccacucguuucagugucucuggcuacacuuucucuuccuagugaucaccaaccugaagagauggauaccugggcauggcugcccgucccugcuugugccuuucugugacacuugagaacaaggcugagucccuaaggcaccgaggaaacaucagaagcagcugaaaccccacaggggaauaucugauccaucuugagcucauuacuggccgccagacaugagcauagggucaucuuauggcuacuccacccaugcaggaaggugcugagcugauggagcagaacggagggcggcaccauuucaggccacagagacuggaccuggguuucuuggugguuguuguaugugcuaggguagagcccagaucuacagcuugaagcccacccagaaggcccagugugaggguaccaggugcacccaggaaggaucuuaccugaacuccccaacccaggacuugcauguuguuugagccccuccaucuuuggcacauuguuauggaggccuuaaccaaccaaugcaagcgguaaccuacuagagaaacauuuuccacgccugacaucaguuuugcaagguugcagacucaaacuugacagugcaugagaacaggcaagcucugugcgccagaucagcaagagacugcuaugccaucgagaucaccagaucaccgaccuauguaaagaagucagggguguagagcucaccccugaugccucccccacccccuccacaggugcucucuuggguggagaugcugugauguggccucaggagaggggcuucccuugggccagcucugacugguuuaugaagaucugucuucagcaggugucacagacugucccuuacuagcguccccagaagcugaacccaguccugggauccaaauccaugagccuccucuucuauccacgugcuaaccucucauucugucaggauggucuacuagcugaguccucuugcugugcucaugaguagguccuuucugagaucuagagaugacuggguuagagagccucugggugucagaggugcuccagcuccccuuuaggagcaaccacacaucucccaaauccuccacagggucaugccaagccuccagguacaggccugcucccgucccagccgagucauuuuccuuggugugugcuguuuccaagucagcuaaaguagcacugcccaccccugccuggacagagcgaguuaccgauguggaaggagggauggcgcgcaauggaugugcagaccuucugcuuugugcuauccuagcucuccggguuccuguugggcugggaguucaguacagcugaggccagcagagacucauguuguauagcuuccucaaaccaugguuuagaaugugggucccuaagcagcacugaguuaguaggacuuagagagggcggucuguagacuuagcaggugcuaacacugaggacgcaggcuggcgcagcuguggagcagcuggccucgcccuggugcuucagccucgccauccuggccaggcucagggcugggguucugcauauugagacgccgcugaggacaugccgucuaccagcaaaguuccuuguaaaucuugagcguugauggauuuggggacaugugagugucccuauucucccucugguggacuuguuggcuucuugccuaggcuggaggaccccgagagcagagaggccuuguggaaaggcuauccaucucucuguaccagguuuuauaauagcagauaguaggcuugcuugggggugugcuuagucagcagagugcuugccuacuaugcauggaguccugaguucuggcuccagcacuauguagagcugguauggugguucaugccucuaaccccagcccuggagagcaggaagagucuugaacuauguauguagcaugaccuuaucuuaagcaaacgcucccuguuucuugucucuucuuugaaccauauccccuggacccugagcugaggggguuccgcccagaacucggagcuccauucugcacugguggugguagggcaggucucccucuacauacacauuugcuaaugcugucuagacagacuugaaauuaaacuuaguucuuggaca

SEQ ID NO: 4300 - RNA, 57975 nt, Mus musculus
uaggaacgcguugcugcgagcgucgcccagcaacgacuuuuccagcgcggagaagcugccaagugcagaagccgggagagcgcacgcgcgucucgcgcgggaagcggugcauuaugggaggcgcgcgcuuuugccgcuuccgcgaauauggcggcgccguaguuagggcgcgggauccuggggcgcggggaggcugcagugcgcaguccgggcgcgguaauggcgacuccggaucagaagucgcccaacguucugcugcagaaccugugcugccggauccugggccggagcgaagguacgcgucccgggguucagggcuguggagacugagcgccaugacccccgccggccgggugcuguucuccccggcccccgggaaggaaaggggugcggcucgcggacugucccugcccugggggcccaggccggagcugcuguagcggccgaguuuguuuuuggguucguccagacagcacggcagccugcagcucugcuucugcgugcuucucacucugcugucaccuuugccucuggugaugaugaguccugguuagaugaugcucgcuuauuccuggacgguucagcuagcgaauaaugcuucuaagaagccagacccccaaggcaguccugcccacuuuacccguacugucgccgccguaguuggggguggggaaaaugucaaggaucugguuucaugaagcucauuuuggagaugaguggggacgcgucuugagggaagguuuuaguaauugacaugacuggguugccuuagaauguugagacaaaucgcgcagguuuucaagggaagacuuuaaacaagaaccgaguuuuaaaaacugagagagccuuuugaucuuucauaauuuguaacaaccuauguaacaacuugucagcguagaggaugaauuacugugucacuacuaaaccguugacuuaacucccuucuugcuuuauuccuuguaguguuucacugugcaguuuguucauguaagaaaucuuugaggcuuccucgacccuauuaugccaugagagaugcuccugucuaauggagggaaugugacuagcacguuggugaauacacaguguuugugggugauaaagggcuagggagaaggcggauaggaggagcuuagaguuccaguaucuggggagagugugagugcagaggauaguuuacuuuucugaagggagugauccagucauaggcaaaauuagauaacuaaggcuuaacacgccauaccaucauuuuucuuuuauugcauuggguccaaaauuuuuaccuuccagaaagaaccucguaguuauagcuagauuuugaaguuauucauuaugaacuucuaaauuugaauuuuacauuaagaucccuuuugauagaaguuucacagccuucaggugauugaaaugcuacuuuaaagcagaauccuguauccucccauuuucccacccccauuugugauuaugucuugugaaucgcuggacuuucagagagauccaggguaaagcucauuaaagaugaugcugucuucucuguggauggaguugagggaugcagagucagcuggguucucugcccucacacacuuuguugauauuuuguugugcucugacagguguguagccauagcuaauuguugucaucucuuuuuccugauucuguugagcaugacuucuuguuuggccauucagaucucuuccuaagguuguauuuuauuuuguuuucuuuguaacauauguucuugcuggguugcuuacccuuauaacuuugaguguucuuuauuuaucuggguacaguguucuuuaucugcuuucuccacaagguggaaggcaaggauggauuccugaaagcagugcugccuuacuccccaaaugcuccccuggaagaaagaggaaacaaaacaaaacaaaacaaaacaaaaaacacuuaacauuaucaugauuuggcugucaugugaagaacuguuaucaaauccaaagucauaaaauuucuuucaucuuuuugcccuagagagguucuguucuauuguuaugugugauaugaguuaguuuuuuguuaaaugguacaaguugagacuauuuuugagccuaccaaaggaaccaucuucccuuaacuauacuugucuuauucuugucuuguagacugaaaguguugaaguggaaccuuuaagaguguugauagcaugggcuguuguuccggaccaguaagaaccaggguuuguguaggagagggccuggugucaguacauauuuuaaaagcaccuaaaguucagaaugguuuagauuuacaagaaaauuguacacacaugguucucuuuugcccaacaccaucucuucuggucuuagugucuggcuuacugaggugcagugucacaguccguaauaauacauugauauuguugaugcagaaacacaguuguugccucaaaggaaguuaagaggugauuuauuuuggaacuaagcauaagugacuauggucuaguaacacaguuucagguuaccccuaaugccuuguuucaacgugauuaacaguuauaugaagcuuaguaacagaauggcauaaagucauaagucaagguacuuuucaaauacauuggcaugaacaucagguacguggguuaaagcaaaaugggaaucucuguuacuggucucagguacuauuugaugacagucucauguuaggguugguggaggcuggguucucuacaugccaacacacagaggcaggcagugaauggggccuuuaagagggcuuaggauagguggccaagacaacuuauuagcucgagaccugcaacauucuguccagcugucuauaaucacaggccuucuaauagucagucagucuggaagaaucucuaacaugggcauggcuuucuugggaaguucaguucacaguauugaccaagcuccaugcuuuuuaggcuccuucagguguugcuuaguacccagggcucccucucgugugaggccacuuguucuuauucuuugucauucuuacucuuauuuggguccccgugggcuccucuggacuuggaucuuuuccaauauuuguuuuguuuuuguuuggugagcuuggcaguuuugaagauuaaagauuguagacuugucugauauuuucccagugacugagugggauucugucuuggggguggaaauucugggccuggagugccauuuucaccacacgauggcaggcauagcaugcucuguuacuguuaauguuguuccugacugcuucacgugggcgucuucucuggaagcacgugucucucacugauggagcauuucugccaaguggauguuucuacaagaauguuaacauuaggccuucuuucagguuucugggggucagugccgcuaucccuuguaguuuuaucuccgaaugaacacuuuaguuuagaaugaacaauuuaguuguuucaguuuguagauuuuguuguggaaacuaagauuauugacuucaagucugucuagaauaucagauuuucauuuucauuaaguuuauuuucagaauuuauuuauuuauuucuugguggcauguauauuaugaaucgauuggucuccaaauaauuuguguacuggcuaguccuguaucaacuugacacaaacuguaguccucugagaggagggaaccuugauugagaaaaugccuccuuaagauggggcuauaggcauuuuuuuuuuuuuuuuuuuuacaggcguagggcauuuuauuaauugguaugaaaggacugauugguauggaaggacuuagcccacuguggguggugccauuccugggcugguaguccugaguucuauaagaaaauaggcugagaaaaccauaaagaguaagacaguaagcagcaccccuccauggccucugcaucagcuccugccuccagguuccugcccugucugaguuccuccccugacuuccuuaauugaggaacagugauuggaaauguaagccaaguagacccuucuccaagcuacuuuuggucauggcacagcaaugauaacucuaagacacuuagugauuuauuuucagauuugauacugaugucuaguuuaauucucuuaguguuggagaauauaugauugcuaauuacagcuacuuuuuaaaaaucugugugcaccugugugugcagucacacacauaucaguaugcauguucauucaugugucagcgcgagaacacacgagucuguggagagcagaggacaaccucuaguuccagaccuugucuuccccucuuuuuaaaauaugaccucuuguuuguuucuguguucaccaggcuaauuggcccaggagcuuacucuuuccuuccuccccucccuuccccuuccucucuguauauguaugcugucuucaaaugucugaugguauuuaggcaggaagauggucaggguagccuuuucuaguugucauacuuuuuaguuggggguccagcuggugcuggagccucccuugccacugucuuuucucuuggcuuccucuggcugaugacuccccugugcuaacuugcuguguguggugcccucugagguuugcccggaugggggucugguugucagguugcugggauuugggcaggcacuggcuuuccuccacauacacagcuccuuccuuugcuacguagauccugagaaggacggcauucccuucucaagccacccggggcuucuacagaguauagaaugacucuucuugacauuugucccugugggagguuaguuuuaauugccauucugacacaguauagcaucacuuugguagggagugucagugagggagguaugaauuaaagcuucaagcuccucuguugccuuggcuuuccuucugugguggacugugccuugaucuuugagcuaaaauaaacccauucucccuuaaguugcacuugucaaaguauuuuauuauagcaaaggaaaagggcuuucucuugggaacuuggaaaacacugcugagagaaaugaggacaguagaggccuggcuccugaggccuccgagaacaagggcugugucaggaaaugggccagagacaauccuaugauauucaauaagaaucugguuccacuuugccaccacugugagaccuugaaugaaguugaauuuaaagauaaugaacuauucauuagaaaggaguguggacaagcuucaagucuuugacaagaaagugcagucaacacagcagcugcagggaucagcacccugagagagcaaccuggccguccacacugggacuugaggacguguuuccccagggucagcacacacaagcucacagaacugugguccacgguggcaaggcugccccucugaauggugacgcugucugugugccacuggucuugaaaguaugaaagacacagaagggaggaaugguggagagcagcugaggucaggcacuauguggcagggucgaggccccagagagcagcaaggccucagaggccacugugaggagcuugaagauaaagcauaagcuguaguagagaccuaggaguguuggggaugccaggaucacaggguaugugccaggaagagcuacaggcaugcaguggcgcuggaccaaguuugaaggagaagcuuaagggcugaaggaauggggcugucugaagcuuuggagcccagccaguuucaucacgaggcccaaaugcuggacaugggacugcaggauuugguuuuggccacauuggauuugggguuuugguuugauuauuccuugcuaugcccuugauuguuuuauuuuggaauggaauguuuauucugugccauuauaugcuagaaguauauacauuuuugauuuuuauaggaguucacaauucaguguuuugaacuuguuaauuuuugaaaaaugucaagacuuuggagacuuaaaguuagaauguauuuuacauuuacaguaugagggugucuuaguguuuauugcuguaaauaaacacuaugaccacagcauuucuuauaaaggaaaauuuuaacuggggauugcuuacaguuucagauguuuaagccccaauuaucgucacggugggaagcauaggggcaggcaggcagccauggugcaggggaaggagcugcaggcaacaggaggagcagagccaccgggccuggcuugggcuucugaaacucaaagcccguccccagugacacacuuccuccaacaaggccacaccuccugaucccucugaagcagcaccauggccugaugagcaagcauucaaaucuaagagucuauggagggaguauuccuauucaaaucagcacacuuuagucccuggcccccauaagcuuguagucauaccauagugcaaaaugcauucaguucaacuucaacaguccccauagucuauaacaguuggagcaccauuuaaaaguccaaagucucuucugagacucauguuaaucuuuuaacugccauccucuguaaaaucaaaaugaaaauacagaucauauacuuccaacauacaauaucacagaauauacauuaucauuccaaagggaggacuggaccaaagcaagaccaagaacuagcauggcaaacuccaaacucugcaucuccaugucugaugucaaauguucuucagaucuccaacuccuuucauuuaaagcauucaacugcuuuccugguccaaagucccaaaguacacauucugccaauagucaacauggucaggccugucacagcaauaccccacuucugucuuagucaguauucuauugcuguggaacaaggcaccaugacuauggugacuuuuaucaaggaaagcauuuaauugggguuugcuuacaguuuuaaagauuuaauucauuaucaucaugcccagcucccuuucuguacucuuaauaaacccaugauccucuguccagggagugagacacccacaguggugacaggcaggcagaagugggagacggagcugagaguucuacaucuggaucuguuggcaucaggaagagcagcagccacuuccugugugggcuucugaaacccauaaggucacaccuccuaauuccucucaguuagcucuacucccuaaugccccagcauucagguauagaagccuacgggggcauuucuauucacaccaccacggagggcaacaugagacuuugggcacaaagaggagaaggguauagguuaaagugauauguugugugucaacuuggcaagaggugaaauuguggugacuaguuuuuugguuuuucgagacaggguuccucuguguagcccuggcuguccuggaacucacucuguagaccaggcuggccuugaacucagaaaucugccugccucugccuguggugauuaguuuuauuuaucaucuugacucaaucuagaaucaucugaaaagucagucucaaugagagauuguuuagguuggucugugggaacguccuuagggaauuauauugauuugugggaaguccugccuacugugggugucaccauuuccaggacagaguaucauggcuuuauuaagaguagagagagggagcugggcauacaguuuuaaauuccuugcuuucuugacuggauguaaugucaccaguucagggcccuggcucuugacuuccuugcagugauggauuguaacuuagaauugugagucagauaaacacauucuccuuugaguugcuuuuguuaguguauuuaucaaggcaaccaaaaacaagggcagucccacuccccuucccauuccugaccuugcagacauuggguuucuaguuugauagucuuugagucagugccacaugcccaucuguucucuagcuuuucucucuggcuucacaucugccuugguaaguguauguccuuauuuaaagugcuuuauucuguguguguguguuugugugugugugugaguuuuaaaagagacaaaccuauguugugacucuucuccacacaaguugugccucuuucuuccuagagcugagggccacucaaaggcucuccgccaggcuuccuuucuaagccccaugccuggacugugacuucagucacuccuuuuaaaacggcuaugguuccagucuggcuuaccucuagauuuuuccauauaucugcugucuuuuacaaacuuuauagaauucuuuugcucaagccauugauuucauaugacuuuucugcccucugaguuaaggcuggggaaggggguuugcucccuugaccugugugcucuggugaugaaagcugucagguuauaacuugcacccuuccgcucgccuuccagcugauguggcccagcaguuccaguuugcugugagaguuaucggcagcaacuucgcuccaacuguugaacgagaugaauuucuaguagcugaaaaaaucaagaaagaacguauguauuuuucuuaacuauuacauguuggauugugaaacuugugaaaacuuauuucgacaugacguguguguguuuguaugugugucuuuauguauuugugcaugcauauaugugcacaugugugucuauguauguauggacacguauaugugugcauauacuuauguauauauacauauguauguauaugugucuaucuguguuuauguauccacacauuuaugcauguauauaucuauauauauguuugcacgcaugcccauacauguaugugcuaugagugcuauucucaaguauguuuuaauaauagauacuauuaaaaauaaggacaguuuaauuauuuuuguggcauuauaauuauuaaaacauagugaagguuuauuuuaaacugucauaacuguaauuuaguuuuccaauacaaaagauaaaggacucacugucacuucuugccucucugaucugcaguaucuaaugcaguuaaccacgcuuggaggcauugcugccuuuuucaccgucagaccugcagcacuuaagagcugugugagcgucuuacuucugagauggcacuucaggcucucuuaaguucuccuccacucauagcacuugguuuggguugaagucagcuuugccaccccucccagcuucugaagugcuuuguggagucuaggcugagugacaggcaguccucagcagucugugggagagcuguccugguccugauuuugugggugugugagcaugcugaaaacggggccuuucagugggacuuaaacccugccguggauaguagccagcuucuccuacuggggccuacuguuaaacuucccagaugaagagggcuuugauuuccguucuaaguuuuugccaauuuggccacagcacuccuaggaagucauucugcuugacauaguauccugcccugagcuguugcauuaggaauugcaugggccagugaucuguguggauguuaucuuucagagcuuaacacagagucagggaguggaggcuguggccccacaaugauuggaccuaguaccuuugccuacugaagccuuaagcagugugacuuuaaggacccagaagcuggaauggcaagcugcagugauccucuuugucaguugcuuuacugugugguuuuaaguuacccauaaucaaguaugacuggaaggcaguggugggaaaauacaucccagauacagaugaugcauagacugucaagucuuaccaucccaaggaaugcaugcguggaagucucauaccaccccacugcuuccugccuggccgaggagccaucucuguucagcaugccuaugcucugugugcugccugccacauugucccaugagucaccuucucagucaccagagccagggcuaugcgucucauggcaaggcugccuucagacugccauccuucuaccucaucuccucagaugcuaggaaugugggcugccuuguuuuucuuaguggccccaaggcagaaggacccugaccccuguaaaucagcuaugcuaaagcaagucagagugcuuccugcaccugaaagauugggguuacaggcaccccaccccuggccuuaggcccuagcucaucucaccgguuaaauaaguagaaaaauaacagugaguauauagccuguuacuaaagauugaagcuuacuuuccuuccaugccuggcaaguuucuuauggaaauguaaauucuuuucaugagcucuaagcugcugacacucuagauuacuaccaagaccucaccauuuggugucauauaaacauaauuuccuuugugaauuugauuucauggccuccuguuaagcuuauugccagugugugucauaaugaagucauuauuacagaguuucaaggaagucauguaauaaucaaaagugauaaauggacaauaaaaauaauauugaaaauaaaauuaauaacgauauuaauggauugacauuuaguuugaaacagugauuauuuuacacugaagcaauuuggaauacuucuggacaucuuggcgaaaauguuagaauaugauuuuuguuggggauggguggacaaggucucaucccuguguagccuuggccagucaggaaagcuggccuugaacuuacaaagauccaccuaccucugccuucugagugcuaggguuaaaagcauacucugccacaccuggcuagaauguggcuuuuuaagucagaugaacugccaugcuugcugauccuaugaauuuguaauuuccuagauagcuucacucuccaucccucccuccaaguaccugguaucaguuaguaggguuggcggugguuugccucacuguggauccauaugugaagacagucuugucuuuaacccagcccaagagucuucauguuuuauguguaucagagaagcaaggcgagcugaccaaaccgauauugcuaaaagucuccuugccccauucuuugcauucuugugcucagguuucuuuuagcauguccuagucuguuagugcagaugcagugacuuuccuaacacugaauuguaugugcaacuaauagacuuaauuaauucauuuucuaaacuuccaguuauucgacaaaggagagaagcggacgccgcacuguuuucagagcuccacaggaagcuucauucgcagguacggugaggucuucugggagucugggaguggagagcggcucuaggaugcuuggaugcccuugggugcuguccuuuaaaacucccugugaucacuaauggcuuuuaguuguagagagugcuuccacuugagagauucaguauuggaaguguuaguugggcuuucuguuaaacuucugauguguguccuggacuccccaguuugcauugcaauuccucgauggcauugccaggaguaggugugcugguggugugcacaccuggccccgcugcagcagaagcccccauggcugaugcuguugugauaacuaaagggaaaugucuucccaaacuaauauuuugauaacgauuugucagcuccugucaaagaguuacucgugccacgggguagauuuugugguuuccgaccaugaggaacggaguccacgcucugcagagagaguuaagggccuggguuacuguuugcgcagcaggugcuguccggccagggcuguggagacugagcugcuguucuuccaguccucgccucugcagccugaaaaugagcuccgugccugcccagagcuuugaugccucagugcaccuucaugcaccuucgcuggggagggacacuucuccaucuuggcaagugcuuaggaaguaagaacgagagcuuucugugcacccaugucuuccagggaaugcacuguaguaucgcuuuuccuugucuucagucucucuccaucugagaaugacuucugaacuugcaaugugacaugggaguuuagugugcuauaaggaggcagcugcuuggccuugcuggggucacggagauaguuuuaugccccaaagccuguuguguauguugcuguggccacuggauggaggugcccuugggaaauugaccuuuaagaaggcuguuuucuaacuguuagaaacucuguuuauuccuaugcuugcuugcuugccugcucccccucccuuuuuuuuagacaguuuuuaaccguuuaacccaggucgugcugaagcucacuguguggcccagguuggccucucugcuccggucuccccaguucugggauuacagguauaagccaccucagcuggcuccuaaacauuguuaugaugguggccagccuccuacagcuaccgcacagaacaaacguaguugaauuuuucauacuggaaaugaacuaauaacuaacgaugggagacaauggucuaauacuaaagcaggcaauaugcccagagaaauagccagucuagcuuucugauuaaacaaaagaaauccagcucuucacagugcaaggcucacugauucucucuuuguccuguucucuguucagcgggcuccuugucugcuguguaugccgugguugccaugggugccgugggaggagggcucaagggugcagguuguuuucagagccagagcauggaggauacaggugugacauaaggcagucugguugagcugaguuccaguguggccaauagcaagggugguggcuugucuggggaugaaaccuguguacagcugggaaugcugagacaggugguggggugagugaaggcaguagugggcaggugcugggugaaucuuugcuuucauauuuugucuacacucaaaguccgguggacgcagugcaggaagcugugucuguaucuaggcccuccuggcaggaaucugaacugucugguugugagggcugcugugggagcucagccucagcccugccacaguggcuguucuuccucuccuugcucccccagguggauugcuccauaccaucugagcuucagcuggaacuggcuguagugccggggagcuagcuggguuggggggggggauggaggcaagggugaauuguggcuugauaguguccccaguccuguccuagggcccuggugaagccaucuuggcuccuuggaaugguagcuuccuggcugcugcagccucuucuuuuccugucccuaucuguaccucuucaccucguugucaacacuuguccccuuugguaaaagcagugugguggcacacuccuguaucucagaacugggaggcugaggugggaagaucaguuuagcugcucagagagggagggggagggagagaggggacuguggggggcagacaggauccuggcaagccacugaccugugaacccuguguccuuuccuucauguucuccauccacucccuugcuggauaaagugcuauacccugaggagcacagcaaaggcuccagccuuucccccgagugcgaugcauauccuaucauuguauuuguagugucugggccccaguucuagucuacagaucuguucaugguuucugcuccucaugcugaguuucuagagauuccucggggacccagcugugcaaguugcugcaugucuguuucuguuagaagcgucagggugcucaccaggguggaguucuuuccauucuugucuucucuuuccauaacgcuccguucugcuccaaauggggcaucaaacaagaaaaccagcuuacucuuccccuuagagacaagguuauaguauguaguccugccuggccuugaacucacagagaucugcuuaucucugccuccugagugcugggauuaaaggugugugccagcaugcccagcuuaauccacagauuuuuugguaauuacuuuuaucuuuagaggguuugguaaauuuuacuaauccaaagcaggguaacuuugggauguguuucuacagcguuaagaaccuggggguguuggucccagagaagacugaucguguccagucuucugagggguggcuccaugcgugacccgugaagugagcucagauuaaaugucaacaggugaauuuuaaaauggaugucugguuuggaaauaaguauaggagagaaaaugaaacaaaguugauacacuagcucuuguaauacuauuuuuuaucuaaacagggaguuuugaagaauaaauggucaauccucuaccuccugcugaaccuuagugaggacccucgcaagcaggccagcaaggugggugagcagccccagcguggccugugggguggcuggaccgugugccauaggaaggagaacagugggacaaagcauaaggcccaucuucggaagccacguauuuuuuuccaacggcagcuuccagaagauguguuucagaauuguuguucugagguagcaguguacauugagcagcccaaguucaaagaguugacaccgaaauuaggagcaucaguguggagggucuacaguucuugagcugggagcaucugucacugucauaccacaggcuuccugcugugaaccccuuacaggguuuacccgugccucuggcuccucccugcuguggguccaauagaguguucugcggaugucugacuggcaagaagcugaggaguguggauggaggagucgucccagccuccguauuauguagcagugauagacuuauuauaaacuuguuuguguuuuauguuggaguuuagagagugccugauacugucaauuacgaagguucagaaacauuuucauugacguguuugaauuagugugagaaucaaauccaguugcagacauagcuuggaacuaggacuaugaaagugcuguggguuugcagucgcugugcagguccuuaccuaugucuacacgcgcucauuucaggugaccagcuacgcuuccuuauuugcacaagcguuaccaagagacgcucacucgacgccuuacuacuaugccaggccucagacccucccgcucaacuaccaggaccgcagcacacaggcacagagcucuggcagccugggcagcagcggcaucagcagcaucggcauguguggccuuaguggccccacaccugugcagccuuuccuucccggguaacuugagcucacacacacagauacacacgugugcacaugcgugcgcgcacacacacaaacucucuuucucucucucucucucucucucucucucucucccucucucucuuucucucucaccacaggaaccagaagcagccaugggccuaugcgcuuaccacccaugcugccagggugcggguguggcucucaguguuguaggucuguucccaggguuuuagcaagcuguuguuguuggacucagaauuuuaagacguaacagggagacuccuccuuaggcugugguuuucagacucucgguccgugcugugagcagagaggacggcagcucagcgaggcagggugagccucuugccauugucauuccuguggaccacaguggaacaggauugagcuggauggugcuccagaggagcauuggucagaggucggcaucagaagcuuggggcuuugcaugugggcacacuggaaucccauaucacugagcucuaagcuuucacccacaguacugaggguggacggugugugccacacacagaccgcucuguggugagccagcacguacagcugacccaaggaccauauguggcugagaggaucuuaucugcgaccuuggaauuuagagugcuuauugcugucaugagagguuguauagacaacugugagcagaauuaggcucuuauuuuauauuuacuuuucuuuucuuuuuuuuacagauucagcauuacugaaugcuguugcuaagccugugcccacagaggauaguguaggacaggggaugggaguggugguacuccucauagggagggaggguggugcuccucauagugcggguacccagagcacugugcccagagcccuaggaaagugagugcaggucagcgccugcggcuguuuuaguucugagaagcaguaguuuuguuacaguugucacuggacauaaacgucaggcucuuagauuuucagagccacuguuaguauucccugaguucuuuuugccuuucauuuuguguauuaguaaacuuuucaaauggauucaacuguagucuaguaugcacacaggguggggugggggcuggugaccacagacgggacagggcccagguguugagaccagucaacucaggaaauguagaaugaaugaaaggccaugaucuuggacuuaaacuagaguaggauuucaagcuguuucuguguaggcaugaugcaucuguguguguguagagaacucgguaguguggauguugggugagacguccagaugggaguaggucugaaaacugggucgguguccagggacagugcagggaccuggaacagacuguuauggggacaugugguucuggagagcccuguaucagaucuauaaaguaacguauucaguguaauaacguaaggaaaaucucuaaguauguucugucugcuuauuugaagccacaaauguuucuuucuuacuuucucuagacagucucaucaagcuccaggagugggugacggccugcgacagcaguuggggccucgucuggcguggacucugacuggaaaucagccuucuucacaaaccccuaccuccaaggguuucccaaaugcucuuucucgaaaccugacaaggucaaggagagaaggggauccaggugguaagauguguuuugucauuuagaagccagcaccucaucuguagugauuccuuaguguucauggaaugaagccugggucccugcuguggccaggugccucgugaggucacuucauguuggccgcuggagucugguuguucuguuccuucucuguugcacucugucuccuugucccaguccccuccccaucucagucugacaucccuccugagaagccacccagaucaucaacaagguuacuugugcccaaaccaaccucuguggagaguggugucuuagucaggguuucuauuccugcacaaacaucaugaccaagaagcaaguuggggaggaaaggguuuauucagcuuauacuuccacacugcuguucaucacuaaaggaaggcaggacuggaacucaagcaggucaggaagcaggagcugaugcagaggccauggagggauguuccuuacuggcuugccuccccuggcuugcucagcuuacuuucuuauagaacccaagacuaccagcucaaggauggcaccacccauaaggggcccuugguacuugguaaaggcauaaauacuuuuucagugagaguuuaaaaaaugguuccagagcuguaccugcugcuuacaagagauauauuuugaguagagaguuauagacagguuaaaaguaaauggguggauguuguaugguugugaaaucaaccacaggggcagagccucuguggaauagacuucacauagugagauguaggcggccuuuugaauagggaaggucuacucuuaaggaagguucagugagucuggugugagugcuaagacagccuacaccaguguggauaggggaaggagagcagaagagucccgccaggguggacaggggaaggaaugggcagggcugccaugugaggccgacggacacugaugguugguugcagccuuccuccccacagcaugaaggagugccugagcugcaugcucugcugugcuccugaccgucucuggcuucccucagcauccuggcuucuggguguucugccuccucgcccucauuuuugccuaacacccuaaguuuauugugguauuuguccagaagaaccggggaagcugaugucuuuucugagcuaugaacucccguuucuuguguuaggaagauccuguucucacuguguaguaagcuggcauuacacaacucccuaccgugcacucccucugguucauuuauggugaugucugucugauggucacaggacagcuuguccucagaggcuuucagggggacccuguaggaacaccgccccucucagaaaucccacaacuuucuugacauuucuuuugcuucuuaaacucacuucccgaguugaucuauguggucugggagcagauguguagcgugcaccuaaucaauuaugcaacucauuucauguggagugugcuccuuacugucuuacaaaucuuguugcaggcacauuggaaguuacugaagcugcucuugugagagauauucucuacguauuccagggcauugauggcaaaaacaucaaaaugagcagcacugaaaacuguuacaaaguggaagcgaagguaugcuaacagagccugcugcagcguagguauguuagcagagccugcugcaguguagguauguuagcagagccugcugcagcguagguauguuaacagagccugcugcagcguagguauguuagcagagccugcugcagcguagauauguuagcagagccugcugcagcguagguauguuagcagagccugcugcagcguagguauguuaacagagccugcugcaguguagguauguuagcagagccugcugcagcguagguauguuagcagagccugcugcaguguucagagguagagcccaggcacagcuccuuacccauuccuggggcugggcagauugggcaccaaacaaguugcacagccugauuugacuucuugcccuggccauuuguggcugauaagaucugucacggucccucugugacagugcauuccugacacagucuucccccaucccugcuccugugagugucugcccugcucucagcuucucagcagaacaggggucauccugucccucagucccugguggacauaccccagaauggucuugcauagagauacagcgggagccuggagccucucccugcggccucccugcagccucccugcugcucugcccucuuugccuugguggcaugcuagugacuacuuuuuauaauauuaggacaaguuaccugggcuagugaugaggucucccguucacuuugaguuuugacuuuaucuguguuuacuuuuuaggcaaacuuaaacaaaucuuugagggacacagcaguccggcuugcugaguugggaugguugcauaauaaaaucagaaaguaugcugaccagaggagucuggaccgcucauuuggacuuguaggucagguauguucauccuuguuagguuugagguacuuaaucuucuugaugucugcguguaaggucacugucaggcucgugcugaggaacaugucagucaggguccacugggaguaugcaagaaugcaucaaggccagaggagagaguucaagagagggagggccuuugaaguaggagagcuugggccugcccuguagccaucacugcugccucaggauaaggaagggcccugagaauauaaccaggucuucaggugcccacaucuaaugcuacagauguggggaguggggaccuacugcagugucacugccaggauguccauggugggcacagagggaccuacugcagugucucuugaagcagguacuucuaucucuugacugcugaaucuugagggagcagaagauauaaaagugagugugggauacuuucaaagccccagacucuuggacaaguuuagugguccaugcuuuugguuucaguuggauucuuagguaggaauugcugccugccaguguuaucaacagaaauuuacugagagacuuggaggcagcacagagagauacugcaguguggcugguggucgggagcauggcagggcagcguggcucauggucaggaaugugacuuugaagugaauuucacguuugacagcaugcugccuugcccagauucuguucauucaccauaguuucuuucuauaacagaaggugaggagagacugcauaguuagcuccuggucuugagucuagcaguuuccucuugguucuguccaaggaauuggcuugcuggccguugcuggccauugcuggccauugcccuucuucuccuccuccuccgagggcugacauugaaagcacagaagcagaauccauugccucuccuugcuuuacucguaguccgucugggagaaugugcgacagauuguaugacagucucacuucuuucugguugcguggaagacaugauguggucgucuugcucguugacacacuuccaccuuuggcuguugugacuggugcugcagagauggguaguacagcucuucccucagcacacugugcccacagggcccaggcccuacaguggggccuuagcacuugaaguuguauugcuuaguuaucugaggagccuuggaguagcugauccaguguucaccccagcaaacaguacaagcaggcauccuccugucgauucugguucuuacuggaguuaugguuuuugaacauuuuuucauauguccauuggcugugucucuugagaaauguccaguuuuauacuuuugaaaaucagacagugugggucuuuccacccuuuuauauauucuggguauugacaaguugucagcugugugucuuagcucuuuuaccacuguaaguagcgucauaagugucucucucacagcauagguauugaaguccugauuucuuaucuuccugagcacccuagcaggaguuguuagcacuguccugcaggaguuguuagcacuguccugcaggaguuguuagcacuguccugcaggaguuguuagcacuguccugcaggaguuguuagcacuguccugcaggaguuguuagcacuguccugcaggaguuguuagcacuguccuagcaggaguuguuagcacuguccugcagaagcaugggcugcagcaccagcgcuuaucucagagggcucugacauggagggcuacaugugacuccuguuguucugcugcggcagucagggagauacgguugcccauacuagacugcuugagugcucuuggggugaucuguaucccugcuggggugucuuccuugugccugucgucuuggguuguugcugugcacauucucccugaggccuccgcagaacccuucucagacccaacaugggacacuggcuccucuggccagccuagguggcccagcuggcucccucuggcugugggagaggaaugcacucauggaaccuugcugugugggacauugugauguggauccaccagugacugcagcugugugaucugcaaguuugcauucuccaugucagacugcaaccugaguucuugaucauuugcuaaacuguuuauauuuuaguuuuuaaccuuguauagguuugcgguucugcccuuuuggaggcuggggugaugguuuuguaaaaccugauguuguacccugacaaauuccacauuacugccucugugaacauuauggaaacuacuaguuuguuaaggauuucuaugccccugugcuaauuauuucuguauauaaaaccugucaaaguaugugugugguaguagugggaacuuuggaagugucagccuuccuugggugcucuggacuucacucaaaggucuuugugguucuuugguuggggcaguucaucuuuaagucugacuuuugaaguguugcugucugucugcuaaguugauguguuuugugcucauuuuuauaguuauaggagauuaaaauguucauuuuauguucauuuuguaaccagaauuauauuuuauguucauuuuuaagacugaaagggcauuucauucuucugugugguaaaauaggcccauaauuuaugagccugugcauuguacuaaggucuguggggagccauggcgccuacacauuuauuuaaugagguuaggcuucagccuuugccagucuguuuauggcagcuugucuugcagacagacuuuggacuguguacucuguuuauagccuuggggucaugcaaaaggagucuuguuacuagaugcaggccagaaggagggacccuucuuuaccacuucugacagugucuuuaguucuuguuggggaugcagagcaguguugagagcucugugugggaaaguaaaccacgucuaacuggggcuggcagacguucccagcgcuuggaaaagcauuuaagaaaguuacugugacuguagaaacuucuaaaggacaccaugcugaggggucauccucggacgugacccacgcguguagcuucaugaaaaccggacacaucuccauuuuuccucugcaagguccaagcuccuugugaugcuacagguccggcaucucaguugcacugagcuccgugggaaggugccgucuccucucgcagagugaggcaugugugugcauggucaugcuuuaaccuugcguauucuucccacacagaguuuuugugccgcauugcaccaagagcucaaagaauacuacaggcuccucucuguucugcacucucagguaaggacuuccucugugaguuauuccuucaaguuucaagaguuagaaaaucaagacuguagagaggauuuguugcuucauacauauacaaggcuaauuacuuccauaguacaagauuuguucauuguacccuagagccaauuaauuguucauuucaggguccugucuaccauaugaagacuauuugcauguagccuaagagugcuguagguuuaaaggacugugacuguauuguuagcguagcuguggucuuggucucaccuuguguggguuaaggggugcugggcuguacucacucacuucugcuuaaccuuucccuguuguuuuuuagcuccagcuagaagaugaucagggugugaauuugggacuagagaguagccucacacugcggcgccuccugguuuggacauaugaccccaaaauaagauuaaagacccuugcugcgcugguagaucacugccaaggucuccugaguuccucuuuucugugcuucuagacauucuugagugcaaaacuugucuguagguagggccugcgauucugcucugguugaggguacaacaaacagaucguagauacagaucauagauccaggcucacagggacaguaaccugggaccggggcagccugccauuagccugagaugagcugggaaggagguguugugugugaggcugcucugugucuugcagcagucuugucuguccuguuuggucuuuagcagauguugccguaagaacugcuccuggacucguaggugucugcucauucccgucugcuuacacaccagagcagucuguacaaagcuagggucacguaaagcccucagcuucugacacagacuguugacccuugugcuuguguugcugggaccugguucugccgcuucuguaccuuucuuggggcuccugcugggcccuggcugcugagcagugucacacuaccccacuacacuguacugcagggaguugggccucgugugccacaccccaagccuugucacugcugauccuuagacccucugcuucucaugggcacuuagaucugaacuaaauugcaaugugaagugugaguuucaagugucugggcugggcagcugggcacuuggucaguuuuacaauuggaaaacuucuuggcugacuuuugcuugaguauguguaaagccagaaacugaaccuuagugcccaggccuugcugcacggcacgcuccugcuguggcuaaauacaggagguccuuacuaacugaagaaagcagauacacuuuaucucgcuacuuggcugucuuugcuuaguguuuagugauugguuugugccaugaauucaaauuuggcuauuucuguguauuuuuuuccccauuuccccuaggacgaaaagggggugagcuggccucugcuguucaugccuauacaaagacaggggaccccuacaugaagucccuggugcagcacauucugagcuuggugucucacccuguccugagcuuccucuaccgguggauauaugauggggaguuggaggacacuuaccacgaaguaaguaccgagaccugggcuaaggggcguggcacccaccuuuuccagugugguugaucucagccauuaucaccgccucugaacgggacuaugccugcaccuccagggucagugcugggagcucagcgagguaugagugcaggcucacugguggacugauggcagaggcgugugggcugcucucccaggccugggagcugucuuuuuacauggguauguuauaaacuuggucggcuuggugcugaggauuugagugacgcaagcuacugcauuugugucuguuuuccuuuggaaauacagguaguuacaugugaggcaccgugcauguuccuaaaaauaccugacauagaaccuguagcaaaaccagaggggcuuggcaguuggggaacagagcuagagacagcacacucgaaaguauugccagcagcacagagaaauggaaaaagaaacgugagaaaagcugucucauugauccacauaugcuaagaggcuaagaagugcauagauacuacacagaguacagcauucacggcagaagcucugauguuugcugcagaagugcuacagagaggaagggcuuuuuaggugggggauggguugaaaccaggccacacguuugcuagacaaaugcuccaccacugaccuacugaccuauauccccaggcuucugucuggauuucugaaaugugcgguauauaacuguucauuacguuucucagacugauguacugugcuguaguacgguauacauuucggguauuuuucugaagauacccaguugcuugaaauaugaguaagacuuaagguuugauuuauuguguguaugcacaggugcaugugugucugugugugugugcucaagugcguguguaagccagaaguuagucucagguauugaccuccauacaacuucuaccuucuucacuuuuuacugaguaaacuaggcuggcuacccagaaugcccuagggaucugccugucucucuccagcucuuggauuacuagugugugucacuauagccagggcuuuugccuguuuguuuuuuaaugauauuguuauuuuuguucuguuuuucccauaucauauauucugguuauuguuuccccuucucaacuccucccagguccucucuaccuccccucucauccuuucccucucucucauuagaauacaaugggcuucuaaaaaauaauaauaaaauaugguaaaauaaaaacaaauaugcuggaauaggaaaaaauaaaugaacaaacagaagacaaagaaccaaagaaagggcacaagaaauauagauacagagagaaacacacagaaaucacauuaaagcaccgaauuggaaaccauaauaaauuguguguggcugaggacgguguccacagaguccggaagggggcuuuggcuccuuggaucuggagcucuaggaaguugugagcugccacccaguguggguggugagaaucgaacuuccauccucugcagcugugaucuuugauuuucuuuguucacugagccauggcuccagccgggacuuuauaaguuacugagugagugugucugucuguugagugccauagagugaguccaucuccgucacucagcaagcauaaccucaguucuuaucccagggaaagauuuuaauuuuuuuucaugcuuuucuuucgaguuaauuuaaaguuccaugaguucugcaagcauccccuggguccuuuucugggcuagugagagcuugcauguuccuccauugacccgucagucuucccacaccuccccacaccaaagauucuacagucuaacccgaguucacauaggucacuggcaagaccgaggucccuaguccuuucucagccagucccuuugcccacgugacccuugaccuggugaccuuuugacauguugacccuuugacuuggugacccugguguuccuugcuccuuuugcuggugaugaugacugacugguaaauaguucucugugagguuaggugcagagcauucuuugcugagggcugcaguuaacugcagugacuuagaccugcuucauugcugcugggucugccucacucagccuucccucccuccuggaucuacacgaagccugggcgaguccagggcucgcugugagcaagugagucucgagugagacgagcagcaagggcaagguuugcccaagcugguucagucuagaacacugugugacuuguggauguuuccugucccugauguccuucauggugaacucuaugaauaguuuucauuuacguuuuaagucacauuugggaagguuaucuuuaacugcaaguaguagauuuacuguacacauuuaguagcuuagagcauuacauuguguauuugacuuuucuguguaauaaacauuugaggauuuugccucuauaguccuacaauagguuaauucuuccucagcuuggccaaagucaguuaggauuugauugugaaauuuaauuuuuucaagugcuaucucgguggcucuaagugaguaguuuguggaguaucugcagagggaaaugcuucuucagccauuggaagguguaaauacgggugaagagaaacuggauagggaagccaagaagauacugugagcugaaaaagaacugacuccuguggucaguguuggcagucagccuggguagccugagaagcgccugguaaagcccaggcaccugacugugccugagcaaaagagcccagcggggauuaguuaggaggcuacaccuaccugggauguagcagcaucccagaggccggcuggggaugcaggcucaacuagagaggacagagagccaguggaggcagcauucucugcucugccuccuucccuacuguagaugcagccuacgaaacaugagaccgaguaagccugccugccuuuucuucuucuuuuuuuauuggcuauuuucuucauuuacauuucaaaugcuaucccaaaaguucccuauacccucccccacccugcuccccaacccacccacuccugcuuccuggcccuggcgguccccuguacuggggcauauaaaguuugaaagagcaaggggccucucuucccaaugauggccgacuaggccaucuucugcuccauaugcagcuagagacacaagcucuggggguacugguugguucauauuguuguuccaccuauaggguugcggaccccuucagcuccuugggugcuuucucuagcuccuuccuuucuugugcugcuuuagcaaguacaaggagacauguccuagcagaacugcagagagccaaagucggggaaagucccacagcagcagaugagaacuucagcaacugcccuuucacgagaaggccagcagguggugggugcuuagcguaacaccacugggaauucugccaccauugagagugucuugcagaaauggagaaaaaagagagagguuccuguuaaguaaaccgugagaguucccagccugcagauucaugaagaagcagggccgugcugaggccuccggcaggucaguggaucugucagcaguuaagauaauuugugaggcaaggccguggugagauaguucuaaccagacagcuacagagucgccaccaagccuucucaaacuuaacaaaguacaacaggaaggaacauuuaaguucaucuuaugaggucauuguaguagcacacgagacaaaugugugaccacuucucuuaggacuguagauguggaaagcccccaguuaauacuaggaagcaaaauuuagaauuccacauauugaaaacauuguuaucaaaagggguuuuaucccaggaaucacauagguguggaccauagucuaccaucgugguuggcaugauaagaguuuagggacacagucuacuuuguugguaagaauugucuguugacauuuagcacaauucaguguuaaaauacuguaaccuucaccagaaaggaucucaagcuuugggacagcuacugucugugacuggugagaggcaguccgccuugucucuggaugaagaaggagacaacguuacacuguuaucucuccuucucagcagugugcucacgcuggcaagacaggaacggagaggaguccaaucugguagaaaaaccaggaagaaguacgcuuagcccauccuagaugacaugaucuuaacagaaagaaagcccagugugcacuguauagagauagucgggaagggggugcaccugcgcauugcacuaaguucucagacuagcggacugccaggcagggacaaaaaccccuuguuccucuaugcucaguaaaugcugccaauagaaaauaaagaaagcagcuauacucauauccugaaauacuuagggaugaauuuagccagcgcagcuccagcccagugcccuuugaaaacuguaaagugaguguuuaccugguccacgaccuucgugguauaaggaagcugacuggacuccgcccuuugaagggcugugagcauuuuaggcacuaagcuggaguccgggugcuguugcagggaggagcugugggagcgucugcucugcugacagaucucauuccuagacacuaagcugcaugcuaaggacaucuccccucugcuccuguuguagggcggggagugcacgguugucuagcaguuaaugagaaaucgguacaaugacguuuuauuuuuuugccuagauucuuucugugauugacauaaugguagaaauugaaggaccuugagggggaaugcaucaauacagugcaggcucauugcaauuauacuaugaccuugguuuuccucugccacauguauaucucacagggggcauuauacucuaaagaugagcacacccuuugugcucaccacuagcugcucguagacugauugcacgcuccugugccccagaugaaacacuguguuugugacuuccaaagauuacugaauugucugggagguuuuuaauaauuuaaauuaaaauuucuuauuguucacacugauagaaacccagcugcaaacuaucaggauaaauugguguucugucuauauaaacuagcucuugugguuaagugaauaacagaggaauauaauuuauaugcaauuaaucuaaaucuguugaauggcaagccaaagggcaguuguggcacagugagguaaccagggagaugcuuaugguggguuuauagcauuuucuuguuucucucaguaugugcugcaugauagcugcaugauaacagugucuguuuccucaaacugccuuuguuauauauuuuaaguuggaaagguagcauagaacaagaguauaaguuagauuaguuaguuaguaacaaaugaucccuucuuucuggucacaagaaugucagcauucaaaagcuuggccuucaaaaacaugggugagaccucauuguaacugacaggcaucucgcaguggauuucugcagaacacgugguaaccacucugagagagugaugcuaucuaaaacaacaaaaccagcaaaauguuuagcugguaucaauuauuaaagcuuuuccgaguuacacauuugugcaguuuaaagguuuugauugucugugcagaucuggcagagagaguuagacgucugaucaugagugaguauacugugugugcuuaguuucagcugugcugcgugugugccacgucauuccucagcuuuucuuggaaguaaaugaugagugucacuuucugacauuaaguuauucuucaucaaguucuuauuauaaaguuucuuugaaauccugacuagcuauuacuauguccuauauuuguaaauguaaacuugcaucuuguuuuuccugaaaagauuaguauuugucuucaaguucuuggaaaucuguuacacaguaagaaacuuuauuuuuaaugguuacaugauuauuauagaucauugucauauucacuugcuuuuuuuuugacauuuuucccaacaacacuggcuuuauucaucgauuguaauauugucuauauauacaacucaagauaaaccacuguuagaauuaauaaaucuaguaguuucuagcuuacaugcuauuuauuuauuuaugaggcaaaaaucuuacuaugcaguccuggcugaccuagaacuugcagagauaugucuacuuuccaguuacuaggauuaaagaccuauaucaccccagauugccuuugacauuuaauagcauauuagaaguauaacacauuucaaucuaaaagcuuuaccaauaaaagaauaauauuuuauuuaagguaaucaaugauagaaauaauacaaaauaaaauaaaaugguaaaaaauacacugaaagcuauuucuguaaucuggaaaaugggguggaugauccaucuucauggaucaggaaaggaagcucgcaguuauuacagcaacagcaaaaccggaacggggcacaggaggaaaacaccaaagggcauuagcacuguggcagugugcucagcuucacuuagcuaaggguacagaauacagggugcccugcugcugggcaggcuuuggagguguccggucauuuacacagagacugaacauaacuggcuggucaguucugcuucugcagagcaaguuuguagggaccagagccucguggcuaaacagguaagccgucucuuuguacuguagaugaacuggaggcaguggcugcuggaucuuuuuccugugggagggggaaggugagcagugacugaugagauagacgcagugcuuaucacgaauagguauucccaggggagagucucgugagaaagucucugcagugcccuugggcugcuugguugcagguggcccuugcaugggaggucuuguguggugggcucuugucuguggacugcaguuugugaacacccugugugcucagcugcugcuccagccuguggcacucuggagcggaagugaucaugaguacacaccccgagggccacuggccuugagugcugagaaagcgcuggaguuguguguggguguggaacuccucgagcaugaagaacccucaggacucaguccuggaggcugccagccagaggcuuacugcacucaugcugcgccccacuccuaagucuccacggagaggugcaacuugcuuuuguuguaguugguuuuaauuaucuagaacauaacuuagcuuucuguccagaguacuuuguuuauuguguaggugagugggcucuuugugucugaagagcuuacuuauagauuaacuuuguaauaauguccuuguuacuauaacuaauauuuuuacaaguauuucuucauuuuauuuuauuuuaacuuuugguuuuuugaaacaggguuucucuguuugacccuggcugaccuggaacucacuuuguagaccaggcuggucuugaacucagggguccaccugccucugccuaccaagugcugggauuaaaggcgugcacuaccguggccuggcuuuucagaaguauuucuaaugcuccguguucuuuugcucucaguuuuuuguggcgucugauccaacaguuaaaacugaccgucuauggcacgacaaguauacccugaggaagucaaugauccccuccuucauuacgauggaccagucuaggaagguaggccgacuggacaccgccauuugguguugacugucauugcuucgagugcuuggacgaugugccagcugaccuucauguaaggaaguuguguugugcucugcuaauggaccaugcugauguaugcuugcuggugagcuguuugagcuccuagcgcucacucgauagagauccagugcuuauggucuguguuuuuaagucaguagcuaaugugggauguggggauauucaaaguguuuggaccaccaacuuguauaaagaugaaucauagcucuuuuucuuuuuagguccuuuugauaggaaagucaauaaauuucuugcaccaaguuugucaugaucagacaccuacuacaaaaaugauagcagugacgaagucggcagagucaccccgugacgguauggcucuuguggugguaacagugaugggguugugguaguggugaugguagggauggaaguggugauggucaugugguuaugaccgugugagaagguaaguauggauggguagggacccuggcggugaugguaauaauguugcuuaaaacucuguacugcaguguaucuauauauuaccuggaucacuaaaauauauguauacagaauauauaugaacuugugcgaaauaccuauuguuguguggaugcucagauuuuuuaacauggaauuagauaguagcauugaaucaaguaaacuguuaccuccuuagugauuuacauggcuuuauucccauggugaugaaaggauagucaauaaggcaggugggaggccugugacucaggcucuucaggaucugccugccgcaguugacagguucccuugccggcugguggaaaucugccauccggcccucuuccuucacucucuugcuuccugccucagccucucuuuugcuggcaacuuaucuccaguuugcuagugcucugccauuugagucuuugcauaagaagagacgggauccagagccagauuuggggaaggcccuuguguuuaagaaguagaaagggucagagacuguauuggaguuuugaccuuuccaccaugccuacaucacacaagagguguagguggccccggagucucucagugcuguuggggcuuugaugcuccuaugcuauugugagacaaguuaagugagacacacuguagcuacugccuuacggacagggcuggagcugcuucuccuggaauccaagugccagcaucugcucuugguccagggcgcuggccuucugggcucaggacugcuuugccuucauugacuguggcuggguugggucuacguugauggguuggcuuggguuccacauaggccuuuacuguuccucuguuaagauaugugcuacauacggacgugugccuguccuucuuguuuuuacagcugcggauuuauucacagacuuagaaaacgcauuucaagggaaaauugaugcugcuuauuuugagaccagcaaauaucuguuggauguccucaauaaaaaguacagucugcuggaacacaugcaggccaugcgacgguaccugcugcuuggccaaggagacuucauacggcacuuaauggauuugcucaagugaggggcuccaccuuccauuaggaggaaauggguugaauuguugcaaaucuuuguuuaaaaccagcucuacauagauaaaguuuuccuggguuaaauccuuuauaguugucucugguagcuagcagaucaucagaagugugccacgccaaggucaugaggaagccucaagucccugugaccaucaugacgugcaguggcucccugaggggguggagcuggaagcuagucacaguugacuuuggcuuccguuugaaauuaacaugauaaauauguauuuuaaauuggccucuugguccaugugcuuuaugcagcuugacaacauugccuaucucacugugcccugcggccuuccuccucuuguggaguauccagaccugguguguguagcucagggcucuggacagggcugacggugaauggggcuuguguggucacaguagggccagugcucucacugaagaguuugaagggcauuguccuuggugugucuaaggguucccuuuaauaauaauuuuauaauaaauuguucucuucaggacaaaaaaaaaaagaaggcauuacaccuugccugugcuaaugaagcugauguuuugagccugugaccuccgaguuagucugacuucccaggagguugucuccagcuggcccaucucauccuccaggggaguauggguggcggugcccaggagcgucugaguuggagcuggucaucagcuggcguggaugcucagcaagcccaugagugcagagcauuuccacgccagaaguguguagguuucgcagagaguuaaagaggauguggcgaggagcuauuaaaggguagaugcucucauggugcuggccaacagcggcagugcacaggcgugggcaugcaaaguggaugcuugugcagacagccuagccaagcagcacagagugggggugugcucagcauugcggaucacuccuccccggguguugucuccuguccuggugugucagucaucuucggugcagggcucucuccucagccaucagucuaucuccugcacaccugccaugauugccaucuuagucagaagagugggggcuucgugucuggaugcacagcccugagcaaugaaguaagcuaggugcuggugaugguguggugcuggccacuggaacugugaugucuauaguuagcugcauggacauagggucuucguaggaaacuguaacaguccugcccguaagcuagccauagugugaaaacuaucaagaugugucgcacauauaaguacuuucacccuaagcugaauggaaauuaauguuuuuaauauuuugaagaaaccuacuuucuacagcauuguuaguaguuaaugucaugagcuuugcuuaaugaagcagaguugagauuuuuaaaauuauuuuaauaaauuuugagcacagggauaagagaaagaagcaugcaggaagacaguaagacacucaagcauggugugggcgccucagagggucucacuuuguugucuuugcaguggccacauacaaggcucuggagugaaacacacucuugauacucuuucaaggacucgugagaaaccuaagugaggccacagagugguugcuaggcaccgugaugcuucuguagcuauguguuacuaucccacugucuuccguuuuuagcuuuuacuuuuuaaauuaauuuuuaaaaaauuucaaauaauaguaucuuuaacuuuaaacaccuuuucuaaagaccagaacuuguucggccagcaacaacuuuguaucagcauaacuugacggggauucuugaaacugcugugagagccaccaaugcucaguuugacagcccggagauccuuaagaggcucgaugugaggcugcuggagguaagugagggugcugggggcaugugaggguacugugugagggugcacaucuuucuaaggggauaggucccauagagcaugggauucccacggguacuuaguggugugagcacauuuaauaguacauuggaggagacgcacauggucagcaggcagggacucugucugucugcuccucagaccuuucgugucuggagguggugugguagaagggccacgcuuuggguuaugaacuugagcccucacugccugaucugccucauuacuauagacccacuggguuguuuuuguuguuguuguuuuguuuuuuuugaacuacaggguuuuuaaguuucugugccugacagcaggcagugugguuuugucauaaaaagguucagaacuuggagcuugucuguacuguucauucagaacaaugccagucaugauucccgcacgaucgcagagcacugugauaugcuccgcuccucucuguucgcucacucgcucgccuggaugcuggugaugcaggcuccugcuugcacaguggagcacuuccugguuuuaaagccuguaccuccuuguacugccuuuccuuugagcaguuggcaggcucuucaguugcaaguacaacgccucucaauuauguguuguuuuauuuuauugcugucaggucucuccuggugacacugggugggaugucuucagccuggauuaccacgucgauggaccaaucgccacuguaagaucauucugcguacucgugcgauauucacagccguuugaauugcugggcauuuuauuguuuuaaaauggguuucuuuucuaaaagcuaagguucaaaguaauugugauguaggcuagauccacugaaugaguugcauaagcccagugcuucagauaguuauuaaugagagcugaaaugcucuauuaguuuaagaauucuuagaaauaucauuuguucugucacagguugcagcaagugcuuaauaaaugcauuguucauuuuaugccauuauucuuagacuggagcaacuaauuuaggauaauuugaaaggaagcauaaaauauauuuuaggggaaugguauuuuuccuccuuagauaaauuugcuaucuagcauccaucugggcugaugagccgauagcugucacacugcucaugcuccuucgcucacucacuaagaaggacaagucuccugcugcagcacagaaccugggcuggaggagucagcuccacacguccgugguuaaauugccuuuccagcucauguucucucuuuaggguggaucugagacuuagucguuucuguaucugaagugcuagggaaauaaauugcguuucuuuuaauauuggggacguuugcuaagcauacuuaggcucuaaaaucccugcucuagccuucacgacugucccuucucugaggucaaucacaucccuugauguggugauccuguggaagccacacgcacagaaugucacccagagcugugucuuaaguccacugggccugagaacuguuagggagguucuuugacucaggaauuccauauuugacuuuggucaggucagagcugcuaguuuaacuuuccaauuucucuuaaguguaacuacucaccauauucaggguggccugggcuuaggaguugcuguucuguguggugguuacuguacacagcugucugguauuucagcaaauuguuuaggacuuuauaugugcuuuguuagcccauggccguauguauuuucaugcauaauggauccaauaauaaggcuuaggguacagcucagugcgagagcacuugccuagcguguaugaaugagucccuaagcacagucccaggccacaaagacaaaggugccauaguacagccaagcaccucgacaaggaggacugaguguggucuacagaugugcuugcuuacuuauuucauggugucacacaccucacuggcaugccagaguuacacacuguguacuguggauagcugaauacaacuucaguaggaaugaagaaaaacaguuuuuaucacagcuuuauuuuaauggcauauaugugauagcccagucauucagacgccagcuggguugguugugucagcagccugggcugccagauggagaaaaaaagaaagggacucugggcucacuugguagcucagucaggaccagaguguggggaguguuuccguuuguggguggugaguuauggccaucaucauaggcuuauuauugcagaggcacaaguguuuaaaccagcauuagaggugguuugccagguuuaauuguguguagaagcuacugagauagaaaaggaggggcaggaagacagcccagugagugcuguaccaagcuggugacugcaguucaggcuccagcucucaugaacaugcugguguggcagcccuccugcagcccaaugcccaggaagcagaaaugggagccccucccauagagggcuggcuggcugagcagaaauagugagcucugggcccaaggaagagacuaugucucaaaaagagaagauggagaugagugaagacaucugcaugcacaugcagccauguccaggcauguucacacaugcacaugcagcuauguccaggcaugcacacacacacaugcagccauguccaggcaugcucacacaugcacaugcagccauguccaggcaugcucacacaugcacaugcagccauguccaggcaugcucacacaugcacaugcagccauguccagacaugcucacacaugcacaugcagccauguccaggcaugcacacacaugcaaggggaaaaguacacaaaagauaaagggaagccucauuuauaaauacaagcuuuuucugcuuuucccucgguuaauuuguguguuaccuguuuccguucuagucucauuaauugagguugucauuuuuuuaacagaauuuaauuauaguaggaauauaucuuguagcaaucauauaauuauaucuuguauaauagcagcauuagcuucugcuaauucuaagauauaaaaugucagugagauuuuuggguuagucuaauuugggacauugugaaauucacaacccagguugcggaagaacgcauuagcuaaauacgcucauuaacuaugugaaguauuucugguugaccuugcuuuucaugagucucaaguuauuuguggugaaguccauccagauuuaagugugcugaggucacggagucuugauuccagcugcagaagacugauucggagggcuuugcggcugggcuguguacauugcccgaggguggugagggaggcugagaacagggccucaucagggcugcagucccacacugaacaagauggagacuguugcuguugaggucucugcagaugaggagucugaagcuugcuguaucucugggcuauaguuuccccuaagugaaccacguagcagcugguaaaacagcuggucacacuugguuucaggucagagcagugcaugucuuccucuuacauaguuaguaccuagaagaccauggcuuaacugaacguuugaaaccagugggaauauggaacuucaaaggcuacucuaugauguaucaugaauauagagaagaauccuauaauuaacugguaacucuaaaucagccauccuuacucuguuaucaugauaucaauaguguaggaagcaagcaguacacagguaaucccccaggcccuuagaguuaauuuuugaauuacuucagagcaguuucauuguuugcuugccuguccaucugucugucuguccgugccucuuccuccucuuccuucauguucaucaucauccucaucuucaucaucaugcaccuuccuaacuuugccacugaguugcuggcauaggggaggaugaauaagcaguccuuguuacacaagaugugugagguaccagaacacaugagaaguugguguaguuaaagucccaugcgaaaguguaaggagcaaggauaacguucugugcucacuggaagguggugaggugaacagguagggugagcacugcaggccucguguaaaggccugaggacagacaugggcacacaagauuucuuggagauaagauuucuucagagcagaguguggccucgucccagugcagagucagugcagucagcuguaauggaggguguguguguguguguguguguguguguguguguguguauguguguguguguguguguguguguguguguguguguauguguauguguguguauauguguguguguguguguguauguguguguguauauguguguguguauguguauguguguguguguguauguguguauguguguguguguguguguguguguguguguauguguguaugugugugggggggggcuuccuucacugucuagcgugagcugggacauuuacuugaacuagauuccucaugguuuuccugauguucaaguauaacuggauagauagccuguguuuuccuuuggaaacuuggccagcccaggagggcugaugugggggcugaagacaguccccauaccaggagccaacacuugcuugaggagccacgucugugguacugagucuauaagccugugacggugaccugagagacuugucaggguggagauaccacugugucugccucuacuuuugaagaugguaucaguaaagcaagugauuucucuaugugugucucuuacaagucgggguugcagucaaguauggcuacagaguuggcucagugguuaggaacacuggcugcacuuccagaggaccuauguuguacucccuguacucauaguguuacuuccagaggaccuauguuguacucccuguacucauaguguuacagugucucagccaucuguaaccacagucacagggcaccuaaugucacuguccuccaaggggaccaggcauguacauggcacauuggcacacauguaggcuauuauaaagcauaagauaauuuaagaaaagcugguccugaugaugcacgccuuuacucuuagcacagaggcaggcaggucccugagcugcaggccagccuggucuacauagagaguuccaggacagagaaacccugucuugaaaacuggagggggaaauguccugucugcugucacaugccuugagcccugauaugacagaccugccugcugcugcugcugcugcugugagucagcuggugucuaaggagcuagguggcugcuguccucucucaucacauaagugcugugcagaaagggcugccauguaaaaaaggcuagggccugggugaggagauucuuugcaagagagccacgcccugugcuugucuuugcagguguucacacgagagugcaugagccacuaccugagaguguuuaacuuccuguggagggccaagcgcauggaguacauccucacugacauccggaaagggcacaugugcaacgcgaagcugcugaggaacaugccggguaaggccagaggccggcgagacauucaagucuuacagucuccgagcugagggcgcgagcucacugcugcgaucugagucuguguuguauggacagauuuacuuguauuguugucucggcuucauuacagaguaagaggaauuaagucacacuggauguuuucccauacugugaaguuucuuuuaaaaucacauuuguuucuucacuaaauguucauggguguaguaugauggugauggugaugauaaaaauauaugugugagugccugagucuguauaugugcuugacacacauggaggccagaagaguuugcaugcccuggaauuggcauuacagauaguugugagcugccauguggaugcugguaaucuaaccuggagucucugaaagagcagaccgucucuccagacuuuaguauaauuuuuucuuaaagauuuauuuauuuauuuuauguauaaugaguacauuguugcacucuucagacacaccagaagaagguaucagaucccauuucagaugguuguaggccaucaugugguugcugggaauugaauucaggaccucuggaagagcagucggugcucuuaacugcugagccaagccccaaguuuaauuuuuuaaucacccauuuucaaagaagguaugccuuucaauaggccccugguuuauuaaaaauucaccuagugccuuaauuauguucucuuugagguguggauuuuucuuuugcgcauaaucuaggauauggccauguguuauauuuuacaguuuagaauuauaguuuacacccuuagucaagauuuuguuacuguuacaauauugaaugacuucaauuaugaguaauuuugaguuuauuauguagaaaucgauuacuaaagcauuucauaaaccucucuaaggcacaacuaaacggaaucugcccuuugaauaauaaaauaguuguuauaaguaacuuauaaaucauaguuguuauaaauggaacagguguuugaaggaaggggucuccucauugcugcuguuuccgugagucauaggcugacucuagacagcucccgaagguucaggauggugauggcugcaacagacugcagguagugcuggccacccgggccggcguggccacagcagaguggcccuuuccagggucuuaacacuuucuguacucacugacggcugguuccuuguugguggcugagaaggaagugagcuuucuuccuguuugacauggugacugacagcgaggugggggagcugcucuccauagccuucucuucacagagaaaacuggccuccuggguccucaaggacgaaaagugcaaggucuucucgcagagcugaggcaagccuugcagugagguacugugggucuucccugcccccacgucugaccccgcacuuguauuuccuucuugugaagcuguucacuuguugagaugaaaauguuguuuagacauagggcuuuuagagaggcauaggagaguguuaguccucugguaugguugguuacagaguacacugguugguggcagugcaaucuguaugggcagggcaauaagacaguagagcuucaugagcuuaagaaguggaagugacuggagaguugccuguggcuuagagcacuuguuguucuuccugaggacccagguucaauucccagcacccacaugguggcuacccauucccagaggauucgauacucucucugacagccucugguaccugacagugcauauguguauacaugcaggaaaaacagucaugcaguaauaaauauauauuaauuugucauuaaguaguaaaaauaaaucuaaaggaauguaaucauuuguuggaaauaguguguaugcagcaccacauggccugcucucugcucuuucugacuacggaguacaaugcccucucugcugguugucugcaguaggccaugccccugcagagugcugcucugcccuggagccaccccuucaggagcaucgccacaaucacccuucagucacagaaucucccaggaggcauuguggagaccucauugucacuuuucuuuucuuccaguggagaauaguccaaaguugagcaagggcagugauuggcccaggauucuauaacugcaugucuguacuuaggguugacucaagcuuauuggaaggcaaaaauggaagccguagaagccaaggguuagcucuucacauucgucuguugguuuuccuuuaaccacaguuuaucacuucugaagcaucauugaagcauugugccagccacagccacagccacagucauuugccuuuggaaagauggcacagugguucugaacugagguguagaaaaggcaaugugcauuacuaaugguugugaggaaaagggcaggugcugagggguagcugaggcuacacacugagguguaguacaggccagcccuccuggcagcugucuuuauggugauguauuuaacaaugguacaucuuacaaaggugguguugucugagaugucuaacagcucucucugugccugccuugggucgcaaggauuaaaugugcaaagaaguccucagacccagccugaggccaacagugaguugcugucuuugugagugacacuugccuguaguucacacaccgaaugcucuaaggaggggggaugagggcuaugggaugcugaaccauaagacaugcagagaaaugcugguucuuaaagcaucuuuuaaauccaaggcuuuggaaaauaaauuggauaggauuugaucgagucaccuuaaauggagcagcaccaagggaaguacagguugugggggagacuuugaagcuguugugaaacuacuuugaggaauuucuuuaaaaagagaucuuggacuuaggguugguaaggacugcugcagguaugcccugcugaccacgccuggaccaugccugggccacgcugguucugcucacacuguaggucuuucaguggccuuuagagggcagcagacagccaggaaugaaucugucuagcuucuaggcaagcaggagggaaggguggacauuauugguuuuuauguuaacaugaguauuugccugcauguguguaugugaacccugugugugccugauggcuuccuagcuagaagagggugucgcuguccugaaguuggcauuacugacagcugugagcuguuauguggguguugaaucucuauccucugcaagaacaggaagugcucuuaaccgugcagccaugucuccagccuguaauuccucacuuuguguguaaacccagcagggcacacuuguguguucauugcaccuccgugugguguugaccaagcucauucuuacaguccugaugguucuucugggcuagucacgauuuaagcgugcauuuuguaugcauuuucagggugcugggcagaguuaagggauaauagguacaaguuuauaucuucagggaugaagggcuuugaaucaaguccaugcucuuuagagucucgcagagcugccagaaggacagccauggggguaacaggccccagucaugcccagagaggccguguccucaacuccguuuuccccaggcagugaucucagugucaccauagaagaaugucuccuccacagggugaggacagguuugccuaggaagaaaacuguguccaucauauagugaaaacggaagaaagaacauguguguuaacucugguggguguggcccuggucaugcgggucugugggcaggguuugaauacugggguaagugacggugccaacaguuucuccuggauugcccagccugggggcugcugcagaauguacucaacaugcagaaaugugaggugacauaucccagcacacaaggauguuuuaggguacacugcugugcucaggauccccuggaacagcuaccaucaaggugggagagacagaguccuuuccuuccagcucuuggugacaacucagaguagaucugcagagugauguccucugggggcacaaccacacauaccugagugccucuugacagaggguggugaaguggaaacuucuggucucuuuggaaagucaguaugucgaaugauguuuugcuggggcacacagaugaaaggauguuuugcuaaagcagacacaugagagaaucuguugcugaagcagacacaggugggaagauguuuuacugcagcagacacgugauauuuagaaggaauauaaauaugaccccacagacggggcaggaguggggguugguggggggcaggccgagcauugguuugcuuugcucugccucgcuauucuucucuaauucacacacauguauugguucaccuuacacuguguugcugagcucugcuuguggugaugccauagagagaaacuggccaaagagcuucuugugaaguuccuguggcuucuugccgcuuccucagugguggguuggugagcuuggugguuucuucuggauugaacaacccuugcugauucaugaguggugacugccaaguggacuggacugcugcugcugguuuguguugguguuugcuagaggacuggacugcugauauccugacaaugaagguuggagaugauccaaagaacuauuucuaaacaugucuacuucccucauauccuaauaaccuuucuuuucuacuaccucuggugggugggaggcaauaggucuggucgaacccuuguuaaaguagguuguaaaaaauaaugccuacagaguagcuauguccucugugugggaaacagaagucagcuguauggcuagagaauuggguuagaaugccugguuucagggaagaaaaccacacuguucugggccuucaagagaacuaggaagcauacccuccuugucagaugcaugggcgucacugugugacaucuucccagggagaucggaacagaugucugucacucuagacagggaaccaagacagaccaaauuaacaguguccuugaguccaacuuaggaaaccagugaguuuauugggguugguacuggugaggggcuacuugaaggagcacaugugacucaaaugcagcugcagcccugaaaaacccauccuggcuuggguacugcuaacccaagcucguuccuggagcucuggugggugguaggcaagaggucuggucgaacccuuguuaaaguagguuguaaaaaauaaugccuacagaguagcuauguccucugugugggaacagauaugcaggcuacucggcagguuggcaagccuccucccuaccaguuguuuacugcuccuguaaagauggaccuuccagcuucuuuggacuguggaaguuuacuuacugucucacgucccuccucugucuggugggacuguuucuagucaaagaaaauugcugcagaucagcuguauucguggauagaauuccaaguuguggagcagaccuguggagugggcuacucuucugaggguccugugcugggugggcacacuccuggcugauggcuacauauagccauggggaaauggcacccgugauguggacacacagcucucuuccgcugucuggggucuucacggcagccauaagaagucugguguuuuguaaggaagguguagauacauuucuaacaaauaagcugugacuucugaccagggaagcguggggacccuggggucuguccauggggagucccuggacggccugccucuacacaaaaccucuuuguacacaucuguugccugacucuuccuggugagucuguucaccucagauggaguaggcaagagcaggaucccacugaaauugagguuggugaaccacugaacuuaauugggaucacacacaggaguaaggacaccuuccaaguggcuuggaaacaaaggagaguuccucucuccuccagugauuaguaauugcuuguauuccucagggaagggcugagaggacucagugcuguuguagaccucuuccccaggaacugcuagugggcuugaccuuucaagagucaggauaaugacagcugcucugauuggaagauggcucggcuacaucaugaccagagggcaguuuugcaguguccugcagucucauuaggaagcccaggagcagcaucugccauuuguguuucccucuuacuuuccaaaggaaugcuuuccugagcccucaucagauucuuagggccagacuugcuacugccugcucaugugacugugugcgcucauacacugguuuauguguaugcucugggcuacguuaaauucauuaaagcauuuacgacuuuuuuauuugcuuuuauuuuguuuuucauuugggaccgugcuuccaucuguccucucuugagcacacaugcucacugcaccaagacagcagugccucuguaacccuggagaugugucuucuuugaugucauccucucuccuggagccacaguuccucagagccucuuuaaacauccuacaggccagaaauuaaaaauguagccaaagccagugcuguucugcucccuguggagcgagggaggccuuuccugcuuccucuggcugccgaugcuggcggcauucugcacaugcauaucagcucccugggauccugccuuuuuucuuacugaauuagggcccaccccgagacccucuugucucagaaugaguagggagaaauagccauuccuugcauaguagauggacugguugcauauaagauauaaaauaaggcuucuauuuaugcaugaugcucguuucuauaaaauaaacuuuuauacuuagcugugugaaauguguguguacguauguauauguacguauauguguguacguguguaugugugugccaacgaaugagcaccagaagaggacagccgguauucucuaucaggauguaccuuacucucuuggcugucagccggccagccccugagaucuuccuuggcccucuaauacuggaguuauaggcacgaccaugcucaggccuuuacauggguacuggggacaugaagucaaguccauaugcuuuaaagcaagcacucucagucuaguccuuucgcuaaugcacaagaguggguggagagcuucuggucucuggcaucuggaaugaggcuuacuuauggcuuuguuagcaggcagcuugugggcacgggggucuguacuagcaccaggaccucccuucccugaugacacuccaucuuuugcagaguucucuggggugcuucaccagugccacauccuggccucagagauggugcacuucauccaccagaugcaguacuacaucaccuuugaggugagucagcuagccgcaguguggugcagcggugaggugagcaggcccccccagagucuccacguguccuuucagguucucgagugcuccugggaugagcuguggaacagagugcagcaggcccaggaccuggaccacauuauugcagcacacgaggcguuccugaacaccaucaccucccgcugucuccuggauagcaacuccaggguaaggcucacuccugccagccaggacggagacugucaaucuucaggugcugccgcaucagugacugagaaagguucucacacugacugccaccccccccccccccguuuucauugucuuagucaguuaauggcacggggcugcauaaguuuaacagacuauauucacagagcugugaggcucccauagcccagggcuuucagcuugguucuuuucuuguuuagagccucucuucuggaaagcugugugcucugaguagcaaggcuuucuggauucugauuuuucuuuaaaggucuggguugagaaagaacacauucugagugucaagcagugaacugcgcaucaggcugacuccuugagagcauuucucacagugugcguggucgggauauucuggguucguguccagcuucugccuggacuuuaccgaggcuuuuguuuuguuuucuguuugucugcaucagccuaugcuggggagaaguguuuggauaaacauaauuauuaaagaguaugcgugugugugcaugugugugugugugugugugugcgcgugcguguguguguguguguguguguguguguguaugugaacaucuagugaucaaagauaacucuaaaugaaauuugcuuucuagaugcagaggagguggaauagagugcuaacauccuuugaacagaauuaguaacucgugaaaugggcuucuaaagucaucugggguccugcugacuauucccacuaaguccagucucggagguugauaguacaguggguuucacaucuguuaccuggcaugcauguuuguuauggaaguauuucuuauggcaucaguauacuggugacugcauaaugguacccacagguccuggccauucucuguaaugugcuuaagacaugaagcacccauuugugggucaaagucaauguucaggcagaugguggccucucauugugaauccaggguucucuuuucagaggcacaauguaaauuuguggaaauuaaauuauaugauucaccauggcaaccaacucguaaaugcagcugccgcucuuuucaagcuguagaagucagguuauaugucguucugcaaaggaaacagguguggacgucaccagguguauugcucuucagcaaauguuggaauugcuaaggacuucacccacacuggcauccugcauucuauggcucugcugaccauggggcugagcucauagaagaugggaaaugucugugugagacaaguugagucacccuaauucuugaauuuauagaauagcuguagauguggcaaaguccaaagagucuucugccuauagggagguaguucuagggacuaguuguuuggaguugguccccagccagccucacugaaggagcgcugccuuaggcucccuuagcccugagguugugucuuaagcuguucaguaagccgauuggguguuguuugcuugcuuuagaaacagggucucagacuagccuggaaucugugauuguccugccucagccuccaguguugagauuauagguaugagcugccacaacuggcuccagaacauuuugucauuaguuguuccuaagaaagaagucuauuauauaaaacaguaaaaaaguaauguuuuggacuuauuaauuuuaagugugguauuuucauauuuuuacacugugaggaagucaguugucaugauccaguuaagguggggaaaugacaguugcagacauguguguaucuccguuugauugugcagcauugagggaaaaagcccugagcagcacaguagaaagggcagcucagacccucagagcagacugaagaagcccacagugcaugcuccacucaaaagaaguaucaguuaguaagcucagggacguaguacucaaaaaacaaguuguucuugucaugacuacaauagaaaaauaaaccaggcaguuauaaccauauuaaaauuuaaacaggacugucuccuuucuuuguuuucuaauguuucauaaaauaaauucugacagagaucaggacacuugcuugagacugcauucaucaugagccacauggcuuguggcaugcagcggcaucaccugaucaggccuucugucucccugcgcugcugugcaggcuaaaggcccuauugcacugugcacuuugcacgagucccuguguucuuagguuagugugcucgcagaguugcucagcaaaggcuccagucucacgugggugcagaguuagcucagcugucauuuuugcugcuugacaucucagcaggacagggcaggacuuugacugaggauggcuuauauguucagagacuugguccccaguuaguggaacaguuugggaaggauuaggagguguggccuuguugaaggagaugugucacugggagugggcuuugauguuucaaaaagcugguacuaggcccagucuccucccucugccuucugcuuggggaucagauguaaagcucucagcacugcuccaguccaugcaugucugcuucccacuaugguagacauggccuaacgcucagaaacuguaagcaaaccccauuaggcucuucaagagcugccuugaucaugguaucuccacacaaagcaaggacuaggaggagcuuguccauuuuuguguugcuguguggcucuggagguguguacacaggucuaggcacacacaaagcaccuaugugguauuagcaugucuguguccucaguucacacuugcaguagauguuacuuaaggacagcccacucuuagggcuucugagucacacacacucuuccagucuccccgagcuuuagaggaggcaaccccaaagcacacgaauauuuaagcagagaugccucacuagcaucugaggcucuguucauuuaaaaugcugauuuuucaggugcuuuuaaaccaacugagagccguguuugaccaaaucauugaacuucagaaugcccaggacgugauguacagagcagcucuggaggagcugcagaggcgucugcaguuugaagagaaaaagaaacagcgugaaauugagguacguuuuuaacuccuguuuucucguggcuggccagucgccaugagcgguggcaguagcguuucugcugaaucuccacacugaggcagcaugcagccuacugugagucggaggaagcugugcgcgcugucagacugagugcucaccucacugcugucgccaagcuucagaaccccagcaguggugguaucccagggucucuaccgcagccucagagucggcugcugcugucacuaccgggaagcuggcuuguuuagugacucacaugagcuagguuuccuuagaacauuucuguguguucccaauguccuggaauuaauaagauccaucagacagaucaggcuguuggugggguuucuugcucuugcuagccugggucucugcucuuucuaggugccuggucuugggguaaugaaaggcaagucguguaguuggcacagugagguuaguuuuacuuuugaguaguguuccuguaacagugucugugugaggggccuagcagcauaucacaggcaggagcaggagugucuccuuuuggugcuauugggauagcucuugacugcagugguuuguggguaauucugaagagccgugggauuugcacacacauaaucuccugauccaugcccagcagccugugugagacugacagacacaggauugugcuguagcugucacuuaccgucucugugguaagaguugucaucugugaugugacuuguaaaguaaucaugauacucagugugaccugagugucacccuuccagaaagcuguucaacuauauauaauagccuacugaaaccagccuuuaggaguguguaguucuaggcaggccgugguggcgcacaccucuaaucccagcacucaggaggcagaggcaggcggaucucagaguccacacagugaguuccaggucaaccagagguguagugagacccugucuauuaacaaccaaacaaccaaacaaauaagauuugcucuucugauacuagcaugguggcaguugugugcacacugguggucucaccagaugucaccggucagcagcagaagggacacagauauacacuaaguucaggucaucuggcguguuucauucagagaugcuugauugucuggggagagcuauaaagcugaaccgccugcaaaauuuaaaugcaaaagguaaaauaaugugcagcagucauucaggugugggcccacugcaucugugagagguggagccggcucggaaagggcuugagcaucgugagugcagugcgguagaggcuggcuucugcgcucugucauauugcucuuaggcggggcagucccagaggccuuccuucugcaauucauggcuccucuccacucccuucccacuguucuucucaaaacccuucaguuauuaugauauuuccaauucaaauuuaggauugaagggcuuuuacuucuuuuagcuuaaaaaauacauuuuauacauugacacuccucguuuuagcauuagcauacuuaguuccugcugccuuugccgcccacacuuauguacacgccccuauucaguaccagcuguaauugaaaaauaccgugacuaguauuacuucccugagaaucuaugccaccagguaaguguguucagaaugcacauagcccuguccuguguaccgugauucuacaacauuauccugucucucagauuaacuggcuacuuuucugcugcucucuauguagcagaacauggaugugaaacuccaaaacuuuuacuaaauacguaauggaaacuauguuauagaauguuugagguuauuucaagaauacagaacuugggcuggagagauggcucagagguuaagggcacugucugcucuucagagguccuuaguucuauucccagcaagcacuugguggcucacaaccaucuguaaugggauccaaugcccucuucuggugugucugacagcugcaguguacauaaaauaaauaaguucuauuuuuaaaaauacagaacucuuuguauuggucuaauaaaauaguuauaacucacauuuaaagagcuguauggcaggucugcuuaugcugaaaugcugagagccucucccacaaugagagugagacugugggucccgccaugugagcauggggucggacagaggaagcagguucuuuugcaaaaguugguuguugguaaaauccaaaauaaccuugaggugaauuauuaggauguauaagugaguuuguuuggauuccuguaaaccaaauaugcaacaaucuauuuacuuucuaucaguacaauugggaugaaaguuuaaaagaaaugccacuaaaaaaccaauguagccugcacaucacaugaaucucaagaagaaugaagaccaaaguauggacacuuugccacuucuuagaauugggaacaaaacacccauggaaggaguuauagagacaaaguuuggagcuaagacaaaaggauggaccaucuagagacugccauauccagggauccaucccauaaucagccuccaaaugcugacaccauugcauacacuagcaagauugugcugauaggacccauauauagcugucucuagugagacuacgccggggccuagcaaacacauaaguggaugcucacagucagcuaguggaugaaucacagggcucccaauggaggagcuagaaaaaguacccaaggagcuaaagggaacugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagugagaguggguggguaggggaaugggggagaggguaugggggacuuuugggauagcauuggaaauguaaaugaggaaaauaccuaauuaaaaaaaaaaagaaagaaagaaacggggacggcugguuccagcagggcuccugggccguccccugggguccugauguuguuacguuuucuuuccaauugugggacaaaauacccuagcgaaagcaacuuaggggagaggguuugcuucagcucacaguuccagcuuccuuucugcaguagcgaggucacagugacaggagcuugagggagcaaagaacgcauguguccagggcucaaugcaguuuuuccuuugcaucagccaggacccagcagauagaaagugcuguucacagccagaguguguccuuccaccucagggaauaaaggcuagaaaaucccucacaggcuugccugugcaccagccuaaucgaggcaagucuuuguugacacucuucccaggugauuacacauauugucaaucugauaacugaagcuacucauugcaacuccccgcuuugucuaccugacacacggauauauuauuuuaaggcacaccuuucugucauaguuagggugacuguugcugugaccaaaagcaaauuggagguguaucuggcuuacacuuccacaucacugugugucaccaaaggaauucagagagggcaggaacugggaggaaggagcugaugcaggggccauggaggggugcugcuuacaggaguacuucucauggcuugcucagccugcuuucuuauagaacccaggaccgccagcccagggauggaaccauccgcagugggcugggccugcucccaucaguuucugacugagaaaaucaccgcaggcuugacuacagcacaaucuuaggaggcgucuucucgguugaggcucccuucucuccgaugacacgcaaugcuugcgucagucugacauaacauucaccagcaccuuuuacacccuucucuccaaagucuugucuugucucauagugaaagugcaguccaauucuaaaccuuucugcagucucgaagauuuccaacauuuuagaaguucagagauucugaacugugagcccccguaagaucaaaacgaacuuccauacuucuagcauauaauggcacagaauaaacauuccaaaaugaaacaaucaagggcauaccaaggaauaaucaaaccaaaaccccaaauccaauguggcuaaaaccaaauccugcagucccauguccagcauuugggccucgugaugaaacuggcugggcuccaaagcuucagacagccccauuccuucagcccuuaagcuuccccuucaaacuugguccagcgccacugcaugccuguagcucuucuggcacauacccugugauccuggcauccccaacacuccuaggucucuacuacagcuuaugcuuuaucuucaagcuccucacaguggccucugaggccuugcugcucucuggggccucgacccugccacacagugccugaccucagcugcucuccaccauuccucccuucugugucuuucauacuuucaagaccaguagcacacagacagcgccaccauucagaggggcagccuugccaccguggaccacaguucugugagcuugugugugcugacccuggggaaacacguccucaagucccaguguggacggccaggucgcucucucagggugcugaucccugcagcugcuguguugacugcacuuucuugucaaagacuugaagcuuguccacacuccuuucuaaugaauaguucauuaucuuuaaauucaacuucauucaaggucucacagugguggcaaauggaaccagauucuuauuaaauaucauaggauugucucuggcccauuuccuggcacagcccuuguucucggagaccucaggagccaggccuggguugcuggagagaguggguaaauaagcugauagccuaaacuauuagcuaagggcuaauaagaggugaacuugcacauguaaagcaaugggaaagacccagcauggaguguauggagguagagugcugucuguaaaggagacagacagucuguagcugcucagcauggcugcagaggaugugcuaaggggaagggagcugcugaaaggacaguuggccccgcuggaacccucccaugcugccuggcuacagcuccaacuuagagcagggccacggccacuguagggcaccugaggccagugagauucagaaagagcagucucaguucuaagugccagugggcaacucauaaagcgcgcaagcgagagcccuagcacagugcaguucccaagcccagagucuaugccaggagugccaaggcuccgaucagaagagcuaguagauggaacuuaccguauucacucaugagaagagaacucaguaacucccauucaggcuggcugaacaaugguguuacugaaaaaucuauuuugaggggagagggaauaguuaagauacgaucucacuguguguagcccagucuggccucaaccauucucaugccucagaugggauuaugggugugggcuacaugugugucuggcugaaagugaccuuuuagaaugagaguagaugcuucuuuccaaggcagauugucuggcguucucacuauagucagcgugccagcucucagaacugacaaguuccuuccaugcccauugucugaaugagggcaugugggggacgugaggccucugcacuacagugcgugacgcacagugcugccgugcugaagcagggaagcauccagcaguugaacuugcugcuucucacuaaccagggccaguggggagugacugcggcagaggaagaggaggagaacaagaggauccgagaauuccaggacuccauaccaaaaaugugcucacaguugcgaauauugacgcacuucuaccaggugaguauagguaugagacguggugucuguccucuuccgggacccgugcuugcuuccagaggaugggaaauguggccccacauccuugcuguaugagcagcacuugggauggagcacuugggggugcucccccuccggcuucacccuugugcugggcacucuucagggcagcuguacagcugggaaaguggcacugaggaccugugacuugucaugcucuucagagcaccauugccagauagugcaggcagugugcgggcuuguuggagagauaagccaugaauggucgcaguacuuuacuaaaccacagccuaucagauuugcaucuuacaggaaggcugcucuucacgguggcauggaguccaguggguuuagcuugagucugcuccccucuagaguaaugacugagcaugcguuucagcccgugagcugaaagaugagcaguggagcccugauuucucuucaccacagaguagggcgcguagcauccgcaacugccuauuucugucuggugugagugcagaggaggccagguggucagucgcucugauacagaacacagaacauaucauugcuugucuaacuguacagacggccucucugaugagugcggcccaggcgccgugaaaaccugggccccugcucaguucccguuggaggccuguuggugccggugcuucaggagggccuguguguucugacccaguccugugcuuucauccuaggguguggugcagcaguuucugguguuacucacgaccagcucugaugaaagucuccaguuucucagcuucagauuggacuucaacgaacauuacaaagccagagaacccaggcuccgggucucucugggcaguagggggcggcgcaguucccacacgugaggcuggcuuggguuaguacaugcuuacucaagccuggccccucaagcagcugugagcugcaggugcccccugucuacacacaggccccaguguucagcacugugucugcuggaagaagucuuguuauccacuggacuugcgugucuguaacgcugcugaguucaacaggccacuuaccuaccauguagucuccguagucgaaagacacugugaugugcugggacaucuuauuuccaccguguaauuuauauuucaacaacaacaaacuguuucuugccacaaaaaaacuagaccauaaauuaagaguaaugucacugcuguuuuuuagcauucucugugagacaguuuuuguuaucaugaugacacuaaaauugaaacaugucuaagaaaguccacaggcuguuuuacucuggcuucaguguuuguaacccucaccugcgugaggucaucacuacccacgcgucaucuccacacacuguccucucucccucccgaaguuuacauuuuuauauuugcuuuacuguuucagauaacaugucaaacauuucaaagagugggagccguggagggagguguccucagccugccuggccgcaggccgcuggcugaaccaggcaaggcugagacugucuuauuuucaaaguucugauaaguguuaggaagaaaucagcuuggauugugaagguuucccuucuccuugccuauuuuuucacuguaaauauuuauauacuacugaccagaugacggaggggacuggguuuugguuuuuuuuguaaaaaugucuuauccagucacauaauuaugccuuuuuuauguugcauaagugaaaacuuagagaauuaaaaaccauuaucuuucagaug

SEQ ID NO: 4301 - RNA, 3851 nt, Mus musculus
uucagaauaaaugcuaaagacugcagcuagugguuuuguucuuguccgaagaagcaauccuucgaucugcaccuugaccucauguucccuugacaucacagccucauguccgacugcuggugcuucaucuucugcaaggaacacguuagaagcaauccucugucaccacagcaugauggggccucaagggaggaggcugaucaccagguggacgugucugauggcaucaggcugguuccagacaaagcagaggccacggcugcuacagccucagguaggugcuggcggcccaagccgcucucugauccgaacugaugaucagacucuaagguccugagcugcgccacggagcaccagaaccaguagccaagccccuggcugcgccaaggguugucauggguuaaccuguaagugucauaagaagagguuggcucugcuuagagaguaugaggcgugucuuuggguuuuaaaagcacagcacaccagaaggggaaacauuuguagucuuugcuucccuuuuuuuuuuguuuuaguucuguugcuuuaauuugguauguuuuaucuuaacuaugcagaccagaucccuguuaccagaagugauagaauuagagccauauagugugaacccccagccuccagggcauaggcuuuucccagggccagucucugcaucagacuacucaugacgggcccuggcccuggccagccuaccaggucagcaguagggaaggagggcagaguguccuuggguuugcacgcuuuuaccugugccuucccacccugaccugugaaauaaagcauacagcaggccgagcaggucuguacaucccacagggggagugugaacuugacuccagggcugucugcaucaauggcagcccaaacaucaggcucacacacaccuuccugccauccuucagucuucuggcuguucccuggcuagcauuuguggugcuagaacugugcuaugaggcucccccaucugggauccuugccagagcugugucuuuuuuuuuuuuuuuuuuuuuuuuugguuauuuuauuuguuuacauuucaaauguuaucccccuucccaguuuccccucugcaagcccccuauuccaucccuccucucucugcuucuaugagggugcccacccacccacccacuccugccuccccacccuggcauuccccuacacuggggcaucaagccuccacaggacuaaggaccuccccucccacugaugucagauaaggccauccucugcuacauaugcagcuggagccaugggucccuccauguguacucuuugguuguugguuuagucccugggagcucuggggugaggucugguugguugauauuguucuuccuaugggguuguaauccccuuuggcuccuucaguccuuccccuaacucuuccuuuggggcccccgugcucaguccgauuguugucugugagcauccgcaucuguauuggucagacucuggcagggccucucaggggaccacuauaccagguuccugucagcaagugcuucuggucaucagccauagugucuggcuugggugucugcauauaugcuggauccccagguggggcggucucuggauggccuuuccuucagucucugcuccacucagucccuguauuuucuuuagacaggaacaauucugggugucuuauucagggugucuaugguaacaaucuaagguuuaggccuugcguucuuaugcuaguuucuaaggaauagugcuuugcccagugaccacggcucagggcucucuggaccugguauugugagccauaccuuggcuuaaggagagauggcauuucuugugguggcccuaccugaggucugcggcuuguguuucagcucccaucucucucugcuggugacugcccuguccgcaaggaacagcuacaguccggucuuccaagguggaccccaagugggaaccggggguuggagccuuucucagcaugagccccauguuucugcuucucccaggcucugguccagacugaggagagaugaucagagagaggcugccauccaagggcugugcagaaggggggcuccccaagaaguccuugagggggcuguuugauggaaacucccuuagcaauguuuacucuaguuggagugugaugagucccuuggugcucaagccacuuugguugugugauccugugccaguugccaccaguugguacucccuggccuuccuugggcuucugggugagccucacaggugcaggguuaaggccguccagggagcagccugcuggucagucccaggucgauaccgaccuggcugcucugaauucauuaucugcacuucccugacaggaaaaccugucaguaugucccaugagacaaggacuguaugguucaaggucaggcuuugucacaccuauguggguguggcagguccugaacuugccacuacacaaggcaguggcagcuaccccgggcucgggagcugggcaucucugcccugucucacgucacuccugacuccuuugcucucucuguauguggcauccuuccugacccagagccauggggcccagagggcugucaaaccugcauagaggcucggagcaaaagcacccggacacucuccuguugcagugacagacaagggcugugauuaagaacuuagagccugagugagcuuggugugacggggucagagcuccugaggucuuuaccgucucgauuucucguuacccugcccagauuauuccagaagcccuuugaagugauguaacuuaugugucagaacuuacauuuuuaaaucguuaauuuuuguagugacaaaauaaaggccucacucuuccaucuaaacauggagcacauacagaaugccccuaucucacacacucacagacucacccacucucaucuccccagacuccaucccuagucccagaccccggaagccacugcucugccuucugucugggugguuuggcacuccagggccguagcaaauguccucauugaguuuuuucacucauggcuagauaaguucguucgccacucaucagagaugucuguguccaggcagagucaagaguccaggcuguagaugacccagcacgugcuugcccuuacugcaaaugaaugcaugggcuucaugcccugaguagcuguugugagcaguggugaccguggugugcuuugcacuccuacgugccuccagagcugggugaagggugacuggccaggacaagagcuguuuuacaggcuggguuccucagcaccaucucugccauuccgauggcaggagccucgccucacgcacaggaggcuguguccagucugccguccccauucugucaacacucugccaucccugaggucacucggagguuuggaccacagaggcuggguaaacacagauaagccuguuuuccagcucgcuugccacagugugugugaucuggccuuuccuucggccuucuucauuccaacauuuuaccgcaauaguguguuuggccaaguuguccccaaaacucugcaguuacccacgucacucucugcugugggaggccucaagaguauacguggagaggccccuucaggaaucccgucuggccucucagacaccuaccauccaaaccugugcaaagugacucugugaacggacccugcccagugcaguugccucuggaccuugccccccacccccccaccuuuggucagucuuugccguaggcccauccucaccaaagggugauucuugcuguggagccaucccuccugaggcuucguuccgacucugcagaagcuggagugaguccagccugugggcuccugaucccgagacucuuccugcauuccuucuucacugug

SEQ ID NO: 4302 - RNA, 6666 nt, Mus musculus
uaagauuuacuuuuguuuuauugaguguugccugcauguggguaggaagugcaucgugugcaugcaggauccauccaggcagaagacagugucugagucucuggaacagaaguuacagaugguugugagccccuaguguggguuuaggaaccaagccugaguccucugagagagcucuuaacaaaacagaacauacucagacacauaagaagccaauccgugcuguccguguguguauucuuggcugugggccccacucaaagggccacacuaggaacgugcugacuggaaggaagccggcucuggguugucuuugccucuguggcuucuuagugagacagcuugggguggauggcacaggccugccccagugacagguuccucagccccagacuccagucugugugaggcgaccugugcuuucaaacauauuuguugucuuguagucaguggccugacaguccaggagagacuuccauagcagguggaguucuugcuuccuucuuuggcucggcaggacuucaccuguguaggaaagucugucucccaacgcugcucucugaaccuugaggcuuugcaccugaggaaaggccuguucuguucaccuucuuaacaggucucauuggcggguuaaccuucugagaucuaugcgggguaucacuggacagucugcaagaggguaggaucucuuggcaaacugaauauuuauuuucuguauucuuuuuuuuuguuguuuuuuugagacaggguuucucgguauugcccugucuguccuggaauucacuuuguagaccaggcuggccuugaacucagaaauccaccugccucugccucccaagugcugggauuaaagucgugcaccaucacugcccagcuauuuucuguauucuuaaaucuauuagguucagacucuuuaccugaaaugagagccccugccuuuaagaguugugggcaggacagacuuagaucacaggcucucagaccauguuugagcguggugguuuuaaguggcaggcgcucugugugcugcccacggugggcuuucucacugcugaguccugaguagcgguguggagaugugcauuugugguuuccagcuuuaacagcaaucugcugaccugcaggugucuguaccaaauuagaaucucaucagaaguuaacgcacauaguuuucuguuaacuguguugucucugaucaccauggggcuguggacuuuaauuaagagaagucccuggacagaaaugaggcagggcugcuguuccugucguagggccggaaagcugcccugccuuuugcaccaaggucauggcacacuaggcaggggugagcauacugggcugugugcacggucugaugugagggccugcucucugcagcggaggaguaccugucguuugccuuugaacacugccaucgcuccagccagaagaacaagaggaugauucugaucuaccugcugccagugaagaugcugcuggugagugaguguagcugacuguagcucgcuguugcggugcuugugcuguggggugugcuggaccugugcacagcccagagcagagugugcacgugccugcacaugccggcgcagcuccaaguccuuccagggagcuuuguuguguuuauucacgugacagaaacucugaacuguaauggucauagaacaagggaaacgguacauguuacuuauauuucuucuuagaagcuaguuucaugucagugaguuaacuagaaaggaaaaacacuauuccagucugccuaugggaaucuuaaucauaauaaauaaauauuuuugagacagucuuaugcacuugagguuggcuuccaacuuaauguaacccagacuguccuugaacucugacccuccugccuccacuucccaguggaugggcugcaggugcauaucccugugagggucaguugaugcuugagcaggaacgccaccuagguagauagacuagucaguuggccuagaguacaagcaaagggguucuuuuucacaucuaagacuaauacauggcugagggaggcacacagugcugcauguggcugaaacagaugguugaaaaucgcuuaugagaaugggaagcagggaggccgccccucugcggccccaaucccacugaccguucucauuccccagcccugggcuuacccuggugucucuucagcuaccaccucccuaccucagugcguaagugacagagcacauggaaggucaugacugaagucauacccaucaaguugaaaagcugugcccaggccuccuuaguucuugaccagaguuuuguguuucuguguggcugugcagaccacagcacucacggagcuuagagggugacugucccuccuucugcucugcggggauugaaccccggucaucaggcgugguggcaggugccuugaccugcugagccuuccaccuggcacagcuucuuccacgugcuuugcuaugcuuuuguuuguuucccuguuuaaagguaaucucuugauaagaaucuuacugaucuuaaaaguggaacuguuggggcuggagagauggcucaggggugaagaguguuuguugcucuugcagacauuuggaauugggugcccagcaucuaugacagguggcucacagcugccuggaacuccagcucucggggaucagaugcccuuguguggccucuggguaccugcacaugugggauguacacuacagauauacucguauagacauuuuuuuuuuaagugagagugcuucuguuauggaaagcuaacuuucuguccuagggucacaugccgaccaucgagcuccugaggaaauaccaccugaugcaguuuucagaagugaccaaagccgucagguaggcccgugcuuucacacuuuaagaacaggaggcuagaggagauugcacauguguugcccuggaaaccccgaugagcucucuuucugugauuuggcucugugacccacgugguguuucuucuugcccagugagggcaaccugcugcugcucaaugaggcgcuggcaaagcacgagacguucuucauccgcuguggcaucuuccucauccuggagaagcugaagaucaucacguacaggaaccucuucaagaaagugugagugccuggggacacagugagcagagcugcucugcaagcauugagccccaggauccaugucagagcuggaagcgugcaggccauaguagguguaaaaacagcagagacaaggagagccucuuucagcaaggcaaggacuggcagcugaaguuguucucugaacucuacauacacaccugcauucucacacacaauuacacacccaucauacacacacacagacagacacacauauagacacacacauagacacacacagcagaaaagaaagugggcugccuugcaaaggcaucccuugggcagaugauacagccucauuguagccuauaggggcaacauccugacccucgugggacagaggcugacccugaaggcuauauaaugacauagcuuggcaauagacucaacaugagcuuaggguaccagacgccuucugccuguccacgcuauuguggaacuguuguccucuuuccuuugcuccauggcagcuggcuuauccucugucgccacugugugucagggcguuaagcgugauggcucccuuucuugugugugaugcuggacaguggcucuucugaggccucgucccagccgccucucacacacacagacccuuuuauagcugaaggcagucagucagaaauaguaaggaggagcugaagucacaggacaucucagaguuaauugacaugauaaagaaugcauugaagauuuaauagauacucagaaaauaucuaaauaucuauucauacaguggcugcuuacaguacaaagcuuauauacuauuguguuuaauagcugucguuugugggccguguugcagaguguaucuuaucaguaagaacuuaaaauauguugaacauuagcucaccaaauaaugucacugccuguccucuggcucuucuucuugucccugaagugcugaguccuguuguuacuuacaguaguuucuuuucuucauagguauuuguuacucaagacacaucagcugucccuagacgccuuucuggucgcuuugaaguucaugcacguggaagacguggacauugacgagguccagugcauucuggccaacuugauauacauggugcgugaguccgccugcucucagggggcugugauacggugcugaugucaccaggagaccuauugaugaaggcauauucuaguagaacugacuuuucuuccccccccaguaaauacuauucaaagggccucuuguggaucaguauugagggcuauaaccuguacuaguguguccccagggaagggaguuuucaucaucaugucguauuugaugugacugagacucagaaguguaagccucuauccuugucuguuucagggucacauuaaaggcuacaucucccaucagcaucagaaacuggucgucagcaagcagaacccuuucccuccgcuguccacagugugcugaugcccaggccuugccaacagcgugcuccugcuaccgcugcccgcuggagcucacaucuccuggugcagucgccagcaccugaggcacucacugugguuuccaguguccuaacucaugccagccuugccaagaccuggaguucuuuuucaagauggaccaacacccugcugcuggccuguggugcuccugagcguccgggaaggagacagcugggcuucgguuuguuuauggaggcuaccuuugugacaucuuguaggguuuccucccucccuccucucucucucucucucucucucuuucucucucucucucucucuuucuuaaaaagguaacccaaguuuauacaaguggcacgaguucuuuacugucuguuauguaacacaucuguuuucauaugcaaaaugucagcauugugagcucggaaugcuggguuaacuugaggcuucuuuuuaaaaguagaauuuagggggaggagagacgguucaggcgagaacagcuacugcucugccagaggauguguguuugauuccuggcacccauauggcagcucacagccucuaacuccaguucuaggggacccauugccuucguuggccuccacgggcuccugcacacguguacaaaagcucacucaggcaaacaggcaugcauacauaaauaaauacaccuuuuuuuaagaaaagcaagaguuagucuaauguaaauuccaacaguuguaaaggcugugcaguacuaagacaggaccuggcuguugggcucugguuauggccccuucugagccuuuccucugccucgcuuccguuuccuauagccacuguccugucgggcccucacccugcagcuucauccagcuuagccccuuccagagacccuuccucuagacaguuagccugggugggcuucagcagaggguucugggcacagugcaucccgcagcacuggguacggccagcucucccucuuccuuccuccuccucuuccuuuuuuuaaauaaauaguuuauuuauuuuaugugcauuuguguuuuguccgcauguaugucuguuugaggggggucagauccuggaguuacaaauagcuguggauguugggaauugaacccaaguccucuggaagagcagcuaguguuccuuaccacugagccagcucuccagccccuaauacuccaacuucuuaagagugucuguuuccucuguguguuguuuauuuuguucacuugucuaucaucucuguauuucucugccugcccgcccacccgcacaucuguccauccauuugucugucugagguagggucucuuuauauagccuggcuggccuggaacucuauguagaccaugcuuccacaugaugcuauucuugccucuguguccccagaccaggugggugccacgaugugaggcuugucccccguuuaugagaagugcacuaauguggaaaggcuaacaauuuguuagucucugcagaguuuuuguagucagaagccauuccuuuugcagacgaacugugggggagcuuacguggucuccacggggcauggugcaggacguccccuuacguggcugcuucauuagcauccucuugcaggauggcaaaaucacccaaacuaugccaugaggcaucaauauccugacuuuaucccaaaucuuugccuggucaaggcuuuguggcuuuaggcaacugcuccaugugaugguccugggggcuagaagguggcucacuccugaauaugggcuuggauauugggcucaguggggugggcguggacagcuuguauucuccauguggccaucuccagcagcuaaagcuggguuccagaacagggccaaaggaagaggugccugugguaugaauuguaccacuuuccagcugagaacacugccuuugccauguccauggucaugucccuacucucugaaccauucgcccacggugugcagagaggcaucuggcauugagcguggccccucauaggcugguagagcuuaugagcuccaccaaggcuaagccugcccuccuguguccucuguguccaugucuaugguguuaccuccugcagagcugccaugaagagcugauccaguagagugguauccuuguaaccauucaaauauuaggguugcua

SEQ ID NO: 4303 - RNA, 42705 nt, Mus musculus
aagaggaggagccgagcgcucacgggcggagcccgacagcagcaggaggaggagccgggcgcgcacggagcgggcgcagggcaggaggaggagccgggcggcgcggggcggggcggcguccggcccagccauggcggacgagggcccucggaagggcagcgucucggcucucaugggccgcaccaacggccucaccaagcccgcggcguuggccgguggccccgccaagccggggggcacgggaggcuccaggaagcuggucaucaagaacuuccgaggugggugcgcuccggugaggagcgaacggggcggccggcgggucgcgcgcucggacagggccuccuggggcugcccggcaggcccuguccccgcgccccggcccgccugguucccgcacugucccgucucggcgccgcaacccgacuugucccugcaccucacgcuccgccacguccccgcgccccagcuggccccgaucccgcaccuccuggcuagcccggccgggcccugccucggugccccggccugugcuguccccgcgcggccguugacccucucucccccacagacaggccgcggcugccugacaacuacacucaggacacguggcggaagcuucacgaagcggucaaggccauccagagcagcacauccaucagguacaaccuggaggagcuguaccaggugagcggcggcgagggccugcgagcaccuggcuggguuccuccuccagcagccaccggggccaacgcuagggaggcccgcccguccgcccgcccgcccggggagaagcugcggcccgagccuucccuagcggaagccgcgaaacccugggucagcagguguuucuauggaucgccgcccuggauuagugcuguguguugaggcuuagaccaggcugcuuaggagguguacguuuucccagcgccagaagaaaggagguguuuggagcuaagaggcacagagcccccagcagucuucaguguuaucagagugccaguguguuauacauggaacucaguacggccccacuugcuaguagggucccuggguugugacacacacacccccuccccaacacacacacacuguuuuguaguuuaauuauugcaaauaagguugcagacagauucugguaggguuuuuguuuuguuuuguuuuguuuuuuuuugagacaggguuucucuguguugcucuggcuguccuggaacucacucuguagaccaggcuggccuugaacucagaacuccaccugccucugccucccgagugcugggauuaaaggugugcgccaccacgcccggcgauucugguaguuuuaacuuaaagacaaguugugucugcaacagggggggaaaaucauccgaaguacauuuugcuguuucaagcacacuuuucugucaugguuuuauacaauaacugcuaaauauucuguguuuuaguuugugauagaacaaauaauuacuuauauguuacuuaaaaguuaccuaagaggcuuguuuuauccugguuacaaacugaguguauuguaaguuacagaaagcacaagaagaaaaguaagcagugguacccgaaggaaccuguggcaggcccaucacucccaaccccaaacucccaaauccaaaacuuguagugcacucaugaaaaaaagacccacaccugacuuccucugcugggccucagacagaacacaguauaugcuaaaacuguugaauaaaaugaccaucgagcuagggccagccagaugacccaguagguaaagcgcuggcagagccagcuugacaacuuguguucgaaccucagaacccucaaaaagguggaaggagaaaacugacuggagacgcauccccagaccuccagccucuugacgugacacaagcacccacacauacacuugguguacacacacaaugauaaaacaagggauaugggguacgagucagcuuugugucuguuuacacuugauucucaguacccagauacaucauuguguaugugcaaguauuaauccggaagaaaaacaucugaaauccacaacacuaguagccccaagcauucuggguaagggaccacuggccgauggugacggauugguguauaugugucuguucuuugucuuaaguuugugaguugauuguguauugaaggagaggauuuuauuuaagguuuuguuuuuguuuuguuuagacagggcucacuguguagccuuggcuauucuagaacucacugugaacagucugacuuacagagaucuuccugccucugucucuuggugcuggaauuaacauuaugcacuacuacacccgccuaaagauuugcuuuuauuuuuauuauuuuaaguaugugccuauguguaggugugcauaugaauacaguguugggggcaugugacaugugcuccaguagguuuauuuuguuuauuuuauuuuuuuaugagaagagagagucgguugguuuuauuuuuuacgagauucacuguggggcuggagagauggcucagcaguuaagaaugcucuuacagagguccugaguucaauucccagcaacuacauggugacucacaaccaucugucaugggaucugaugccuccuucugguaugugugaagacugggacaguguaccuuauaacuauggggaaaaaaaaaggucucacuggguauuagucccggcugccgcucaugugccggggcuauagguuaacucuaacauacuugucccaguagauuuuaauggccuaagauagaguuguuugccagccgcucagugaaaauguagacuguuucccuccccgguaacgaagggcugccccgugaacucauccccucccguuccccagcuguggcagcugcugccguguucucucuacuccuccaccucuaucuagaaggagcagcgcauuugcaguccucuggcaucuggcucuuaucuagaauggcguuugccauuuccucuggugcuaacaguuuggcauuuugguuuguuuguuuuuguuuauuaauguguuuaguauuugaaauagaauuccuuccaucccuguccuccuccuuuccucucuccauggccccuggacacccucuuugaaaucccuccuuugugcccccaagugcauauuacuuuuauuaacaaguagagugucuauagugcaguuggcuuauucaucagguaguggccguuuggguguccagugggaacaugaccagcagggccgcuaugaacguugcauacaucaugugugggaauguguuuucauucuucucaggaaaguaucucagauacagaaaaugugugcuuccuuucauaagaagcugcagcucuuccaagugacuccauuuuccccacugcgguagcuugaggguccuuuacuccacauucucaccagcauuuggugccgucgaguuuuacaaacggguuuaauuuaccgucccuguugacggcaggugucugucuguuugugugccuguugcucuucuauacuuuugaugcaguuugcugcucagaucugcuggcucccugccuccuccugccauccccucucccugcuucccucuuaucucacuguguagcuugcucugccugcaaacuuggaguccuccugugccaaccucccaagugcugggauuacagauaugggccagggugcucagcuucaucugcuuagauuauuuucccguuauugaaugugugaguuuaguauguauuccggauauaaguucuauauagguguugcuaguauuuucuucuagcccauagcuuaucccuuaacuaaucuauguccuuugaagaacagugauuuaaauuuugaaguuaagugucuuaucagcuguucuuuuagguuauguuuuuaguaucccccuaaaaaauaaaaacuaaacuuuugccauaacugguaguaauagcacacuuauguaaccccagcacucagcaggcagagaagaguucaaggccagccuccucuacuagccagcucaaggccagcuacaugaaacccugucucaaaaacaacaaagcaacagaucuuuguccuaaucuaagaccuuguauuuagacagagcugacaguuuuacauuuagaucugugaucuauguuguguggacaucuguguguauggugagauauaaaucuagauacaguguuuuucccauaaguguccagguguugggcacauugcccaacugccuuucuccgacaagaccaguugucugucuaggagggguagccuccagcuuuuucccacauuugucugagcuauucuuggucuuuugcauuucuuuaugaaucugaaaaacugauuucuggcuuucucaaggaaccagcuuggguuagaguuauggugacucuuagaucaccuagagagaacugacucggccuuagagauagaaggcucacuguuggggcuaauauuucucagcagugauuucuuguuucauuuguaaagauguuacaaaccuuuuauggaauuuucaccuuaccuugaauucugacuugugauucuugcuuuuacuuaaaauuaccauuaauuuuguauauugaaauuguccuucuaauuugcuggccuugccuguuuucuguagaucccauuguaucuucugcccagacaaucacauguagcuagaaagcuuuuugcuuuccaaguuuugugccucuuauuucuuggcuuugucuugcuaaacuggcaagagccucugggacagugguuggaagugagagagccggugcugucuugcucuagaucucuagaacuuugguuugccacuguugagugugacgaugcuaccauguaggaggguccuuccugcuccccgcuaauuuaaugaaagcacauuucugcaucuauuacgggauugcuuaaguuuugcuucuuaguuggucgauuauguucauuaaucuuucuuucuguguugaauauaaggacagucuugcaugcuugggcuauaucuuuuguuuuagaccuggucucccugugccuccuugguggacuuggaacccccuguguagaucagguuggccucaagcucacugagcuuucccugccucugccugcugagugcugcuggaguuaaagccacugcugcuguggccgcucuguuaccuuucuuauguguugaguugagugauuaauuuuuuguuaacuuugucuuaauguauuauuuucuuauuaugucuuugaucaguuugcaugucaaaguaauauuggccuuaugaguuuaaaaugauuuucucuuccuuguauagaauugguauuguuuuuuucuuaaauguuugaaggaauucccuagaggagccauuuugguuuucauuuucauuuuaucauuuuauauguauggauguuuauccugcauguguaucugugccccagauccaaaccuagugugcacagggcagaaggggucgaauccccuggaccuagagugaagugagcugcugagugggggcugguaucaagccugcauccucggaaagagcagcuuuucccugccgagccauuaagugcacagcgauuguuccuagugccccugaggaggacaccagcugucuugucuuccgagucucucauucucagccgugccucagcuacuguugcugccacaggugugagucucucacacuucugaaggcuucuuucugaauuucugccuaaccuuugcaucuuguuuauggcuauuguuuuguccugacccacuaccucuguucuugauacccccuccccauuaagaagauuagugacaauccuugaauggauguucaacauucuaaauucuaacuggugugccagauauuuuuauauuauuguaaauucguguccuuuauucuggccauaguuuaaugauuuaaagaccaucuggucuuaagccucacuuuuaggauuuguuaggccagggcagacugcugcuguaucuagggccagacgacccuaccacggaaacagaccuuccuaggugccuugacugguuuucagcuggauauggaaaaaccgcuauucuaggccccgugagaacuccagcacuuuuaccuccacucuucuagaugguucuuuccucgucccagaacguguacccuuuguugcauauuggggguucuucaucucucuugacucgguucugcgugcagcugcagcuggguaggaaacuggagcagcuggcacuccccaaagaucuucuggcagcguccaagaccccagccaacgugccaccugugcugcgucugcucuuugucuauuuguuugucuuagguuuuguuuguuugcuuuuuggugcccagggccccuaaaauacucuguucuuugucuuuuuuauucccccccauuauuuugacugggaacaagaacugcaccaaaacaccuaaauacucggguuuuagcuuaaucaaauaccucuugcuacuaaugcuguccugugaccuagagagugcaguguccaggcucggcugucccgacagaggagguuccuuuccaaauacggcaggcaugcgacgggcguccuaggcugagcccucgugcaucccgggcugcuccaucucacugaacaccuacccgugaggacucagcuccaucuuuguuagggcagagggguggcucuggccuccgacaaauagugcuccccugcccucuccuguuuccagcugugcuuuaugcccuaccacagaaucuuaguugacagcaccacuuuuuaccagaggcuggaaauacuuaguuuugaagucuaauauaaauauaggagcucauuggccauggcucucugcucagcagcucuuuuucuggguaucacguggguucuaucugucauccauggcgaggaggucuccuggcucccauccucuguaucuuccucugagcaggguuguuuugaagaugcaggucuuuugcuucugaagacuugagucugaaucacucagaaggacauacuccugugacuuucauacuugaauuuuguccuuuggucacccuagucucuagugcacaucagaggaagacccaguguggagcuccaccugagaacaaacuccucaggguggccuagcuuccagggagaggccagcucugggcuagaguacacagcagggcuggaagguucaucccugucagucaugauagugaaggagggagcagugugggucuguggagagcuaagugacaggguuggcuaaaacugacaugggaaagccagcccagggaguggugggcagguccuauugcagggaccacuuugaggaagucgcauauuaguagagcauaaauucaauacaaaagcagagaauauguccucucugacuugccugucccaccagagccugccugccuagucuagcagccuccugcucaccucucagauuugucuguuuagcucuugccgcagccuugagagccaagguuggauuuggaagguagugacagagugggacccgagaugcgugucuccugagaaguuucugaguuuccuguugccuggauuugggcccugauuuuauuuuguauucuuauuucuuucagguaggcaucuagagggguccaguaucccagccccacucugggugagaguaguagggggaggagggguggggaggcagcaagucuguauagaaauggugaccccaggccauccuuaccacagaaagugccaccaauccuggacuucugggucuggguaguguguuuuacuggucuucugaugugaguucaggaucaugucgggucccacucugucauagcaugucucuguaguggcugggcucgaguaacuaggucuaugagguaguuuccugagggcuucccagaccugcaguugaagcuugugugcuuuuuuugucaaugaauccagugacacaggccaugauuucuuguuccuguuuucuguggcuucaccuugaagggucucugcaugaauuugcauuuaaugaacaccagcagagcccaggccuccagccgccugcggucccuucuuucauucaguguucuucaccugagaggugacuguuuguggcacaggaagcauuuuguuuuaguagcaguaaauagucuucaggugguauuuaagagagcaaauggauggccuuggacaccacggcccccgcuugucagugcucagcauggcgcuggcgcagccugucggucacugaggagucugcuguggggcgugacccuugggauguaggagcaguauauuuucaggaaugaguggauaugagagcagcuacaaacuggcacaagcagaguccaaaggcugccacgucccaccuuugguuguuggacuaaaccuugcuucucuaaggugauuccuuuuuaaaugcccauagcacauugucuuagccugacuggacccuuccuucuuacaucaagagaggacauuuggaaacagucuccaggacagguauagcuugugcucaggccugcaguaagucugugcuaccugugggcugccaccugccuugagguguucucacauauuagaaauaaaucaagucucagaguguuucaugucaguaggugugacagccauagcacacccuuaaucccaguacucaggaggcagaggcaggaggaucucugaguaugaggcuagacuggucuauauagcaaguuccagacagccacagcugcauagugagacucugucucaagaagaacaaagagaaaaauguuccuuucaaaugacuauuuugugaaggacaguauaccauacacacaaacuggauauuacaaaaagaagauggggcuggagagauagcucagugguuaagagcaccaacugcucauccgaagguccugaguucaaaucccagcaaccacgugguggcucacaaccauccguaaugagauccgauacccucuucuggugcgucugaagacaacuacaguguacuuagauauaauaauaaauaaaucuuuuuuaaaaaaagaaaagaaacaggcugaaaagaaaaagaagaagugcacagucauauaaauguaaguguggacugacucgggaugagcugcuggggagaacugacguagaagacaugaaggugcuuuaaggaaaaggaguugaggaaaguuucucuguucucuguccucgguagagaacauuuuuguuuacaucucacacuugaaugagauucugacauguguacgagauuugaaagggguuuaauuaugacuggugagacuauauucuuucaauggguagaaauauuugauuuuuuuuucuguaggcuguuuaaaguugcuuuuuucgcuggauggugguggugcucaccuuuaaucccggcacuugggaagcagagguaggcagaucucugaguucgaggcuagccuggucuacagagugagagaguuccaggacagccaggaaggacuacacggagaaauccugucucaaaaagcaaacaaaaguugccuuuucuucaucaaaaucaagaaaaaauaagugaauucuacaacagucaguaaauaaacagggaucagcauagccuggucugugucacucaggacucacaggucuuccacccacacagcuggaguccgcuaugccugagcaagggcucuguucccuccugucacugcccagguucacaucagaaaauggccacgugauccaaaccuacuguagaguccugguacuguugagcagccugauuggaaaacagcugaguuagagcaaagcuggagauuuuaggugcagccccccgccccccaaggaauagugggugcagcguaccaucaaucugagccccucacuguuggccgcugcugucagugugggcagcacaagcacugagcgccuguaugggcugcaugguagguaacugcagggcuuugcaagagcuuugacacucugcugaacaaccaccuuuucccuuuguuguaggcuguugaaaaucuuuguucucacaaagucuccccaacgcucuacaagcagcugcgccaggucugugaagaccauguccaggcccagauccucccauucagagaauauccuuucuuuguuuugcuuuuuuuuuugcuuuaugguguuucuguuuacuacacaagucuuuuuaaaaugggaugaagaacuaaugacuauccuuaagauaaaauaauagguuuuaagucuuuuuuauagaacaaauagccuuuuuguuucauaauucauuauaauaguuguuuagugaaauuuguaacauuuaaguugcugauaugagugagguuagacagccuccagguacuacaucugguuggaacacucaggggaguguuugaaaauauauuaaguuuaaguucuguccuuuaguaagagucaucuuauuuauuuucuaugauaugugacaaauccccacaaauauggaugucauacccagcuuauuuucuugggguguaucugucaggaaucaggguacagcccaguaguuucucugcucagggucucguaggcccaagucagugugucagggaggcugucucaucuaaggugggucuuuccuggcucccacaggugggaaacuguagaaacaaggucccgacuuaccaucuggccauagugguccuggcuuaacccugaggacugugcucagggccuugcugcauccaguuucucccgguggauugugaacuacucugggcaggcaggagaaccugccugucuggccugagacuguaccuucagggacagaaccagacaaaggauggcuggcuauaguguuccaauaagaagggaauuaguccagaaagaacccagaugccccucaacaaaggaauggauacaaaaaaugugguacauuuacacaauggaguacuacucagcuauuaaaaggaaugaauuuaugaaauuccuaggcaaaugguuggaccuggagggcaucauccugagugagguaacucaaucacaaaagaacucaaauaauauguacucacugauaaguggauauuagcccagaaacuuaguauacccgagauauaagauacaauuugcaaaacacacgaaacugaagaagaacagaagaccaaaguguggauacuuugccccuucuuagaauuggaaacaaucacccauggaaggaguuacagagacaaaguuuggagcugagacaaaaggauggaccaucuagagacugccauauccagggauccaucccauaauuagccuccaaacgaugacaccauugcauacacuagcaagcgcuugcugaaaggacccugauauaacugucucuugugagacuaggccggggucuagcaaacacauaaguggaugcucacagucagcuauuggauggaucacaggacccccaauggaggagcuagagaaaguauccaaggagcuaaagggaucugcaacccuauaggugcaacaacauuaugaacuaaccaguaccccaaagcucuugacucuagcugcauaugugucaaaagauggccuagucggccaucacuggaaagagaggcccauuggacuugcaaacuuuauaugccccaguacaggggaacgccagggccaaaaagggggaguggguggguaggggaguggggggggaggguaugggggacuuuugggauagcauuggaaauguaguugagaaaaauacguaauaaaaaauauuuuuuuuuuuaaaaaagggaauuagucuggcaaguacuguaggcagggcugggcagaggccaucuuggguuugcugccaugccaucugugacucaugcccacaaggacaucagucugaccuggccucaggccaguuuaagggcacaaacucuguuguguauaaaaacccauguugacuucuuuggaugcauauauucaugucuaaaacaaaucccagagcccucguaucaagauuuucuccugauugaggaaaucucuguuuuucccuccuguggaaacuugguccuugcaucugugcagaccuuguuaauucagagugccuaguaauguugcuggacacagccucuguggucguggugagagaccugcacagagccugugugccugcuucccacagcggguugucaggccauccugaguucugcuacauggcuucaaucaggaugaacuaaagacugcaagauuauacaagaugauggugaugggaucccuggaggaccugcuggcauguaucuucccucaggagguagcugugaagcauacggagccucugccccauucagagcacaggaggagccugagccugggccggccagggacacgggcacccagcacgguuuugcugcaaauggcuuucugauuaccugcuuuaaucacccgccugccaguuaaucccacucuggggguugaccuaugcguucccacauucagcaagccuuuguucccuacccagugucuuagucccuggauuauagaaaaguggcugugccugauuuccuucuuccaaggaaucauagcccuaggacagagccauagauuucuugauaagaaagcaggauuuuaaaaauuaugacuuguuuuacaggagggaaauagcacuaauacauuguauguuauaagugacagacacaugcaacucacagcagcagaacagaaaucagguagagcccccacaguggcggggucagggggagucggggauaccaguggacuaugcccugaagaacaaugggguguaagcagacagugagcaugacugagugccaaguguguugcugagaacugcagaucacagacugcacugcauucuggauauguuacaggaaguuguacaagccacugagauuacuuauaguuucuaagcuaaagcucaauacaauugucauguaaagaucacagcaugauaggacagccuggccaguaugcagccuggaaccaucaccagccaacacguuuccaagagcuguuaugugcugccuggcaucacacuagguccugagagaaagcacugugagcaacucagguguuuguguaacagaccauggccaccucaggacauaaggaggaauaacccaucugccugaggagggaaaugcugaggggacaggaggcccagcgaggagacagcccauguagguacacggcaggcagagaagagcccacuggcaagaagcagcaauugcugcugcaggcuuccagaaaaggaaagcucacuuuugaccugcagugagacuggcccgugcugugcugagggccaggcacugcacaguuuuggcucaguggauguauugacuaauggggagaaugguaacuaaauaguccuaaaaagaacaguguuguauagggugauuuuuuucagcuuuacucuucuauucuguuuccagcaagaguauuaagaugcugaagccaagcaagcagagauuacacuucugcuuuccuuuaagagggcuuugugauugggaauuuuuuucuagucuaucauuagcauucuugcuauuggguguuaauuguaucaugaaagguguacuucacuuccauggauggugugaguucuuugcagggaucaacccuucuccaaaaugagacaagaaugcuuaccaggaagcugccucagcagaagccacaacagacccuuuugacacguguguaucucacugccuagaauuacucaucugugccaccguggugacaccuuaagccuugcauccuagaacugacugaauuguagcaggcugagcaggaucucgaucaacauaguacucuguggaaaugcuuugacucuuuauacgguuuuccauggaaaauagcagaaaaugguugaccugcauuacuuaacagaacucuuucauuacagaacuuugacauuggacccuugcaucuuagaguuacuaggccagguacaacuugccugugguuauugaugacaccugagcugccugguagcaucagauagacuagugucaguuuaacuccaucuuaagcuuaaaggcucaugcaaauucacugccacacagcaugcuggccaaugugagcguauuaggaacuucauugucgggccagaggcaucucucacccugcuaaaucaaauguccuguggccaaccugugucuugcuuugcccagcuuuuuguguagguuucucauaguggucuggcauauuuuaccauuauagaagcauuccccaagaguaauaugcuagccacugaacuaacaguguaaaugugugaaugugcuuccucggacuuaggaggggaaaacuagaccucuuugagccaccguggcuauggccaccugcacagauguaccugucccucuaccgucucccugaacauugucuucccuuccugagggugggccagcaccaugugcccccaccagcugccugugacucacggaagagcugcugcuucucugaccuggcuguggcacacuuggcaagcuucuccucugucugggugugcugcuuccucaugugagcugagugugccggcccugcgugcuugcacucgcaugugagcugagugugcugacccucugcacuuggacucauugacauggaugggacaugugcugcugaguggcagacaggacaucuggcacuuuccaccuacagggacugcguucucuguguuaggaagcuugaagaucaaaugaaaaugggcaaaaaaaaaccuuugucuaaaaacccacauucuggcaucuuuguuuucaaacugugcuuuacaguuuuagaaaaguguuaggagcuggaguggaagcuuguuggugagagcacuugacccaaggccaagucccaggaccuguaucaggcaggugacuuaagcuccaugugugaugggacaccuggcaucacacaaguaaacaagucauuugaaagaauccuaaacauuuaaaaaauaauggcucagcagucaggggcacuugcugcucuuccagaggacugggaucugguucccauaacccacaugguagcucacaaccauccauaacuccaguuccaggggauccgaugcccuuucugcucuccuugggcacuguacauauguguauauacacacgagcgcgcgcgcacacacacacauacaauagaauguccuaauaacaagguucaggccagcagaguauauggcgagacucuggcuuaaaaaaauguuuuuugagucuuuacuaaaccucauacacuggcacaugcuuguaguaucaucucuggggauacugaggcagaaggaucucaggcuccucauagucucuauguuaagauccugacucaaaaacaaacaagcacagugugguggcugauaccuaaaaucccaacacgugggacacugggaaggaggaaagcuggguuuaaggccagucuugggcagagugacacugucccaaaaguauacacacaaaaucccaaacacagagaaguacacuuugagucuagguggugcacagucuggucauagaugcaaccuuguguuuagcguuuuaaguuuuuacuggggaagccucuaucacucuugagcugccagcucccugcuguuaucauucaauacacacuuuuuuacuguuggacauccuggucccaucagucaccagcuguagaagguccuuuguagaguuauguucaguccuggcccucaguggggugcaguccugcccccccuccccauuaagcacuugugccugguuaucucuguaagcuggcaggaacagaaagcaguccuacagagaggagagaauggaagucaaagcaauaaggcgcagaucccagggggcuggaugugucagguagcuuacuacagauagggagugaggccaguggacagagacaaagaauucacacuccucgcuugggagcugcaggucucuguugguauauuuguaaaaaaaaaaaaaaaaaaaaaaaaaaaaagccauggguguuuguuuuucacaaccuggagacgaagucccgagacccaugugcuaguucucuccaucugguaagagcuuccugcuuuguggguagaugaggcagcucucugcggugucguauauacccacuggcccuguugccuuaggauuaggucuccacuguggauuuaggauacagaaguguugagacuauaguguggucauauucucacuguuuguagagggacaucuagcagggaggguauuggucagagugaaaguuggaaaacugggauggacuauuguguuugaagcuuccuuagcaggucugcacagacucacuagacagcguuuuauuucuaaagaagauuaacacaugcuggcaagaucacugcagacaaaugguaaguguaaccuucaucagccuugacgcucugucagugcugccugaguuagcucacucacaccugcucacuuguacaagccucugcucuagacagaaugaaggugagcucuucacagccgccuuuccaccaacuugaagccugagcucagggacccuucaccacguuaagcaguagaauggaguggggaggugggcugcucagccucuucuaggaggaggugcugccugcaggucagcagucacugugugcucaucaaagacuccuccaaguccucagaggaggcuuccagugucuaauggaaacguuggccugaauuccagcuccuugacuugacacauggguuucaguguggcccagcuguugaugaccuaugagagaagauagucuauguggcuucuucaaguagacugaacgcuuauuuucuaaagaugagcauucugagcucauggauauaaaaaacaagaauguccacuugggaagguauuucaaacgucagcaggucucaccaaaaaguggaggcaguuccagcuggugaacacauggcuucagcagcaaaggagaggacaguugacugccugcccuggagcccaagagccucagggcagugcagcaggcuaucuaacuguuggaaaacuuaagccagggauagagguuauauacccaccugcagucaccacauuuaggaaguagaaauaaagaaaauaaaaaguuuaaugcuaugagacccccaucucagaaaaccaagaaugaaagauuagacagacaugcacaagcuucauuuugucaucaguugggugauaaucaaauuucagauuuccuugaggcugagugcuuuaaaacccuuguagucugggcuguugcauugaauggaaaauaccagaagaaaaagcuaaguuuguaaaaaugaaggucuugguauaugcgggguuccaucaggaaugauugacacuuugaaggcagcuaauguaagauggccuaagaagucucuguucucaguggugugugugugugugugugagggagggaugugugagugcugcuccucccuguucuucagaucaugaucagaagcaucuuccuguuucuggaucgaaccuacguccuccagaauuccaugcugccuucuaucugguaaguccacccugaccccugggccuccugcagaccugcagaguucucuuguuagagcauggugucuucacggaauagacucccacgacuccugggcuauauauaggcugagggagcaggguuaauuuguggucauuucauaucugcuuucuguggaaacaguuacagcaacagugguugcuggagacaguaugggugcagggguggggggaggaagggaugcagaagggggcagaaucaguggugauucccauaaucuugauaccguugaggcucacggaaggagaauggugaaacauaggccaaagaugauaggcccaacaauagcaauucgauaauugagugccuguguggcacaagauaucucauuaucuccuugggguagugagcuuggccuaucuaggaauuaaccucauuuaugguagaggcauaaacauccuggacuggcccaacaagccaguugguaggaggacucuuaaagaucuggguaucacuggcaaacagcauuuuggggcuggugcguguagcacacgugaaacucuagaggaucaaagguaagccaaagccuguugugcuucuccaucagggacaugggccuagagcuguuuaggaaccacaucaucagcgacaggauggugcagaguaagaccauugaugggauccugcugcugauugggcgugaacgaaguggagaggcuguggacaggagucugcuucggaguuugcuaagcaugcucucagaucuccaggugaggccuuggucuugagcauuugugcuugcgccaaaguaaaggcaggcuucagagcuguaaguggggacuaguacccagaaguaugaguggacaucccgauugucuaguccuuaaggagagugauggaggccugugguacagucugcacggagcugcaagagaagcgccugauaagaaccagugcuugaaaaggaagguuucugugcucaagcucaucaggagcugcuuguuuccuagguguacaaagacucauuugagcugaaguucuuggaagagacuaacugucuauacgcugcugaaggccagaggcugaugcaggacagggaggugagcugugcggccgacugcauuuggcuguaacccacuccuugggccugcugcccuuuuguauguauacauuugccaaagucucuggagucuuugggagagaacugcuugcuguacaaaggaguuaauuucuuucccuuagaagcuuucuuucuuuauuuccccuccccuaaguauuuucuaaaauagcgauguuuaagcaagccuaugucuaaugucugagccuaugucuaagcaagaagauaaagagcuaaucuuaaaaaucaaacaugucacuguguaaagcauuggugaagaauguaugugaagaagccuagauaauaacagcagugucaccucagccccucugagcagcuucuuaggucuagaguccagucccaagggagugaugaguccuauguggagccaccugccccugccaagaugggcccaacccaucagaucacaguuuagcugcagccgugcuagcuaagguggcacugaggacaagcgauggcugucugcaguugccgugacugcaggggagggaggaugucaccgcugacagauccgugugauccauguguacagguugcuaguaagcuuuggcugucuccccagguacugauacuaacucacccaucguggcccacugguauuuguccccccgcacuugguaguaagccgugagaguggccugggcccugccugguuagaggggcuucucaguggcagucuguuagcgagugaguggguuugcuucucucucucuuuuucucuauuuuuugaggaaauuuuauguauaaugugagaagucuuugucauugauguguuaaauguuuuuuuuggaagguuccagaauaccuuaaccaugugagcaaacgucuagaagaggaagcagaccgagugaucaccuacuuagaccacagcacacaguaaguaagcccugcacugacuccucaguccccacagccacggccugcuggccucacacugaggcuauggccaugcuucuggcugcacccaguacucugagacucugcucccaacaccgagcuuugcuuauaaugugugcacucagcaguuacacacuggauuucuuaccacgagcuaucucaagaggacucaggaaggagagcgacucccucagcgccugagugcuuuguuugccugauagaacuucacugagcaccaggcucuugucuuucuagccucuuguucuucuaagguuuugugaguccauuuccugugcaggguguggugauucgagugugagcacaggugccugagggaggagccagcggugugagaucccgagagcuagggggcuggggugcaagagcagugugcacucuuuagccacuguccacccaugucuucauggccaugauucucaugaaacaguacacaguuuucucuuuucauuugucuuuuccucuagacuccaggucgaugcaguguuugugcaagauguguuaugcacuacugugaggagauggagacauggggguggggcacagaggagacagugaaacucccguccuuugggguuuggggacaagaggaaagaaagggucagaucccaggaggcauagcaugcaaguucaggacagcaccuuuuuuaaaagagcauuguguucuccauuuccagagggggcaccaugggucccaguacagaccugugcugggagaggcuggguuccaccuguaaagagacucucuucuaaggaucacuggucaguaaaaaaaacuauagcccaugagcugaggccgaaaauaggagcucagauaccuggcaggaauagagacuucugggaaauaaaaacaugggagaccccacccccccgaaaacugagaaaacagauguuugaagacaaggagggaaaccgaccaugcagcugaacucuggcugcaauaaaggggguaauaaguuaaaagcaaggcaaagcuuuguggccuaagcauuuauuaauaaauagucuaagagucauuauugcugggaauuaagugaaaaacuagauuuuauacauggugccaauguagagaauauaauccaaaccuuuuaauuucauauucaguuauuaggagucaauauuuaaggggauuagauguucaggaauaaaauggauauuuacaucugccugguggaggcgaugaguuaaggggaggccauaggaggcugaguguuagcagccagagaggagcagaggcuacacugacuccccagaaguggagccuuaggccacucauuucugaacuccauuuccauggagggugggauauaauccugccuuuugccauaggugcuaugagguuuaaauuugcuaaaaaguuccuuguaaaaaguugguguacaccuuuaaucuaaugcucaggaggcagagaagcgggugaaucucugaguacaaaacuauacucaucuacgucgugaauuucaggccaaccagggcuacuuagggagacucggaugacgcugccugaguccagucccugggacccaaguagcagaaggaaagcguugaguccugaagguuccucugcaucuacacacaugcuguggugugugcgcaaugcaucauuucaaacacugauacaggguacugaaccccaguaguguuccuuauaaacucuugaacaaagacacgcguacaguuaaucacucucugugcucuucugaaaagagaaagugaguuagaauagaagagacagccaggaagcuggugugguggggcucgagggaagccaagggagguccgcaagccugugggucuccauagugaguucuguacagauccugucucagagagaagaguggcugggcuggggaugaaccaggaaggccauuucuguaccugugacugcaggggucagccucuguucuguguggcucaugagcccagaccucacagugggcuguuuccaugagcagaguccuucccgauaaccaugggccugaggauggucagggugaggagugucucagaccuagaguagcagaugagacaauugccggucccuccugugauacagaggugaggaucaggcugacaagcacaguggaaggcagaguguguggggagacugugggccauagugaaggagagaggucagagucuggauccccauguaguugguaaugugccacagaaaauacuuaagcccauagauccuaggccugcuaguaccucagcauccugcccggcaggccagcgugagggugaacauggugcggaaugccagaguaggcgcugauaggacuggaggcugcacugcuagaccgcaucccugggcucccgccacaagacuccagacugcccuagaguuuacaugugugauucaggaggcuuuagcaagugacauccggggccaaacugugacgggcagaggaaaaagucaaaacccagggugccguacccauguaccuacaccagccaggcaggcagaccauuuccuguggaccugcuguguuauucagcagcuuguguuuagaaaugcugcugcaagagccaggcagauguuauaaucccagcacuagggaguggagacagaccagcguggccuguguauuaagaucuugucuaaugaaaagaguaaauugaauugaaaucuggguuagaaucaucagcaaaagccauaauuaauaaucaguguaauaaaaucuuagguuuuagcccucgguccaaguggcuguuagaugccugcugugucuucaacucucaccucaacagcuaaccagccucuguacugacaucaucugguuugcuuuuacagaaaaccguugauugccuguguggagaaacagcuguuaggagaacauuugacagcaauucuacagaaagguagguuuccccaaucaugagugauuuuacagugaguuuuaaccuuuaacuugugaaacccugugagcauuauauauaacuucacaaauggucaauuguauaggacaaacuauugugacauguguuuauuaaguauguuagcccucaaaggaauucauaguuaaaugauacgacugggaucaaaggugggcaccaccacacuugccuuguaacuugcuuggauuuuguauuuuuuaacuaaacauuaaagaacuuugcuggcugggcacugguggcacacaccuucaguccuaacacuuggaaggcagauggaucucuugaguuugagaccagccuggucuacagagugaguuucagaacagccagagcuauuacacagagaaacauuaucuuggcgaaagcaaacuguaggcuggugauuuucagcccugcuuggcuaaacaaccuuggaagguuuuucuuuugugaaguaauuguuccucguagagaguaccaucauauagaauacauaugugcagcaugucagugcaugauacagugugugcugauuauaguucagccaucaguaucuccaguaucagugccucaugccauuuccucauuugccaccuucagucuccucuguucuaguucuucauaaacuguacacuagguuaccaugagcauacguagaaaucuaggcucuucccagagggagauuuaacuggagagagcuaggacuuagaucgguagauagcucuggugucuugagaagaacugugggaggaacucaaguuugucuuuagagggcauuacaccacuuuguacauaacauuaaagccauagcccacccacuuccuaugcucuguacuuguuggguuuuguguccauugguuuagugguuuuuuuuuuaauuuuuuauuuauuuauuauauguaaguacacuguagcugucuucagacacuccagaagagagcgucagaucuuguuacagaugguugugagccaccaugugguugcugggauuugaacucuggaccuucggaagaacagucuaguacucuuacccacugagccaucucaccagccccgguuuaguguuuuuuguuguauuuucacagcgauuguacaccuccagaaauuauaaugaacacagccacucuuuuguaacacuuggauaccaauguaacuuguuaaaacuuaauuguucuugucaccauucacuguuuaaggucguauggcugugauugaugggaacuguggcugugaugggaacuguggcuccuccuuccuugugcucugaguaucuggagauucagcucuaaggcagugccacuccugcuaguggcugggagacucugcuuugccaggcacucgugcuggucucugugagacacguggaagcaggaccaccauacaguagccaaguaaaccaggacaggaggaagacugugucaggccucugccgccauggucugccuucauggacagcaguccugugaggcuaccauuccacuuugcauguagaagaccaaggccacauagccgugcugccuaagcacuguaguuugugucccagucugcauggauggguuucccaguaaaccacacacaaaccuacccaagugcacauucacacucagugcucuuuucauuuaacuaagagcagaugcauucagaacuuggguugggugcuuuuacaaagucagaauuagaggacaggugugauaagacagcuguuaaucccagcaccggacagagacagguggaucucugugaaucugaggccagcccgauuugcauagcaaguucuaggacagugaggacuauauaaagaaacauuaucuuuuaaaaaaauaaaaauaagagacaguuggccagcaaaguaucaggguugaggaagauguuugcuaccaagcuugguagaaucaaguucaggucuuaaaaggagagucauuuccuacaguuuaucuuugacuucuaugcaugcauuuauacagauguaauuuuuuaaaauuuuucuuuaaggaguauauccuuaguggaacauauccuaagaauaacaggauauaaaaauaaucuaaggcugggauaagcucagugauauggcgcucacuuagcacgggguguaugcaacacagucaaagguagaauauguauuuagucugugugaggccugggaccaagcaacacaaggaaaaagacaagaauuccuaaaauuauuuuagaaauaauauuagcuaagcauaguggugcaucccagcacacaggaggcagaaucagacagaucuuagugaaauggaggccagccuggucaauauagugaguuuuagguuagccaagaauacaaugugaaaacuugccuuuaaaaagauuaaaaagggggcuggagagauggcucagcggucaugagcacugacugcucuuccagagguccugaguucaauuccaagcaaccacaugguggcucacaaccaucucuaaugggauccgauacccucuucuguugcaucugaagacaccuacaauguacucauauaaguuaaauaaaucuuuuuuaaaaaagauuuuuuaaaaaugcauuuaauaguuuuguccacucaaaaucugguaacaaugcccagugugcuaguaugaguaccuguaaugggcacagcauggcuuguagguaacugucuccacuaaggaaacuggagagcuguuuggagaaugcauaauugcagauguaggacaggaaggacagaaggaagccucagcauucuagggacauuguuucuaaggucucuggggucacccaaguggccuuagagccaucagcaagcucuuacuaagagaaccgggcguggacuggcgagaugguccugaguucaaauuccagcaaccacacaauagcucacaaccaccuguaaagggaucggacucccucuucugguacaucugaagacaacuacaguguacuuguaauauuaauaauaauauaauauaauauuuauaacaauaaaucuuuggacuggagcaagugaggccgaccagaacaagugcagagguugaccaaagcauccuaaaaauucaauucucagcaaccacaugaaggcucacaaccauauguacagcugcaguguauucacauacauaaaauaaauaaaucuuuuaaaaaaagacgacgacaaggcguaacccuacagcaauacagcacaaugacugaaauucauuuuguguucuuaacaucugggaguucaaaauggcacagaaaagaauuauuauuauuauuauuuuaaagauuuauuuauuauuauauguaaguacacuguagcugucuucagacacaccagaagagggagucagaucuuguuacagaugguugugagcuaccaugugguugcugggauuugaacucuggaccuucagaagagcagucgggugcucuuacccacugagccaucucaccagccccagaaaagaauuauuaaaaauuaaaaugaauaauuauaagacuaaagaguuggcuggagcgguggugcacacagugguuacagcuguugugagcgcacacaggaccagagcucacugagcucacacgugguagacaacucacacccaccguaacagacuguagagcauucaggacuccugucugccuucugaaggcauucagucucauuugagcacacacacacacacucacacucacacauugucacaguauauaauuuacuaaauucuugugagaaaauaguaaacuguguuuguaaaacuuuauucuaaauguuauuacggggcucuggaggagucuuaggagcacaugcuggccaugcaugcauuaggaccuaaauuuggauucccagaguccacauuaagaagccaccuguaaccacagcacugggauggcagagacaagaggagcucuacugccagccagucugcugcgucgguaagauccagaguugggggagagucugucugacauuuaaaaagcaagcacagcacagcugaaggauggcugagggaaacaucaccucaggcucuggaucccggugaacaugcguacacaguuauacacacaccuacagauguaugcgcaaacacacgagcacguguguacacaguuauacacacaccuacagauguaugcgcaaacacacgagcacguguguacacaguuauacacacaccuacagauguaugcgcaaacacacgagcacguguauacacaguuauauuagaaaaaaaguuucaaaaaguaaaaggcccuuaaaaauguuaggacauuauuuaggacuucuaggagauaaaauuguacaaaaguuaaagcuuauuugcauguuugguucagaaguaguuuggaagcgucaagcaucuagaccuagcuuagcaccugugugugcagacacugcccagugggggaaggcuuguuuguuuguuuguuuguuuguuuggagaaaucuuuuuuguuaauuuguauuuuuguuuuuccgagacaggguuucucuguguagcccugcuguccuggaacucacucuguagaccaggcuggccucgaacucagaaauccgccugccucugccucccaagugcugggauuaaaggcgugcgcagccaccgcccagcuugaagacuggcgucuuaagugccuugagcaccuaggucuacaaccggacucucugaugcccucuucuggccucuguaggcacugcauaaauauuugcaugcuuagaugacaugaaauaaaaucauaaaacguaaauaacugauuaaaaauucuaaaaugccauauugaauacaugaaauauuggauaaauacuuauuugucuuauaauuuauuaugugaaucaaauuaaucaacuaaaaaccuaaaguugacucaauuucaauuuagauuuaugcaucugaguguuuagccugcauguauguaugugcaccacauguaugcagugcccacagugaucagaagaguaucauaucuccuagaacuagaguuagagauacuugugagucaccaugugggugcuggaaaccaaaccuagguccacaaggauagcaaaugcuuuuaacugcugaacuaucucuccagccucugaaauagucuuuuaaggaauguuuuucugacugauagacaaagccucagauaauuuacaccaugaacuucucauaguaaaacacuugucuaaauguuuuuuggcucauuaccuuugugagaucagggcuuuagugaaaugagaaguaaacagggcauucccgaugcacucaggagggcggggcucgccuccaagucugcaagccacauccuuacuauguggugacacuguccuggugacacuugugagggcuugccuuccugcugugacuugucuuaugcaucccacuaggccuagagcaccugcuggaugagaacagggugcccgaccucacccagauguaccagcucuucagccgggugaaaggagggcagcaugcgcugcugcagcacuggagcgaguacaucaagguacacgcaugcuggccuucccuccaccgugcaguggccaccugcaguacaauaguaacagcuuccugucguucucgcacaugcucacucagucacacauucacuggcucaucugcucccugugaacuaguacauacuuuggucuagcaguccggucugccuccugcugugugucccucacuugccaguauaguagcaccauucagcaucuuugaggacagucgccuggggcugauccaggaccucugaaugccaggcaccaccugcuuaaggggauacuagagcuauccauagucauguccacaugcagaguggaaaaaaaugggugacaccauguugugagacagcaaaagacacacuuugcuucuuaagccuggugcugacuuaguuguuucuuguuucuguagaccuuuggaacaaccauugucaucaauccugagaaagacaaagacaugguccaagaccugcuggacuuuaaggacaaaguggaccacgugguggaggugugcuuccagaggaacgagcgcuucaucaaccugaugaaggaguccuucgagacguucaucaacaagagaccaaacaagccugcagagcucauugguaucaaaacagccccagccaccucucauguuuuacauuuaggcaaauacacugacacuacucauguguguuccugcucaagugggacucagagggcuugcaggagcccgugccccaugaagucauauggccugaacucagcuuggcagcaggcaccuuuacccacugagccaccaugcuggccucuuagguacuucauaaacagaagaaugccagguguaggcacgugucuuuacuugagcacucuuuggguggagggcagguggaucucugugaacuccaggcuagccuuaucuacauagcaaguucccgaccauacaugguagggccuugucucaaaaaagaaaauggcuggaggugguggcgcacgccuuuaaucccagcacucgggaggcagaggcaggcagauuucugaguuugaggccagccuggucuacagagugaguucuaggacagccaaaguacacagagaaacccugucucgaaaaacaaacaaacaaaaaaacaaacaaaaacacucaaaaaagaaagaaagaagaagaagaagaagaaccuccaauauucuuccagaucgcgugcuugaggagauucaagccuuguuagaauacucaggaagcucacuugucagacaggaugagaggguugguaagccagguuguggaagggcucuagaacuaacugccuuuaaaggucagugcugcucccuguccugagcagacccccaagcagguguauucagggaggccacugcuccaacugcugcugugucuacuuacuucuugucauacuugaaacgaacccccagaccccaucccccaguuaggaaaaguaucacugcauuucuagaagggcagaaagugacaugugauccuaguacuggggaaggacagacagacagacagacagaucucagaagcucacugcagcugaccuaccccuaucggugagcuucagauucaguggcagaccgugucucagaaaauaagauagagaauugguugagaaaaugucccaagaccuacccuggcaucuacaaccacacaaucuauauccauauauagauauagauagauacaucacuuuuuuuaaaaaaaggaagagaacuaauaaagagccagagaaagccaucggcaguuuaaccagacuggugcuuccauggaggcuaacaacccaggggagugugggccucgggaagccaugggcucugcucucucagccgugacuguuuccacuaucaagggugacuguuuccucagaagcgagaggccucgagugcucaccucauccuugagaccugagaccucaaggagaguucccugagaaagucaacuacaguucuuacagcagauuuuaaaaggguccguucuggugccuguggcaauguguccuaaaacccauguaugaaaucuaggguuagaaaagaaagccugcuuuuuaacacacuugggggggggggggaggcagcuggagagaugccucaguuuaccucacugcuacucuggauucccauagaccuggauucuguccucuaaaggcaccaagcgcauacaugguacaucacaugcauggugacauggcuggagagauggguugggagcaccugucgcucuuccagagcucagcuuccagccggcagcuguuuauaacgaagcuucagaggguccagugccugcucuucccuggcuccugcugggacuggcagagaaauuaacccauacacaugaauaaaauucaucuuuaaauauaaaaaaaauuaaaacucaaucugagaccauuuuuuuaaaaauuauuuuacucugugaauuuguuaaaguucuggaaagaugcauucucauuaccuugagacaacuugucuuuaaaaggcaguuugcuuccuggagcacuaaaaggagcuggugggagggguucuugugugguuuucucuguugcugugauggggucagcacccaaggccuguguguccaguugucuccucugcucuggucccacagcccuuuucugauuggaacucuugcucuuccagccaagcacguggacucaaaguuacgggccggcaacaaagaagccacagaugaggaacuggagaggauccuggacaagaucaugauucucuuccguuucauccauggugaggaaggaggggcuguggggccagacgagccugcaaaccugcauucagagggaaaaaugguccccgaacacggaaguaguacucaaggagauuuuuguccauggaguguagcagguaaaccaggaaucucucucaggucuugguuuuccuguuugcacagguaaagaugucuuugaagcguuuuauaagaaagacuuagcaaaaaggcugcugguggggaagagcgcgucgguggacgcggagaaguccaugcugucgaagcucaagcacggugagcucagggugggccguccccagggccgcgggcgggcgggcgggcgggccccaugcccgcuccaucucaccccuccuucacauacgcagagugcggagcugcguuuaccagcaaacuggagggcauguucaaggacauggagcucuccaaagacaucaugguucacuucaagcaggugagcucggugggucugagucguuacaauaacaccggaucacacuggagcaugcgacacuguguuguaaaaauuauacgauuuccaggccagggaugaggggggcacacguuuaaucccagugcuugugaggcugaggcagagacagacagauggaucucuuaguuuaaaagccagccuguuuucuacauagcaaguugcagggcagccagagauacauagagagauauugucucaaaaauauauauauauauguauguauguguguguguauauaugugugugcgugcacacacacacaauuacacacacguaucauuucuucuugagugcacuguggaucuguuuacugacuuggcucucucuguuuuuagcauaugcagaaccagagugcgccaggccccauugaccucacggugaacauacucaccaugggcuacuggcccacguacacacccauggaagugcaccucccuccagaggugagugcucagcugcugaucaagcccacuuaggccagaucuuaccuuagugcugggagagaaagguuuucaaggcacccccuccuucuguagccugggaagugguguuugaaaauggccucuucagucccagugagaggcgcccuccccagagccugcgugcucuucucuccaucagcagcaccuguguaaguggcagcucaccuggcugauccuugcuucccagagcaagguggugaugagucuuggucaugguguguuuagggucuuauguauuggcugugauuugaaguauuaugaagaaccugaagugggccauggagccgugggcucagugaggcuaaaauccaaaugccuaaagcaucagugaugccaagagaaggaggagcaggauaggccuccuggucagcgauucuauccuaaucaugagcagaggcucuggaacugcagggccagagcaacaagaguaaggcugggcccugcagcucuuucuggugggaccuggucaccacucccugcugaaacucuuuaguucuaagacugguugcucgauuuccuuguuuggcccucacuggucucuguagccuucuguuuguugcaucucuguccuaaccuuccucacaacacagagaccggcuugcagcucagcaagcagcuugcaugucugcuuuucccuuggcuggacauggugcccugugcuuccaucuugcacucacugaaccugacuagagugguuccucccacucccugagugcugccugcaccaccauuugccagaggccucagguuuauuuuguuugagguagguuugcgccauguugccucuguccugguagcuaugcuugguccuguccucugagaauccucucuccuacccagugagccucucaggacccugugcuguuuucauuuguucuauaauguccaaacauauccaaagugugcaggguaauuccuaggaugccgguguuuggcccuggcuguggagauggcgucuccuuccugcucugugaacucagugaugcccuugcccucacugccucaguacaggccacccaggauuauucccccagucccucaggucaggagcuacucacugauacaagcccuucagccaagcucugccagcuggcugcaguacgucuccauggcugcaugguuaaucugaguggccugaggaccagcauagacuagugaggccugccucgcucggcaugugucugugagaggagugugucaggagacccugcccucccugagucgguugauggauucagauggugaugacugaagaugguugugggauugugggaauccguggaguuggugguguggccccuguacacuggcucugcucccuuugcuucacuucuguuuccuggccacugggaggggagcgacacagccuuacugugccacaccuucccuccagggcccuuccaccuugccaugggccuaaaaguggugauagcacccaacucuggacugaaaccgacccaaagugcacauuccuuuccagcuguuguucucagguauuugucacagcaaugaccacugacccgcugcuguggcacccacuccccagggcacgcaggcaggaccucaucucagccucugggucuguguuccacagagcuguugaggaccgugcucaucugccgccugagaugaucccugucgaaucggccuuacugugaugaauggguugguuguccaguuccaucuguuuagaagcuaacauucugcucuagggaagaacgcucucucuacuugguauaucuguguguaggucugucacugaacucacaugguggguucuuagugacuuauuugaugcccacaccauccagagcuugcggcgggcucccuaggccuuuuccauauccucauugucuguggggacguuuuuguuuuguagcaggucuuagagccuuaccuaauacuguauuuuuuucaacugugacaaaauacaccuucacauagaauuuuccaucuuagagauagaagcccuguccccucagguggccuaacccugucuccuccccaugggcagcagccacugucugcuuucuguuugacuugccccugauguccguguucggagcucacacgugauauguacaucgaugaguuccuugugcuaccguguguggugcugccguguuccucuuuaacucuguggacagacacuuggcucagccauucacugaauggugggccuucagggucuuucugccuuggacugucacgaugugucuaugaagauggguaugaaccccguggucacuucuggacagguagcugaaacagaucuuccuggccuuaguugcugagcagugaggaucgaucagcuccucggcucucgugcuccuuucuuagcauccugcaguaggcgagagguggugccugccugauguaggcaguacuuccugaggaugaugcuaagcaucuuuuuaaaguauuuuuuuauuuaauauauauuacugcucuguuuucagacacaccacaagagggaaucagaugccacuaaagauaguuguaaaccaccauguaugugcugggaauugaacucaggaccucuggaaaagcagucagugcucuuaaccacugagccaucucuccagccuuagcccuauuaggcaucuuuucguguguguauguuggccaagcugucuugucaaagcccucuucugaguugucuuuuguuguuuuaagcaucuucacauguuccagacucuugacucuuaccagaguauggauguaaucuacagauacuuucucugugagcucucuuugacuuucuugaaagcauccaucuuaguuuauuuucuguugcugcaacagaauuccugagacugauaauuuaguucucaagucugggaagggcaaggucuaaaggcuaccugugauaagggggucaaguagaguaaggguucaggaaagacugccagccaagacgcugguggcugcuaacccacgcgcacucccuuggugcccuuugaaguaagucauuggcaguaggugcucugcauucacccgugcauguccgggcuagccuucugucccuggcaguaggugcucuguaugcaccugugcauguccgggcuagccuucugucccuagcaguaggugaaagaaaccacuuagagcugugaggguuccuuuguucucagucucagagauuguagcccaagcuacucaaggaaacccugugcugaagaagaaaacaaacaaacaaacaaagcucucugucacugucagggugugcugaugucuccuguaugucuguugcuuggcagauggucagacuucaggaaguauucaagacguucuaccugggcaagcacagugggcggaagcugcaauggcagacaacgcugggacacgccgugcugaaggcggacuuuaaggaggucaggucuugguccaggguccuguuucuuccuuucuggcagaauguuaggagaaugcucagauugucauugaacuuccauagcaaugaaaggcaagauuuuuuucaguaugauucagcaguagcuuuucuuggucaauuaaaauaacaaguaaaggguuaauauuccacuuaacaaaaaucaauaguaaauuaaucaauagcaaauuguuugccaggguuggggaaugaaucaguagauaaaguguccuugcugcacagccagcaggccugaguucagacccuccucacccauguaaaagccaggugugguugucagcaggaugcuucgguuggcaaagucaccuggcaccaagccuggcagccagauuuugauuccucaggacccacaugguugucuucugacccccauaaaugcacaugacaggcacaccugcacauacaaaugaacaaauaaauacuauuacuuaaaacuuugguaauagucaagcauggcugugcucacaucuaaccugagcaguuggggugcaaaguuaugaggggaucacagggcuuuugucagccucacugaaaaagugagugacccgaucucaagagaagacagaaagccgcagagcaggauacuaagcaccuccucuggccuccaugugugcacagcagcacaguuacacaccacacgugcagucgcuuagagagcagcagguguaaaggccacuacaaaagcaaggugugugugccuauguguaugugugccucugugugcacaugugcgugccccuaggagaccagaaacaggccaaauacccugaaacucacugcagacaguugugaaccaccugauguggguguuagucccuacaagagcagcaggcuccucugcuccagcuugccuccccacuucucucuuccuuucuuucuguuagcuguuuuaucuuccuucuggugaaaagugccaagccaaggaaaaaguuuugucaugugccaagaaaucaaaaggagaaucuuuuaagacuuccacauacucucuucuaagucacuucaauuagaggugggcaggaguccuuccuaagacauuuucacagauuaccagaucagaaagcucaccacagggcuguuguagcgauuacauaaaaggagcacacacaggugcacuaggaggugaaagaggcaugucaccaagucaccaagcaguggguggggaaaggcccaugcucacaucucagucuaaugugagcauaaaucauguauguauaggagcacacccagagcucccacccauacauuguaucacuucauagguaccacagaaacauucuuaugcaaggcauuagcaaaguugaguugugccacuugugugugucuggcuguaguuaggagcugaccucugcagacagcagacagacagccccugaaauacagaagagggcugggguccaacaaaaggcgccuggcacugcuguucucccaaaucgccuuccuacccuucuccauacagaacugcuagaucucauguuacugacugugcacugggacauucuagauaaggaaagaggaccauggaacauccuuggcagagucugcccucacagaguagcugagcagaggucacacggcgcucacugugcacuugcucuuugucugaacaaaguacuggaagcacugcaggccuuccuuuccccucucacccaaacucccugugcuccuccuaagccucugggguuuccacugccacccagagccucagaaagccaugugugauggugcguguucaugaacccagcacuccagacaggcagaaggauagaaaguucaaggccauccugggauuuuacagcaagccguugucuuaaaaacaguaacagcagcaaacaacuaggccugaugucugggaaguaaugucaauaugcaaggagaaauaugcaagguccucagcugccuggaccccagccucagccucccacugcuggcugcuggcuugcaggccuguguggccaugggcagcuccaagacaggaauuuaaguguaacacccaauaaucauuccuuucuuuuauaucaauagcaugauuucuucucacuugguggcugaauccccuaaaaaauaaugcaugcaaaaccauccuguuugacuuguaaagugucugagcucagcucugugacggcuucauucucuuaaaggggaagaaggaguuccagguaucccucuuccagacgcuggugcugcucauguucaacgaaggggauggauuuagcuuugaagaaauaaaaauggccacuggcauagguaggaagaccccacaugacauuuguuuguuuguuuguuuguuuguuuguuuguuuguuagcuaugucaccuuggcuaucauggaacucagagaucaaccuucuuuugccuccaguuugcugggauuaaggugugcaccccacacuggcacuuauuucuaccguguugacuuaacagacagaguagaggcuggaagugugcuuggcugcagagugcuugucuggcacgcacaguacccuggucccauccacagcacuaggaaaagaguuuaagagaagcuguaggcugugacacauccauggcuucucuccuggcugagccucguguguguucuguaacguuugucuccuuugccucccucagaggacagugaguugcgaagaacacuacagucucuggccugugguaaagcacggguccuaauuaaaagucccaaaggaaaggagguggaagauggagauaaguucaucuucaaugcagacuucaaacacaaguuguucagaauaaagaucaaucaaauccagaugaaggagaccguaagugcuagccucuuguuuuauucauguggucuugccaagaguccuuagcaaugucaugaccauuacaggucagagcauaugucugaaucugguacaaguguagacuuuggaguaguguccuuuuauguaucuuuaauugauuuuaugugaucaguugaaguaaaagucaagaaaccuguuggaacucauacccuccuauaucaaaugccagaacagaagcagcucauagaauuuccagaaguagugccugcccucugcugggccuuggaaggaugaggaggucuacuacagacccuacagaccucagaagcagcaguuccagugggagcgggcucucagugucccacagcucgacaagcuuaugagcacagcugucagcccuucugaccugaagcugacacacaccuggguucuacugccuuccuagaaauguuuccucaaguguguaugagacaaacuguagaugggagaacagauuuacagaacaagucauuaccugguugaugucgcaggcugccccucccacagacagacagugauggugucacuuguccugaggcuuucgguuugcugcacagaaaguguccucagaauacgcacuaguauggucugaggaggcagagggagcuuuccaccaucagaagcaauuucagaggacuugauuuugguugccaguauggacacgguggcuuacaaccauccugugcugcuaggaagcccugauauaagcauucuuauaagaaaaauacauuuuuuuuuaaagauuuauuuauuuauuauauguaaguucacuguagcugucuucagacacuccaguagagggcaucagaucuuguuacagaugguugugagccaccaugugguugcugggauuugaacuccggaccuuuggaagagcagucgggugcucuuacccacugagccaucucaccagcccaaaaauacaacuuuuaaaaucacuuuuccaaguuaguuuuagaguuguauaccuuggaaaaguuaagagcuuucauggaacaaauuaaaacauaacaaagcagaacaaagccugccuuagucugcaucaaaccaaguuugucaaugcaaagcaguccugaagcaucugugcccuccuucuguucuccuuucucauuguucagguugaagaacagguuagcacuacagagagaguauuccaggauagacaguaccagaucgacgcugcuauagucagaauaaugaaaaugaggaagacacuuggucauaaucuucuaguuucugaauuauacaaucagcugaaauuuccagugaaggugaguauugugggcacagcugggggucagggugaguaccgugggcacagcugggugucggggugagugccgugggcacagcugggggucagggugaguaccgugggcacaaaugggggucagggugaguacugugggcacaaaucggggucagggugagugcugugggcacagcugggugucggggugagugcuguggacacagcucgguguuaugugcuguauucauccccaacauguuagaaucucaguguccuggcauuugacuuauuugacagggcugguaugagcagaggccagcacacaugagggagggcaagggcccugugcacaucuuccuaaagacucauugcuucuccaugcuguguuuucaggagggagcagaggccacagccacaagauguuagaacacauguucuucccucaccauaguucuuaaggcuacuacccaggcaggcccuuguggcagugguguugguaggugcuagauucagcauucacaaacuaaguagcauuuccugcuuuggagauguaagucacccucuuucuuuuaguucuagaacuaagcgcugagguucuauagcaugugaaauacaggaugagcuggaggagcguuggaaaaauacauuauaaaaugcagucuaaaaugcauuaucagcucagaaggaauugaauucucaggaccugcauccuucagcaacuggaaguccccugguugcaugacaccugagucacacugagacagacagauuagucaguaccucaagcauaggugaggccagugccuggccgcugcccugcccugcccugcccuccaugaugauggaugcacagcccaugcuguacugcgauguuuccuaccccaagucagggcaucuguuugucaguuugcaaauguuguaaccugguaauuaaguguagagugucaugugcaaaugggcaaagcucuagcucccaugcuuuauagcuaauuguauggucagccauaucuuguaacaggcaugggcugcccaugaagagaaggguuugcuguuugggaaaggaugcucccucagcagaaggccccugcuuccaagucugagugcucugcuuccuccugcagcagaagugauggcagagacauucuaaggcuguggacuuggccuugguuuuagucauccgcacagagacugaguucuuugacuggguauagcgguauacaccuuuaauucuggcacucaggggaagaggcaggcagaccuccgugaauuuggguccagccugguguacauagggaguuccaagacagcuaggacuacaaggauagaucuugucucacaaaagaaaacaacaaaggcagggcugguauauguggcugguccccugcuuucuauccacauggcaagucaaagcagugagaacaggcucuguaguaagaccuacauagugacaaugacacuuuugcaguaacuuagaaaaacacucagaauguguggcuguacugugaugugccauaucugguaagcauggacugacuaggaggcugagcacauagaaaaagugcuucacacgagugaauggcuagagaugguguauaccuauaaccuuuaccucagggaggcugauacaggaggauugcugcaaguuugaauccaaccugggcuacuuagugaguucauggacaauagcucagacucugagcaggagcagcacgagggcccugaggguaaggcagguaaggcaccugauagcaaagccugauagcccaagcucagucacugagacccagaggaggaaggagggaaccaaguccuacgguuggucuaugccaugugcccacgcucuuacacacaaaaggaagaguaugaauauauaauagcagcaaaguaagaaugccccagcaaagcaugaucagauuuuccuucuaaauaugugagagcaugcaacauagagucuguuugcaugcucaugugaggagaagccagggguuguguguguguguguguguguguacacgucuguuguagcauugcauauuuuuguuacauguuccauacagaauguugggucuguguuucuagguucagugcccuauccuaaaaugucugauuucucuuuucuagccuggagauuugaaaaaaaggauugagucacuuauagacagagacuauauggaacgagacaaagacaguccaaaucaguaccacuacguggcaugacgcaccagcugacugucgucucccagugagacacacacacgaagcaccugagagugaagcugcugugccgucuccaggucccugcagcugccccgacuguggacgcuuggauucggagcagaggaugugguucuuggcucauccuucccagggcgcaagggcuuugagaugacacccaucuucccucccugcuucuuccccuacuucuuuauuguuucuguuacucucuaacuucgcauugagaaguuccuucacaagcucucguuccucuggcagaaagccacgggcuugguuuguugugugugugauugugggacacaguggaauuacccuagcugcuguguucuuccccucaugaagacucagagagaaagagagagcccugggcuggggcacuggggagaaacuguccaggcugccacucggaucucugcacccugagcauuggccucucuucuguguauuuucagaaaguuggaaacuuuggcuucuguaaaucagguuucuaaaugaggucccugaugugccaagaggacaucaugucugucaugagacacagcucacccagagggcugcuugucguuuguugaggggcuuggggguuucauguuuguuuccaugcugguugaguguggagguccugguuuuggcuuuggggugacugcuguuugacuguugaaguugcaguuugugugauuaccauaauaaaaucgggccugguuuuauagucuugcacagagaccgucuuggaucucugcccuggcacuauauggaguuuaguuauguuugucaaaaggcaaaggaauuguugguuccuggagacauacuguguguacagguggguugggcagcgagaacgaggcuccauagugguguuggcauggugaugaugacagacacuuuugcaacauuuaaaaguacuuuauauuuuacaaaguagcauguuucauuuugauuaaaagcuaccaaaggaauuuugaucauguauaaguguuuaaagcaauauuuucuggaauauaccaaguuuauauaacucgauuuuaugcuaaauuauuaaaggauucucccuuuuugaaacaugcauguuuaagauacaacaucuuuuugggcccccauauuaaaacccuuucucuuuaaguaucauuucuauauuuguacauuuucauuuaugaguucuaugauguggucucugaaagaccaaauagauuucuauuucuacuucuuauuuuuaaguucauugugucuacaaauuguuaauauuguaauuuaauguagacuuacuuugaauaaaacuaguuuaauuggccuuuaaauuacuuuacuaauacauuggcuauguagaugacacucuccuccugacggcucagcagcuuuugacagguagcaaaucagacaaaagaaaggaacccggucacccucacaggacugccccuucucuuuccuccacuacaggcacaaguuaagugagccaucagccaaucguaaggaccuuucacucuccucguuucugcccagucucucacucaccaacauuguucagagucuucucagagugaaaguuaauguggaacaacacagagaaaauaauggcaaacaaaaagggcagcuagacacagaagcuuuaagguuggaauugagggaacuuuugccuagaaaaccuaagagagacaaaugaaaagugacacaaaauuagcagaagucug

SEQ ID NO: 4304 - RNA, 16206 nt, Mus musculus
agacagacaaagaaggagacuuuuuauuagcaucguuacaggcaaugcauuacgugagcugaugcccaguguacaacccaccuacgcugcaagacacgucagcagugugaaucuauuauuguacacagugcagagacagggccacccugaacgccaacacaagacuggaaaucacuuuacaaaaaaguaaauaaaaauaaugccauuuucuauuuaggaaaguggcagcucacggguggcagagcacagaaauauggggggguguguacccagccagaugccagaguucagcccccccaggccagguagcccaagccaaguguccagagguugacccugugcgugccuguguggcaagccuucccugcucccguuugcuucuuaagugugcagccuaaccaucagccacccuugccaggcccaagggucuggaccagagauucccuuuguaaggcuuaaaucugaguaaaagaaugaagaaccaaacaccaagucuuaaaagucaaaucaguggagccuucucauccucuuuagagcucuacuuugguaacauauuaacauuuaaccaguuagcaaaauauuuaacccaguuagcaaaauuaacaccgucauuucaauaguuauuccuuugugcauaguaaauguugcaagaugaacuucacauuugauaaagcagauuuuaaaacaguuugccagaaagugugccucccuuccacaccuaucuaagcuuggggaugugagaacaggccccugugcaucucuggugcaccugcccaccaggcuagauggucugauagccggcgugacuccucuuccugccaaugagguaggcaaugaggacgaugaggaccagcccugccagggcaccgcccacagcaauggggaucaacauguuguuaccauccugaacacacucuuccacugcaagaaagacaagccaggggauucacuccagggcacccccucaagguccaauuguuccuccccagcccaaggggaaaggaugaggccaggcuagagacuuugggacaucuauagacuauagacaugaguguuuucuaugcagcuggggaaucccagguaugcuccgcccagguuagaaugaauggugcugaccacuggaccauuggucagcuuucagaaagagccacugacugucauuuucugcaaucucuuuccucagccaggacacccuuaccucacauacccauuccugcaguuccuuccuuacaaagggaagucucaagcugggaagaaacccugucuuugcagaggaaaaggguguuugcucccugcccauauaucccugucccucaggaaguucuaugaugccucugcugccgacccccccccccccccauuacucuggaugcugccucugcuacuuaccagacccaaaccugucacuguccaccuugaaagccuggaccugcacacugaagacauugagggagagcaucuugcugacaaagauguguuccucaguguugcacuuguaugaguuucccacaguggccugaagagcuuucagugaaugguuggagaugcugaaugugggcacugcaaugggagagagagucugcucaagcacaggcuacagugggugaggagcaugggaaccgaugggaggaggaagccagucucaccuagggcaucaggaagagucauauucaagcgcacuccuugcaggaaaaacaggcuagagcuggcauucugaaagaaaaggcaaucaucagccagcacggugagcaucagugggcaacaggaccucuacauuugcagcaaaaacaaacauucugguuggcucuuuacagucuuguuuuuagguccucuggaaagagcagccagugcucccaaucuugagccaccaccccagcccccagacuuuuuguuuaauacaggcugucacuauguaguccagugaggacuuaaaacucaugguccuguuugcaccucucaguacgguacguggauuaaacaagcaccaacaugcccaacaccugagaccucuguuagcacuggguuacccaucaaaacagagacauaaggaaccauucuauuuaaaacuaccuuuagaaugguacagaaaaguuuaaaacccauuauaagaaauuauuaauaagcucauaucuguacugagcugggugugguggcgcacgccuuuaaucacaguguucuggaggcagagacagguggauuucugaguuugaagccagccuggucuacagagugaguuccgggacauccagggcuacacagagaaacccugucgugacaaaacaaaacaccaaaaaauuaugcugacugagguaugguugguugagaaacauguagaagcccuggguacagacaucagccagcacuauaaacaaagauccuucccagugucaucuacauauucuccguugcuaaguauacauguggcuuuucccaggaaacaguacaaacaggagaaggcaggcggugagaagcaggugguacaaccuggcuucaugcucugcucuuugcugcucucccaaucaccuagccuuuggaagaucuccccaaauaugagcagaauaaaugugugucaguguguauuuguuggugaaaagugaggagaauccugauugccaccacaccaaggaugugaagacccagugacuaugccccaagugacaacagacaacucagccucaccaucccaaacugcaauuccagggcucuguucuuguucuccacuuucagggucaccaaguugauaccgcaacucccacuagaugugucauuugggcugauguugaacgcucuggucaccgucugacaagaaaagcaauugaguuaucacugaggcucugaugacccccucacaucacagccaacagcacuaauggcuaauggaggagacauaaccacucuaacaagucaggaggaguccuuaaccacaccuggcagguuucugaguucccacauagugccuacuguucagaaugcugugccuugccaagauggcuuagauuggucccugggguggcuuuucuuggugucaacuugacuacaucuggaauuaacuaaaacccaaguggcugaguacauucaagagggauuuuuuuuucuuaaacaacuugagaugggaaguccuucuuaaaucuguuuuguuuguggcagccuauauaaaggacacagaaggaggaagcuugugcuuugcccgcuugcucuugcuagcaaauccauaacucuccagcaccuugucugcccacaugcugccaggcuucccaucaccauuauggacuaaaucuuggaacuguaagugaaccccaauuaaauguuuucccuuauaagagcuucugugcucaugguaucuauucacagcaaaacaaacucagauacauacacacaacaaacucagacacacacacacacacacacacacacacacacacacacacacacagauuuacuaggauagauuacauggggauggauggaucucucucccucucccucaagagaaccucgacuaacaaagccccugaugcuuuuccuaccuuuugucagccuccaugccucacuugguccuucugccucaggcauccauccuuucugaguagcuaagacuacaggugccuacaagcuuggucuggcucaacuacacacucacuagugucuccuauccccacagacacagacacuguuccugccagaggacaaacgaacaaauaauacaaaauuugaguaauaaaagcugaaggaaaaugcaaugcuucuccuaggaucaaggcacuuuuaugaggugccaaguuagcuagcaucuugggcuuucaugggcagaagguauggcacaccccacucagacaaauguagcccaggacucagagguggggcacagcccugcacaacugauacaguauauacuaaguaacagacugcagcaccacacuccuuugaugguaaaagcagccauccucccuaccuaccuuguuguccuuuuucagguaggugauauucaguugcagugccauagaggccagcaggcagguuccguuguuaccaguaacauuguacuuggauacagugggguuugugggcacaagugguggugaggggcuggguggcccagugguuggggaagguccauccugugugcagugugucucuguagggacaguagagacaguuggaagggcaguucaaaauccagcuugcuuauaacuaccucagauacuggagugcauguuagaacuagagacacccacuucugaacucugcagggcacuuuuucacccuguaucugacaggcacauggacagcagguucaagaagcagagagaggaccuagaacacucuagcccacuuguugcaucccccccccccaacauuuuucccaucuuagccuuccuucucagugagcaagcaaauaaauauacugagaccaagacaaaguuucacccugccacaagggagugagucuaggucauauauacaugaauguagcaugaauucaaguguuugcacugagcugucacaugagagacacuguuagaaacaagacagggacucuugacugucaggcccuggccaggccugccauuuauaaaaacacaugaauuaacuagagcugcauauuaucagcaagaaugugcaggagccugcugggagggaaggggagaggaacagaggggaggggaggggaggggaaaagaacggaggaagucuauuuuuauagccugcuaguaauaacuuuucagucaugguagaaucucuccuaugcuuaaguuucacauaacaaaaccucaagauuaaaaccuggauaacuggguuggagugaugggcuugauggcuaagagaguauacugugaacccgaguuaaauucccaguacccauagugggcagcuuaccauuuccuugugacagacccaagggagagccaauacuucugaccuccucaggugugugugcauccccacacagucacacacauaaugagaaccacaacaggaacagucacaacagcaaaagaggcaugaauaaucagagcaagcaagaugcucucugauuaccaacacguaauggacaaacagcgugaguccaguaaugaacauacuauauuuucaguaccugugccaggcaacucacaacugccugaaacuacaccuggagcagacccaacauugcccucuguccuguaugacaccuguccucaugcauacacucacacugcuggugaccugggaagcccagugccuaacacacgcccugccccagaacccuggugguaccuuggcguggcuauucucggccugcagcagaauuccccacagccuacuccaggcugagaacccccugacuaucucuagcaaaguaccuguucucacaaaaaaaagccagguccagcuagugcuuuacuuccucuuuuaaaaaauuccacuguauauguuuaaguguuuugccugaagcuaggcaugguggcacacaucuuuacucaaagcacuugggaggcagagguagguggaccucugaguucuagauuagccuggucuagagaguucugggacaaccagggccauccgaaaacccaaaaaguuuugccugcauguauauuucugugccucacuucuguguguaauaugugccuagugcucagggaggccagaagaggucacucuggaacuggaguuaagagagaacuggcaaucacaaccugggugguacuggugcaaacccaaguccucagaaaagcagccaguguucuuuaacugcuaagccauuucuccaguuccauuuuauuuccuuuuaaauaagauuugucaagugcccaaguuuucuuuggucugaccauuuacaggaggaggagacgugaggcuuccuuccuggucaaggccaccccugugugaccuauaagcacacgcauacacacucuuggauuuaauaaguaacaauuaucaggagagcaggagagcagacuggaagcauuauucagguguagcagguaggagguacaggacagaacugacucccaaggggugaguucccgcuccauauauaaacugcacugcaauuuuugacucugguaaucaacagaaaaggggacacugcuauaacauccuaagaucagauacagggaggucgguagaaggacucaaccaaacaaagucagcaucuuucggaagcacccauuucuucucauucugucuggcucauguguguggguuaucuuuuacucuuuguucugucaauaacaccuuugucacuagauuagaaacagaacagcuuauuuauggagcaaagagaugacuggguggguuaagagcacgugcugcuuucccagaaggcauagguuuaacuccaguacccacuggugacucacaagugucuuuaacuccagcuccaaaugaucuacuguccuuuuuggcccucauggacaccaagcaaacacacaaugcacauauaggcaaaacacacacacauuacacaaaacaaaacccucauguuuaaaauaaggaccccaccccuaccccagugccauuuguaucaugacaguauauauuucagacuacgacuauggcaacagcugggcuuggauuaggucagugcaagagcaucuguaacuaauguaaacggcuauguugccagacaugguggcacaaaccuuuaaucccaguacuugggaggcagaagcagguaaaucucuguaaguucaaagccagccuggucuauagagugaauuccagacaauaauaguuauacgauagagagacccugucucaacaaaaggggacaacuuaugaggcagcaaaucuaugccucuaggcccuggcccuuccaauuagcuuuauauguaauaaaauacuuucuuuuuaaacuuuaggugcagacuagggucaucugcugagaaaauacacacuacauccccuaaccugcaacugacuuagaacugagagaaagcaccugagguagcucucuucacagucacaccacagucuucauuaagauuacucaagaagcccgaaggaaagcuaauaaggacagguagcccagguaacccuuugacaaaccacaugaaauggacaauuucagagcugacaggauuggggccaagugacaauugggcccacuagcuugacaaacuugugcagacuaggggucacaccuccucuagagcugccugagcagucugaggacuggcuuacaggcagaguguuuugcucaccauccacaggaucacuccucuguauuccaugcaugacggagaccagauuguauuaaccaagcucuagccuccuaaucaggauguacccacucgaaccuuuaacagcagaggggcugccagauagaggaacagacuccacccacuguggacugucaccugaagccaugucacuccagcaccuuaccuuccuugcugaaguugccacucgacagguaggccuggauaguggcaucccggagcacaacggucacauucuucauguagacccggauaucacugacacaccgguaugcuuuguugaugucugccuugaugucaguuguggaauccaugguguagaucucuguaucccaaucaaucaacaaaagaaaacaaaacacaauguguucacaguaccuaaguuaagagugacugaauaccaccaucucauauucuuuuguuuguugugaagcuuaacaacaguuuuauugggaguuuaaaaagaaaaaugucaugacaggugagcuguaaaucucaggacugagagaggaagagaaaauuccaugccaugugcacaugccagcaugcagccagccacacaguggccaguggaaaagccugaguaccagagaaagcauacucaggcucuggcaagcaucuaaaagggacagaaaagacaaaaagaaagcaaugacucagaaaggcaggggacauaguggacacucguguggcucucggaaaggcaaguucuuuacccuucccuucagauuugcauuuuuuacagaagucuuaccuuugcugauggcauugggaaaauguucuguaucugacaaguuauauguaaaauacauaugcuggacacuguaacguguuguauuuuuugugaaguugagugucaguaaauauccucuuccaaaaguaauugugaggcuggggucagaaacauuuucuuuaccacaagaacugccauuuuucaguacuucugcagaggcuggcagggaaauguucacgaucuagaacaaauacaauuccaaugcaaagccaugagaagguaugcuaaggagacacugccaaagaguuaccugcacgcaaugacagaaacugagcuuccagucaaucuuaaaguagccauucacagagacucuuacuuggugcagcauccguacaaagcuacuggacuauaacucaaugcaugcaaacaaugugcaugacuucaaacgggguagucagaaguuccaucuucucagacuuucugacuauucugaaauacuaacuguggcugugguagauauggguacaguguucuaaaaaguauucaguuugacaaaccaguagacagcucacugcauucucacuacuaacagaaacaggcugacaagugaauccagugugagagaccuggcagagucaggguuaaacgugcuucccacucauugugugcacaccuuaauuccaaugugcaggaggcagaggcagaaaaacauaagcuaguaggauuucggguaugguguaucucaugauccagggaugcauuuaaaaggguaauuacauauaaugauugugugaaaugucuaacagguaauuaaaaagaaauuuaagaugcacgauacucaucuacuaguaaucuaggaacuacagaaacacaaacuugcuuuaauguaaccaccacuaagaacauauuuuuguuuguuugcuuguuuguugagacagggucucauuuugugguucuaaagcuuguagaccaagcuggccuugaauucaaaauuugccugccucugccuccuucugagugcugggauuaaaggugugugccauacgggaggcgugugccauaauaagguccagcccacuaagaacaucuuucuuaaaggggacaguccacagcacugcuccucaagccaucccuuagaauaaacaauauccugaagggaagcaaaucauaaaaaucuggagccauuuauugaacaaagcuaacuaagcagcccgggaguauuuagcaaacgugcugacuucucugauucuucaagguggcuauaaaauacucauccagaaagcguuacagucagcagcgguuugcuguggcugcagcuaccagcagacaacagcagagauuacugaugggcuagaagcucucugcacaagugacagggucagacuaaggcaggguaauuuuucagaaucccacaaugcuggugucuccuaccugagaaccauucgcagucucguagguggucagaaaggaggcagagaagcuggccauuauacacguugugccauuguuuuucaccucaaagagugcugaggcgccaugugcaaggccugcugcuuccaggagaaagagacaaucacaaaacugcuauuuguuuucucuaccuucuauuacaggcuguguccuacuccugaucccccaaaccugagggugcgcuaacucuuaauuccauaggaaaacugccaccuucaaagcuguuccgucaaccugacaaucucacccccagaguacuuacccuaggcacaugucccuuaaacaguaagaugugacggggccugagagguauaccucaaggcaagcaccaaccuacucagaacccaaggacagucugcacuggguuuucucacugugguccuaaacaaauaguuacaaucugguuuguuuuuacuucucagaccaggacuaccacagagucaugagcucagacacagugcuuagauuccaccagcacauggcugagcaauguugggcacauucucaacucauacauguugagagcugcccuauuuguggagguucuaaagauuuucuagugaauuaucuuuucaggacauuucuuuccuggcuuguuaaauauaccuaauaaagcucacaccuguaauccuaacacuggggaggcugaggcgagaggaucagcagucuuccaacccacaguacagagaagacuuauaaagucauaaacagucccacuauccuagucauuagaacaacaguacuuucagcugggcauggcaaugcacaccuuuacucccagcacucaggaggaaggcaggugucugggaauuugaggccagccuugcuuagaccacacagugagaccgcgucuccagagaaaagguagcaggggcggcacaguucuugacaacgaucaaguuuccuuacaguucacagacgaacaagccagguaccuucgcucauuccaaagccaacaacuacacagcaacaaccacacuguucacucugcugcuacaagcuuguauauagucuuccaaggauauugagacaugaaucugaggugucuacauaggaguaugaggcaggaggaucaccagaaguuccaggcuacgauauucuacucuauuuuaaaaauaaacaaaaaaauuuuagaaaauacuuccaaaacaagcagacuucaacaaacccaauuuauuucauucucacaacuuugaaaaaaaaauuuagaguaacuacuauucacacccaagagccuauccagaaaucauauauccuuucucuugugcuacgagcaaagcaaacauugaaacucauguuccaaaaguggcugcagaaggaggaagcagacugcagcucacuucagagagucccgugcuuccuaacugcucagguuccauuacagcauucccaguggaugaccaguauaaacuggaaacagagaagggcuggcaagauagcucagcaaaagcaaaaucgccaccaggccugaugacugagcucuagccgugggacuccgauguuggaaggagacaauugagaugcuuuggccuccucacauaagcccuggccagugugcccaacacauauauauacacaaauaaaauauguaacuauaaaguuuucuaaaagaguccaccguaguuuauccucaauaguggaugcaaacuucuagaaacagagugggggcugaagcaacgugucaguucuuguagaguacauagguuuaguuccagcacugacccugcagcccacaaccuucuaacuccacuuccagaggaucuaaugcuuuuuucugaccuccaagggcaacuaauacacauaaacucucccaagcacauacacauguguuuuacaaacagagcauggcuauuccacugaguuccuauugcugcgaugaaaugccaugaccaaacgcagcugggggguuauucagcuuacacuuccacaucacugcucgucacuuaagucaagacagaaaccuaguggcaagagcuguggcagaggcauggaagggugcugcuuacuggcucaauccccugcuuucuuacagaauccaggacuacuagcccagggauggcaccacccacaaugggcuagcaccuugcccaucaaucauuaauuuaaaaacuacccuacaggcuucaucuugugcaaguaguuucucaauugaggcuuccuuaucucaguuaacucuugcccgugucaagcuggccuaacacuaucaagcauaacagucaagugugguggcauacacuguaaucccagaacuagauaagccaagacaggaagacuauauaagcauuuggccaaccugauuuaaacuaucaagaucuagggcaacucauggcuacauaccaagucccuguuucagagaaaacaacugaaaauaggggucaaagauggcucuguggucaagaguauuugcuauucuucuacaagacccaaguuugagucccagcagccagauuaguuagcucacacccaccuguaacuccagcuccaggggaguccaacacccucuucuggacccugugaacaccccuuauacauacacaaaacuucuuaaaaaaaaaaaaaaaagaccaaaggcagaagaaaaggucccuguugcaggucuaaggcuuccuuguccagggacaucccaagcagaaagaccuggggucuaacuggccagcacagcagauggaugcccccugggagcacacaguccagcucugacuagacuaucuuuuuaugagugguuuugucaaacccacucucccccuaguaaacaucuagaaaacaugcagauucaaaggaaaacaaaguauuacuaaaauuugaaauaaacuuuauggcuuuuaagaacaugccuuuuucucagcucacuaguugcucccauucuguggugugucuuucucuuucuuaacaaccugucuuuaguucuacuacuuaaaaaaaauaagauggaaggaagggcugggguggagagcucagccgugaagaacacuggcugcucuuucccagggcccagguccugcaccuaccaacaacauggcagcuuacauacccagaaucucuacucuagcucacaaggauccaguuccacaagaucugaggcucucugcuggccucagugggcaccguaugcacacaguguacggacacauaugcaggcaaaacucucauaugcauaaaaugacaaaacuaaggcuuuaaaaaauaaaaggggcuaaggagauggcuuagugcuuuagaacacuugcugcagaagcccuggguuggguuuucagcauccaugauggcucaacaccauccaaaccauuuguaucuccaguuccaggggcuccaacgcccucuucugaccucuauaagcacuggcacauucaugcaggcaaagucucucucacacacaaaacacuagcuuaaagaagcuguuuaaaaggcaugcaauacuuaaauauuuuaauauaaaaagcucuuuguccccuaaucaguuaaagugccuacagcacacaugggacugagaaagagcagcugccaggagcccccaccugccugcuaaugaugcccugcucauuucucauuucuccauggucaaagggcaacgcugucucauucuuucaaaacacuacacuuguggaaauccccgucccugcuacuaguaagacagugggccacauacacgcuguuggccaagcuccgugaccuuggagccagcagcggccaccuaagcaccuugagauuacacaacugacaauggcagaagugcagagccagagaggcucgcugucagaacaccccacaagucuuccacuccaccagccuugccacuuuuguuuuggggcucucuucuuuacccaggaagugcugccuaacaaguacuugugacacuuuuacuuugugacaaguacugcucaaagcacuuuucaauuaaauuacuaugacaaccugaaaaggugguuacuauucuuccauccugcugagguggagaagcccuguuugcuggcuucagugugcgaccuacugaccacgaugcuuuuccagcacucgguuaaggaguauggguaagccagccuggguuacuuacauagugagacccugucuccaggcaaccauaccaugaauucuuuuuuuuuuuuuuuuuuuugguuuuucgagacaggguuucucuguauagcucuggcuguccuggaacucacuuuguagaccaggcuggccucgaacucagaaauccaccugccucuaccucccaagugcugggauuaaaggcgugcgccaccaagcccggcucauaccaugaauucuuuugcuugauuuaaauccaguuucuucuuaucuagggacaccuuugaacauguaaacaaauggccaaaguucuaccccacacacugaacuagcaccucuagaggcacgacucucucccugcuggcuaccuaccuuccauaaggcuggggcaagcuauguagaauguugugggagaaaagugacaaguguuucuucuucuagaaaaauccaguucaggacuacugcuguaaaccuggcacuuuaugaaagcaccaugcaaucccauaugucaggacugggggcucgaaagagagcagaggagacaggccacuccaggacaggugccacaguuuauguguccacaaaaggccagguugggcugcagagauggcuugggaguuaggagcacugacugcucuuccagaauuucugaacucaaucaccagcaacuauauggugacucacaaccaucuguaaugggauacaauguccagaggucugucugaagacagcuacaguguacucauauacacuaaaacaaacaaacaaacaaacaaaaacaaagcaaaacaaaaaagggccaggucaagauaacaauaucuaaguugggucuaacagaauaugaacucaaaauuacaagacuacugaaccgcuggaccaccaaucuagugaagaauucaaggucccacaauccaggauaacuuuaauuagacuucucauacuucuagacugaccaggcucauccagaaaggggaaggucauaggguuagcccuaacaaccgaacaguuccauuaagcaauccuacauacuaguuucaguucacacuagucuguugucuauuaagcacuuaagcagcuuggaggugauagcaauuaauguaggaacaauuaacaaucccaucguuacagagguuuuuuuuuaagauaaaauuauuuuugaagucacacaaccaagauccugucuaaguuguuaaagucccuuugugaaagcugggacaauuuauggcacaggggcacucaaucagggucacagacuuucccucuccacuuagauuuugcuuugaaacagugucucacuuuguagcccagguuggccuccgauucacagaaagucucccacauaagccugcuaagugcuuagauuacaaacucaggcugacccaaccuuaaaauuccccugccucagccuccacggucuaacaagugugagccaccacugauuaguuuaguuuauucauucauucguuuauuuauuucauuuuugcaacagggucuccgguccuggcugucuuagaacucauuauauagaccagaauggcuuguuaaagagaucguccugacacuagcucaggauuaaagguauaaaccacuaugcaagccacaagguaguuugaaaaacaugaagaggccuaaccuggcuguccuuuggauuuuaucccaaucagcauuuaggaagcagagacuacgagaaccugaaccugugaguuucaggccagcgugguggugagacaccccuccccccauuuuaaaaguauaaaacagucuaaggguuuaagucguuuuuggcugugcuggagauugaacuccagcuaguuaccaagccauucugacacaacagaacuuguuucggcaacucguauauuagcuacaacuccugaaccgugaagggucacagguccccuuagcaaggcuucuggguuaagaccgccgaguaagcgcaccucucacggaccagagaguucacacaaguagcaaaauaaaagaaaggguaaacgaauuccauaaagucacagucacagaauuugggggugugagccucugugcccaggagauuuggccagccaccucucucccguccugaagaugcuggcaccgcagcgaaacgcuccgcguugccgggauacagcggcgaggaagggcacccggcaccccaggcaggguccgaggcagcacccaguccucucacaaggcagcucagagccagcagcacugccuggcaggaacuccagcccagcuccuuccagagcggcucagacugggcucccaacccgcaccuacguccuuaggcccgcacgggcucccaggcggcgagcgccacugcggagcgggcgggccggcucgaggccuucuugacgcccgcggcuccgggcgccccguccccgcccggccugccgcucuguucccguccgucccgagacaccgaccccgcccggcccuccuucucucucccucccucucgggcucacccagcagcagcaggagcagcggccgccgggcgccgggggccgccauggcgcgacgcagccgaggccggaggacggcgguugcgcgggcggcgaggccggcgggagggcgcguccaccgacucgagaggccccgcagcugcggcgccggcacggagaggacccugcggccggcagcgccugucacgugagcagugccgcgcccgccggucacgugagccgagggucucgcgagagcccguggaccgccagcuuacuccucacuucuucgggaggcuccguuccgcacgugauguggucacgu

SEQ ID NO: 4305 - RNA, 29167 nt, Mus musculus
aggguuaaaaagguuucuguaaauauuuuauuuuccauauuuuagagucagaaagaagcauguaguaauaaaaauaauagagaauuauuuucuucacauccguucugcugcaaacugccagccccucuagcccagccccuuccagccagcucccaccaggucacguggcucucucugagcagccggugacccgacacccgucccauuauguacagauauguuacaaggcaaaaagaaagaucucaagaaaaaaaaaccacaagggcgguagcccaccugcuccaguguugcaggaccaugcgagaggagccagugcuguguguccaaacccugcuucauuuuugucuuuagguguggagcccucuugcagcucggucuaggggguggcaugcuccacaggcgggcaggagugggaggugaugucacugugcuuguacgaggccguauccagguccaggauuuucccguuuaccuccagagucaugcauccgcgguagaacgcagugacgggugcagaaaucaccgauacuucugagcagggggagggcaaacacugaaccaaaggagcuugauccugaccacacgaugcuccccacccuccauauagcugagggccagccuugcccacacucugcaggauguguguccccuuucuguuauuaucccaugggggcacagaucuuagaggcauaagacaucaucggcaucccuuaacccaucccuuaaccgcgaccccccacaccaggcaugcaugaauaucuuauauugugaguccccaugccuuugauucugauugguuaaaacuaaauaccuaccaggcggggcagagagucugcuguuugcuaaaacucaaguccugugcauaccugcuaccccuguuccagucccaccugugggccuguguaagcaagcaggaugcuguuggcugcucuugcuagcuucugguagaagugugcgaagggcaggcaguuacacugccagcuacuuaaagcuacagaugccugccaguauccagguaccucauuuugcaucgccugguaaccuucuccucuguguuugggcuccuggguucucagacacacucuucaauggaugacuuagagcuaugucugccagaugaaggacugaacugauaagacccccucacucuaacccuaguauagggcaaccugcauuuauaguuccugugagcagaacccugucucccagucagcaccacagccccuaugugaagccagucaggcagagugcuccuaccuggcaggccuccaacauaggugugcacagagccuugcagaugugucuuaaguguguccagucgcuccugcagcugggcagugcucacuucacucuggcccuuugugccauccacuucuaggguggccucacccucccgcagggagacagugaccguguguuccuggcugucgcacaccuugauuuccaucagugccagggcaacauccucaacugccaggaccaccaacugcaggggauagagaggcagaggaguuauagaggggucugccuauccugggcgaggcuggccccguaggcuagcuguccugucuuacuagucucuuuguacacuagucccuucuuagggugucugguaacccuugcucugaggaugucuaggaacccuugugcuuucuccuccccugggcuugguuucuuugaauguaaagcaggggacagccagaaggugacaggaggagauggcucagugguuagagcgcauacugcucuuauagaggacuugaguucucuucuaucauccauauggaucacaaccaucucugacaccgguuccaggggaucugcugcccucuccuggucuccacgggcacauggugcccauucaugccaugcaggccaaacacccauacaugcaaaaccuuuugcagucccuggaaaaccgagggcuugaauuacccuuucccagccugagcugacuucucaaaaaggauguaacaggauacagcuguagcgcugugguaccagcacugggaaagaucagacacacugcccucucuggggugaacagucuuugcuagcaagggccuuggucuguugaucacacaugcuaggggugggucgagaugcugggcagcaugaagccuggaccccuuggugguaugcaucauggaaauuaacccuguugcugguuaguauaaguagcaagcagggcucuacggccugggcagauggaaagagaaacccuccugucugacgcacaccccucuuaggaacaugggagagaggaagguuuuuccuuucucucucaauagccucguuuccuauaagcaaauaguuggagucggaggcuugauauaguugccuggcuugggggacacuggacauagucugcggugaagcagagcucugccugaggggcagcugacucuggaagaauauggaaaucuccuagugcuagugacaugaugugacucuuguauguacggcucccugugagacacuccaugcuuacggccccgcagaggcucacugccccaccagccaccuuagcccaugcuguacaguugugcccaugugacugcauggcaaccauguccccaaagccagaggggacaccuagcugugugcacucagaccugggucugggaaggagucuccagggcagggcaggguucaacaagucaauaucccagagagugggugggggcuggggaccuuuccuugcuacuugguaccagggaugaaugggugugucucagguuuucaccgaggucaaaggggguggagauggggugcucggugaucagcguguccuagucaaagcuggccccauucaauucuaccugcuucuugagcuucuuuguagagugguagucgacuagggccacagagauggggacgacaucgucgucccccaccagcgccagcagcacccccguguccguggcagggcggauccgagccacaacuuuaacuucccaggugguuuccgugccgacauccagcgauguucgggcugcaaugaaagcggcccaucacaaggcaauccaaguggcagagaggcgagagugaguggcagcccagaccggagcgaucacaggggacgacagcucugcacgcucugggagggcaccuccugguaagaaggcgaguggggagcaugcaaccagguuguaccccaagaccugccagugugucaacauaucugcugagugguacucggccagggccacagagagggggaugacaucguugucccucccaccagugcuagcagcacuccugagucagucaggugaaucugagcugcaacccuuauuuccucagccugcagaacagggucaagaacuccagcacuguauguagacuaucaacccgugggcacgggggaugccuaaguauggcugcuccucaccucgaaguguccucuggguaacaacccauccagggagcuacaagcccagcagaaagggccaucugccgccuccucauucccacgucucccccugcuguucucaaagcacuguccacagccucagccaaugcgcuagccucccuucugcuggcuccaggagacccuacagcaugcaaguuggcuggagaacuugaggucauacucgugggugacugagaacagaugcugugggaggcaucgcuccagcaggcccuauguauaucuguggucugggugccuuggcugagccuuccagagccucaugaacauauucccauauaacacaugugggugcuggcgcagcugcgugacgcaaguccugauuacaggaggccgcauaaaacccuuagucuugauauuuacaucuguaccucaccaacuccagaauagaggaagccacugugaaucaggguuguuggcagagacaggguccaccucacugcccucuguaguauacuagagggugcuaaagcuagcuugaucucuccacccaccacggucaaaucaaguccucuauucuguacuagaugacaucuacaggauuaauucucaauaguuugucgaguguaugaacacagauugaaaaaaaaaguaagaauaaaaacacuuuguccucacagaagaggccaaguguaucucaccugguaggcgccugacaagacaccagacccugccugucuggugcauucucucagccuggcgagucaccaggcauccuuacucucucucagaacuugagguugggcggcuccaaaugacccucaauggcuauuguacuuuaagaaauuaugggcucuugcauaaaggagccuacgagcugaguaccagaccugccugagccuccuuggucacgcccaggucugguggacagcguuuccaucacggcaggccccaugcauccccccuccucagccacaugccugagaagcacagcaggauacacuuugcaggcccuuucuguuuugucucccugugggccugagcacccgugcaggccccuuccaagggugauaaaggcugaccuccuuccugucuucaugcuauaucuucuuuccuccucuaaacuuauuucugauuuacaacccucaugaagucccuggccagcgaaggcuuggcacacuucugugcacaugucaugcguuuggacauguccaagguugacuguccacuucuaacuauuggaccgugucuccaucacuuucucuuccauggcuaacaugugagguccaggcagcuguccugggagcugggcuuugcuggcccugcugaggccugccccagccuguggguaaccaguucaucacugguacucacggagacaggaagcauuuaaauggaucuuauacuucagccuacagcugccuagcagucccaccacggccagccccagauagggguagggcggcacccacuuacuguaguugagccuguagguagcaaauccauuccccgggaagaaggagccccuuucugucacagagaagcacugcauuuuuguguuugccuugacugucuccuggauggcgcugucuuccccguucagccaguuccaacuccucaugcacccauccaggcgaggguuaaucuggaaagacaggugacugacuccugguggcuuccagagcuaggacacuauaauggcagauuagagcaaaagaggcuucgagccuagcacuacaggaucuacaggcagggcccucuggcuuaugugugugugugugugcaucuauauuguaaacacaacuuuagggaguuuuucacgagagcucuucaguuuucagaacauuucaggacaccuauauccaugcagggcaggggcacacguaacagugaggcagccaccugcucugucugucacugugggcagagggacaagguaccugccaccugacuguguaagucgggggcauuuuauugugauuguaccuugccucugccuuacucgggccgacaaagcauagguagagaagucagcccaggggaagggaugccagucccagcuuaaccacaugcuuacggugugcaaacuguuacaucaucaaaucaggccacccuuacgugucacagaucugcaacgguguguuggauguuacccccuugggacucucuuggugaccgagucacuaugagcuaccaagcagguuuccaucugcagcagguguugucaucccccaaacgaggguucugaccauggggcucagagacagaugaagaacaaaggccaggcauggcauaggacagaaagaagcagaacuuugaaaaauggcaaaaaaaaaaaaaaaaaaaaaaaaggccaaacauuagagcauacuagaaaucuagguauggcuagcaagcuaaaaugauagcaauccaaagcauuuauuauuccauuugucaaaauggcauguuuuaucuuuacugcaaaguaaauuuuuuuugguuguuaucaagcuagaagaaaacuuaaaugaguaucaugagagguggccagugauugaugcauaauacaucaauaguuacugcuguccaaugaacggcugccagcaggaagauucgguggaacccugcuauuguaagacuugggcucagccacagggcaaacaaaccccuguaggcccugccaagccugagcugcauccugccccgugucgggaauggacuuaccggcuggacgagcucacucuccuugaagggaaugccgcccacggugagauucaggugauagaggccccucuccagcugaaacagcuccccagcuaccgcgaucuucauuacagcaucuuuguugaccuugaugacaagguuacguuccagcucuuccacggagaucuggagggggucaggcggggugggagggaaucaaguggacggucacuucuguaaggccccagaguguaucaccuggaccaagugcaccagaccucagugccgggcaucccacguuaucuguguuuaaggagccugacccacgagaccaugcuggugucuacagggccaaggguaccugaccucaggggaaacaauguccaaguuauuuggucuaggaagucugaccucacaagaccacaccaugucaccuguguccaggaggagcuaaaccuuucucagacuguggccuggguuauccccacacccuucuuuccucagaggaagucacuacuguggcucuccccucacgaggucagggaucugaaaguggaggcaggaucauccugugaagaaggcuagucucgccaauaccuuuggcauuaaacaacacacggcuuuuuccagaaggaagucauagaaagguccuauugaugcuuauucugguuuaaaagaacuugagagucgugucugauggggcacaagccucacaagaaacuggagccuggcugucuauacagucccugcucuaagacaagcacaggguaccaaccacaguccaacuggucucggguaaagugagauaagaccugcucacucagucucucuucuaaggaagauguccuucacaccugagacccuggacacuguggacuggcacagagagcugcucucgguagcuuguguguccaugaggaaccuccaggcuacaaaggggaaccugaaggcagcagagugcugggucagagccagacugaaccuaaugccagcuccauguuugaacuguucucaacacacgugacacaaacacggugucagauaacagcccagcgaagccucacagagccaacagcugcagcccaggcccugcggccuacgccacagacuacacugucaagggcguuaugacccuagcuuuuguagaggcuugucaccaagcuaaaauucccugauuaaacaagcuugggucucucagcuuugacccccucaccaguacagcugcugugggaaggauaucaguauggguuggacacaggcuguguguccuaugucaguacuaagcugacauuugaaucgcauuugauucagcccugggucuucugcugucuaggcucuagaugaccagaaccagaaaaugaagcuccuggccaccucucacccagugucaugcagaugagaaauuuccacccaagagugacauugacucugggauccaggaauagccccucauugcagagaaucccaaucuggaagauuuuuaucccaaaguggaugaggcacuguuggcugugcccaaggugaucccagugugcacugugucuagauaguagaugcuguguuguuguuguucuucuucugaugagaagcgaguguuuacugugcucacuaccaaggugucagguaaaucccauacccaggacauggccccaccuuuuugcuuaccuggucugucggucuaccuggccagcacaggugacuguggcuaggugcccauaauggcccaagggacuaggacaauuauugcuaaagaagagcuaucacuuccugcacccgcccacagccuucacuggcuuccagauuucuauagcagaaaccccaauauuucuucagugcagucuaggccugaaugucaguucacucuggcucucucauuggugugucuaccuccaugguauacaugacuguggccuauguaaccuccugccucaacuuauaugacaucucugcuacuuacaagguucugaugcuuacugaagcagagcucauccucucagcccugagguacccaaccuuaaacaccucuggccucaccuccgcucagcccaugagcugucuacagaguggcaauacucaugcggcugcuguaguuagaagagcauauguaguuuuaaguuuucuaacccccuaacaauuuagugucuaggauggaguaauguugaauaaucaagcaaauuccucagaaacuuggcacauaggaaagauuugaagugaagauuccugugugggaacuuaaauuauauacgauauggugggggcguacuuaguaucugcccccaucuaucagaagggcagagugugcuaugaauggcuggucagggagcacuggaaggggcagaccuuggccuccugggccauucuauuauugagcuaugagugacggugugugagcugccaccuagacagaaccaugccacagugacugcucccagacagcugggagcuggguucuacuccaggguuguccccagggcuguguagagggacccccccccccaagcuucuuuuguuguggacccuuuccuccucugcugcagagacaccaauugcucaaugccaggaagaagaacacacagcacuuggugacuggagagacggcagggguccuuacuugucaacaaaguggaacauuuuuucuucauugcuaagaggaaaacucaugucuguuuuucuuccaagccuguuuuacugccuggaguauaggauguguuuccagugugugugugugugugugcauucgugcacgcaugugugcaccaccccagcucuggugggaacagccgucagagcugagggcagaagaauugccuaugagcagaugaacggaggagucuggccccaccagcucaggcccauggguguuuugaguugguuaucuauguccucugguaucuuacaaugcuuggccuuccucaagcaguuauuccaguaucuucugggccaaagcuucauguuuacgugauauagagcccugaacggcauguguguaugugcgcgugcgcauauguugcauauccugguaugaacacaucauaccuugggucuacaccagcgggccagguggcugagaguagggaguugcuauggagauuucaucgacauaucucccuuucugaguaagucacacucagccaaugaagcagaggcucuggacuaacuagagcaggagccccgcccaugggucacacccauccccaaaugcuagggauagccuuggccuuccacuuacaguuugccacaugccgugguugaugguuggcccgcugcuggugaugcgcccaacgccauuguaccgaagcugcagcucaagccgcccagcucuuaggcccaggacaauccaggugcugucugaacggccuccagcgaagaagaggacuccuucagggucaaaagugcggaagucaaauucagccagcagccuggaaacagacccaggagacaaacugaggcccaaggcagauggugcagggcugcuugggcccugagcccagguagaguuuggccccuguggugcuuuccacauggggagcugguucucucagagguggagcugagguccuggaucagcucucuuaccugggcucugcugucccgugugccucgcuucucaccugguaggcugaagccucuugaagcguagucuaaucacgggggucccgcugaacaugcggcccagguacaaggacuucacgcucuuggccaugcugaagggcacacaugguaagauguccugccaugagauaggaugguguugggggguggggaugcccuguggaugccuuucaaguaaccuuugagguccuaggucacauuggaugucuagaaggucuccucugaccuucuagaaucccaaggcuagcccgcucccagaaaucacagaguccauaugacccagcucaugucggugccuccaggcagggaccaggguucugauuucuuccuuccauuaucacccuuuugucucaucuauucuuauuugcuacuggagcuuaaauuaugaaaugugacaagcucacagaggaacacagggaauaauaaaaucauuuuuuaguauacuauuaaaaagcgaacagaacacgaagaccuuggagucuucccugcuuucugcuguaggcuuucccacugaccagagcgaggauggaauuaaagcaggcugagcuggcuuccaggagccugagggacacaauggcccugaacugccacacugagcuuaacgauuuggacuucaggcucauaguugaaaaaugguucuccagcuucauaggucucucugacuugcagaguuaucaugguaccugguuacccagaguccuugcuccuguuguucagaaaaugccaucaaugaacaacugcccugcaguuuacuugauauagagcccugaacaguguguguguguguguguguguguguaugcauaugaugcuuauccugguaugaacacaucacaccuuggaucuacaccagugggccagguggcugagaguggggaguugcuauggaaauuucaucaacaaaacaaaagaggcucugcuagcugugugguccuaggagcuaguaggaguuuucagucaaccaagucucuagaaacuuucuucccauaacccauuaauaacaaaggguccuauucaaagccaggcacugggggcuucacgaggccaucuaguggacacuacggucaccuaccucacaaguauccaugucuggggauaguuuuaggcccccucgcccaucacaguggcagguauagcugccuggggaguugacacaggucugcucacagcgauccugcuggcacucguccacaucugucgacaaagggacucacaguaggcacgggaaggcgccaaacacucggugcaacccccugacuccuccuagagacucuguagacaucacuguuuauccuguuaucauggaggccuaucucuuagggcccuacuuucuagagagaaaugaacugaagaugucugaggacugugcucagacugaccagcccagacauggagggaccaagguuguggagagugguacagagccaggauccccacaaguucuuagcuccgugcucccuuccuugagggcucagcuuuucuccagagcuccuguagggaaucuuuuggagucuccugcaacuccuagacaggagugacuguggagggagucucugcccuugggacauggugaaccuccaaagugggaggagagcagaggcccacauuacucuccauccacugugggugcaacacaagucuaccaaggucuucccuuugucuacugcaugcuagagaaggcugacaacacaugggugugugcucauuugaguucauaugggaacacacacacacucaugacagcauggucugugugcauacaugcauggauacaauagggccagauaaggggaugagacagagggcucacuuuagggguccucuucauugaagcuacacagacucuccuaggagguucugacauuuucccaacccuccuguguacaaagacuuccuggaacacuggaccaaugauugccaccaaugaagcaagguggucuacguucaggcagugaccaacauguguccuaggcuaagcaucaaagaaggaaguacccuggguaccuuggcaggucuucuccuuggagcuguauguauaucccucaucgcagaggcaagaguaggagccuggcaaguucuugcaucgcgcguccccacaggugucugagucugugcauucaucgauaucugcaagcaaaggcagccaggcuaaggcaguacaggucggucuuggacagcugcagcagccacuggggcaggaggguagagaacgggaggaaggcacgaugccuucaccacgggugucaagugauagugagcccaaggaccacaugcugcucauccacauuguguacacuguagacgucauugcucaggauucacaaugcaaggcagguguccucaaccugcuacuaaagugugggagcuaugagccuuggccaaggccagggaugagagccacaaugagaggaccucuguuccuugaauggagaggacaugggaggggaggccuauaccuccccagaugcaucuccuguauauuacacauaguuacgaggacacagugauugacaguucuccuacaaucacaccuccuaagaauaaucuuugggauggucagaggugaacucuguggaagauaaaaauaaaaccuuucccccuuucccacguuggguuugggaaaucgucauuugucugaugaugucuguguucagauccugaguuccucucacacccaggcauucaucuggaacacccacaaagguugcugugcacugguccuggugagccucagugacucagauacucugggucuaucuguguuggacugucauuccucuagauccuaaaucaauacaggguugaaacauggacaacugagaugguuuuucugggugaucuggacugaauggaaaugggaccacacaguggggaggucccaucugcuucuguguucuugggaguagaguaaggggagcugggagguauggcagaugcacagagguacuggggacugucaccccucgaggucucugcagucacaugcaggggucuaggccuugugacuacacaggcugucuguagguucugugggugggaaggugccuuggaagcacaaguguggaugggcaucuccagcucuugcccuugcucucagauguagggaaucgcccaugaugcuggacuggaccaucuccaaaggacacucaucccaccaccccuccccaggauaggaagucaggcgagguaucacugcacagccagggccuuaccuuggcaggucuggccgucugaugcaagcgagaagccacuauggcaggcacauuggaagcuuccugguuuguuguggcagaccuggcugcagcccccauucuucuggacacacucauugacaucuggacaugaagaaagagugaggggcuccuacccgggcacuucccugcuggccucaugguaaauacaugaacugcugcugcugguggggaaagccauagacuugguucuagaggucccuaggugcacaaggggacagggugaaggacaaaauggacccaccaaucagugcccagcagucaugagaccaaugcacagccuagucuagcacccugaacagaucuauccagacgaccuguggacaccgcagggcuguguugagugagaagcuuggcagacucugccaucuuguuugcagcuuuaccuaauaccucacaccugcuccagaguagaucaaggugggacccaucagcuggggugcuaagagccaugugcuauuuccuucacuccaauccugguucccaaagagcucccuggagccucaacucuugaggagccugcagcucuagaggaugaaccucagggcugcugaauucaggagguucucaggcagagcaccagcccacccuggaccugcaaaggggucccaagagggaugcugauacagaaaagacuguagggaugguugagcucccagucuuggguagagggugaggaguagguggggcagagagagggcaagguguggacucaccuuugucacagagccggccuccccagccaucugugcacacgcagaagaaguugcccaugaggucuuggcagauaugaguacccuucuuaucacaaggguuuggggugcacuggucaggcaagucugaguuggagaauacaaaaacgaaaaccacucagaauaucucugaaagccucaccgucucauauagcuggggguggucagagccugggggggggcagugaagcucccagggguuccaaaaaaggcugagcugugauggaggguccuaccuugggacagaaacaaauaugaggaacuuuuaaagcccugggaucgguuccagcaccaccacccagaucuacugagcuaugcaaagagagacugcuggcuccugccucccaggaaaugggucuucaagauccccgagaaggacuugggcacauucucuccacagcacugguggagcccacugccaaacacacaggaucucagcacuggggcaucacgucaggcgugcaguggucagacaaacaagacacaggggugacugagccauagagcgucagucuuuagcuucuagcaugcaguuaaaagaucuuucaaugucaccgcccuccacagaguaccuuaggaacauggcugagaccuccggacacagccugcaccaugccuugcguggaggcaggaaaacucugcgugugcuucaaccccaagguugggaagagagagccauuauuauauccuguucucaaagaacccuuucagagguugaacagaugugggcaugacccagaggauaggaacccugggcccuucacucugcuccauuugaaggagucuacagucugccuggaugggguggguggucuccugucuaccaacaagcuagaucauucuaaaguagcgguucucaaccucccuaauguugugacccucuaauacaguuccucauguuguggugaccccccuccccaaccauaacauuauuuucauugcuacuuuauaacuguaauuuugcuguguugugaauaugaguacuuagguuuuccgaugguuuuaggugaccccugugagagcaucauccaaccucaaaggggucauaaccuacaaguugagaacugcuguucuugagggucuagauacauggggguaucagcuccuaucacucuuacaaggggugccacuucuuagcccuaaucaguccagacuagucacccacgugaacuggcauucuuucacccagagaucuuaugccacuugguaagcaucuucaugcugcccgauuccuucuccuugauguauguaugccuaucuguugccagaccaaagacuggcucuaaaguuucacuaguagaagauauaaaauagggcugccuccagacggcacaugcugagcucugacuggaugaagguaaccaaccccauuucccuccugucugucuucaagagugugguuagcaucagcuggccacccaagcccccaucgcaggagcugcauccaagggcaguagucacacgugauccagcacuccuggagcauagcuguacuuguaaauuuuuuugccaucagcucaugccucacacaggcaggugaugcuacacucuaaggguaucuaacaggaaguuccgggcugggugggcccucuguggugcacgaaaagcugagacccgagagcugaggaccaauaggaagccugagcuguccccagagccuaggaccaauaggaagccugagcugucccucucugaggaggcagccuugagaugcuuccuuggucuuccucugcuuucgguaguaggcagccauuuugagagucaugacaauucacaucucugacuuugauucuuggugucggcucuugggcaucccuagccuaucugcugccgacauaggucugaagccagcauuuguuccuucuugaguuacagggagcaguuucgggccaagccagagggggauuggaaacacuggccacugucuccaggaggucauccuagcagggugcuagaaggucuucuaggucacccacaccauguuugcuccauuccugggggccucuccacaggugccucccacaccuaaacucuagacagagaggguaaucuugcugccuggcagggacgggggcacaccaggcguaagauaaggcaggggccaaccucuggauuucccagaugcaacgcaggagcccauccaggcuuuucaggucagcuucauuccuggcagccuccacuuguccugagccagcugggcugggugccgagcccauggcaggcaugggaagcaagucuaggcuucucagggaagcugugcgaucugauuccccuccccccuccccccauggcccuuccacguuuacauccaaagucugcuggguuugcacaaauuacagccaacagugugccugugagucuucaacgacuuuugauuucuucagagugguuguuggaagauuauuauaaaaugucauuuuuccuuaagcaaguguuggcuggauaaagucagaguggccuguaagugaggggucaggacuggagggccuuguuguucuacaacugcuguggacuuguggaagcccaccugaggccaagacgugguguuuggcuaacucaaguaucugguuggaggccuaaauuuauuucuaaaguuuacacugguaaauuuggcacaaggguugguuaacuuggccaagagagccacaucuacccauugcaaaaucuguccuuaggccgagggaugacgcugugccaacuuccaauggaguaauauuauuuuuaagagagucccaacacagagccaauaccaaaaccuuugucccucugucccuagagaaauaccacccacgacaugucauuucuuuuccuguugggaauuuaccaagucccauguuugacccuuggcaggugcccagaguuucuccuuagacacauuccagaaaggugaaagaguggacacuguuuugcaggccuugagggagcccccuuagcuuuccacaggcaagcuauucuuacguugucaguuuacccugggucuuuuuuguggcuguagguggagugugaagugugaacuggcucacuagguggcaaguuaggaccuggguacccauccuguccaauccagguccuauguugugggcccagaaaggagcccagaccccuaggaaaucccaguggcuugacucaccaaccacugcuugauguugucugucagaggaucacauuggacaugacagggagccaggaauggcuugugagaaaggaauggaaugggagccaaugcucuuccuggcaccaagugggcagaguccaugcuuagacuauggcuucucucugucacucuaguugcuguuggcauggugaccagcucccauggggugagguaauggguuuccagaagaccugcucaggccaggguuuguuuagggcuaggucugagcucucuagaaauugccagaaugauggccugcaaaaacuuuugcuuuaauuuuuaacagaaaauggguaaccagagaacucaggcuaugacaugccaugggcagcagggugaggagccagguacaaagagaagcagccugcagagcugguaggcuuggccuuggccuuaucuucccaugccucagcaagaggauaugcgggucauugggcacuuuugcacagccuucaggaggggcacagacaaugacagcugaggugggcacccaugggaccugugacgagcagagccaggcaggaggcaguuuuguguuagcccuaauccagcaaggcaucuggcaaaugaauuuaacauaucugucaccagcagacacagagguuuucuucucuguucagcucagggacaggcucuggaaguacacgcccauucuccucuuccaggccaccuaccaccuaaggagcagaacaucaugugccccucccaccggaaggugucacugcaauccaaaacaucuuaagaggguucgaagccauaauucuagccaccaaccaaagcaauagaauaaucccucagagcacugggggcaaaggugaaugccuggggacaauaauuucauauguaccaacaaauuagaaaguauaaggaaagaaaugaucguccuuggguggaggaaggguuguggggcgggcuuacugggagaagggccgugagcccgauguaaagugcauaaguaaauaaauaaacucauuaauuaaaaaaauugucucugacccuuucuuaggaaccagaacuguggacagaagcauaggacaucauucuagcuugugauaacaggaacaaauccccaacgcuggucaaucaacuugcuuuaagcugagccaaagaagcugacaucugacaggagaugugacuguacuugccugggaagggacuccuaucagggugacuaaggacagggugacaccggugugcaaaagccaugucugcauuuccgggugcaggcagagagcugaaagaggguuuugcccacaugauguguaguaggggacauaccucacaccccacggacuauuuaacucucuauaauguguacauguauuguucauuagaaacaaaaccgagaugcacuuuguuaaaaagaaaguuaaaagggcaagaagcugacuggggagggucggacagcuucucccucagcagccuuaccccuggcuacccagcacaugcuucaggugaagcaggagggcacacuuacucugaacacauuuggcgaaaucuggguuuuuuucuucaggccugccauauuuucucaugcacucugcaagaaacagacaacacagucacucuucauuccugggguggagcaguuauccaaauuggggccagaugacaguuucuuuucaugcggacaccguggaucuccagugagugcaugccaaucugucaguacggagugccuggcagggacagcaggaagguguaccagugugaccgaacaccgggcccagaccggugagugcuggaaucucccaccauauagaccagcaaaagcuacagugcaagugugauuagggccaaagcugagcuucaagaucacgaugguucaggcagaacuaaggguacuguucuuagucugcaggcagaaacacucuuaaggcaccuuaagccuggagggcacuagaucuggcacacaaguguguucuucaaggggagccaggagauugacauuggaacagauacaacacgugauggccgugugugcucagccacucuaucugguccuucaguaggccacaugugggaaggcagcauggacaacauaagcacaguuaggaugcauguguagguuaacagagagauggcccaaggcucuugggcugguguggggcuucagaggacacccugaguaaauguguauugugacaugggcacaauucgcugaagacuacaacgccaacugacccaugggaaauugguaaagccauuacccccacgggccaggaucaagaggaauggcaaagcuuucuugggauucugaaaacgaguguuuacaaaugauggaucaguguguauaaagacuagcgacuguggucucuuccucucaugucuacagccugauaucuacagagacuuccuacugagauuagcuagcccuuccccugcguuuuagcuaauaaauagauugaagugcugggucauagucuaugucuuggagaaccccaugaaucccagcuugacuguauaugucugucauuucuuuauucucuugucuccucuagccaauauugugguacccaagccuggagagucacagcaggcuagucacuggucuccugugcuguugccagauaggauuuauaagcaggugccuguggaacagaaggucaguaucuuucccaaaugugugguaaaaacuccaaaguccaagaauauacaguucuuacaagcaauauagauccaaaguacuucagguguucaccagacaaacagugcucagaggggaauauagggcuucuuaaagaagcaaggugacuauccucuaaacuaggacccuaaucuuuuuuuuugucucuccuauaaaagcauauuggagcaggguagugcuaguauaugccuuuaauuccagcagucuagaggcagaggcagguggauuguugaguuugaggccagccuggucuacagaaugaguuccaggacagccagggcuacacagagaaaccacagagggaaauaaacaaacaaaagaacuuaugauauuuuccuugucacugugugcuuguuccaguggcugagaguuauguguguguuccuguucaucaaacuauguacaaagccuucuguaaagcucuaaguuuuaacugauaauagagcaaauguugauaaacacacaacauacaagcaaaacuauuuuuuuuuuuggugugugugugugggguccucaauaaucucagaaguacaaaguccugacaccaguaaguuggagagcacucaauuagccauacuuccagaugugggcagggccugcgaucaacugaagauaucugcaaaacagcagcauuagucugaggcucaggcaacucagaauaaaaugaugguauaaaaaacacauucauguauaauacucacacaugaguauuguugacagcucuaaucucacagcucccuucuucuagaaguaacaugguaaugggauuuccccagcaugaaauauguguguaugacaacgaagcuacuauaguaacuuuaacucaccuugauaucguggauagaaauacuccuguggaaagagaagaaaggacacaguuaaccagcacagcaugaggccuuugaaaagggcuauuacuggcucaucaagcccggagacaggaacccagaagcacgaaucuugcacuguggcucccucaaagguagggcuuggaagccacuguccagaaaggaugucacggaaagaagcagaggaaccagaggccucugcugacucagccucugcaagaugacugcaaagcaugacuguguagucaccuucaggaggaggcaaaucggugucaccuagaccuaaauagagggugacucuccacaugucuucugggaaaaugcuuguaggauagacacaguccagguaggagcccaguuucaguccaaggagagagaguucuugucucaggguuuccauugcugugauaaaacaccaugaccaaaagcaaguugggaaggaaagggauuuuuuggcuuacacgccauggacaggaacucaaacaggacaggaaccugaggcagaagcugaugcagaggcuacggugggguguuugcuaauuugcuucuucuggcuugcucaaccuacuuucguacagcacccagaaccuccagcccagggguggcaccaccuacaaugggcugggcccuccaucuuggaucacuaauuaagaaaacgugcuacaggcucgucuacagcccugcuuauggaggcguuuucuuaauugagguucucuccucucagauggcguuagugugugucaacuugacauaaaaccccuugucaaacugacacacacacaucacuuuaagucccaacccuuucucucucauucauccccaugaucucacauuaaaaacauaaauaacuuuaaaaagucccacaguaguuauaaauucaaagauauuacaaguucagucccuuuaaaauacccagacucuucaaaauccaaaaauguuugaaauuuuuuuucagcugugggcuucuccuaggggcuuaggucacuucucuggcucugcccuuugcagcacuuacagauuagauugucuaggcuccagcuggcugcacuccgccgaugcugcuguucuugguggucaucccaugguacugaucucccaaaugcugggucucugcagugggcugcauuaucuccaauagccucuccugugcucucuucagaaacgccaacucuacuacacauugucaagccucagcugcucuccaugucccugucacacauucaacaccagcgccacccauugccucuuacacuaccgaggucuccugccagcacaaggcacagcucuggaacagagcuucuguguguugacucucaggaaacacuuuccagaagauuucaccucagugaugcuggucucugcucaaucacuguuaauuucucagcaccagcugaccagcaucaagagaguaucccagcaaagcaaagguuucacaucaguaucucuucagcuaaccagaaccacagaaucuaauucaaaauaacaagaggccccaguggagccuuuaaccuucccccugaaacuucacaaguugucuccacugugcucaacaguaugaucuuccaagcucccacagaacagcucacugagccucaacacucaauggcuuuucuagcccaaaguccuuccacacuccuccccaaaacacacagucaggucugucaaugcaauaucccacuauccugguaccaauuugucuuagucaggguuucugucgcugugaugaaaagccaugaccaaaagcaacuuggggaggaaagaguuuauuuggcuuacacuucuacaucauaaucuaccauugaaggaaacuaggaccgagacucaaacagggcaggagcuggaggcaggaacuaacguggaggccauggaaggaugcugcuuacuggcuugcuccuugugccuuacucugccugcuuucuuauagaacucagggugacuggcugagcccucccauaucaaucacuaauuaagaaaaggcccuacaagcuugccagaucuuauggaggcauuuucuuaauugagggucccuucucugagaugauucuagcugagucaaguugacauagaacuaucuagcacaguucucuucauccucagaugccccccccccagucauugauuuucauacaauaucuuggaaaaacacauuuucuagucgaggcacaaaucuguucacaagagcucuuuccugucucuguauccccacacuguacaguguauacaagcccucuggcuauuccaggccagugaccagaugaguagaggccuguucagggaugauauacgcaacaggcagccaaacaggccaaugcugcagacucccagcagagcgcccaccucaccugcaaugugacagacgucccuguuuguguucucucaccucucucucacuagugaggggcuacgugggugagagcagagguaacaggggcggagcaugugggaggaagguccccaugacuagggggugauggugugcuuuucuacaguuuuagaaagaauaucuggaaggaacuuagaugaccaaaugcccuucauguuacagagucaaguguggggaugcagccagcgggcgugagguggaguucguguguuugguguuuacaugguuagggaagagccuuucauagccacacacauggaaaggucaaagguaaaagcaucaaccacacuccaguaguacugcuguaggucugucuugaggccagcacaagccaacuugacuccuggaaggauguagcaauucuaacacccagcucagaaagacccagugucuuuugcagcugccugagagugacagaucagaacugaucucccugucccccugcccaggaccaggcaggauccugcccuuggauuccagcuaucuaucaauccuucuuccaggccuccuuggaggaacucaccagccgggcugaagcuggauagcuuccauggcugccugaucagacuacaucugaaggcagcucaugucccaaaagacaaaacccacacaagaggacaaugcuggaugcacgcauuaucaagacggagaaacaucugagcccaaagcagggugcagguaaacugacaucauuuccugugauugcaaacgggauggcccaacugccagcccaugccacacaacugggaagguucuagauuauucugcacaguaaacugcggcugccaccugcagaacaccauucucaccugugucuguaaguccucucagacucuuagaggccaagacaucucugccuagcgaaaugaggcaguggaauggcuuuuuuuguagucgggggagcauguuacuagcauccucaguuuugacuucucaucauacaugacaagcccaccacaaacucucuuccacaggcagcaucgggcuuacagaaugcucacacccgugccucugcccuauggcugcugacucucauaggccauggguaccuagcuguuugcugcuucauagacaggcuuuguggagugcacacucccagggaacucugagcgucagaugcucagggugguggaaacacauguucuaccucaccagcucugcacacagagcguuacaguugaagauguacacaguacugcucaucugaguuuggggaacauucuaagcacagacaagaagacauaguuucgagggagagcuuucaaauucuggggacaccuccgcaagguauuucaccuaagaugucccuucucugccaagaguccaaauuccaacucucaggucucuuuuccugagaagacaccccuuucuuauuuuucccuccccacacugggccucguuccucuugucuaguauucuaaaaggaaaugggaugggagguguucuaccugcccuggcacuggccuuccccgagcuguccuuggagaacccaccaugucaggacaaauguccuuaguggguagacaugguuuaaacauggucacccaggucccagacccuuagaacuaacagugccccaaagucccaugagaguacagcaguagcagcagagaagggucuggggggcaggcagggagaaugaauuagagccaccacugaaagcugagacacagucagggagggagggggcggaggggggucucucauucagcuuccggaguauuaauccccgcagcagccagccaacccacuaugaaucuugcaucuuaaaauuuaaaaagaaggugagaaucagcaaccaggccugaggucuuccuuccuguaccaaaguauggggcagaggcuccagcugggauuaacuucuugauuaggaaccucuagaggccagcauccuaagcuggggagcagccuuaaggcuuagguauauuacugaagagucugcagaaaggaucacuuggggcagaguuacaaccucagggccucucuggaauuagcaacugggacagggaacccagccagugagaaggaagugcccggaagggacaguaacaauaaaaagggaaaccagauaacagagaggcugugguggagagaagggacagagagauuagacguggccagggcugccaccacaggggagcugccaccgccacugaggaaugcggguggaggcacacaguagcugucuggauccugcauuuccuccccagagaaagucaggaagaagcuaccaguauccgcccacuggagggcucagaucuggccccuuuuuuccuaaugucagaagaaaugcuaacuaaacagagccagacucuucccagacaaagugagaaaacaaaacaaaacaaaacaaaacaaccaugugguucaucaugugggagucggccuguuuccagcgaucuaggcccacccaguauggagggcaggaccacacugucauccccucccugggggcccuggaaauagcagauauaaggagcaggugugcaucagcuacaguuggccaggauaccacucggagccacaggaggcuggcuggucuacuccagcacgguauguccacaacaucagggaacacacaacaggguuuuaacaaguacugagagcuuucacuaaaaccacacugacuccucauucagacccacaggagacaagaggacuuggauggaagccuggcaccucuauuugcauuaugagucugucacuugcuuuuuuuuuuuuuuuuuuuuugcaauggaggcaugcuaaucccucgggcaccggcuacauaagccuggagccgcauacccaucucgucccccugcaggguugaccacacagauaagcagauaggaaggauguguuaacauucugucuugucccagauccccaagggaaguuaagggucucgagggacaacagagucuuagagaucacugagaacuguuauuaugaaggaaccugcacuccugaggacgcccuuguccccucgaggaauaaggacuccuucuaaucacuuuguaguaccaguacugaggcagcauuagccggaccacacuugacacgcccugcucagcucagcauaucucagacacugugcccaauccgucuauuuaaauuuaaagcucacauccacgucccaaaggcagcccugaggugaggccacugggccucuuguuccuuuccucggugugcacugacucauuauaucucugccuucugcuucucacuacuucuagucucuauggauagaguuacccaggcagcacagccuggaucuuuggcauucccagacgugguccuuuuacccuaaaauuucacucacagaucagcccaguaaggauucccgaggaccauugugagaaucugcucugguaggugaucugcagaccucagcuucucauugucacaaagaguggggcagguaaaccgaagccacgccucuugucaagaccaucucaugggccucaucuuacaaugagcuacauuucaaggccaggaaagcugaccuagcauuuucacaggaagguuacaucucuucccacucuuccuucugaggcuaugaaggugacuggcgcuuguauauccacuggcgcgggucuuaggucuccccagggguauggaguaggggaggcuccagccaugggucccugcagaggaucacggggacuccagagcacagcuugguacuaccucuuccugaggcuugcccgguaucuguggcgccaggagaaaagcgacuagcagccagaucaaggugcuagcagcuaggaaagagcuuugauuuggaacucugcaaggugacgugaggugcgugcggacuggaugccgggguuaacaguuuccauacugcaggcaagaggcacaggucagguauccaagcuggcucaugagaggaaaguccacguguuaggguguagggguuacagagggacaguuuuagauagcgcugaugggaagagguguacgccaagcccugaaggagacaggcucugacaggaccagaggggucuguccuuuggagcauuauagucaggaguuucacccaaaagcugacagaaaagggaaacccucccauggccgaagagaaguuauuuggaggagguggggguccugaggacauuacucucuuucaugucuucauuucagaccuuugcaaauaagaucauaauuaaaacauacaagcaauuaaaaccagagggacuugacucuaacuaagaaaagcaguucccuguccaggcagucaggagggccagcuugggccugucugcccuggcaggcaggcugcagaggggcgggacuccaccgcugggugguggccuugcugcucucucucaacucuugucaccacaagcccuguccacacugaauggcaggaagcuucaugggaggguggaguuguaacacacagaaccagucaccuaagcccacagcccaggugaccaaggacugggacuuacccuagaaugccgauggcagaacucauugggucgagagcaaucaucaaaacagagaagcagcagcaaggguagaaaaagaucagccaucugccccauccugcuguagaugccuggggcagcaccauggugaggggagggugggagguggggugggggaggggggagcagggguggggcacagcuugucaccugaucuuggcuuccacacuggguaacagugccaaagcagcuauggugacacucaacagcuguagcaccgcuaucaggaaagcagcuuugacagggauuguccagucagccgauuagacacaagucaaagcaaaggccccaauggcucacacagcgccauccuaacaucaugugauccuuacuucaccccagaagaauucuuugaagggaaaaugccagcggaacccaacauugugaaaccauaccgauuuggcagguguugggggggggaguggggggggggcucugcaucacuacggagacccgugggccaguccagaucucaaucaaccucacgcaugcccuacgcugggguguguuccccucaugaauccacucagcccccacgcgcaccuucuggggagaguccugugcauacauaggcugcuggcugcaguuggcuguacgccugcuccauuccccaaggacauuauuaauagaaguuuguccugggccagcacagcccuugcagaggcaggugccggcccucuuccucacguugcuccccacccgcccguaugcauguucuuagcacaauuccagccaucguauuuuuggaccugcugcagcaagcaauuccagcuuugagaucuuucaauuccucuuucaggaaaacccugggucccuccggaggaagaccaaagaggagccccaccccucaccuccaauccaauaaagggacuggcagucuuaggaagccuuugaguuucaaaucacugcggauuuuucccacggguacuuucuuuucgaggguaggggaagauuuaguuucagagucuacugaagggaucucaguggagcccacucaaggauacgcuuucuacuccugaagaggagaggacuugugggucaacugagaaacuugggcucaagaauggagaagugcaagggggugcgaagaaggcucagugucuaagaguucuggggugcacgugguggugcgguccacacaaggauccuuacaucuccagaaaggauguuugggauucgacaguccccgggucuccuggacccucacagggugggagucggaacuugcggcccccaaaaguauggguucugggacgcccaggacccaccccgcgaccccuggcgcacgcucaccgucucggggucguucucgaacaccucucuggccuccucuuugcugcacaccuccuccacgcacucccguuccagguggcccugcuuggccuccucgaagacuugguaggcgcggcgcugccugggccgcagaaacugcgccgccucacgcgcccgcaacagcacagcugcagaaagaaggguguacggucaaccuacacccacucggggcuggaauguagggggucugggaugcuggggaucguaaugccugugugucugggaugcuccggguccgugaugccuagagcucagagguccggggacaggaugccagggugucugggguacccggcaccaggaugcugcgccgggguacaggccuggagccccacaccacgggguaguggguuugggggaccccugcgguacucacugugagaagacucggaagccagcaggagcagcagaagcgcagugcccagggcggcggcgggcccgggcgguggcggcauggcgaggccggugccggggagccuagcagccgggagcgugcggucagagcacccgggaggcugaagcgaggcgcggacgccgcgagacacgggcuccggucauccuggcuaagcgacggugaaggucacaucccugcggcggcagcgccgcacccggcgcucgcugcgguucugggccgugaaggaggcagcgggug

SEQ ID NO: 4306 - RNA, 3123 nt, Mus musculus
augagcuguuccaguuuuuuaguuccacagcuucuguuucauuucuuuuacaagaauuaaacgagaaacagccauaggcauucaaaagcaauuacuuccugucgcuuccuguugauggauaucaucccuagugacugguucucugugguuuccauuagcccuuugaacauacuugugugucuuccauucgugaauccagagagcucuugggugggugcagcaugcaugugaccugccaggagcucagagcgggcuaacuaauuaccacuacauaauugauauggcuguuuggcaucucugacuaguaauuuugucuggccuuccucaguuuugcccagucuuuucccugcuauguuagccauauuuuuccagcuuucuuucuauccuuguaauauuauguugagaaaugcauaccuugacuaccuauuuauuuuaauaaauuuaauuuucauugaaaauauuuuuuuuauauauuuugaacauaguuucccuaaagcauucucagcuugcuuguuuauacaacccaggaccaccugcccagggauggcacugcccacagaugguugaacccuuccacaucagucauuaaucagaaaccugcccugugggucagucugauggaaacuaguccaggugacuaguuuguuucaaguucacaaaaacuaaccaacuggggugaccucuuaacuugacacauacaucaccauuaaacaguaaccuuuccuuguuuaucaucaagauguuaauacaacaauauaaaguauaaccuucaaaguuuccaucuuuaaaaacuuguuaaaguucagugacacuaacaauauccagucuuguaacuauagucucagaaucaaguaguuauuccaagagggaagaaagaaccaaagcacaguuaaaaguggaucaaaacaaaagcaaaauccaguaauguaaauaauuuauaaucuaaugucugggacuuacucaugaucuuccgggcuccaggggacuugggcagcuccaugucucaggcuggcucugccauccacaacucacagcuugucugguaggcuuaaguaggcuccacuccucaccugacaugguccugcaguccuagcaucuccagcaugcuggaguuucuacugccucuccuggcucuuuccaguuucaaucucagcucauuucugugaccucuuaaaucuugcagcguucaugccuacacaaucaguuccacuaugugggguacacauuaccaagucagguuuccugcuugagauagccuugacugcaucuggacugcagugucugugugcugaccuuuaggaaguauauccagaaaauugcacuuugaugaugcuggucuuauuaaucacaacugauucuucauccccagcuaaccaucauuauuugucccaauaaagguagauucuuaauccaaauaucacaagaacaucccugguaucccucugauacuucauaaugucucucuucuuucaaugguaucuuucauguuuccacaacucauuacacucugaacacugaccaaaagcaacuugugggaggaagagauuuaguuccucuucuagcucucuggucacaucccucagugagggaaaucagagaagaaauucaaguaggaguuuggaggcaagaacuagcagggccacagagaaugcuuauuggcuuuauuacaagcaagguccaacugcugugggacccuuucacguccauuagucaagaaacuguuccacaggccaaucugaugaaaauaaugccucaacucuuuccucuucacaaccaagugacuauuuugagucaagcugacauaaacuaaccagcaguuugccagacaggugaaaggguguugggucaggcacacaggaggacagucaauggcuuuaucuuuaagggggcaaaagccagcccgagauaauuuuggcuccaagcuuguaauguuccaacuuucuuccauugugaaguuacuauccaucgaccuuguacuaucuuaacaacuggguauggguugguuuuuccugacaacucgucguccacauuuuuaucagccucucacacguguguuuucuuccuaauaaagguuaagaggcuaucagaacuucuggucaguguaacugguuauuccaaacugagcugguucaagugaugggcucaguccuagcuuucuuugcaacacgaaauacuggaaaaccgcucuugcccaggcuuuuauagaacucucgauguuugaggccuguuugacgcagaccuaaacgguuuugagucuuuggcuuauuuaaaacgucacauuucaggagugccacgaucgauuucugaaaaucucucauucuccuuuaccauuaacguagggagaauggugcuauacaucauugagcacaugggaaaacuguauuguucguauaucugcuacaaauaaaauaaaaauaaaaagccagacgccuuuaaucccaggaggcagaggaucucugagcuccaggagagccaggucuacagagugaguuccaggacaaucaaggcuacacaaagcccugucucaacagagaaaacguguaggagggaggcggagggcagaguggggcgaggagagcgacggguuuacuuucgguacugucccagugacuccggguggaccgggggcucccaguccccaccgcaggucagcagcgcacgggacguccggagugagcaucugcucuccgcguggcuggcagcaccgaucuccuucaccgucgccgccguucuaggacguccgcugucuuuuaaaaacugccgcgcugcccccuacaggcgcgggccagcauuggcaccgccccuucccugucagggccggggaggggacacugaacaccgaauuccaagggaggggcugccuaguccucgcgaggcuucguucucgcggagguggcggcggccggccggccgguggggaugcgcucggaagagggggccggaggcuuaggcgcagcccuggcugcgcggggcccgagcuggagggagaaacuaucgagcucagagacccacugccgccgcgagucaccgcggaaggagucggcggcgccuccggccccgacccuaagugagagcggggccggcaagccucgcgaggagaagaggacagcccugagcaaggug

SEQ ID NO: 4307 - RNA, 13224 nt, Mus musculus
uccgugggugaaaagggaaguuuauuccaaagugccaaggcucacucccaggaaagcaagcaggcagagcuaccugggagacucaggguuaaacaggacugggagaaagggaguuugugagcugggcuggggcuggugagcagcaacagggagcuuagaggcuagccuggaucuugacaggaggcacccaagcccccuguaaaugggucauaagcugcucuugccagagauaagagaaugacuccacuuuuagcaagcaggaacuuucuucaagcccaggagggaauggggccagagcuugggaaaagaacuuucuugggggacaagacccuguuaggaugcuuuuucagguauguuaguauccaaggaugucacagacuccaccccacagauguggcuaccacuguuuucuucccguuguaguccaugaaaacacugaguugagacgcauuacaaccagucuuacagaggaagaaaauaaaggugcgcuaagccggucauauuauuaaguggcagcuguacaggaggcaaagucguuccaucacauuaguuaguuguucuuaauacauacaaggucuaaaaccagaguggacggggcaagaacaacggcuuaaaucucacacuuuaaaacagaacaggguguaggcgccaaacccaaagagcuaaaucugugucucaguuguagcugagacuggcaacccgcugaaaucaaaccaccuuacagaacuaaggggaaacguggcuuagaauggacugcucaacacaugaaaacuagucucuuaggaugacauuuggguauaagccacugaaaaucccugcaauucaucuugacuugaguggacagacauuagugcagcacauccaugugccagagggcacuuucgggaguacauugugaaggcucugcucuggacaaugcuucagccucuacaguaaaaacggaauacaccaaugggaagugguggcacacuugggcaaggugggucacucguggugugccugugagggacauaucuuggcccugggcguuuuccauuccucuucucuuucuucuggauaccuugagggcagcaguguuucucugccacacccuuccaauccuugccacaugccuacaagccauugaaaccuacaaaacuaaaauaagucuuauuuuaaacuaucuuccucaggcaucauaagucugauuauaauacaauuauaaaaauuaaguacacaugaagauguuaucgugaaagccuuuuuaauuugguugauacacauuuaacaaacuauuagaauaauccacagagagauacaagguauuuacaauggcaaaaccaugugaaaccaaagcgacaugucuuucagacaggaaugcuuuugaggcagggcuucacugugcugcccacggugagauacagugagcccucaucaauucagcucccaaccaaccaagucggcauccaguguggaucgcuggcugccgcaccagcgcuguuuauuaaccuuuuacugucaaucuggaagacuuugagcuccugcucauuacuugggucucaagccccacccgacagaaagcacauaagacccaggguaggagguacagacacuaacacguuuggcaagugaagaccaucuguugaugugaucaggcagggacgugaagggcaagaccccacaaggaagacgccauugcaaacaacuagagggaagcgguggccuuaaucauguggucuucucagccugcagaaaauaccaacacugcuuugcaaacccacucaguuguccuagcagcagaaaaccagcggcucuaagacuccaacucucuucaacagcauucucgacuuuccuaacgcugugacccuucaauacaguuccucauguaaugguggccccuccaaccaucacauuuucauugcugcuuuauaacuaacuuugcuaucaccauuauguaauaucucugcuuucugugaaagggucauucuacccccagggcgagaagugccgcucuguaacagcauuaaugaucaucaugaaaguauuaaagacuuauaaacuaauuuuacaugaaaaaauaagauauaagacauguuucaaaaguacauuuaacaaaauuuuucucaaauuuacuuuucaugcucaauucucauacauuccacuuuuuuuuuuuaaagguauuggggauagaacccuggaacugauaaguaugcaaaacaugcuagucgaggcucuaccacugagcccucaucuaauaaguucuauguucugaaaucaguuacacacacacacaugguggaggacaaagacucugauuagguuuaaacuuacuuguuuauuaaauggccugccuauuuucccccacuccuuguauuauaacaaaaauaaaacuuaaggaaaaugaguuauauccaucuggaaucuauaacagaaauguauuaagacuuauaaaauagccauccacauaaacaacggaucauaugaaaaaauaaccaaguacuuauuuuuuguaacacuacuuacagaccaggauacaccacuacacacauacuggcuacugguccaucuaggcuacucaacaaccuaagagucuggcaagcaacacuguagagcaagggccacugucugaagaucaaaucugcugcuccuccaauggcgacuccagggcuuccaucagcuucuuauucaccucuucauuaugccggcucugacagugaguuaaguguuucuuaaagccucuugggaaauuugauucaaaauuacagcguggacauuuaaguaaacucugcccgugggcugcuacgugguuuuuaagaagagacuccaaaagaaacgcuuuuccacaaauugugcacuuauauggacuguggacauugugcuuauuaaccaaguggugcaagacagcgcccuuuuucauggcccgacagcaacagauuuugcaguaguauuucccuuucccacgcuucauguacuuugcgaucuccuccucagagaugaaggccuccuucuccucggugaacugaagcacauuuuuggcuugcucuguacuacccaucuccauuuuguucucuuugcuaaaaucaaucgauuccacauccaccuguuccugaucgcugcuugacuccuggcccuucguguccaacgugucuaaaucugcucugauguauucacugcuacugagcucggcauccgaguucuccuggcuguccuucuugagcuucuuugaagaaggagauaaagccucgucuaacaguuucuuggggguggccagaagcccuuccugggccagacuaucgcauuuugcauuauccacagcuucaaguuguaucuccucacuaagcucaggggccuucugggcgucugagaacacagcggauuugggaaguucagguagaaacacgugcuuccgggacucugggaaaagugcgcguuuccguggcucgggagaagcaggaaggacugcuuuggugggcucaggaaacaguguggacuuccuaggcucagcaucgauagacaagacaggcuuccauaugucugacgcuaccuucggugacucagaugagcccgaagcagugugcuuccucgucucagagaagacguuagguuucugagacuccauaaugaaggaagacuuccagagaucaggaggacuaccacaagaacuuuucuggggcucagggaaaucaagugaagcaggagaaguuuuccgcuggucaggagaaaccuuccaaaggucuggugagcuugaaggcuucuugagcucuggagaaccugcuggacuucggaucucuggggaaaguggugggccuggucugcggagcucaggagacacgggaggcacugccuuccagugcucaggagacaagggaagggcugucuuccggaguucaggugggccagacuuccaugacucuggagaugugggugguguuuuccaggaaccagaugagacugaagacuuccaggaugcaguggacauagauggggcagguuuccaaggcccaggugauacagaagguauugguuuccaagguccaggagacauagguugaacagguuuagaugacuuccacgguccugauguugcugaaggacuggauuuccaaggccuaggagaaccaggcggcccuggcuuccaggaaccuggcgacacugcugggguuggucuccgaggcucugaagcgauggcagggaauggcuuccaaaguucaggagacucugcuggggauggcuuccuuggcucaggggaggcaguccucgcuggcuuccgagacucuggagaugcacugagggaugguccccaagguucaggggaaguggccaguacuggugacucuggagacaaagcugaaggggcagccccugugucugcaaaggaagagugcuuuggggguuuggagcugacaagagcagacuugacugacucaggagaagggccucgcucaggcuucuccagcucaggaagcucacagggugggucuacacgcucagggcaaggaacaggagcagcuuuugaggccucagcaggaagacaaggggcuuggggcucgggcgaaauaagaggaccagcgcccugaggcuccagaacuggaggaccagaagccugugacucuggacacaagcucgggcucguuuucugugcuuccauggggagggcuggagugggccucgccucugcugggucaaaggcuggguucugccgcucaggaggggaagggcuuuucccagacucggugucuuugcucggcugcucuuucggcugcucacuccacuuguccgaggcugcgugucuggccgugaugugauaguacacauuggcguacagcuugcuggugaagaagcacuuauggcaauggaagagcuuugcacucuucugguaaaagaugagcuugcccaggcccccggcauccauaucaucacagaacucaggaugaauggagcccauguggagcugcacauucucauaaucggugccucugaaacugcagugcccacacuccaggcuuagcgcugguuuccucaauuccugacacacuuccaucuucugucacacgccguagaacugcacuugaaagacuucaacagugcugcaacagagaaagaaguuauuuccaaaggacucugugcugaacacaauacuguacuugcauaguugugagcccggaauggcauaugcuuuacuaaaaaugucuacaagauuucugagaaaagggagacuaacucuggcugagcacagcacuuggaguuuuauuuggggccucucagguaacucuaaggcugucgcucaagcacacccucuucauuccugcgggaagacauagccguaccuucccagacacugacugacucgcucuagcccagggccaggacuaucaguuucucaagaaucaacucccacuacuuacuguagccuuacacuuaggcccuaagaucuucaaucaacaagcuguccacacacagagcugaugcauaucuaggugacuuaaaucuaggaagaaacuuuagauccuuuccaggaaauuauuaagucuagcuauggaaagauugcaacaugauccuggccuuauuuucuaucaacuuuuggaauauuuuaaccacucuuagaauaaaaacagagaagcugucaaaagggccuuucugagccuacagcucuucagggugucucacagacaucaggcauggaggauacauuuuuagcaaguuuuuuuuuuuuuuuuuuuuuucauuguaaccaguguuacugaggaacuaacuguucuggccauauacaagcacagagcauuuuacacauauggcucacauucaaccuaugcccacgugcuauagagaguaagcauaaaacucccuucuacuuuuuuauaugagaguauuucuauagaaaauaguaaauuacuacuuggcucaaaggcuguuuggauuuuaaaauauaccaugaguacaggugagaaagauucccccaacuccucaaaacugaguaaaacuccuugcuacacgggaagacucucacuccugcuguuuaacgguguuuccuuuuauccuaugaguucguuuauuuuuuuugaaaggcaggcuuuugauagguagcacaguuaaccugcuccuuaccaugcagcccaaggugcguacagcaccauacccagcuuuacuguguuguucuuucaugagaaagacugaacaauuucccuacuagccuuuugucuuuuuaaaaauuagguauugguucauuuucuauaucuaccuuucuuaguuguaaacuuuaauauauaauuacaaagagaacaguccuuaucuaaaauauuuuccagcuuauuauuuaucucauuaacuuuauaguaucuaaccacaaaugguuuuuauaaaacacacacugguuuacauacaaaauuuaaaacauaaggcuuagaaucuggguuucuaagugaugcuuuuuuccccaaccaucuucagagccucacuccgaguaagcuuaucuuuguagucgucuacuagugaguguaaauguucacucuugggaacacugacacagcaggcaccagauauaauuuucaaagcagaagucaggucacuaacuagcacccccucucuuuaaaggguucccuaaagaaauagggcugacaaaagccaacguaacuuugaauggguuaaccugacauaugucggaugucacuaaccuggugacugacugugccagaaaguccacagccagugaauaaggucagcaguuauucuucgaggacucuagcacacuaaggcaacaagcaauaccagagcgugacucuagccucggacuaagugaugcuuuuugugagcccagggucucauuauguagcaguuuggccugcuucccaaacucuugauucaccugccugggccucccauaugcuaggauuacaagcacagcaccucacaugccuucuuaccccgcuauuuuuuaaucauuuaguauguuuuucuaauguuggucauaucauacuuucuaacacucccauccuuugguuuguuguuuuucauuuuaguuuacuuucaauuuuuaauuuuuuuaaaaaaaacuuaccauaaaacuuucauagauauggacauaauccugugucaggcccccaccaaauucaugacuuuuucuuuaauuauuacucuucucucccccuuccccauaccuguggagcucauuuaguguuccuuguauguauguuuuuagggcuagccgcuccaucguggauaagcaauuaggggguuaauccccaggaaagcugauucucucucagcgccugucuagaacucuucaucugggaguuggguuucugagauuuccccaauccacgcuguagcuuaguuuuggcagugcugugaguugaaugcagcgccuugcaagugcugguagaugcucagcccuaagcuccauccuuagcaacaguaaauuugcaucuuuaaucuaccuuuagaaggacagagaaaucuagccuguccuuuuuacccaaaaucagcgguuucaacccuagacuagaaaaccccuuucugucaggaguagugacacacacuuuuaacccugcacuugggaggcagaggcaggcggauuucugaguucgaggccagccuggucuacaaagugaguuccaggacagccagggcuauacauagaaacucugucucgaaaaaccaaacaaaaacaaacaaacccccuuucuuugcuuacuaugcaauguugcguuuaauauuuacuaaguuuuauguuuauucugaacucugguuuuucucucccuauuucucaccacuuucacugcccacucuggcaugcuagcuccuccacacaggaaccaguaacugauaaaacuguagccauuacacacaguaaacucagucauugcaaaaucuucucuucacugucaagggaagugauauaugccugcagacuggcagggcuggccauucaggaagcuaagagcaagaggcucacuugaaccuaagagugaguguugagacuagccugagaaacacaguaagacugugucucuaaaaauaaaucuuacuucccauuaaaggauaacucuacuacuuagugcuacauccauuccaguagugacaagcacaacagguccccgaaaaccugggcacugucccgaggcaaaaaaguucacggaaacuuagucuccuggaauuguggcauccuguauaacgaauacuccaauguccuugcuuuaguugguaaacggaucugugugcuuucccuuaauauugcuuuauuauaagugccucuauuugacauauagcuaaguuagauucuaggcaguccuugauccgaccuugggcauggauagcuaagucacugcccuacacagaaauuuaccauuaucuaggaagaaggaaguuugugaccuaaagaggaaccagaguagauacuuagaacuauagauagcugaguuauacccauacacaguauuuacaauggccuagggggaagguggacuauacaauagacuagaguaggagcuauggcaagggcccuugccccuggcuucuaagauuaaguggaccuuagguagagcuguuuuugaucccaguuguuaacauugaauuuuaucccaguugguuccugccaguccuuccauguuugaauuccuguuuuguguaagaauccaguaaccucauuguaccuugccagcgugucaccuaacuucccuauuuucaucuguauuaaaaaguaugaugcucgggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaaucuuaaaaaaaaaaaguaugaugcucauuuugacaaauuacauucagauccacacucccuugugucgagucuguuugucacuccacuuucccugacuucuuugcccaccuguaaccggaacccuuuugcccguggaucgagaacccaagugagguuugucugggacaauuuagcaaaaguacuggccacugcugaacacauguaugauggaggcaauggugcaaccauacucacauucuuucugagcccucagugagcagcacagauugcagcuucuaaaaauuacaggaucacccuuauuucaaaaucagugaacacaagaauaacauuuuaaauucuguaaguccuauuuuauuaggacuuauauauuaaauauauuauauauuauauaauacauuauuacuaguauugcuguuuugucucacuagguacccaggacuguccuggagcuugccauguagaccaggcuggccuugaacucaugggacucucccuucuucugguucucaagagauggaacuaaagaaaggugguuuuuuuccucuguacaguccauuuuguuacccaacaggcaacccauccacccuuuagaggggucacccuaaagcacaggcaguccuuccuuucaauucccucaaaccuagucagaugcauagucagcauccuaguuaccccagacagcucagcucucauagagccagguucaccccuguagcccuuuccugucccuggcacugugugcucagaaaguacuugaucaguccucagauugcucugugacgacgcagacuuuauaagcaaaggagaccugugugcucgugucaagacaucaagagcuggaaagggggugagaagcccaaggucauccucagcugcacacuguguuccaggccugggacacagaaaagcugucucagaaauaaagcaccaaaaaccccagcugagaaaacucagcccuaacaggaucugcuuaacaucaggcaaaaaagcagagccuggcaaaggacagacgcagacacagcagaggaaagccagcacaaucagcugaggaccccuagcgagcaucuguaauccacacaucaacugcaucaacuguagggcagcccuacaguuuccaagaaugcucuguugagugugugcugcuacugagaugaaagugaauaaauaauaaauaaaugaaaaacaaacaaacaaacuugcagguagaucgcccaccucauucugccaaggggagauuacagguguguaccaccaugucaaguaauccauuacagcuaucuuacuauuaaacuuuuuuuuuuaauucuuuuuuuuuuuuuuuuguuuuuuguuuuuuuaagauagugcuucuccauguagcccuaaauauccuggaacucucucuguacaccaggcuggccuugaacucagagaucugccugucucugccucccaaagcauaugccgccaccaccacccaguagauaaaaauacuuuuaagggucuuuguaagagguguaguuuaauggaauugcacuugccuggcauggguaaggccaagggccugacucaauuauuagcaauagaaagaauggaggcaggguaucggagcaagcugggaaaauacguaaagcacaccauguugacaagcaguauuuaaacauuaucacuuaugaauaucaauaugucacaaagggaaacuauggguaauacagaaaagucuuacuuuuuuagauuuauuuaugugugaguauuuugaacacauuuaugucugugcacagugugugccuggugcucaugaaggucagaagagggcauuggauuccuucaacugaggcuacagacgauugugagccaccaaguagguggugagaauuaaaccuggguucucuacagcaacaaaaagaucucuuagcggcugagccagcucuccagccccagaacauuuuauaaaaugcuuuaucaugaauuggaacaaaguguuugucagcaguaccacacacugagaagcuagcaaucaauacaagaccagaaggacuaagagcucaaccucuuuguuuuacaauagagaaaaaugcucagaguaacucuucuuuucaaauuuuauaagcauuuuugagguuuuucuuuucaauuaaaaaaaauaguuuucauacaguauagucugaucacuuccuaucccucacucuucccagauccuucccaccaacccaaguccaugcccuuucuugaaaguaauucuucaagggcuugacucuugagucuuugcugaacaaugugccuagacuccaguguggauuccagcacuucuaacacuaacuguaaaaagacucuaaaagucugcgcgcuggucccuggugcacucuggcauccgcaccuacucccucccacuuucuuccuggagaccuaauacuaguuauggacaguccugcuuuguuucuugacacagggucucuaggccguccuagcuguccuggaacucaucauguagaccaggcuggccuccaacucacagagcaccacuuuccccugccucccgaguucuuggacgaaaggcaucgagucaccauaccuggucuugauagucccuuaaaaauacacuuugauauauguuuuauguuaaaacuccaacacagaacaugugugagcuuaguggauauguaagcuacacuaguugccaacuuaacacaccugggauacaggaaccucaccugaagaacugucuccaucauagugauuuaauaggcaucuguggagcauuuucuugauuuaugauugaugugggaagcacagcccacgguagcagguacugucccuagguguguaggccuuugcuguauaagaaagggaacugaauugugaguuugggaacaagcuagaacacagcucuacucuguguuuucugcuugaguuccugcccuuaauucccucaacaauggacuauaaccuguaagaugagauugauccuuuccuccccacagguguuuuuugaucacagcaacagaaagcaaccuaggauguuggcacuauuagucuacguauauacuaauaagacuguucuuucuuuuuuuaaaaaaagauucauuauuauacauaaguacacuguagcugucuucagacaccccagaagagggcaucagaucucauuacagaugguugugagccaccaugugguugcugggauuugaacucaggaccuuuggaagagcagucagaccucuuaaccauugagugaucucuccagcccaagacuguuuuuucuuauuauuauuuuauuauauauaaguacacuguagcugucuuacaaaugguugugagccaccacguggucacugggaucugaacucagggccuuuggaagagcagucagugcucccaaccacugagccaccaucucuccagcccauaagacuguucuuuaugaauagccuuuuuuuuuaagguuauacauuuuugacugguuguuuuucuuuaaaaacuacaacaacaacaacacaaagcacaaauaacccuuacguuucuacacguuuuccaauuccauuaacaacuuguguugaucagugagcuaauuuguaacaagugucacuuuuuuguucccaaguccugggauggaacccaaggccucacucuugcuaagcacgggcucaccaucgagccgcagcgucagccuaauuuaggagauccacaguuuacaggagagacagugcauggccacgugugugccacuaacaguguagcuaauggcucugaguuccuuguguucuugacaagcaagauccguugaccuggggguagaacuucugggcaccgagcgaucuuuagauuaauuaaauguuugggaauacuagauuggcaccgguuuacacuccacagucaagugccaaagcgcuggcccuuucucgggaaaacaccccgcuaggcugcagccauccauccgaaaggguaccugggcgaggcuaagcccggauacgguccacguccagagaccuucggagccucgggacagcagcccuaaagcagauuccagaccgauaccgcccccucccauccugugcgccgccacgcaagaaaaacacaaggcuggccccggaggcggagagcaaggaugaggccaccgggcgcuccggccuccaggccgcgccaagcgcaccacggcgcccgcccucccgccgaacccugcagcccguaccgaggcgcccgcccgcccgcuccucaccauccggcgaggcguccugaagugaagaggaggaaacgcccacaggaaacucugggcuggcugugcggccucgggaauggcggcuggacgcaggaccagccgggaaguaccgcgcgcucgcaccggaagugccgucgcgugccuccgggucgcccccuucccccggccccua

SEQ ID NO: 4308 - RNA, 5810 nt, Mus musculus
auaaaauaaauaaaucuuuauuuuaaaaaggauuauauaauuucuggcuuaaagugccauuuaguuuccuuccuuguaaacuaguaaauguuuagccuuuccuucagaggcaacagaaacaagccacacagucaccagugaccccuggguuacaaucccugcuaaaacaugcaggauacacagaagcaaagccaugcgccuucucucucugagaguacuauuuccauccuuaacauguaacucaagggcuuugagagaaggagcaaggcacugaccagaagucauaacuauagggaagagacgcagacagagcauacuaggugauuuuucccuaacuuuauuuauaaagaacacaacucuaacacagacaaaaauuccaacacacuccagaguccauuaacaacaaccaccacaacaacaugccccaguuaaugccugucuauagcccacacugaggagucgcugagaacggacagaguaucucacuugaaacacaggaaacaacuugugaucuggaggacacaaaaacucccccacuccacuguggaaagugacacuucuagucuucggcaucaucaaacuguccuguuucgaagaccaucuuggaguagugugguaugaguggagguggauggugccaacuggggucguauaucaugucucccuguggugcacagcacacccaaggcuugaucucuugggaaaugcuccccuggaugucaucagcaucugcagacaguuuccaagagaugcaagagggagagucaaacuggacugcacagaaaaaugccuaggaaauaaaccugcaaguauuuuaauagaagacacacauauucuugggcaugcaugcacacucgcgugcgcccacacacgcacacacacacacauguccuuuccugaggaaaugcacacaagccacucuaaacaacccauaaaggaauacaaagggacagacagcagaguacuuccaucugcagccgcucagcucaaacacuuuaggagaauuuucuuguuaaagcaaauugacauguuguggauucaguguacuuguuuuuaauacagaaaagaagcagagauuccaguccugggacaauggagcaaugaacaccaucugacuuccacacuguuugccuuuagggccagggugcagggucugagcugcucaggcucaaccccagaggcucccuaccuaccguaaggauuuccuuggucugcuuucagcuccaagucccaguccucauuaaaaagaucugcagccuguuccaugggugggcaggauggacccucugacagcucccaggcauacaacuccccaucagcuuccuucuccacugcaaagccuuccuccucagaacuugggcccucggcaugggcaggaaugucagcagggaugcucugagcuccacuggcuaugaacagacagacaguuuuuaaaaaugauaaacuggaggucugcucauaugguuagaaacuuucugccgggcgugguggcacacgccuuuaaucccagcacucgggaggcagacgcacuuugcggauuucugaguucuaggcuagccuggucuacaaagugaguuccaggacagccagggcuacacagagaaacccugucucggggggaaaaaaaaaaaaaaaaagaaacuuucuaauagccguuuucuaaggaagcaauaaaaaaucuacagauaguucuuucauuacgugagcacuuacugacuggaguauuuaguuuauauuuuagaaaugaaguugaucauuuuuuccaagauguuuugucauaaacaaggccacucagucaguacagaggguaucggcuuauaaaggggacaucuucaggucguuuacagugaacccaauggccucuggcagaguguacuuccgcuauucaagcccaugccccacuuuuccuuuugaagcuuguuagaugcaagugcacaaaggaaaacagaacggagccuguccaguccccguguucuuccuccugaauucagggaagccacacaguaacguaacaaagccuacagaaggacaguagaccuccaaaacauggguugcuauggugauaccaggucugaggaaaggaagcaaguggccugagaacagccaugguguuaagacugucaucacagcuauaacacaauucaguggagagcacggaaucuggagacagacugccucaggucagaucuguucugagcugucugacacugaagguaacuaacccugaauuaccacaugcucuggcaacuccgcuucaaacagugcacacuucagacaagaaaagauguucacugcagcaccauucagccaccaaaugccaccaggggauaaaugauccacaaagugcaggaaaccugguggugggcgugcucagucuugugggugaggggugcugacgcaggcugcuacaggaauggacccuggaaaugugcugagcuggaagaagcaggacguaagagaccaaaauuuccuuuacugugaauucacacuugcauguccauaccagguaauucauuagggguggggagcuaucaguaguuaggggcuugagaacuaaagaguggagagugcuccagagacagggcuuccuuuuggggucgugacaacauccuagagguagcagugacaguuguacacacuaucacagagcggaaugagccaggucauauaguuaauauaguuaacagguaaagccaagucuauaucuuuugcuguauuuuaagacuuuacuauguaccuuaaguuucucauuggugaaauaguccucagauuguugugaguuuauuuagggggaaaaaaggaaacacucagaucugugccugaaacacuuagcaccuacucugaucauacccaugcugucuguacccaggcuguauagaccagugcuacccaguguaacucaguacaucacagagcuacacaguggcagugucauuacagaucuucucauucaacacgacgaaguacccuacuuuaaagauaaagccaucuagagaugaaaaaggcaagcccaaggacuacaaccugggucugaaacugaaacagucuuccuagcuacacacacuagaugcuuuuccucccagugaaauggggugguuuggguccacggucauccaguaccuccucgaagcuucuaaaccaagagucccgcugagacagugggcaaagaagguaacucaguggcuaagugggucagcuagcaagagaagauagacaagacagcgggacugugcugucuccaucucuuccaauggccaccccagccccagucucugccgucuacuugccuagucgauccacggccagcucagucuccgucucccgaccagagaggucagcuguggcaaagccagccuguggaagaagaaauaauuaccaggaacuuggguaguaggacaugucacugcuuugaagcuccaaacccgcccacccauaaugcccugcacgauguagaguuugcacacccuucugaggaccuggcaaggccucagaacagggccuguaggcuacaggcaucacccaggaacacuucuccguucugaccgcugggagugcccuuuugcggugcccaauggacagcugucacagcugucaguuuugcucucagccccaggcccucuucagaagucugggcagcaggacuucuccaagcucagagacccuagagccagaugggacagcucccuggucucggcuuguaaccucaagucuguguguaaacucuuuccucuaaguccaaaaacacuuuaacugcucuaacuucucuuuuuuccuggccaggauugauaguugucuccugaaccugcaacuucucugcacaccuuugcccuucucaggucuuuaugucuaacaacuccuuccaacacagccauuccacagcgguccacgggagaagcagccugaguucuacacacuggaaagaauaccuaaccccgccccccccccaaugccaaccagguaauuuugcggccuguugccucaaaguuccccaaacuuuacuccccccaaggucucucugcaguggaaacaguaauguccagggcuuggaugaucaggcugaugucaguuguugccccaccaugcacguaggcugugaccuuuagauacuggaauggcuguucugaucuggcaggggucguaugauggaggauauuuauaaaacaucuaacauauguuggagacguagcucaguuggucaagugucugccuaguguacacaaagcuacacacugauuuuuccaacacuacauaaaaccaggcauggugggccacucuguaaucugagcauuuaggagauaggugcaggaggaucagaaguccuggccacagagugagcccagcuccugggcuacaugagacccugucucaaaaauauuacaauaaagccaacaauaauaacaaaaccaccuguuagacugcaagaaguaacacuucuuugacuuaaauugcaauauuuauuuuauuuguguauauuugugugugugugaauauaccaggaggauccccuggagagggaguugcagagggcugagacaucuguugugggugcuaagagccaagccaaacucuguaagaccaccauggcugucuuuccagccuucauccugcauguaaauaaacuguacuuagcacucacccuaauuaccguucauuaucuagucaccccugagcuuuaaugacucuaucuccuguaguccgugauaaccacagaccacugcugcccccuauggugcuggaccucuuacuugaaccucacgccuaucucccuacuccugcucacccuuccacuuaaaagcuucgcgagcccuccacugccaucacagaccagcaaugccauucauauugacucucacguuccuuucuguaagaagccugcucuccgacccaagcuccaaggccauuugccuugcccuuucucauauccagaccuuugcugggccuacccucucacccaagaacauccuuuccagauccgcccuaacaacaucacucuccuauuuugcaaaagugauuuucuuugcaaaucuauugguacuugaauagcagcuucaaguaccaucacugaggcucugguaagcguucuauucauucauccaauuaggauacaccaggcauaggugcggcuucugggaaacaggaugucuacagucaagaagcucgcaguagguggaugcaauacgggcaggucauggggaaaggcuguauggcgcgcacuuaaaaacaaguuucugaaaacccgugucacaaggggaccauucguuucaucaaaugggaaaaagcacgggugacaucuggcguccaaggucagcuacacauccccaccaauggccagagguccucaaggugagaaaaaaaaaauccguuuccucgcagcucccaccugacccagcccccugcggcuggagcgggcucagggcagccggcuccgggaagccagcuccgcguucccugcauucacucccgcagaugcuccccagcagccccagugucccucucccuucagcgccagccacagccuagggcucggguccgcgcgcguucccgcgcccacugccguuaccggccaggcucucugcgugcacucgcgcggccccggcguuucccgggugagcggccucccggcagcgcgugaaccccgcgguuucccgccuggguggucgcggaugcccgcgucccccaccccgucgcgcucaccuccgcgcugggggccuccugcgaacuccgcucgcccgggccccgaccgguggcugccugaggguccaugcccggccgcccacagccaggcgccugggacgcuccggcacgugacg

SEQ ID NO: 4309 - RNA, 685 nt, Mus musculus
uggacaccaaauuguaaacauaaggaaguagguuucugagaaacagaccccgcuggagaaaaaaggccggcccacugcgcagcaggcuccggacugcccaguuugaaaagccuucucauuccuuccuuauucucacucugcagcuucaaaagccaagagaugccuaaggagcagcaagaggugguuuuacuggggucaccccacaucucaacuucugcgacagccaccacaaucaacaugccugagaucuccacgccugaccaugugaucuggucccuguucaauacacucuucaugaacuucugcugccugggcuucauagccuaugccuacuccgugaagucuaaggacaggaagauggugggugauacgacuggggcccaggccuucgccuccaccgccaggugccugaacaucagcucccuguucuucaccauccucauggccaucgucgucaucguugucuaugccacuagaugaugugagaugucuugcaacaucucacaguagauaacagauucuggggccucccgggcuugcuauguguuuccuugucuaucacugccccaaacccuagacuuaguccugaccauuugccccauacauaugcaaaugugacacucacaaaucuguccaugguggacucaauaaagugcacgugcugugaaaaaaaaaaaaaagaagg

SEQ ID NO: 4310 - RNA, 685 nt, Mus musculus
ccuucuuuuuuuuuuuuuucacagcacgugcacuuuauugaguccaccauggacagauuugugagugucacauuugcauauguauggggcaaauggucaggacuaagucuaggguuuggggcagugauagacaaggaaacacauagcaagcccgggaggccccagaaucuguuaucuacugugagauguugcaagacaucucacaucaucuaguggcauagacaacgaugacgacgauggccaugaggauggugaagaacagggagcugauguucaggcaccuggcgguggaggcgaaggccugggccccagucguaucacccaccaucuuccuguccuuagacuucacggaguaggcauaggcuaugaagcccaggcagcagaaguucaugaagaguguauugaacagggaccagaucacauggucaggcguggagaucucaggcauguugauugugguggcugucgcagaaguugagauguggggugaccccaguaaaaccaccucuugcugcuccuuaggcaucucuuggcuuuugaagcugcagagugagaauaaggaaggaaugagaaggcuuuucaaacugggcaguccggagccugcugcgcagugggccggccuuuuuucuccagcggggucuguuucucagaaaccuacuuccuuauguuuacaauuuggugucca

SEQ ID NO: 4311 - RNA, 32806 nt, Mus musculus
aucagcgggacgccaaggcggggcguccagcgguggcccucggcgggaggcggacggcuuccggcaauaauuggacgcugcggcucggugugguugguggcugucucgucuggaagggacccgcaggugagaagggccucaggacggggaggggcagucgggcagggcgucccuggcucgcccuccgauguccgccgugcugcuccgggggccccgagcgggcugugggcucguccaaccucgguagaugcaggcguccgccccccaccgccgccggccuguccccugcggguccgugcggccucccgugcacaccugugugugcaccauccuucaggccggcgugugcgcucgccgcgaggcacgcgaaauuugcaucuuuguccucacagcuccuuucugccucuguuccagggcaguuccaucuccaucccugggccuauucaaacuccccagaacucagacgucuggagaacugucccugugaaggccccccaccccccacccuuuuaccugcagcgccaaggcuugauuucccaccauuaucagaaaagaucccccauuuccuucacauuccguuuuccuucguuccugggcauguuguccuacuacgaagcaucugugaugaucucucuagauuccuuggaguaaaccccauuucugacauucagccuaaauauacagugguuuuguuuguuuguuguuguuuguuuuuuuauaugaucuuucacaaucaaauuuacccaccuauacaaacucuucacguuugauccaaguuguuggaauuuaauuuacuugaaaaucuuguaagaaagcuagagcagcggaaaaaucaaaugcuuacuagguugaagaugggcuucauuuuaaaaagggauuuguuacuguuaauuaugagugagccugugugugggcacaugcacgagugccuggggagaccagaggcuuccauccugaugggcuggaguuauggugucagcugccugacuuggcugcugggaaccaagggcggggucuucugcaagagcaguuacagugagugagcucuuaacccgcugacccaucucuccagcccaggccauacauucuuucuuacucuagaacaauggagauuaucguucucgaaauuuuaaaugaaaaaauaagagugaagcuuuuuuucuccaaaagugaaccugccuugcuauuuuuguuauaaacuguuuuauuauaaugccccugcuauacgcucaaagcguuuguuuugaagaugaaggccauugauguacaauccgauuauuuuuuuauguaauuuacaaauagagcaacacacauauaaagccaaaaaauagaagacaaagaacaaaaacgcaaaccacugaaaccuguaauuuccuggaaccuguuuuaauaggcuguuaugauuacuauaaauauagugccuuaagagcauggcuuguggagugagaguccguaauuuugaaucccguccuaugggauucuuugccucuguacugucauggauaaauagaguguuuuguuaugaugcuggugguugaacaaacauagccccuugaauaugcuaagcucgagcugagccuucaaauagagaauuauauuugcaaaguguggcaguuuucuacuuuacagguuagugugaggacuaaacucagugcaauucagugaauuauucagcguuaaugccuggcccauucugaguucuaguguuugcuguaacuguuuucauuaggagaacguguguuuguuguuguuguuguuguugaagaaggagaaggagaagaagaagaagaagaagaagaagaagaagaaaguauauuuugcuuaguucaagaucuuuaguguucguuucuccuaggacauggauuugaagaaaucauccugcucaucugaagugccccacauucaugucccaccaugggaaauagaaacucagaaaagaccuaaagaucuucggccccaagugacuuuuggcauuagcuugacauucuugugcuuaaguuuuaguguguauacgggcaggagagaugacucagugguuaagaagccugcugcucuugcagaggacuagcuuaaguucccagcacccacaugguggcuucccacgggauagaacugcaguuccaggaggauaggaugccuuuguccgaucuacugggcacccauggaugugguacuacacucacgcauacaagcaaagcacucauacacauaaaauaaauauguauauauuuuaaaaggacggauuguauaagcugugucacagcugaguagacucagacauuacucauacauauacauuuucagaaaugauuucuggauuuuacuuuauaugaugguuagacuugguugccaacuugacacaccugggaauagggaaccuuaauuaacuccgugauguuggccucuggcaguggcucucagccuuccuaaugcugugacccuuuaagacagucccucgugcuguagugaacccccagccauaaaauuauuuuuguugcuaguucauaacuguaauuucgcugcuggugugaauugugauauaaauaucugauaugcaggauaugugcuccccaccccaaaggggcugagacccacagguugagagccacuggccuguggccuauuuauugacuguuuucuugacugguaagugucguauggugacccaguguacuugggguuauacagcccugugcaggagggucugagcuauaugaagaaaauacuguggcaagccacagucaugagccaguuagaaguauucugugguugguuucugcuugcauuucugccugacuugcacagaggguguggacuauaaccugugaaaugaaauaaaccauuuuauuaaccauuaaaccauuaaccuuaaaccauuuccauuucuuuuuuuuuuuuuuuuuuuuuuacgauuuauuuaaugaaugugagugcucuguagcuguacauaugguugugagccuucgugugguuguuaggaauugaauuuuaagaccucugcuugcugcggucaaccccguuggcccugcuugcuccggcccaaagcuuuauuuaacauuauacauaauguacauaauguacgcugcagcugucuucaaacgcaccagaagggggcgucagaucucauuacagaugguugugagucaccaugugguugcugggauuugaacucaggaccuucggaagagcagucagugcucuuacccgcugagccaucuccccaggagaccucacaccccaacaaagguuuuagucagaauguuuuaucucugcaacagaaaagaaacuagacugucugagccuuugcaaauucuccaaacaaaggugguuuuaauuuaaauacauuaaugaaaauucuggcaguucaugucuucuaaucaaguagauagauuuccauaaaauguggguugucaucauuuaaaaucuuuuaguaacguuauuuccugaucagacgcuccauaacagguaugaaccuuuuaaauuacgugucuuuuguuuuaugagaaagggucuuuguccagagcccagguuggucuugaacuccugccucagguaccugagugcuaggcuuacaggugugcuuguguaugucgcccauaccuagccccagugguguuuuuguuuguuuguuuuuaguggugcuugggcuugaacccagggccuuaugagcaacuccgcaagcacugugguaccuaccggucuauagccccggauccgggggggccuuuuguuauuguuuaucaauacauuugcucccagaauucgccuuagguuaugaacuauagagacugaacuuuaagcuaguggacugacacugcagucacaagaccgugucaugacaagucugugaaguaaauuguuaagagaacaaauauuuuccuguagguugggaagucagggacauaaggguuuuauuucuaugguuuacuggcugcugugccaguccuuuaaaaaucgaaacacuuagcugaugaagugguuauaccaaacuauuuccucacuaaguuguuuagagaauuacagucgcauagaguuggcaguaaucaaaauauaguuggaaaugccacaguggcucuuuuuauaaauacaguuaauuuuuuuuugaagcuaaaagguaaguauaccuaagagguaguggcugccuagauuagugcaauguuugcauguuaugaagcuuaagguaauuugcuagcuguggacacggguuuaccuaagacaaaggugaggaacuguugguucaggaggguuguuuguuuuguuuuguuuuguuuuguuuuuuccuguuuuguucuuccuuuucauuuugugcuacagacccuagaacauugucuuucuaagcauacucuucauaagagcacauugcucaaaaaugaagucucagaggucggagucucucacgguccuagucacaguucuaggacgucagcacaaccagacuucuguucagugugucaaagcugggaccuacacugcauccuucaucuucuccccaggugccugucacugcuguugcucaagcucgagucuccauuuauuugcaugcacgcaugcaugcauacauacauacauacauacauacauguguagccauguuccguugucaggagcuuccuagcuaugcugccuuucucucuaguuucucuccuuaucacguaugguauucauacucuagucuguguguguacacguaauucauaacucauguaugugaguugucuuugaauguucucaucuuacuauuuuaguuccugugcugggcugcuucccauaggcaggugugacaucucauuacuuagucuauguccagugguuaucauucaaacaguccuucaucuaaucauuaggaacuuuaaggauuuccaggguugguuuauuuugcucuggaccauuucucugugaaauggcaguugggggaguugcuugugacagccaugugugcuuaggcugagguuucuguguaaaguuucccucacgucuccuguccucuaaaguguucucugccccaauccugaacguuguugacaaucugauaagucuggauugacggaaugugguggugaacuuugcauuuugagauuaaugguagcuaugaaauagguuuguaauauaaaagguuuaaaaaucuaaagaacauuuuguuaugcacccccugaugcaggauuuuaaucgauacacaggagaagaagacguguaaagcagguuagaaggggcuugcauuccuuuugguauaaaaaacaaaaacaaaaugaguuuagcaugcauuucacauacuaggccaggacuucuugaagauaauucguggguaguguugaaaucuacauaguuuccuuucuguuuguuucuuauaauauagaauaaaugucuauugguaaccuggccuuugcugguuaauguaaauagaguucgagaucucccaaguccucaaagcgaugaaauaccugcuuugauuggcuugucuuuucagugcugaggauauuaaacugagaaccucauccuuauuaggcagaugcccugccacuuacuugcgaaugggauagggaccuccguucugauguaaauacugugugucugaggauccaggcugcucugcugaaguucugugcaaaucaaagcauccucuauaacuaaacuaaaaacuguccacccgugaaccccagugucguauggcuucuugauaauauuucuccugucaucccuuucucuaaaugugcucuuugguuggcuccugccuuucucuccacagccucagucuucuucgcaggucccuucccuggcuugucuccauccauuucccgucacccguuguguucuuucuuuuuuuucuaaagguuuauuuuauuuauguaaguacacugaggcugucuucagacucaccagaagagggcaugggaucccacuacagaugguugugaaccuccaugugguugcugggaauugaacucaggaccucuggaagagcagucagugcucuuacccgcugagccaucuagaacuccuuccucugccaccuucguuuuucccaugcugcugagucguaggaugccaugcgcuucugagauauguuuacugaacucuggcugugccugaaauugcucugguaauuggguagaacacuaagcaagacauugcauucucuuggaggagaagauaaaugauuucaggugacaguggcagagacggaugaagcggguggagauguggaagggccuuguuugcaugaagagaccagcuaagccucuguagggagacggcaucuugaauauguaagcgugacuagcuggggcuguuuuuuacauucaguauguaugcgagucaccuuuggaccuuaauacucagugggcaucccugccccugccacucccaagccugcugcucugcugugugccugccggagagcucagugguuaggagcacuugcugcucuugcagacggccuagguucacuucccagcaccuacauggcaccauugugccugacugacugcuucaguguggcucggguugcacccccaguccgcugcccuugacucaguguaaagcacaggucugaucagaucguuugccuuccaacugccugccucugguuuucuuagaaugaagccaggcuccuuccuucuucuggucucaugccuugucugacuuccugaccauaguccacuccgacguucugucucugaugucuggaauaagcggggauugauucaguugguugccacauaccacugcacagggguggaagggguggggaccgcuguuuagaauggaauuccucagccggcucaggacacaucgucugccagugcgaccgccugugcuuaacccaguuaccacuucaguacagaguacuguacaacccucacugcuugcucgccacggcuagccagugcugagacacaugcauucacauguaaagaguuccaaaugagaaaaaauuguguuuuuuauguguaugcaacuuuaaaaaaaugauuuauuuauuuauuuauuuuauguaugugaguacacugucgcugucuucagacacaccagaagagguucucaggucccauugcagaugguugugagcuaccaugugguugcugggauuugaacucaggaccucugggagagcagucagugcucuuaaccgcugagccaucucuccagucccuguguauaacuuuuaaugaaaacugauuuuuuuuuuuuuaauuuucuaccuuacaggagcacgaugccguuucugggucaggacuggagguccccuggauggagcuggauuaaaaccgaggauggguggaaaaggugugaccccuguagccacgagcucaggagcgaggauagccaguacaccaucaaccacagcaugugagucccugugaggcccugucgcugcugucagccucugcauuugucagcucacggcagagcguggucaccuaccacuuugcccaccuuucugucuaggcgugucucguccacgacagucaucgguuaaaggagucgucagucauacccagcuugcacgugggugcugaggauucgaccucagucuuccugcuuguccaugcgcucaguguggacuggugguguuccuuugugcuuaaggcuguugccuugugcggaucagucacguuuguucaugugugcuguuuugguagccguggggaaugcccggacaugucacaguugucacuagagcuguuaggagugcgggaguguggacaucucaagacugugcuuucaaucccuuugguugagaugguaacucgcucaguguuauaaagaccugggugugcuguuccaugcuggcuguaccguuauauguuuccagcacuggugcuuaaaggcucuugcugucuacauccuccccaaagcucacuugcuguacuuuuggacgguauaguagccaucuuaauggaggucagggauuauggcauuuuaaucugauuuccuugagaaugaugcugcccauauguucguguguccuuaggccguuugcauugcuuccuuggagaaauaguaaaguuuucugccugcccuaaggggauuuauuguugaaauucucucucuuucuuccuuccuuccuuucuuucuuucuuucuuucuuucuuucuuucucucucucucccuccuucccucccucccucccuccauucauucauucauucauucauccauuuauuuauuuauuuauuuuauguaugugaguacacugcuacugucuucagacacaccagaagagggcauuacagaucccauuacagaugauugagagccacuaugugguugcugggaauugaauucaggaccucugggaaagcagucagagcucuuaacugcugagccaucucuccagcccucccuccucuuccuccuccuuuuuuuuuuuucuaaaaaaaagcuggauaagggacauucaucuuagucauaugaccaaagguuauaaaaauagggaguguuugcucuaaauuguaguuaacugauaguuuauauacaugaaaaaacugaaagguuuguacaauauaaauaauuuuauuaacauuuauacacauuaaauuuuaauccuggaagcauuuuuucuucacuuuuagauuuucauaaaccuggcuauaaaaaaaaucaccaaaaagugugaccuuccuaccucaaaaugcauuauaaaaauagcagcugguuaauaauuuccucaguguaggcauuguucuuuauccugaccucugggucuccuguggcuccauucccaaguccucugauucccauccaacaccaggcagaagcacucagcaguggccauugugccagcaacgucaguggugugggagcugccacagccaggugguguggggccugcagccaggugugggucugccgcagccaggugugggggcugcagccagguguugugggaccgcagccaggugugggucugccgcagccaggugugggggcugccacagccaggugugggucugccgcagccagguguaggggcugcagccaggugguguggggcuacagccaggugugggggcugccacagccaggugugggucugccgcagccaggugugggggcugcagccaggugguguggggccgcagccagguguaggggcugccacagccugugcgugacucaguggaaaugaguguucccugcaccugaugguggcauguuaaauagccuacagcuccugcacauggcgcuccagccuaggaagcugacuggauguccucuucuguggccucccauuucugugacacugcuucaggagagcaguagccgaucauuuuuccuuugauaaguuugugacuuuaguuagaaagcuuuuucagauucaaaacgaucuaguguuugaaucggugugaauagaccagcacuagaguaaguauaagaucaucagauucaaggccuugugugugcucuggagugggugucaugacucggcugugacaggauguaguuguguguuugaggugcucucuggcugcuuggugauuggccgccauugucugcguuguuuccuuacugacagggacggacagacuuaauguggcaaacucagcuguuugauuaaaagugcacacugcagugggugaagcguggcuuucacacagucuucucaucaggagcagugacagggaaaugagcgagcacuguuaaaucggugguuuccagugccauuauacacaggcuccaccagccagccuggauccacgacacuuuuuucccugccuuagaccaaaaauuaacugcagcguguccaaaaaaaugggauuuuaguuuucaugguguggauuacuguuauacuuuuuguuuguuuguuuguuugaggcaggguuucauuguguagaccuggcugucauggaacucguucuguagacugggcugguauaguuuuaauuauuacaaggagaaaacuucguuuuaaagaaaagauguuuguauugucaugacuugacuugaaguuucauaaaaaaugaaaaugcuaaaauauuuuaaauguauuuaaauaucauaaagguaacuuugauccgucugguucuauuaaguacuuugaaauauuugauagaugcuuauagaaaaaaugcauagcacagcagccgucagggucagugcagcagcagucaggucagugcagcagcagucagggucagugcagcagcagucagggucagugcagcagcaggcagggucagugcagcagcaggcagggucagugcagcagcaggcaggucagugcagcagcaggcagggucagugcagcagcaggcagggucagugcugcagcaggcagggucagugcagcagcaggcagggucagugcagcagcaggcagggucagugcagcagcaggcagggucagugcagcagcaggcagggucaguguagcagcaggcagggucagugcagcagcagucaggucagugcagcagcaggcagggucagugcagcagcagucaggucagugcagcagcagucaggucagugcagcagcaggcagggucagugcagcagcagucaggucagugcagcagcagucaggucagugcagcagcaggcagggucagugcagcaggcaggucagugcagcagcagucaggucagugcagcagcagucaggucagugcagcagcaggcagggucagugcuacagaaggcagggucagugcagcagcaggcaggucagugcagcagcaggcagggucagugcagcagcaggcagggucagugcagcagcaggcagggucagugcagcagcaggcagggucagugcagcagcaggcagggucagugcagcagcaggcagggucagugcagcagcaggcagggucagugcagcagcagucaggucagugcagcagcaggcagggucagugcagcagcagucaggucagugcagcagcagucaggucagugcagcagcaggcagggucagugcagcaggcaggucagugcagcagcagucaggucagugcagcagcagucaggucagugcagcagcaggcaggucagugcagcagcaggcagggucagugcagcagcagucaggucagugcagcagcagucagggucagugcagcagcaggcagggucagugcugcagcaggcagggucagugcagcagcagacaggucagugcugcagcagucaggucagugcagcagcaggcaggucagugcagcaacaggcagggucagugcugcagcagucagggucagugcagcagcagucaggucagugcagcagcaggcagggucagugcugcagcagucagggucagugcagcagcaggcagggucagugcagcagcaggcagggucagugcagcagcaggcaggucagugcagcagcaggcagggucagugcagcagcaggcagggucagugcagcagcaggcagggucagugcagcaggcaggucagugcagcagcaggcagggucagugcagcagcaggcagggucagcgcaggagcaggcagggucagugcugcagcagucaggucagugcagcaguagucaggucaguguagcagcaggcagggucagugcagcagcaggcagggucagugcagcagcaggcagggucagugcagcagcaggcaggucagugcagcagcaggcaggucagugcagcagcaggcagggucagugcagcagcaggcaggucagugcagcagcaggcagggucagugcagcagcagucaggucagugcagcagcaggcagguuagugcagcagcagucagggucagugcagcagcaggcagguuagugcagcagcagucagggucagugcagcagcagucaggucagugcagcagcaggcagggucagugcuacagaaggcagggucagugcagcagcaggcaggucugugcagcagcaggcagggucagugcagcaggcaggucagugcagcagcaggcagggucagugcagcagcaggcagggucagugcagcagcaggcagggucagugcagcagcagucaggucagugcagcagcaggcagggucauugcagcaggcaggucagugcagcagcaggcagggucagugcagcagcagucaggucagugcagcagcagucaggucagugcagcaguagucaggucagugcagcagcaggcagggucagugcagcagcagucaggucagugcagcagcaggcagggucagugcagcagcaggcagggucagugcagcagcaggcagggucagcgcaggagcaggcagggucagugcugcagcagucaggucagugcagcaguagucaggucaguguagcagcaggcagggucagugcagcagcaggcagggucagugcagcagcaggcagggucagugcagcagcaggcaggucagugcagcagcaggcagggucagugcagcagcaggcagggucagugcagcagcaggcaggucagugcagcagcaggcagggucagugcagcagcagucaggucagugcagcagcaggcagguuagugcagcagcaggcagggucagugcagcagcaggcaggucagugcagcagcaggcagggucagugcagcagcaggcaggucagugcagcagcaggcaggucagugcagcagcaggcagggucagugcagcagcaggcugggucagugcugcagcaggcagggucagugcagcagcaggcagggucagugcagcaggcaggucagugcagcagcaggcagggucagugcagcaggcagggucagugcagcagcaggcagggucagugcagcaguaguuuauaucagcacagcaguaguuauuaucagcccaauaucugaaaaguguagaugauaaacaagaacagaauguuuacucagcuuccauuggggacauagcaauuuuaaugucauagucauauugcuacuaggauucuguucauggcuuuuaugguuguuuauaaaugcuuaggucuuaaagucuuauaauguuugggagauucuaaagcccaucucccuuucuggaguaauguuuuuuaaaagaaauacgaauaaaucuuaguuccuuccaaaugaaaaacaaaugaacguaggauccccugaguuuccagcucucagcuuccuuguaguuuagcucgugcucgucaggguuaguagcaacuuuauuuugauccccaaauuaccaaucaaacacucccuuagcaaagacgugguaaaugaauuucuccaugaaaaacuuaauuaaugaagcaucuuuauuucaguaucuuaaauaguggugaagaagaaauauucaacaaugagugugaauacgcagccaaaaagaggaagaaggaacauuuuggaaaugacacagcugcucacaguaagaguguuuucaugauaagucuagacuuuuacguauuuaauguauaugcuaccacaaugaauugcacggcagugcucugugaggcacaggggcggaggugugcgcucacacacugugcucagugcugcccaugugucuggggcagacugcugacagcucagcugugugcuugguaagguuuaugcaucaaacauggcaagccugaggcucaugucugcuucugaguggccagguauggcccugugcugaguuucuuucugagcaggaaggccccuaggagggauugucuagauguggggacauggagagcgagcacaggagccagcgcugggcagagcugggacagagggcagugguggaaugguagacgggcuugaggaaguucugucacagcucugcccaccuuggcacauggcacgaguaccuguuaaggugagaagaagguggagccaugugaagcagcuucauggucuuacucaugugcaccauguauggcugucacaggcgguaagaccaggaccuucuaguugguauacagugacacagagauaagguaggauuucuuaagcauuuauacuuugguacaaaaauagcaauuuucuucuaaguuaauaaaguaugguagugucaaaauuaauaacuuuucauggacaggagucuaaguacuuccaugauauuagggaauaaagugcauuuuaacacuuauccaagcagaggcaucucuuagcuggaacagggagucaauguuagcaugcccugucaucagagugucccuaaaauacugagguugagaugacuuuccagguuuuaaagacauuucaucuuuguucuagguuuuuaucgugaaaaauggaucuacguccauaaggaaagcacaaaggaaguaagugugcauuaaaggagugugcaauguaaguaagugaguaagugugcauuagaggagugugcaauguaaggaaggaagugugcauuagaggagugugcaauguauuguuucuguugaguaugccacagggauuagucauguuauaauucauaauuauauucauuagcaacaugaggucaccacaaaugccaugagccccuccuuccacaaugcaaaguugcucaugggaagcuacaucgaggcuggcucugcagaacgcuguggacuuuuaucuguaugugauugcuaagcugagucacucuaagggugcaguuuuacauuacacaaguaugagguuaggguuaguuaaauguuccagaaaugguaauaucuuuuuuuuuuaauuuaucacauuuauuuauucagagugugugugugugugugugugugugugugugugugugugugcgcgcuuaccuguuaugguagggaugggaaggucuacuuguaggagaacuuguaggcgucagcuuucuccuucuacuguagguccugggacuugaacuccaguuguuagacuuuguggcagguaccuucccagugaugucuuuaaacuaucucagcuuccuagaagauacuugauugugggaaagaaagcuuacuuggugaugguuacuguccuuaaagugguuguccaaugaguccaguccuugacauacauacuacugaaagacugucagagcuaaccuaauuguacaaagccaagcucaauuaaauaucgccccuacuuugugagucguguggauuccaucugggaaaagcaacaaggggagguuguuaggagacugccaggguguccugugacuucgugggauggggucugauguuaggagauugccaaggcauccugugccauccuucaucccuguagugacccaggucguugcagacaggugcuccugaguacaugcuaaccuuguacugugugagggucgucaccgcggagagauguccucaccaccauaagguuuuuccuuaaagugagauauaccucagauucuacacugugcucuacccuuuguuccccacaacuccacagcagugcuugguguguugcacacacugagaaaacgugggucucaguguuuccugugagugugugguuggguuguacacguuagggcuguucuuagagcugugucgucuccccacgcgaucaacagauccguugcugucuccacugcuccucagcagcccuggcaaccuuucacucagaguccccugugguuccuuacugcccugcagcucaccugcccccaaaacucucaacuggaaaucuguguaguguacguauuucagaugcagaaggaagguuuuaagaucuguccugaccugaggugaaauccauacagaucgauacagaaaacaaaagagauuucagacagaaugccaauaguuuacuuauauuucacccuugauucccagaccucuguaucucauuguaguaguuggcuuuuggcgugcucagcucacaugaucccagcuugggucauauacccucaggccugcucacaccuguuuuucagagaugccuccgguugccaguggcccccguaaggcucacuccuuggugguuggacacauuuccagcagagcagugagaauucccugcagagaauugcucccugaguguguacagcaccagaucccgaggccuccuguccucccacccccucccccuuguccccagcaacagaaagcagaguggaguuucacuaguacucacucuagcagcaaugugaaaaacugccgugccuccugucucaguaacacacaguuggcuuacguuuaguauugcugucuuugcucuguucucauuuaugucugacauggguuuuagaacuaauacaaauaccuuucacuagaggcuuuuaugcccuagccggugucagauguugacugacuuuccuuggcuggcugacgucccugccugucugaugucuuguagaggcauggcuacugcacccugggagaagccuucaaccggcuagacuucucaagugccauucaggacaucaggagguucacuuacguggucaaaguaagugguucuugcggaagcagcuuugaugacucccgaaugacuaguuugaagguuacagguaugagauuacauaacgggucaccugucuauguacagaaaggaaagggacagcucaggagaagauauggagggggguugcaacacuuaggucacaguugcaagucccagaggccacaggaacuaagacauugcaggguccuuuucuuggaaaugccucccacguuugagcucaugaggaccccugaugguuccacaugcauguuccacuucucguguucacccggaaugagccuuguuguauacacaggaacaacuggccaguagacaagaggauuucauaaggacuagaacuccagaaagucucccugcaguacugacggcuguugaggaguuucugccuugggcgaucuucagaagggcgaggucuuugcugugauagcucucaugcaguuugcuuuugucuguggcucauccacgccacugcauuguggguaaagcaccagucaggcuucacaccggccggcccguucccagugcugccagaagacucucacugccuccuaggcgguuagaaguguugcugcaggacagagaugugagacuggauggcucuugaccuccgcuagugugauauguaaugugugauucuagacagcacgggugggugcaggcgaggcagccacggcgucuucugguguccaguguacacagggcaguggccccugaccuccugcagggcauccaaguccgcugcccuggugauggaccuuguuuaggaguggaggaguuaagcauccagggaggacacaggccagcgcucacaguaccagugcugccagcucuaaaagaccucuguaaauaauccucuuuacaaaguagaagugacagugacgggggcuggagagauggcucagugguuaagagcaccgacugcucuuccagaguucaauucccagcaaccacaugguggcucacaaccaucuguaaugggaucugaugcccucuccuggugagucugaagacagugacagugcacucauauacauaaaauauaaaauaaguaaaucuuuaaaaauaaaacaaaaccaaaaaaaaguagaagugacuuauucuguuucuaaauaagaaguuuucuuaaaagagucaggacuuaugccuauucagaagauaauuaacccugcccugcuggcugggugucagcuuccuggugcugcgaugaaauacucugacaaaaagcaacaugagggaugaagggucuuguuucagaucacagggagcuuuggugugccacucacugugguggcagcgcugggcuggcuuguguguccucagugguggccgcccugggcuggcuccuguguccucaguggcagcaguccugggcuggcucguguguccuuagcccuuugguuccuucuacacuuguuuguuaugguuggagguuguuggguuugagcaaaugcuccuucuguguuuauugagaggauugugaguuuuccuacacuguuaaugugcaugcggcugacugguuucccaugagaaauggcucccuucauuuuaggaguccugagugguggugaaaggcuugcugugcagcugguuucuguguccuggaauugggcaagggagcagauuuuaguaugguuuguuuguugguuugauuuuuuuuuuuuaaauaggguuuuguccuguaguggcuuguugauuuugucuucuaauuugcuuuuggucaauaccaaauaugcaagucucauggugugcauuuggaagacguccuugccuucuuggaauguuuugagaagaaauggcauugguucuuuacaugugugguagcacucagcggcagagcugugugacccaggguguuuccuugggaacccuugucacacugccucagucuugcuguccaccacagcucuguugaggguccguugugcugugaggcauucuccggcuaagaugagagcaaacuaugguccagauguuaucccaugccacagagcuguggaagggaggagagacaagaaggugacagguuuguugugacuuggaacaggcaacugacauagcuggauguuuccucugcagcccgagagggcaagagagucauguagucauguauuacagaagugccuuaugaacagaagaauggaagcccuccugaggaguuucuguaaguuauaaagacaugucagaauuaagccaaaccuuuacuguaucaguagacgcuaacaaguuggugaagugaauguuucuaguuugggucaaaaaguaucccagcuccaagucaugcauaguaaauccccaggauguaggaaccugauguugggaaagagagugggaagauacaaguaagagcggagaggagcggaagcaggggaggacacagcaggcccugugcagagccagcaaggcucaguguguaacagacggugguugugcggccgcgggaggcaccggcggcagggagagcccuugucuuuccaucaugguuggcgucacuuagauccucacauugaucuuccuugguucccugauuuucuucaguguuugaaguggcaccugaagagcuugggugugacaaucuuuuaaaaucucaacuuagaaggaagcuuuugacagugggucagagcaugaaggagcguguggagagucugcuagugacuaggacccucgcagcuaggaggccgagugucuauuuaucucaccggcccauagcggaccuguggagacucuugagcagcacagaaagcaggucuccuuaccucaggagcuggagucguccccaccauacacagagagcaggccuucccugaaaccaccuuacuggagucuucauaucagugcaucucacaccgagcuccacugggugaccacgguguuuccauaguuaacaggcggcuuaacguuucucuuuuuucuucaagcuacugcagcuaauugcgaagucccaguuaaccucacugaguggaguggcacagaagaacuacuucaacauuuuggauaaaaucguccaaaaggguaugauuauuacuggaauauuuguugucuuuuuuaaaauaaaauauuuauugauuaauaauucacagaguauacaaccuggccauuuacacauucauuaauucuuaaugcagcauauucauaggagugggaagccauugcugauuuuaauuuuauaacauuucugacaguuacaugucauaggaucagguaggcaagccuuugcagcauuuucuaaauuagcgauuuaugggggagggcccaacccauuguggguggugccaucccugggcugaugggauugggugcuauaaggaagcagacugagcaagccaugaggagcaagccagugagcagcaccccuccauggccucugugucagcuccugccuccaggugccugcccugucuauuuccuuggguggugaacaaugauguagaaguaugagcugaauaaacccuuuccuccccagguugcuuugaucaugguggguuguuuguuuguuuguuuuuugguuuuuuguuuuuuguuuugguuuuuugagacaggguuucucuguauagcccuggcuauccuggaacucacucuguagaccaggcuggccucgaacccagaaauccaccugccucugccucccgagugcugggauuaaaggcgugcgccaccacgccuggcuugaucaugguguuuuaucacagcaguaguaacuaagaugcuuccucacccccuucucccccuggucccccuccuacuuaggcaggcagccauagccgcugagugccugugacugcaguggccaugguguguuuagaaggcggcauuucgucgcacuccucccuguccguuggggucuuacagacuuuucauuuauguuugagcacuaaguggucacauccccaucagcuggacucgugaagcaucgcugucuuagccaccacucagugcagagauaggcugcucugcccaggcucagagcgacacugggcugugacuauaaaagucaauacuggaaacagucuaacguguccguccagcaaagcuguagucauaaguccguccugccagcccaccccaaggccugucgucucuccagccacaggcuugugagcaggucuacaguaccagacugacaucuccugccauggagcaaacucugaaauccaguuagucagaaaggaguuaguuguccccacacagagcaaacacugaaauccagucaaucaggaaggaguugguugccccucccuccccccaugccauuauugcaccugcagcaccagaacuuugaagucuaaaucuuaacuggaaacuuggugcagggcgaggggcuuuuucugacaccagucuagaagauaggucucuccagcagcuaagccuugugcucccuccaaggaaagagguaaucccagagaggcccaguccuacaaagguccuuguccuuucaugguuaaccagucacaguucauucaacccuuggguuccguaaucccuaagauugcagcuuugugacuuaggcaccgugugagucauacuuuccuuuucauuuaauacaccuuuaccuguuagugacgauaaguaaaagggacuuuacucucuguguauacgcuaguguauaugagcuguuuuaaauauucuccuuaucauaaguauaaaagaaaacguacacugacuacuuuacaggcaaaauuguagacccaaccaaaaauuuagucagguagcauuuuaaagcuuuuaaaauucuuauuauuaacaguuguuauaucugaaaaaugaugccacuuuuaaacugccaugaagugagcuccuuguuuuuuaauaugauaaaauacauauggcauaaaauuuaucacuuucaacaauuuucagcauacuguucaauagcacugcaugcauguacaucgcagccacugcuauguccagaauggcuucucuguaccugauacccugcccccaccacuuuccccuggccagucccuccuccuaccccaucauugcaucugugccugcuggcugcggaaauggugugcacggagucauacaguguccuucccacgucaaacuucuuguuugagcucaugacacacaccggucaggauuuccuucaccucuuagcuugaguaauaucccagugcgugaaggggucacguuuugcuauuucuucuucugucgacagacguuugggcuauaaacuuagacagcguuaacaguaguccuugcuugguuuugguuuuucaguucuugaugaccaucagaacccucgccugaucaaaggccuccuccaggaccugagcuccacccuuggcauccuggugagagggguggggaagucagugcuagucgggaacaucaacaucuggaucugccgccuggagaccguccucagcuggcagcagcagcugcagaaccuccaggugacaaagguagguuucuuuucuuuguuugguuuuggggguuuucuuuucuuuuccuugucucucucuucuuuuccuuuccuuuccuuuccuuuccuuuccuuuccuuuccuuuccuuuccuuuccuuuccucucucucucucucucucucucucucucucucucucucucucuuucuuucuuucuuucuuucuuuuuuuuuccccagagacaggauuuugcuauguaucucugacuggcuuuguagaccaggcuggccuugaacucagagauccaccugccucugccuuuggagugcugggauuaaaggugagccccgucacaccugaccuaaauuuauuuuuauuugacacaaaaauuguauguacauaggagaugcaauguggugcuuuauagaucugugauguguaaagacuacaucagggcaguuggcagccaucaccucguguauucaucagcucucugagguuuucagagcguuguuguuagcggugauaugccacugugcuaaugagcaguagacgucaucucuccuauccugggcccauuagccauguauucccuacccuuuucuguccgucuuuccccagauucuggcuaccacuguuucacacucuacuucuuugagaccaguuuuuuccuuccagcauguaacuuagaacaugcgguauuuuguuuuacuauucuugacuucuuucauagaacaggauaacccaugguuccguucauacugcagaagaugacaguauuucauuucuucuguggcugaguaauauauaacauauuuucucuauuaagucacguccaaaaaaaaaaaaaaaaaagucacguccaugggcacuaggcugaccccaggucuuggcuaccaugaauccugcuacucuaagcacgugacuucaguucccuuggauggaugcauacagcauugcgggucacauggccguucuguuucuguugucucaggagccuccccacagcucuucucuuugcuuauucacacccaucugccaacaguccugagacuuccccugcaccagcucagcacugcauuugucauuugcaucucucaugauuagauuagugaugcuggcugucugcauauccucuggaggugugucauccagcuaauccacccuucccugaguccugcacuucccuagcaucuguacauuaaccuaucagaccaacagcuggcagcuguccucacccuccguguugggcgucuuucucccucucugugcuacagaagcuuguuugcuuuguguuaaccauauuguacgucauaaacacgcucagugucagugaggaggaagcugagauuuaacaguagauacagauagagcugggaggccgcacagacaccaggccugucccugggugaaccgcagcgcagcccauguucacuucacuugcugccaugaagcagggucgaugucaucagcaguuccacauuucagauccaccguuuucuagguauuuuucuaguuaaaauagagcaggggcaggcauguccaaggauaacuuccugagcacagggaaaucgcuaugugccagccccaugagacgaugcuaugugguagcccccaugagaccacccugcagagcagugaagaagacugaagugaccgucagagcacauggccucuucgcuguagucuugcugaagcugucucuacagcauggccauuguguuuuguugcaggaagccccuguguuuucuccacgugacaccgcugugcuuccuuucagcagguaaacacuggccucacacucagugaccugccccugcacaugcugaacaacauccuguaccguuucucagauggcugggacauugucacccugggccagguaacaccaacccuguacaugcucagugaagacaggcggcuguggaagcgacugugucaguaccacuuugcugagcagcaggugagugcgggcagcuggccuugcugcuuguggguucuucuuucuuccuuccuucuccaccuuccagcccucuaacacuagauaaggaggaaggaaggauagagcgaaauggagagagacugugaaugccaucggucugguuggaaagggagugacauuauuguuagacgacuuccugaugaauaggagugucgguucuguggggcagugugaucuucaccaucaggaugauaucugauuucuccuuguuucuuuuuugcucacaacuguuuaacaaaugguaacccaauaacaaccacccacccaccauuguucaaccaacaacccaacccaaucccuccacccccaaggcuucuuggggcccuagcauuuauacccucugaaaaaccccuagaauuccagaccuuacacgguugcagaaacuaucuacagcugguaaagucauagcccggcuagaguacgaggcaagucacagucagcugcuguggauagucugaagcagccccguaucccacaccuggguuaaaacaaaaccauagucccacgauauuccugugguuuuuaaagaaaccaagaucuaacuaaagugugcaggucagucccugagucaggccagcuggccaccauccuuugcccucgaaugaagguggggagcacuugauagcagcuagaggauaccaaaguugcuucugaauuguaucaauuacaaggcucauguuucauauugaaaaggaaucaugauucuaaaaauguccuaguaccaaauuacuuaacuagcugaguuguguccugucuccugggaaaggucacaguggucucuuucccugaugagucccacucuggcucugcccccuccugucagccugucguccuugcaguucccgugcuucccacuugguggcaccaucuugagguccugugucuugcuaguugaugcuccugcuccagagugaaauccccaccuuugcguuucugcagcaugugggcauccuggcucacugcaucaagcagugccuguuucauucaaggauaggaagcagcgagugaugcauugucugucuuacggauguggacauaccugggaugcuggagcauugugacgugggggccagagugugccugguucacggcagaugugggcagagcagaaagcaggucccaucagaagaaggaaucaggggucuuagccacagcugagauuccacccagcuuaaaaaguccagcaaagcaccuggaacacagggcaccuuuuauauggcucucaggaucuugcuugagagaaacacugguguggacaucaaaggcgguagucaggggugauguacgugcccagccaggacccuaggaaaguccuaagcagagccccaaggagaugcccagacccagagugagccugugagagcgcaggaagcucuggguucucaggcauggagcagugcagccaggaugcugcagaugggugagcauggaacuggguccaugggacugggcugugcagaggcugggccugagaauggcucgguaggcaggcuagcccaccuagcaagaggcauagcuacuccaucugagugggaguggacguccauugcucccugcauccuuagccauccugacucuuccuacucucuucuuaucucuuucucagcggcaacuguguuuccgcccccuccuuuuugagauuagauuugagcuggcaucagaaaugcaggagagagugguugaucuuuuggaggaaauauuuagagccauggauagagugaugaauaaaugucugucuaggaugggcccugugcaucacacauugcucugggaccuaccuccaaggauaccauagggcaaggccagggcucggccugggccaccagaaccccuggcaggcguuauauauccagacgucacacguccuucaggaaaucggcugacuguugguuugugaguccuggaaguuccuugaugaaagacuguaaagguuaaaggucuguuuacaacaguguucaccuucuauaagaacuuagaguagaaucauccguuagcaccugugagagcgucuuuugaugcauauuuucuugauugaaucacaaaacugaacugugagauguuaccaguucuucaagagugacuaacagcagcaggcuccugguuucucaggaucagcaguagcuuacagccagggcaggguccggccagcacugcaggcuaggaaacaccucaaugaagcugaaggcuguguagguccugggucagcuguuuguagugacagcagcaggagccacuggcaagaugugugugaugugagcagcugacguagaugugagacgugaguaacaaaaagaccccagguucuuaugcagaggagaaacacccgggcaugugggcguuccuccugggaacacugggcauggagccgugaggagggaaggcagagguauuuuugucucuagcucauguuuccauggugcuuaaaggacacggagagcgcuccagccaggccugugacggccccucugcucuucaggcugucuuagaaaucagagucccucauuggcuccauuauuauuuccaaacgaaguccuuaaaagguguggcugguuacauguuguacaagagauuguuuucaguaauaagaagcgaaacacuccuaaaaggccauagcacacuuagacaagggcaucuuuuccuaaaugaucgaggacgugccuauuggcuccgcaguuccgaugcacgcagaccugaucuagcaugggucuuguuuucucauggcccaaguuacauugcccacacccuuugguaacaccucacucagaugcuacccgguuugugucucugucacugugcuugguguugggacaccauuguugccucaggaaccuugugccauuggcugucgucucagccucccuccagcccgaagcaaccccucaucugcuuucugacugaauuucccggucuggauugugguguaagcagaauauucaccaguaaggcuuuugugacugcgcuccacucccauagugcccuucaugauguaucuguagcaggaaguaaagcuucauuccuuuggggacuacagaguccauugugugcgugugcgccauguuuugcuacccauucaucuggucgggacacuggauuuccucacaccuuguagcuaguaggauuguugcugugacauccauugauggguuucagugcagacauguuuuucauuuuucugaaauaacuuaucagugguggaauuacaauucacuugcuguguuuaaccccuggagaaacugcgcuguucuccaucguguccacaccauuugcaucccuaccagaaguauacuaggcauuugacucccuacagcaucuccagcacuugcuguugccugauuuucuaguuagugccacccccaucgguccaagguggcauauccucugccucggguggaugccaugucuucaugaggacauugaccaugugugggucuuggccguagaaaugcuucuccgaguccauucuccauucuuaagaagugagugugcuuuauucauccugcauccaagucucuuacuaaauacucagcugucacagaccuccucccgagcugucuucugucugucucacagcuacuugcgggcacuguguaggaacaccgcgauuugccugacuuguuccucauugauuuaauccaaguuuaauuucaaucuuaaaguguuucgugcacugcucugccuuaaagaaaaaaaggacccauuaaaaaccaucagauaauucugaacagaacugucucuuuuucaguuuuguagacauuugauccuuucagaaaaaggucauaucgaguggaagcugauguauuucacgcuucagaaguauuacccgaccaaagagcaguacggggacacgcuacacuucugccgccacugcagcauccucuucuggaagguaaggacuucaggccgacugggaaugugaggacaaacuguucguccgcaucuuaaacagagaggggagaaaacgggaaagaguacccgccacgggaaccuuacugaaagcguucugcuagacacugggagcggaggugggggcacacagguauacucgugcuggaaggccaucagggcugaaagcugagugcugcacucuucuaaguggaggcacugaccuugccgcagcuguagccugcucugagcacccacccuggagcaccuacccuggcagcgccucacaccuggccuaaauaaagaacuugcacaugugugcccacgcccucucggcagaccuggaagucaggcccacugcucgcaggggaucagggcagccuuuagccucuucucucagagcccaguucgucgguaggcagaagggccgugggaagcacaggcuucagaggaaaugugcacgcuuaacaagacugaaacuuuuuauccgcaaagacugauccuuuacggaaacccuuaaaugucccuagcaguaaccuucauaccugaacaguaaaccaggaguccuucaucccauugugcugucuugaaaucucaccacccguuuugucucuaguuacaauaguguguuucccgcaaccagaggagaguccccgugucccuuccuccccugguggccgcuauaucgugcucacaugguucugcuuaacauuuaucuaaauuggggacacaagacaagcucuuucuuuuuuuuuuuuaagauuuacuuauuauuauacauaagacacuguagcugucuucagacacaccagaagagggcaucagaucucauuacgggugguugugagccaccaugugguugcugggauuugaacucaggacguuuggaagagcaguugguggguucucuuagcugcugagccaucucuccagccuccccgcccccuuuuuaagauuuacuuauuuauuuuauguauaugaguacacuguagcugucuucagacacagcagaucccauuacagaugguugugagccaccaugugguagcugggaauugaacucaggaccuuuggaagagcagucggugcucuuaaccgcugagccaugucuucagccuacaaggcaagcucuuaauuguuggcaguggacaacuguauaaaaauguuguucauuucaaacuccauuuauaacugccuagccuuuuauucugauguccagagccaagcagaggagugcagcuguggauguugcugcugucuccggcaaggacagccgaggaagaguuuguccucuccgaccuugguucuuuucuuucugaaauuuaaaaauugugggaagugccucugcagcaggcggaccguucucuagaacucucucuugagagcagggucuuuguaaguucaguuuggccucaguuccccgcugagauuauacguacacaaacgacagcccgcuaguguuccaucuuccccagacacgggcugggaagggagccccgugcuggccccgaauccagcaggauucugugugugcucagcagcuccucccaguagucucauguagcauccugucucacuggaugcucuggaagaugaggaccugacucugucccaguccgcauagaugagacugguaacguucagugugaauuaacacaccuccuagaaagagcuuuucauuuuuuuccugagauuauuuuauacuauagaaauauuagauguauggauacuuguauggaggaagaaggcuuguaguuuguauaugugauaccaguuuuucuuggacuaguaucuuaaaacauuuggugcuuuuccuaucugcuaaaggaagcagcgcaaagaaagauguuugccuucuccgugccaucucuguguggggaauguaaaaugugugugcugcacacguuccaugaaacaugcaggcucugggcauuuuuaacuggaagaugaccuucaguuuuccagaaaauuggcuugcggauuucuacauuuaacuggccucacuugccauagugaucacaauucagaacaagucaugaaaacgcagacuccugcuggucugggagacaaauggcggguggguaccaggcucagcaggaugucguguuagcacaguucucccaccucccaucuguccagaggccccuuugaggauuguuuucaagccuuaagugugaaguguaaggaagaccaccuuucuuaauccccgaagcuguuaaauggcuccuuugccaagguaugccacuguccggaagcaugcuucaugggagagcauggggguacaggcaggcaggcccaggugaccggagagcuacaguguuguggcuuuggaauggugccugcucuuaagggaacacugcugacugagacacacacaggggacuugaagccuguuaggaauguggaagugggguggcaaguccucaccuggcccuguauauggucaagauccacacuauggcugagcgugucuugucuugugccuggcgaguuccacaaugaccgccuguccuuauggggacgcugugccuucucccaggcuggucucccaucgcucuccugcugcacuggggcgaugcgucuucguuuucccagugcugugcaagacugagccguuugcucccacccagguuaccagcacagaggccgccagucggugugugcaugucucucucugucccuacucagcuuccugacugggugaagccugucagaaacuaggccgagaggguaagggaagcucugauggagauguagccuuucugcgucccuuucuugucucaguauuucgguagauggacacuuccagugaugcugaggucucuguaggcagaagcagacuugacugaagcagucacagggcagagaucgcagacccccuuuuuggcccgucuuuguaaacugccccccugugagcagagaugaaguaccacucgcuccugagcagggaacagcagacucuucuguuagagcucacagggcugcccaccucacacaagcaacagcagauguuggugcgcugcaagaaauuaagcauccaaaauggaugucugaccuuggggugcaugcaguuugcaguuagcuacacuguuauucacagagcagaccccuaggacgacgaaaaggauggguggcuuuccccaaacaaucugguucccccguaggaauaugaggccuugcagauggucgguguggcgaccuuaaaaggaacgaaguggagcuguuucucuugcccugggcuuucuucuuuccuuuuuauuuguauuuauuucucaagacagguuuuuuauuauguggcccuggccugaagcuccuccuucguguaggccaggcuggccuuaauucaugagacccagccuuccaggugcugugaggcacuggauuaauggcacuggcuggguaccuggcuuuguaucuuuucauaucauaccuggcuagaguaucuuucuaauuguauaaauaugggguauccuuucagaauguuuuauauugcuccgacuuaguuguguaaugucuuaguucuccucacagauguagccuuccgccucaggcugagcacacgcagcuccgucuaacccugacuucuccuuccuuuccucucuuugcugcuuccuugcugacugcacgguguccaaggacuaccaccuugcuugguuguugaagguacuuccugugugcuguuccauccugugcacuguccucgcccugucaggugacagcugugauagcagcugucgcuaucaacaagcuagacuucucccagaagcagacugaagaaccaucccugcuccucaggguggucggucugcugcaggccaaagaagcagcuccugccaugcggagccuucccagguggugugggugcaagcucuuccucuuguuacuucaacaaaaaauaaucacagcucuuugguuuuggauaguaccaacuccacacaccuacucucgagacagugcuuguggugugccuccauuucugugugugagggcgaccacuuagccaccccacccccugagccugcaaagggaagaaggaaucaggaggcagcagggggggggggggaaccaggaggagcagcuuccgugccuuacagggcgacuaaagaacguugucaccuguuaauagaugugcuuggggccacccagaagcugauucccagcaaaaucacgucauuuguguggcagugagagggacugggauccacucagcaaagugcagauuguuccuguagcuguugaagcccgugcgcugaccugucccccgacucucuccccaggacucgggacaccccugcaccgcagcugaccccgacagcugcuucacuccugugucuccggagcacuucauugaccucuucaaguucugauggugcacucagccccgugcccuugucuacagcugucccuugugcuuucugugucguguaguuggugugaguauucugugacacaagugacgacaggcucagugacugccuguaccugugcaacccucgcuugcuccuuggagaaccugacaggacgcugaagaugugcgggcaguugugcaccgucagugagggagagagaccccgacuccauuuguacuucuuucuugacacucuucucagcuuauaaaauuugccguuuuguauauuuuuaaauauggaucaaaaagagucuuggauacucagccccauauuuugugcugaacugacaugaacaaccgagaauguccuucuugguugucaaaagacaguuuuccauccuacaguaauugggaugaagaacaaaacaguugauccuuguaaauacauuaugcagaauauuuauuuuucuuaaaauguauuuucacaaccccaguggcuguggccaaaugaguccucauugaacacgagauggagcuaggaaugcacguggggcugugaacuggaugcacuggccauagcuagcaucaauguccccguguuuccaggaaccccugccaugaggccaucauagauccagacucgggaugugggcuccaaaccagaauagagccucugccaaggagcuggaaacagcccagugaggcugaaguucucuuguagaaauuccuuuccuggguaaagugaugagccauguuuaucuacugaucagcuucaucaaauucgcaucuaacugaaugguagugucuuuaaaaugugcuguuuuauuuuaaaaauaaugcaugugcacuuuagaaauuuuugaaaauaaagauacaugaaagaaaguuauauaauuuuucugcaacaaua

SEQ ID NO: 4312 - RNA, 1259 nt, Mus musculus
uccccuagugagcccuuucugauguccucgcguccucuuugucuucugaguuuuguucaucugaucucauuucuccagcugucaccucggcgacguucauuucccaaagcgggacacuggccuuagcgugucuacauacugucagcuuccuuccagagucuauggaaguuuucaccuugacaauauccaucaucacgugaacacauugcucuaggcaaaaacccacaucuuccuccuucaggccucugcagucugauccucuucuccuggguaccuucuguagaugcugagggcuuggguccuucuugcuuacuuucugcauccuccuuuuucccagaguugcaggguucuaucccaucacugugaucuauucuuuaagcacccacaguugagcugcccaugucuuguuaccuccuggaaaagagacucacuucugcugaggucccugucucacaggccuguucucuccaauucuaguucugccuucccauugccuccuaaaccagcuguacaacaaagccuucuccagcagcccugcuccgaccucacuugagggacuccuccucucucagcccuccccccaguagggcucaugacuccugaacccucuaugaagccuuguccucuaaccucuguuguccugucagcuuucauaucugcaaugaagaguuacucucgucaucuuuaaaguugggacuaggugcagggcuagaagaucauacaaaaccucauaagccagauuaggcaucguucuccucgcacugugcacagcugacuucuucccaccuucucugggaguuaaguuacgaagcugccagaaccaagauaacagccgaaugcugcugagucuguguguuucaguuucggugccugugaaagagucuaggcagggaaauggauaugggugucaucccagacugaaagaacucgagacacaguuccguggcuucuuccccaucuuuccccagcucuuaccuggcagucucuagaguugcugcagccaaaccagcacagagacagaaguggcaccucaggcauugucugucaguaugggacugcuuuuaguucacacacaggcacgacagcacgucaacaaauguccucguccccuucacagcagcugccagcggggucccccucaggaguggguggccacaacuggcugaggcuuccccuuccuccagucaggaguacgccuggguuuggggcccguugugccuguguuuguuggucguugugccucacucuggguuucugug

SEQ ID NO: 4313 - RNA, 2101 nt, Mus musculus
cauagcucaguucagaccaguuggccaugaagaccaaagccucaggguacucgagucuccaagaacacacagcuucaaugugaagauuuugguggccaccagaagaggucaccuuaccgugagugugagugugguucuucaguaagucuuccuuucucuacacauuuaaaguguugccuucaccacugaauagcucaggcagguccaacauuauuagacuuucgauuuuuaauucaaguaagcaaaacaaagcaaaaggcucaaauuaaauuauuaggucuacuuuucauaacaacagacuggaauuggcaauucaaguaucucaacgcuaauauguaagcuaauuaaaaagugcaguaaauugaauucaguaguagcuugguauucacauuuaaaugaauugauaauaacucugcuccgugcuccagacgcggcaggggcugcuguacagaugggcaggccuccaucaggccucagguagccauccugaucugcgaguggggcagcagauaggcuugugcucugggucugagguaggaagacaguugcaagacuucagcgccugguguuuguuuaacuuuucuaaagacaauuuagaucaugcaguguucuggagaguguaucuggggaagcuaaagugccuuugugaacaauauggcuacaauguaacucaguaacgaggggacugacucuuuaaugaugaaggacaagacagcuuucagcagaauaauucugguguuguuccaagagguacugcuugggacgcaggauaucugcaguguucacagaguagauuuucuauuacacauggcucaaacagagaacugguaacugacaaccagaggcccagccuccuucaagccccuaggcuaggcaucuuuaacagucugcugacaccuucuaguuuaugggacugcacagcgacacaggaaguaccuaagcagcaaagggucccuagggugcaggaggcugaaaugacgaugauuuaagacacugcccagcuaacugcugacucaucucaccacauucgcuuucuaaggugcugccaaaggcagccaaaugguuuguacacugaagggacuggagucucauagagaugggcacagucuugugccuguuuucauucuuugaaccaauucugcaucuagaauggguuugucaaucacuccugcugggaaauuuuauggugcgaaaaggaaacaauaccgaggagccugcaggacccaguuauuuacaauuauaucuugaacgcaauuuuagaauaaucaauuucaucugaaacaggcuuugaauauaaauaagcuccagaauaaaaaauaugauuuauuuagguggcuuauuaggaaacaaaagcuucaguuaacuaaauugguuucucugucugcugccacuguagcauggagcacccucugauuguagcguggagcacccuccuucauacagauggcccuacccacgacccaguuggacuugcagguaagcagaggaaugagguuaauucaaaucccaccaagcaccucucuguccuucaagaaggaagucugcucauaugauuuccucaccaggcugcauggagagcugcucaugccacgcccccuguaggcugcaugggggauugcucauaugggccucccugggugcaugguucccccaguaauacucugcugcaauucaauuuuuaaaauuuuccucuauaagccaauguucaagaguuauugggucuauugggagaaauuauaguauugcccugcuauugugagucccaggcuagguggaggguccaugagggugccuccucugaucaggccacugaugcuucagugugcaucacagggaguggcuccaagccacagagagcacugagcagcuugucaccuguugcuguccucuuccacagcacaggcaucuggaaaugggaagcgaggaaggcgccagguacuucuuaacuuccacaaccaugcuccccgacacacugggcacgccaucagggaaaccgcugagaacaacuggaucucauauacuucaauagcuuauuucccgaguggguuuuagcugucuauauuuaagaagcuaaacuuaucaaugaacaaaccuuugaaug

SEQ ID NO: 4314 - RNA, 905 nt, Mus musculus
uggguguugcuuuccuuuaauaauuuaaugauuugcuucccucuacaugcacaaaacaaagguucgugcuaagcacauucaacugcccagaagggcucuuccagaauaucccagcacuuuucuaugcagacaccugcaggccuuuaauaucaccaaggcccacauucuuggucuucacagcgccucccuuuccaggcucagccaugagcagaaaggcuagcuaagcucucuccagcaucgcuuccugcauuuagagagcuauggaaagcuggaacuccgguucagcaaacaagagccucccggugacaggcaagcuguaauagcgccuggaaagguauugagcugaggucacgguuggucggcauuucuauuuccuguacuuggcgggacgaggagccccugacccugaccagccaggaccgccuaggcuggcaggguggcucuaggucggauggguuguucuccuggcauccccuacuuuguaggucuguaaggaacaguggaugcugggugugguauccguucugugccccacugcccgugggacccaagaugggagagguggucagggggagaagggccagagauggagugaaguguuguucagugcccccuucccacaggagcccugaccaggaucugcagagagcaagcagacucuggggucacgauggguggagugucugucuuguguucccugccagcgacagcgcagcucccagugucuaacagagggcggaugaucgggagacacaaucuggccccgcgccauuucccagugaccaggagucugaggggagaagcguccacucuggggcacuacaagcugguguccuuucugugcccccucuguccccgggggcgcaagguaggcagcaucccuccuacucacggcgcggggcguu

SEQ ID NO: 4315 - RNA, 5625 nt, Mus musculus
acccuuuagacccuuuuuaucugacuuguuugccaggacuucuuggagacucgacugcugcugauuccugccugcuguccaaaugcugucaggguguuaagaagaaaucucugaaagcuaaccucccgcugagcccacgugugcgccucacaaaagucaauauuuucagcuuucccucggccccaguguguuuaaagggcuuucuaguguacauccuuugauugugggugaguguucauaaggaaaauggcuuccaucuuuugucugcagagagugaaaaagaagcagagucgcucuaguuucgucuucaccggauucuuucuuuagaugaaguuauuuuaucuaaaaauauuguaaauguaaguacaaaagaacuagauuagggaauguuaaugcaaagucagauacacuugcauucauuaauauuaauagcuuuuguuccuucugggggguuauuuuauuggauauaugucaguacuggcccaauguacagcagaaaaugugaaucaaauuugagccaugcaguuuauaacacuuuguugacacuugguuuguuacuagcgcugcguaccacacuaaugccacgugaagacuguggaugacauacaguucuguccuuucugcucaauauuuuugcaaauuuaacacacucugaacauaaauaucuguuuuuuuaaugaccuuucuccuaagucuuuccccaccuuguuauauaugcauugcacauguguuuuguuuuaguucagcuuuaugagacaggauucuucucuagcccaggcuugccacaucucacuguguaucugaggugaccuugaacuccugauccucccaucacuaccucccaaacccugggauaauaggugugggauaucauaucuagcuucccaucauugcuggcuggcaguaccuugcgcacaccuuuaacccuggaacuccagaggcaaagguggcagaucugugugacuagaaggccuaccuaguuuacucagcaaauuucagaccagcuagagcuaaauaaugaaaccucugaaucugccaagaaccagccucggcuuggagaaggguucugagggaggggugucuggaaguggcaaaaaggaacccuggaagucagacuguggguuacaagcugauggccuauguucugcucaagacagcuuuccagacagcucucucuccagauagcucucucucucucucucucucucucucucucucacacacacacacacacacacacacacacacacacaauuccaaaaaacucccggauagcucuuuucuugcagaccaaaagcccugucuuuuauuuacauaccaauucagucauuaacccagguccccuuuugauuaucccaugaaccagcauccuaugaccccaacccccugauucuuagaaagagagcaaacacauauuucuuuuuaaaacuuucuaaacuucaagguuaaaauauccaccccucacuguauagggcagcaaacacuauuaaaaagaaagaaagggaaaaaaaaaguguguguguguggggggggggggaaaucccagcccuccaggucauggccuuaggugagugaggacccugggaggugauuuggcccugagaguagaggccucauaaauagaugucguguuuuuuaugaguuguugggguuuuuauuuuugggauuuuggggguggguuguuguggguuuugcuauguuuuguuuuaauuguauguuaugucuuuuuuuuuuuuuuuuuuuuuuugagucaggguuucucuguauagcccuggcuguccuggaacucacucuguagaccaggcuguccuugaacucagaaaucugccugccucugccuccugggauuaaaggcgugcaccacugagaaugugcuugugugacagaauccaguagagggcaacaggucuccuggaguuaucaagugucauuugugaaacagagaccagccuagcccagacauccagucuguaggcgccuguccuuggacuuccaaccuauagaaccugagagacaaauuucuacuguuuacaagccacaguuuauggucuuuuauuacugcagcccucaucagaguaagagacugaugaauacauucauucauccauuugauucuugcuugaauauccccaggccugugauguuuaaucuuaccaacacgcuaaaguuuagagccacuguugaaacaaaucucuggguguuucugugaagaauuaucuagauuaugagguaugaggaucagcccuaaauauggacagcaucaggccacaggcuaggaugccagacugaaagagacagucucagugucucucucucucucucucucucucucucucucucucucucucucucucucucucucucugcuuccuccugagauaaagugugaccagcuaccucacaugcuugccaccauggcuuccaugcccaaauggacugugcgccuuuuacugugagccaaaguaaacaccuccuuccuuaaguugcuuuugucugguauuucugucagagcaucaagacgagcuacugauguguacauaacuaugaaagaauauccaacugguuccagccucugugagcgagauuagggucauaucagccaaaaauuauuaauucucuuucugacagguuauucuuaaucuuuccuuuuaaaacacacuucaggauuauaggguguacuggcuaguuuugugucaacuugacacaggcuggaguuaucacaaagaaaggagcuucaguuggggaaaugccuccacgagauccagcuguagggcauuuucucaauuagugaucaagggaggagguccccuuguggguggugccaucucuugguucuauaagagggcaggcugagcaagccaggggaagcaagccaguaaagaacaucccuccauggccuugcaucagcuucugcuuuccgaccugcuugaguuccaguccugacuuccuuuggugaugaacagcaguaugaaaguguaagcugaauaaacccuuuccuccccaacuugcuucuuggucaugauguuuuggacaggaauagaaacccugacuaagacauagggaaaacacauaaauaggggaaaauauucccauaagccauucauggagauccacaaugucugccacauguccuucauucuuucugaucuauccuauauauugccauuuuucaguugacuaaaagcccauuuuucaaaugugauuacagguuugcccauauggggcuagccgacuaggccagcacucuuucuuuuuggcucaggcucaccaaggguuacugaggauggcauaggaaacuguuaaaaugaugcugggggggcuggugagauagcucaguugguaagagcacccgacuguucuuccgaaggucugaaguucaaaucccagcaaccacaugguggcucacaaccauccguaaugagaucugacucccucuucuggagugucugaagacagcuacaguauacuuacauauaauaaaaaaaauaaauaaaucuuuaaaaaaaaugaugcugggagugaaacucaaguccucugagggaaagagaguguauguagagggagaaacuguuugacuggagucccuggcuuccuccccucccugacguggucccuaaauuccaguuuucucuuccucuccaacaauggaccauuuggaaagccucggaauagaaaaaaauggcaaaaaccuagucccacauuccugacagcuguccuaaucaccccaccucaccagaagucaccagccacccaagccccuuacccuagaugaccauaccagggcauaagcguauggcagacaugucauuuuccuucaccuacaaucuauuaaaaaaaccuucuccagccauagucuauucuugacauuuucuugucuuguccugagccuagugaacuuucccaggagcccauucccaaauaaaccuacauuuuuuuuuuaaacuucuuaauuugguuugaauuggcuuuuuuuuuuuuuuuuuuuucuggcagagaaaaaccuauuaguagugauucaacaaaagauucugggaggcccuugcuuuggacuaaguuugcacaccauguccauccagcaaagcugaucaaaccaaaguggagucagucaugcugaguggcagggaaucuaagugaaagguuagagaacccaaagggucccaacaguaagaggagauaagaugccgguucaccuaagauagccaaauaaggaagucugagaaccaagccaugguucugauucuguguucccuucucaggaauccuaguccugcucuuacugccuguauaaagugagagcauacagccgaggggaggguuauuuagaucggagggagaguucagccugaggcaucuggaaaaguccacagaagggagagaaagcucucuaucggacuuggccagcaggguaggucaggccaugagaggagugggcacugggaagaaagguggaagagaagagagaaaagcaaaagagaggacagagggugggguagggaaagggggaggagcagggggaggggaggggggagagagagagggucaguaggacuaaguaccagccugaaauggcgggguuauauaggaaugagaagcuuggggaacugaagcccaagagcuggagaaguuuagagcaggagguggguugagaaacgcuaaaaggagccacagguaccacguaagccuggaggccagcagacacugugguauguuacugggcaccuuaagcagccauuuugucuugaguuucucuuugcacugccuagugaaagcucucccacuguguuagugaagaugcuucaauucgugaauucccauuaacagcucaucacucggaauuuggcuuuuuaaaauuauauauauuauauauuuuaauauguacauuuaaaauaauuuugaaauauauauauauguauauguguguguauaucuauauaaauuaucuuuuuuuuuuuuuuuuaaagccaaauugcugggccagucuguaauccuagcucuuggggaaggcugagucgggagaagggcugaguguugugagcuagaaaccaaggccaucucucuaaacacccaaccaggagcuaaggagauggcucagugguuaagaacauuugcucuagcagaggacccgaauuuggucccuggcucccuuaugguggcacauaaccauguguaauuggaucugacgcccucuagugaccuccacuggcaccaggcacgcacguggugcaaauauguacaagcaggcaaaguacucacacguguaacaaauaaauacaaaacccaaaacaaccugucuguccaaaccaguugggugguuuuuuuguuuuuguuuuuaacgcccggcgcuuaaggcgacgaaaggauacuguuaucuacagaagagcaggcacucccuggcuuccguccucccuaggcggcuccguccuccucccucucccggcagcccuugcgcggggaggcgggcccgcguccgacccgcccccucgcagacucgcgggcgggagguuugaagacccagagggcccgcggacgcugcagcagucccgcucgcgcuccagggugcagggcugaggcagggcccacggguggguccccuccccggucaccgagcgcugcgcaacgaggacg

SEQ ID NO: 4316 - RNA, 2599 nt, Mus musculus
uugguuaaaaaaaacacacaggcucacauuguuaguauuauccagauaagcuauagugguucucagauugugcaucuaagagucaccagaacaccuuccuauuugucuaguuuuacagcuaucuguguguaugggugcaugccauggacaccuguagaggucacaggacaaucuccaauucacuuucuccuuccaccacaugggcucuguaaucacuaagguuugucaauccugaguacagauguucagaaccaucuuacugucuccucucuucugauaaaacaugagguggccccagagacguuuuagacaggguuauaaucugauaagggaaaagccacauguccuuuccuuacaaauguaauuucuacagacauuccuagaaaauugaaacuuuaugguugggaaaggagagggggcccucagguaccuuguuuuucuguugacaaaaguugacucuuaacauugucaaguaaaugcucccacaaauggaucaucugacuauuugcagaaugucauaggccaacagagagagaaccccugaauuuccagagaccuucagguuggcucagucccuucuuuuuugauguguaccucaauuccugucuuccugaacucuuguuugccaaucugaaucuacagucuaucugucaaacaauuccuuugucuggacuggucugcugaacugacagugaauugucuugacaguuccuuugccugcccuuuuaccucugcaucuucauuaaacuggacaguuugucauaucugugacccaccaacagcugcuuuuccccuaaagcuggguuugugguucauguuaucgugacagacacucuuauagcccugucaguucuccagcacuggcuucccaaggcuuuuaaaacuccuuucuucuuucuaacucuuuguagucacuguaaccuauauaugcauauguaaacagagauauacuuacagagugauguaugugugaucugagaguuaauauuaguaauuaagacugcaauaaaagaaccuguguuucccuuagcaagggcuacagaguaaagugggccucucuggugccagcgaagccacuguacuuagugaaauuuauugucauucaauacauucugauaucguguaaacuccuaagcacguccaucugacauagugugcuaaugacaggagucaccuguaugccuuaugaagcgcaucucagaggugaugggaaagaaacauggggcaaaagaugaagggaaauccaaggcaaggaagcagagacacaggcgucagugguguggaaagggagaaaacuaggggcagaauaagugaccuuagggucacuuagagaaaccaacacacacacacacacccacauauuuaaaacguacuuuauacagaucugagcgugcgcacugaccuguuuccuucuauaccuucuuguauagaauuaucuggucuccacuaguuagggcagugaaaggaccugggccccuggauaaguuuuugcuguuacuuaacuauucuaguuuucuggagggaagagaacuuauggauccuacauguauagggaaauacuuuccuacacauugaaaagaagaaauguaggauauuaggaaaacgcacaguagaaacaaguuaaagagcaagagguuauuaaagggcaaaaguuaaggcuuugaaagauuuaauacaaggaggugacagucccgugaaaggugaaccaaggguacaggagacggacccagccucauucugcaacagccaagaggagggaaggugugcuuccuaugcacgugggggcacggguggcccuccggcacgcgaagacgcugcaguuguccauaaccugcggcaucgagcuccuccugugcuccacgacuuagucggcucacgcgugucuugcaggaagcauccucgugucuccacgcagcucucgcacgccagcacaggccaaaacccaccaccucacuucuucccgggcucauccccagccagcauucgcagucgagcaugcgucgugacgaggccaagggaccgagccaaucagaacacguauuacgcccauaagucggccaaucaggaggcgccuuauuacccgggagccuugcuucaccccgccuccccgcugacaagcacgggucgcgcggagcaaagcgagcaccccgaggcgagugcgcccggcaagccgaggcgugcccuuuccaaggcggcgagcagaggccgucacuguccccgccgggucccgggcccccgcggcccaugcugggggcggagccagggcggagggcggcggcgcggccggccccgcgcagugauuggcgggcggccggcgguggcugagguccugguggccgcgcgggcaacgcaggcggagucgcggcuggcgagccgagaggaugcugcugucccuggugcuccacacguacucuaugcgcuaccugcuccccagcguccuguugcugggcucggcgcccaccuaccugcuggccuggacgcuguggcgggugcucuccgcgcugaugcccgcccgccuguaccagcgcguggacgaccggcuuuacugcgucuaccagaacauggugcucuucuucuucgagaacuacaccggggucca

SEQ ID NO: 4317 - RNA, 2599 nt, Mus musculus
uggaccccgguguaguucucgaagaagaagagcaccauguucugguagacgcaguaaagccggucguccacgcgcugguacaggcgggcgggcaucagcgcggagagcacccgccacagcguccaggccagcagguaggugggcgccgagcccagcaacaggacgcuggggagcagguagcgcauagaguacguguggagcaccagggacagcagcauccucucggcucgccagccgcgacuccgccugcguugcccgcgcggccaccaggaccucagccaccgccggccgcccgccaaucacugcgcggggccggccgcgccgccgcccuccgcccuggcuccgcccccagcaugggccgcgggggcccgggacccggcggggacagugacggccucugcucgccgccuuggaaagggcacgccucggcuugccgggcgcacucgccucggggugcucgcuuugcuccgcgcgacccgugcuugucagcggggaggcggggugaagcaaggcucccggguaauaaggcgccuccugauuggccgacuuaugggcguaauacguguucugauuggcucggucccuuggccucgucacgacgcaugcucgacugcgaaugcuggcuggggaugagcccgggaagaagugaggugguggguuuuggccugugcuggcgugcgagagcugcguggagacacgaggaugcuuccugcaagacacgcgugagccgacuaagucguggagcacaggaggagcucgaugccgcagguuauggacaacugcagcgucuucgcgugccggagggccacccgugcccccacgugcauaggaagcacaccuucccuccucuuggcuguugcagaaugaggcuggguccgucuccuguacccuugguucaccuuucacgggacugucaccuccuuguauuaaaucuuucaaagccuuaacuuuugcccuuuaauaaccucuugcucuuuaacuuguuucuacugugcguuuuccuaauauccuacauuucuucuuuucaauguguaggaaaguauuucccuauacauguaggauccauaaguucucuucccuccagaaaacuagaauaguuaaguaacagcaaaaacuuauccaggggcccagguccuuucacugcccuaacuaguggagaccagauaauucuauacaagaagguauagaaggaaacaggucagugcgcacgcucagaucuguauaaaguacguuuuaaauauguggguguguguguguguguugguuucucuaagugacccuaaggucacuuauucugccccuaguuuucucccuuuccacaccacugacgccugugucucugcuuccuugccuuggauuucccuucaucuuuugccccauguuucuuucccaucaccucugagaugcgcuucauaaggcauacaggugacuccugucauuagcacacuaugucagauggacgugcuuaggaguuuacacgauaucagaauguauugaaugacaauaaauuucacuaaguacaguggcuucgcuggcaccagagaggcccacuuuacucuguagcccuugcuaagggaaacacagguucuuuuauugcagucuuaauuacuaauauuaacucucagaucacacauacaucacucuguaaguauaucucuguuuacauaugcauauauagguuacagugacuacaaagaguuagaaagaagaaaggaguuuuaaaagccuugggaagccagugcuggagaacugacagggcuauaagagugucugucacgauaacaugaaccacaaacccagcuuuaggggaaaagcagcuguuggugggucacagauaugacaaacuguccaguuuaaugaagaugcagagguaaaagggcaggcaaaggaacugucaagacaauucacugucaguucagcagaccaguccagacaaaggaauuguuugacagauagacuguagauucagauuggcaaacaagaguucaggaagacaggaauugagguacacaucaaaaaagaagggacugagccaaccugaaggucucuggaaauucagggguucucucucuguuggccuaugacauucugcaaauagucagaugauccauuugugggagcauuuacuugacaauguuaagagucaacuuuugucaacagaaaaacaagguaccugagggcccccucuccuuucccaaccauaaaguuucaauuuucuaggaaugucuguagaaauuacauuuguaaggaaaggacauguggcuuuucccuuaucagauuauaacccugucuaaaacgucucuggggccaccucauguuuuaucagaagagaggagacaguaagaugguucugaacaucuguacucaggauugacaaaccuuagugauuacagagcccaugugguggaaggagaaagugaauuggagauuguccugugaccucuacagguguccauggcaugcacccauacacacagauagcuguaaaacuagacaaauaggaagguguucuggugacucuuagaugcacaaucugagaaccacuauagcuuaucuggauaauacuaacaaugugagccuguguguuuuuuuuaaccaa

SEQ ID NO: 4318 - RNA, 38583 nt, Mus musculus
uaaggcuuugaaagauuuaauacaaggaggugacagucccgugaaaggugaaccaaggguacaggagacggacccagccucauucugcaacagccaagaggagggaaggugugcuuccuaugcacgugggggcacggguggcccuccggcacgcgaagacgcugcaguuguccauaaccugcggcaucgagcuccuccugugcuccacgacuuagucggcucacgcgugucuugcaggaagcauccucgugucuccacgcagcucucgcacgccagcacaggccaaaacccaccaccucacuucuucccgggcucauccccagccagcauucgcagucgagcaugcgucgugacgaggccaagggaccgagccaaucagaacacguauuacgcccauaagucggccaaucaggaggcgccuuauuacccgggagccuugcuucaccccgccuccccgcugacaagcacgggucgcgcggagcaaagcgagcaccccgaggcgagugcgcccggcaagccgaggcgugcccuuuccaaggcggcgagcagaggccgucacuguccccgccgggucccgggcccccgcggcccaugcugggggcggagccagggcggagggcggcggcgcggccggccccgcgcagugauuggcgggcggccggcgguggcugagguccugguggccgcgcgggcaacgcaggcggagucgcggcuggcgagccgagaggaugcugcugucccuggugcuccacacguacucuaugcgcuaccugcuccccagcguccuguugcugggcucggcgcccaccuaccugcuggccuggacgcuguggcgggugcucuccgcgcugaugcccgcccgccuguaccagcgcguggacgaccggcuuuacugcgucuaccagaacauggugcucuucuucuucgagaacuacaccgggguccaggugaggcgcggccgcgcagggcugcgugcgagcccuccccgcggccggggcggcgcuugcaacccgggcgaacacucgcagcccggcgagcacgugccgcagcucacggccucccgccgcggggggaaguuucugguucucacuucgggguuccuucuggaacguccugcugaggcugaguguguucccggguccgccccacccccgccccgggccggcuguuacugcccaucucagugccugccaaaguagggcacugaguccgagguggugaugcugggacuggcuucauuugcacuuccgaggucuuuuagauuagcaagaccucuaggcgcugaccaaagugacagcugugaaggacgacuccugccuuggguuccucccgggugaaagcgagggccuagggaggaaaugaauacauugguuacaauaggagccucacugucgauacaguucucuucagcuuggacugggcuucaaugugggcugaucucuugucagauugcuuucuuccugcuacuguuucuuucuuucuuuccaccccucccucccccccccccgccccguggagauugaacucugaaaacaauaaagaguagaaagcucuccuaaugugaauucguuauaugacaucccauaaaaaccuacaguuguacuuccuuuuugguuuucaguuucaaagaagagcucuguuuggguucucccagauguaucuaugacuuucccccccauuucucaguucuuuucauucuguguuagggggguacuuuggcgacuggaucccuuacugaguuuugcgccaguuggagauuaugucugagguagggaauuaagaccucucugaaucacuaucuuuuuaaauguuuuccuagggaauaggaaaaucacuguugcacaucaagguuucugaaaaauugacuuuuagaauaggauuucauucagaauuuuuaggaacccccacacugaugguuucaaaccucccucuuacuuuacuaaguuugucaagugaauguauggucuaaucguggauaaguauuuaauuucacuagcagaagggacaagacagcggggagcacaacuuaaaguugcugaccuugcacaugacaaguaccccucagacgcucagggaccucuacucaagugccaccuauauucuugcugcagagacguuaggaugagucagaaugaagcaaaguuagugaguuuauugauugggagagaggacacgcacuugaggggagucaagugcaaaccuuauuaccccccacccaggcuacagcagcuguuuucuaagugauuuuagggcuuuuaaguuaacgccuuaaaacuaagauuaaggagaagagaaggaaaaaaaugaguucuucuauucuuuccaauaaugagcucuaaaaaaaaaagaagcaaaccaggaucucacacuguagucuuggugggcaggaacucuauguagaccucacaggccucaaguucacagagaucugccugccucugucuccagaguguuaggacuaaaggcauguaccgccaugucuggauuaaacucuuuuaguuauaugaaauuuaaaacggauucauggcgguacugaacaguuuacauaugagggagaaaugugguuaggcaguaauauggaucaaaauaaaaucaaaguaauuagcugaucacuggucacaagaguuugagaugugagcuugucuucugccuuaggucaccagcuauagggauaaucuuuuguuuguuuuuugugguuuuuguuuguuuguuuuuuuguuuuuuugagacaggguuucucuguguaguccuggcuguccuggaacucacucuguaggccaggcuggccucgaacucagaacuccaccugccucugccucccaagugcugggaugaaaggcgugcgccaccacuugccuauaaucuuacuuguaaugguuuuagaauaugugcacaguggagagcaguguucaagcagcuguauccaaccaauuccacuuaaagagggagagggugagggugagggccuccuuugcuauucaaaagcagauuguguggacauugcauuggauucuuuuguuguugcugcuguuguuuuguuuuguuuuugagacagaauuucucuauauagcccuggcuguccuggaacucaguuuguagaccaggcuggccucgaacucagaaauccgccugccucugccucccaagggcugggauuaaaggcguugcauuggauucuaugcaaauguagguucuuuucuguuuucguuuuugcuaaaauucugaguaauucauguauccuuucaaguuaaaaaaaaucuuuguguguguguaugugugaaugaauguacugcaugcacauaaauauucauauccgugauuguggggcaaauguaccauggcauggacauggaggucauaggagaaccuuggguauugguauuuaccuucuacuuugagucaggucucuugcuuaccacugugugugugccagcuuagcuggcuucuaaauuucuggauucuguccuguaucugcuucccaucucacuguaggagcacuccauaaaagagagaugagugucuggccuuguauggguucugaggcucugaauuugggcuccucaggcuugugugacaaguguuuuagcuacaucugcuaacugcccacaccaauauuagagccuuucgggucuccuauuaguacugaaagugagcaguguguuccccuaucuguaggggaaguaaugcagccuuuguaaguuuugcucauuuugcuaacuugaaauccauuagaaugugaccagagggacuagggacugaagagacgucagugguuaagaggacagucugcucuuacacuggccuggauuugguuuccagaucccacaauggcuguuucucaacuaccuguaacucuggcuccaggacagaggucugacaccucugacccccauggauacuagcccucacaggcauauaugccuuaccuccaguauauauacuucaaacauauuuuuaaucuuaaaaaaagaaaaaaaaaggaaaagaaaagucucuuuaacauugugaaaagcccauuucuuaaggcuaacacagcagauuauuucaggcuuagugguuuagaaucaaagauucuagaugaauauucacagagacuguaguaguuguaauaaaaaugaaauaucuuuuuuucuuguuuguuuauauauauauuuuuagacagggucucacucaguagcucagguugucuuaaauucacuugaacuuacaguaagccuccuacuucagcaucccagguccuagcauuacaaaacuuagccaccacacugccuuuaacauuuugauauuuagagagagagaguguguguguguguguguguguugugugaguauugcauguacaugaguguucaggugagcauggcccugugugcacacagggaguccagagcaggauguggguugccuucuucuauuguucuaugcuuauugccuugccuuggagucucucaacucaaccaaaagcgcaucauuuucagugaggcuagccagccagcacacucuugggauuugcccaucuaucucuaaguucugaaauuacuggcaugugcagacaugcucaacaucucuuagacaugggcaccugugguucaaaaucagguacugaugaagagcaauuuuuuuuuccuauugaaucaucacuauagcccuuuuagaauuuuuuuuuaaguuauuaaaaguuaaugugaaugggccagucuaauggcucaguggucaagggcaccugucacuaagucugaugaccugaguuugauccccgaacccacauaguagaaggagagaacuagucucgagaguugucuucuaaccucuacaagcacaagcucaagucaaccccauacacaaacagauauauagguagguggguagguggguagguggguagguagguagguaggugggugggugauagauugauguggaguuagagagacggcuuaagcaugaagaccugaguucaguucccuagcaaccacauuaaaagccgagcauggcugugugugccuguggccccaccacugugguggauggagacagggggaucacuguagcuugugcgcugccugucuagcuccaguuuuaguagagacccuuuguuaggggaguaaggcaaagagugauagagcaggccaggagaaguccuccuccucuagccuccagggagugugcauggccauacacaugugugcauacgcuacucacacccaccccccaaaauuaauucauguuuucaaguauuagaguauuuaucuucucauugcagugaaauccaauaaaagcugguuauugguguuugcaggccagcugugcagugauacaauaugugacuccucaguaccuggugaaugcuuucaccaccauuauacugcuuacauuuguuauuaacaauuagaauguaccuuaaaauauauuucccauggcuuugacugccaauccccucugguccaaauucuaguauugauaagauacaagacucuuggguuaucauuuauuuacaaauuaauuuugggaccaugacggggucugcagaguagcuagggguauagaggacugugccagcacuccuuggcugagagccuuuaugcagaauaacuuuaaauguuucaguguacccugcuuacgcuauagaguagugugaaaguccugggaauaagauaguguguagguguaaggugcugcuguugcuguacagugcgcagacucuucuagggcuugucccuuguacagaagcuccucucagcgucucagaaacaaagacuuucuacgugcuggccacauaaacugguuugcucuuuccuuggcgcugucuuaucgagcauccugaacucuuccugagucaaguuugcaucugaaucuugcugaaggcgcuaaauuccagggacaaaauauguuuacuuagaggggacucacagguuauccaaucugacccuuguaucgggacugaauucuucccacauucugcccagauauucauuggaacccacuaucggugaucuuuuuaaaaaaaucuuaauuguuuauguguucaguuuuguuccuuuuugcuuauuuaucaucuuugcgauucuuucaaaccccaaaugacuugcuuugcuuagcugggagcugcagaacuguggacuugggugugccucugcuuaagccgaauaagcaaaaccuuugauucaggaaauuguuucccagguguaguucuagucuaacacagcuuaaaucugcuaggaaauuggcuagcgagagauuuacaagacaauuuuugaaaaauaugguuaagauuuuauuucaauaucuuuuguaaacauaaaacaaacuuggcauuuaguguuuaauuuuugaagucucuuguaaaacaauguuguuuacucuuugagaauuuucuauauuuugaccauauucuuuuuccucccgcaguucuuccacaucuucugccuguguaguuuuauuguuguuacuguuuuacuuuuuuauugauucuuugugaauuucacaucaugcacuccaaucccacucaucuucccagccuucuguaucugcccucugccaaugggaacaaaaaaauaaauaacaaaaaaagagaacaaaacaaaaaacagaucuguggaagcugcgguuugucacggugugucucacaguucauccuuuagcucagacaucuuuacuuggaaauguuccuugcaaugagucacugguuugguucuaggccucugccuucugcuacacugucaauacuggguccucacugggagucuucuccaguauccuguuguugcccugugucauggagauccuguagguuaggaucugcccgacaggccccuuuacacacuccagcaguucauagaugagguagguguuggugugugccaacucagagcccuggaucuaggccugaguggcagcugaguuggucagccugccaguucucuugcauacacaucaccagggccagcucuacugugcugcccaggcuaggugcgggugcuguagccaacaagaggcaaugccagcucuccugcuuucaguguccucagggccagcuuucccacacugcccagugccaugcucuccccagugccacagcugaugaggggucuggccagcucugggcaguccuuugacagcaacauggcuccaggcagcagccuagaccagggauauucaaaaggccuuuggugauaacaugggucauagacaaugacacagaccccaacccaccccgaugcugcagagucauggacccagacaugguccuuggcagcaguaugggccaggaccucaccguggccucagguggcugugcaggcuguuccucggcaccugggcgucucuucauuguguaaacacuauuccacuucucuuuccccucucucugauacuuacuugcucaucuuggugggggucucccacuccacccacacaggcaaaaguccucugaguguccucugccccacccaugccgugugguauuggguggggcuuguguagucuuugaacacuuuauuuuucuauuuuaaauaacagaugcaaucaaacacuuuuaguguuugauuuuagugagaaagccacauuuccguacugcuuuccguacacauaccuuccuuaggucuauaagcagucuacugugaaacuuuagauuucuucaaaaagagcuuuuguaaguagaucuaauuuugaggagcugugggaacuugggaauugacacuucuuaauggaauuagaaguuaauucuuucugaauuuucauguuacaguuucuuagauaguggcugauauuguaauagcuagagaaugcaacacuaaguaauacuuucccaaaaggguucugggaacuugggucuucaucuguguguccauagaccagcauucacauuugcacucuguuucggguacugugcuggugucuagagggugaagaacuauggagcaaccauacuauacuuacuaguggggagacaagcaguaacaagaccauucacauugacugcuguguggccucgcuuagccuaccggguagaggguaggugguuagaaaaguuucucugaucaagugccagagcaaguucucugaaaaagguccgguguuuggggacauuaggacaguccagguagaggugcuggucaguguagugaagaaguauaugugaugagagcgagaacaauccuuccacaucuauuuuuaaaauagccagugucuggagagguggcucagagcauaagagcagguacugcgccuccagaugaccugagcugcuccccagucacaaccaccugugacuccugucccagagggaucaagugccccuucucaggcacucauucgcacauggcgaugcaccuguacaacauguacacacaauuaaguuaaaaauaagaucuuuaaaaaaaaaaaaaaacacuagcaaauauugcuuuugguuaguaacaaagccuuuacugaaugcugcuguauaccaguauugccauucauccuuacgugguaggcaccauucuuagcuuuuuauagacagaaaacagguccaggcaguucauuuguguagucuucauggcaguccaguuugggggcugcguuugaagacguguuuacaguugacgagugaagugaguucgcuguucuugggguauuugugcuaugaaagcacagagaaacaauuacagaaaacacuugauaccugacauuguuggaugguuguuuaccagcuuuuccaaauagaggcaaagaugugcuucacugcuuaugacaaguucaaucuucacuucaagacaacucacauacggcagagcgaggcaaagugguuuucaguugauacuagagggaaugugacaccagaauugcugugaagacuucaggcucaguguuuaaggccaucuccguucugugcugcccugcugugugcugcccugcugugugcugcccugcugugccagucucuguccaccccaacugcuccuuuuugcaucauaaaaauaaucuauaguguauuuuaaacugguccucuguacauuuaagguucaguccagacuugugcugcuccuuaucugccgucaccuuacccucccuuuuugaaucaauaacaucauuuuggcaugaaauuacuaugucauaauguguagauugucuccuauucgagauuguagucaguaaaaggagaaugacccuuccuuuugaacaaaaagggcaaucaauaccucacagagaauccuguucaggaggcucugugacccugcguuaaauuuuacuuuuaaggaaugggggcuuuugaaugguuugcuaagaugguuguguuuaucuaacgagguucacauuuacugagacuauugaauccccaggacuauggggauauaaaauggguaaagcaagacagauaaaagaauucuaggacugccaagaaacagagcaaccuuugucugagcguuuaaaagccuguggucuuggaauuguuaaaacugcagcacaccaagguuuaccuuguuucucccguggcauuuaaggcagguacagauggaaguauuaggaagguauuugagugucucuguguccacguaagagguaguucacaggcuggcagcuuugcugccaugucuaugggaauccaaggacaagaaauaaaugaguucacaucuaggagaguuauauuaaguuccaggcuagggaccaguguuguacauugacaaaauagcugucauucaggauagaaagaaguugguuuauaacaaaagacaguaacuguguaaugaguuaaagaccaaaauaaauacauaaacaaacaacuuuggagauaaggaauagugcagcugagucucagaguuuugcuuuuguuauuuuuuuaaagauuuauuuauuuauuuuguguauagcuguacagaugguugugagccuucaugugguuguugggaauuggguuuuuaggaccucugcucacuccagucaggcuuuuguuacuuuuaagugagguuggagcuguucuuuguauuaguaggugacucugugaguuguauggaucauggugaaugucacuucucugugugccuauauaauguuuuguuuccuuccugagggauauuuuuauuuuuuacguuaguuuuuuuuuucuuaaggauuucuugcauauuauccguauaguuaauauucagagugaaaaaaguuucuugaagacagaacauuuuauuuaauuaggguaggcucuucuuuagcucaggcugucuucagacucauuauguaagaugaccuugaacuuuggacagccccuucuuagggggugugugccaggauuuauguggugcuuagggucaaauccagggcuuuaggcgugcuaggccagcacucuaccaaugggguguauccgcaggcuucagauguggagagugucuaguaagacaucgggauccuggagugagaggccuggguauaauuccuuuuucuuugucacacuguagcaguucugcuucucagccucaguugagacuggaauacauuugucaugcuguucugaagacuuuaaugguugaucuuuacugucaccuugacuggauuuagaaucgccuuggagaugugcuuaugguaugucugggaggauguuuccagaaaguguuuacugaagguguccucaucugauaggguggggcccuggacucaauaaaaaccggcauuuaucuguuuccuguccagggacacaguguggccagcuacuucacacucuugcugccgagccuuccuacaucgaaagacuguaucuuuucuuaaaaggcgaggcaaaauaaauccccacccccaggauuuuuuuuggcuguccuggaacucagguccaccugcaucugccuccugagugcugggucuacaggaguacccaccaggccuggcuaaaagaaacccuucuuaaauugcuccugucagacacuuugacacaacaauaagaaaaauaauucauacaaagaccaagugagauaauauguuauuuuuuuaguucauagaguaguagguaauccauggugagggaaaaaaaaaaaaagaacccuuuugaaauaaggacaguauugagaaacauguaugcugauuguaugaguuuugugauauguaaguuucuacucaauucacaugguaauugugcauucugaucauuaaucaaauaauuguguuuacuacuuuaaccuucuuacaaaguauaguuuuacuaauuaguaauuuaguaaauuuauuauuuauuuaaugaaacauuucaaauuggacucagaaaaagaccacaguuuuuguacauauuauaguagaagucccuuaguagguggaaauccuguguuucuuuacaaggauaugucuagaacacguuaaacaaacaggaggagguguggcugcacccguuaggcuaaccagucaacaugccuuuuaaagccauacguguugugugugagcauuuuuuuaaauauauagaaaauccccaaaauagcuaguauaauaagcacacaugccaguaagccucuuauuacuguaaaauacuguguaauacuuugugcguucuuuuaugugacugcaguaggucuguuuacaucagcauuuacccauacaagguggcuacugucauucaggccuuggaaaguuuucagcuucuuugaaacuugugggguuacuucuccaguuguaugugcuguccaugguuggcuagacauggcacaugacuggcgcauggaccuaaagacagauuaaagaauucauuucaaaugauuucaagcacagaguuuaaauuguacaugcacucuuagucaauguccuuguagcugcauuuugguguaauuggagggacauggacuaguuagcuguuucuuuuacuugaugacaguuuugaaugaaaagcauguuagauacaaaauaauuuaacuguugacccccccccacacacacacacacacucuuuuucccuguaugccuucacuccucgaauugguuuuuaucagauagcuguuccagguguaccaggcauauaugaaguaguuuauguaguuucguuuaugccagugcaauccugugaggagcaauuaguacauuauacuuuauaguuaaugagauagauauagagaaagcugauacaucacaucuauuucuuguguaagauggagggcugggauucaaauguaagucuuaguccgugucuuauacuuugcagccuguggucuuagugaugaucauguuaugaagggcaaccucuuuuucagacugugucugcaagacccgugaauuaaaugaccaaaggcauacuaacuguagagaaacugcccauuuuauugaugcuaauauuuuuacaugguaggaggaaacuuggaagaaaugagaagcccuacucagggggauuuuucaggugagauuauguagugacuaguguaaaagaagcuacuauaagggauaccaaguaugggaaauaagugcugcacaccucaggguggucacacagacucagacugacagcucaggucuuccugcugaagaaggggacgucuuugaaagugagaaauucaugucuucuuuauagaaaguucuacuccagcucuaggccgaagacugggggcagagagcuuuucuugugccugcgauuucuuaacuguuuuuauucaaaaucauucuuaugccaaaagggcauauuugggguugaguucuuucagcgauaucauuuauauuugagaccaaugagacguuuuucucacuauguauuguauuucaacuuucaugcuaaaccuacuggacuuuacugagauaaaucaagaacauaccuuuaaacuuuguaguucuucuuugccacugugaccaaaacacaugacugggagaaaugguuuauuuugccucccagucuuggugauuuuagucccucacagcagagaagccugguagagcagcucacugaguggcaacaggacugugcucaugugaucauggaccaggaaguguagaacaaagccagaacuaggggcccuaguaaccuacuucugccagcuaggccccacuuccugaagguuccaccuccucccucccccucccaaaaaagaaaauaaaaauaguaccaccaacuggacagcaaacaccccaaacauaagccagugaggagggaaggagggaggggggaggaaggagggagagaggggggaaggagaaggagagagagaaggagagagagagggagggagggagagagagagagagagagagagagaacacaccagcucucaaguaacuuacauguaugucauggaacaaauuaaaaacuauguaaccagaaaauuauuuuaagaguauuugauuugucuguauuuaauuaauuaacugaaaaaaaaaggaaaauuaauuccuuucucuaaagacuuuaaaugaaccauuuuuuuaguguaugugugugugugucuaggucaaaagacaggucucaggaguugauauuugaccaugugaacccuagggaucgaacuuuuagcucaucagcuuuggcagcaggaaucuuuauacacugcaucaucucacuggccuuagauaaguuuugaaaaaaaguggaagaaucuaaaguuacuuggauaauuauauaaaauauaagucugagguugggcucaagacggaaagacaucaguaaggagccaagagaacagccccagagagaaucugagaaucaagggugugggcaaacauacagugaucuacacuuuuuaucuguaaauaguuuguaaauucuuaacccuuuaaaaaaauucccuaaccccuacucugcagaucagacugcccuggaacucauuguagaagccuaagguggccucgcauucacacaauccuucugacacagcuccccaagugcuaggauuacaaggauaagcuacugugucugccuucuuagcuuuuuaaauuuuaaaagcacuacaaccuuguaacuaguuuuauacuugucaauaaaauaacaguaacugggacuggggagauggcucaggcugcuuuuccagagggacccagguucgauucccaggagccacacaauggcuuacaaucaucuguagcuauaguucccagggaucugaugcccuuuucugauuccugcaggccccaggcaagcaugggguguacaaacacacaugcaggcaaaacagaugucuuucugcauugcucuucaccuuuuauauugaggcaaggucucucacuugaacccagaucucacugauuggcuaguguaacuaacuggcuugcucaaggaaucccugucuacacuucacuaaagcucuugcuguguagcccaggcuagccucaaauuccuaauccuccugcuuuagccacuuaaguguccgggauuucaggcaugcaccacuacaucugguugaaagguaucuuuggaugguuuggguauuauuagcuuggaggcuagcgaugucuccaaagaaccuuacauaauuuacauaugcauacauacauacauacauaaacauacauacauacacacaugcauacauuuaacuggaucuguaguucuuguaaaguguacccagugguccuuaaauaguucuacuuuauuucuaagagugaucaugaucaugagcuggcaucccaauauuaacucugcacagaucaacuaaccauugguuacuuauuuguuugauuuaugucguuuguaaacuugauuagaaguaauuagacacgugugaacacacugugcaguugucuuagagcaguagcagcagccuuagugugaguccuugacaucuaacuuuauauuauguagcuacauugcuuuuacacagggcuuauuaaugcccuuucagguuuuguuaucauuaugguauuugugaguauuucaccaccaggaaggcaaaccuuucuggcauaguagacuccaaagcguucacuaacuuaugcauaauucuuagugacaaaguauaagaacaacugcuaaguaaaagugauccaaaggaagggaacagaugagcaacagcagucauuugcucccuucaagucccuuucuaaucacuggauacuuaacacuuacaaaacagaacaguacagugaaaaccuggccucgucccuugguuuaaaaacagaguguagccaggaggguacaguggcacaugauguagugacccugacuugauguuccagcucacagggaccucuggccucccuguuguacuccccuggcuccuuagccugcauuuuuguucagcacacaaguggacuaacacaagacuccagcacacagcuuucauuuggucuuaugcucagaaacccuuuccucucauuugcuaaaauauauccaacggacacaguagcucuccauuuuacaaauccuuaaaauauagaguauguucauaauauuugcguuauuucccauuauguuauuauguauauguccaucucuuccgcuggacuguagagccuuauauauuauuagugaucaauaacuucuuguggauuuuucuuacagggauaucaaucauucugucuuacuuuaugaucauuaaccuguccuacauuuaaguacuuuauaaguaugagcuauuuauaguguguggggcucccaagagaacucugauguuuguuagucauggauagagcuaguuacauuguguccuugucuguuuccuuucacauucuuuuuuuuuuuuuaauugucaaagucaugauucuuuuuguuuucucuuuuagauauugcuauauggagauuugccaaaaaauaaagaaaauguaauauaucuagcgaaucaucaaagcacagguuuguauuucauuugaugaaauuuggguuuuucuagaaaugguaaaugagcauuaauauguacacacacauacacacaaacacacauauguacacacacauauguuuuaaagacaggauuucaugugacccagaauggccucauacucucugaguagcugagaaugauuuuaagcuugugacacaccugccuucaucuccaagguacaggaauugcaggugcuuucuuuguaugcuuagcuuauguggugcugggcaucaaacccaaggcuucaugcaaacuaggcaagcacugucccaucugagcuacauccccagcccaucaaaaugauauuuuaagguuauuuauuuaaugaguuuuaucacguguguguguaucugucuguggguuugagcuugugaguacacaugccuguggaggccagaagaagaacaccagaucuucccuggagcuugaguugcagguagcgauuaguuauccuggauggauuuggggaacuaaacuggggugcuuugaaagagaaauauguacucuuaacugcugggcuuugucuccagccuuuaaaauauuaaucuuauauauuuaaguaaacuaagcuagcuuuuguuuuuaacauaaauuugcuguggauuuugaaucuggcuugcaauuuuauuuuacuuuuuugguggggaggguaagguuaguaaugugaaagguaugguuuuuguccaggcuucucuucuucccuauuucucaaaauaacccuuuaguuuauuugguuuucugucucuacguuauauuuucuagaauauauauauauauauacacacacacacacacacacauauauauacauauauauauacacacacacauauauagugggauugguggacccaaguguauacauuuuaauucuuaauucuacaucuagccuuuuauuuacucugagacauauucuugcucuguugcccaggcuggacucaaacucaaaauucuccugccuccgucucuggagugauggaucacaguuguaugcugccacuguuugcacucuaacuguguaguuguuaagcugcuuauugguaugcuggugucugacugcucauuuccuggacacagugcuguuauaauuagcuguaguuccuguugcucuuuaauccugguagcuuaauucuaacuugcuauuuuuccgucagagaaggcacaagacuaguuuccaguauagaacuguauuuacuuccaaucaggucaaauauauauauauuuguuuguuuguuuguuuguuuuguuuuguuuuguuuguuuguuuuugagacaggguuucucuguauagcccuggcuguccuggaacucacucuguagaccagacugaccucgaacucagaaauccaccugccucugccuccugagugcugggauuaaaggcgugcgccaccaugcccggcgggucaaauauuuaaaacuaccucuuuuugaaugauuauugaugaauugugaauuaugcugcuaguccugcggucccuucaugaggguccuccccaugaggcaccucacagguacagggcccagccaagaggccaaaugauugccuaaagugugcuuucauucuccaaauaauucaccucauccaaaaucccacuuccuauauuuucuaaaccacggccacguugugugcauccguucuaugguucguuugauugcuuugacaagcucaggaccuagcaucccaaagcuaacagaacccaaccguuaggauauucugaauggaaggucacuugugcugauggcuuuuauuuuccucccacccccauuugguugggauuguagcucuugauaccgcacccccaacacacacacagacacccggaccauagcuaacacagagguaaaggagcugaaacacguuuuucucugugugacacacuggaaaacugaugaagcuccaaagcuugauagggauuuugauaucagauguauuauccugggucauguucgugagacuggcucagacucugcauuugacuuugagucgaaccacagaguggcccagagugacucucugcuucuagccagccugucugacacacuggcuggcccuccucaccacaaucugaccucaugcuggugaggggaauuuuuaccuggcuggcccccaggacagggcaugggccauggcagcauccugucgcaguucuguuguucagagguggaucccacugcaggaaacuagaguuucccaucaaugucuuucuucucaguuuuauggaaauaaccuuuccuuaauggaacuguaauccuacaaggacaggugggaccauguacucuugcucuccugugggucucacaguaacagggcggcugaaggcauggcugugguugccuuugccuuccuuuagagcaggcuuccaggaaagcacugugaguaagcagcagguaacaguuccuacuugguguuugagaucugaagauaacguggcaagcaagaggcuaagccaguuccuuucuuaguuuagagagacauuucuugacucugccuccaggugaccuccucuaggucugauaacaaccagccuuugggguuugagaacauucuuguuuuuuguuuuuggcaacuugaaaaaaguacccagagccuuugcauguuaagcaagaacucuucugccuagacaagcaacugugcaacacacacagacacaagcaagcagcucaaccuaagcaugcugcauuccaaaugccuuuaagaagcccacaaguugggaacauaccagaggaaugacugaacugcguuagaauugcauguuagucuacgugauggaagaaggcauggagucuucucuaauaaaacugcucauggaagacuuugcaugaauuccaggcuuccagaggguucaaaccagcaacccaagguggauuugguuccuggggaugacauauuuagguaaagagagcuuaagaaucagucucugaaaguguaauuuacagaaaguguucugggacugcuguugguucagccuguucacucucacucuguucacucuggccugaugcucaugaagaguugaccuuuaccuuagucucaguugcugcuuuuacuugguauccugcugugucuacauccuugcugcuucuaacuugucugcuuucaacacuguucgccuuuaaaauucauuccuuuucauuuccugucugauagaguauaugguucaguagauggcuguaaagcugagggcucugcauucugggagacccugcucaugugugcugcuucuguguguucucugccagugggcagagcacccaggcucucugagccugcugguugggucugaaugauaucuauugauagaagcuuuaaggcaguguacauauaguuccacucaaaaacccagugcagugccuggcauaugggugacauuuagcaguacugugaaugaugguggggauagcccagugcuggauucaugggcauaaacccuuaugugucaucccauaacacuaagaauuggugagacacgacuguacagacgaggaaaguaagguuuauuugccuguucuccucucuucaaguuacugaaaacauggcuuauggcuagauaagccucauggcuagaucacugcuaaagaguccugacaaccaaauuaaauuauucuugccaaaacacaaaauacagauauccaugugaauguaauacauucccuuacauauuuuaauccagcguuaucucggaagcagugugcauaaguagagaacaguauugaaucuauauuguauucuuugacuguacuuauuuuuuuuuauuugggauaaggucuuaccauauaaccccagcuggccuugaacuuaccauauagaccagucuggccuugaacucacagagauuugccugccucagccuccuccaacucugagauuaaaggccaaacuugccaccauuccuggcuuguaaguuacuucuuaaguguuguuacuaaaauuuuuaaauuuaagguuaugguguaggauaguuuaucuuggaugcaugacauauuuaaaaauauuuauauauucucuuaauaguuuuuagaagguauaccggacuccaaaauauaacugcuuauuuaaauauaaaaacagauuuauuguuccauaagcuuaaaaauuaaagucucaggaaaagauaccaaacuuggcuuuuaccuauuuaucucauuuauacccagaauauucacuggccagcaaacucuguagagcagugauucucaaccugugggucacaaccuauccugcuuaucagauaguuacauuaugaauuguaacagcagcaaaaucacaguuacgcaauaucaacaaaauaauuuuaugguugagggucaccauaacgugaggaacugcauuaaagggucacagauuuaggcagguugagagcuauagccacauagagccuuuacaggguucauucucguuguuucuauagaaaacguuuauauuagauaacuuucucacagacuugguuauauuuccaagagauagcuguuuuauaaucccuacucuaaaacaauuaagauuuuucuagaaaguugauuauucacguguaaagagauaaaauucuaggauauuucauuuguauaugcauuaugaaaaaaauuuaaauggucaagaauuaugcgauagcuguggaaaagugccccauuuuaacacacuuugaacuccaggcuuuauacugcaguuuguuuguuguuccucccccgccccauccccaacuuucuuucaugcuaggacagaacccagggccaugcacgugauuagaauauacuccuucacugagcugcacccccccccccccaguucuuuuauuuuauuuuuuauuuugcgacauugucucacuaaguuaccuggguaggccuugaacucaugauccuucugcuucagucuccgaaguagcugggauuagaggccugugcugucagccuggauguaagaguuuguuguugauuuaaauuagauauugucuccucuaauuaacuccauuuguugucauuuucauggcccugaguacacuucaacagcaucccuguucauauccuugaauucuucucuaaauccuagcagaccuuuccugaucuuucauuuucuguucacauggaagguaccugcagccauuuauucucaagucuucaaauauucugcuucucaggacacuuucuuauuucuuuguauuucaccauagaaguuuugcaugaccucaggcauauaagaacaauauaaucaaacacugacugauaauaaagaguggagagauuuuuauauuuuuuuguuuuuuuguuuuuguuuguuuguuugguuguuugguugguugguugguugguuuuucgaaacaggguuucucuguguagcccuggcuauccuggaacucacucuguagaccaugcuggucucgagugagauuuauuuuuaaauacauagaauuuuagcaguuauuaaagauaaaaggcagucuacauacugugagauggauagguuuguauagaagaacuugacuuuggcugaauauuugauacuauaggauguagagcauuuccuuguuuuucagaauucaucaggauuuugauuuuguagaugccagugcuaagaauguuguuuccacaaacacauuguacaauauggcagaauuguguuuagugucauuucagaaauuguuugaaacuccauucuaauucuaggucaaaauucauuucauggaacucaagccaguuuuuauaaaucaagcauucuaauguaauacaaucaaaagugcacuaguuuuguacuuacaugcuaaggaauggcacugaugaaauauucaccuacuuucuguaacagcagaaagcucuauguauacgaaauguacuucacuuaauggcacgguauuacauauaugcuagcaugugcagugagaagcacgcauguugcauacucaaaacagaagacgcaggggcagcugcacaaggcagcggugggcagagacacuuauucauucauauguaugugguuuugaauuaaguuuugcucauugcuuauuuaaaaacuuuuauucacaauuuuuuugaccacuaaaaucaguuugcaacccacaguuucaaaagcugcaaaauaagaccuacauaucuaccucgcacaauuguaaaucacacgagacccuuguuuggguauuguaagaauugaacacuguauccaggaagucauuaguaaaaaccuaauguggugccuugcuuuuuaaagauuuauuuacuuauuuaauauauaugcccuaucauauauauaccugcaugcuagaagagggcaucagaugucaguagagaugguugugagccacgaugugguugcugggaauugaacgcaggaccucuggaagagcagccagugcucuuaaccacugagccaucucuccagcucuuaauguagugccuuuugucagacauuguguauaugggauauuuagcuacaguuguuucacuugccauuuuuuuccuuauaauuuuccauucuucauuuaaaaagaaauaucucuuauuuuuuuuaccuguaauuaaauauuauucaacaguuauuuaguauuuggguguuggguuacuuaguauuuuguagcuuuuaaacauuuguucuuucuuuuccugaguauguuugagucccugcauauaugccugugcacugugcaugugccuggugcacuuggggcucauggagggccucauauccguuggaacuggaguuagaggcagagcuggcuuauggguaccagaccugggcccucugcgaaagcagcaacugaauccuuaaccacugaacaaaaucucuucagccccauguauuuuguaccuuuguguuuuauccuugaaauaaauggccuuuuaagaaaugagaaaagccuuuaaucccagcagagguaaguggaucacugaguucaaggccagcuuguccacauaguuccaggagagccagggcuacacagaggaaaaaaaaaauacaaaaaacaggaaaaacacacaccuccuugauuuaaggguuuuuuguuuguugguuguuuuuuuuuuuugaguuuuggggaggggguauauuuuuuaaugugucuguaguuggcuuuguuuuaagcauuuuaaucauacuuuauuuuuaaaaaaacuaaaagcuuuuuuaaggcuaggucuugcuauguggcccuaguguuccugggacuugcucuguacaccggguugacucugagccugugcgccuucugccucugccuccauaguuagauucucaggacauguuacaaagacugugcugugaagaugaguuuuuguuccugggagggaagguuggagcugacuugugagguacugacuugggucugccuuacaguugacuggauuguugcggacaugcuggcugccagacaggaugcccuaggacaugugcgcuacguacugaaagacaaguuaaaauggcuuccgcuguauggguucuacuuugcucagguaaacuuugucuuugcccuuuuauuucaaacuuaacaccauuuaaugaaacuauaucugauuuuuuuguuuauguguuuguuuuaugguacccgugauugaacauggggucauaugugugcuacugagugacagccuuaguucagacauuuuuuaaagcgacuuuuacuaguauuuuuauuuagaauucuauaugugugcacaugcauaugugugcuugugugcacacguggaugcaugugaggucgaaggacaauuuucaguacaagugugagugucacuuuuuaggcaccuuccacucuuauuuugagacagucuccuagaccuuugcugaguugcccaggcuagccggccagugagcccugggcaucuaccggucucugccuccuuaccuuuacuuagguuacaagugugugcugcuacgcccagcuguuuacuagauucuagggauccaaauguggguccucguaacuugugagacaaguacuuuccaaacugagccaccucccuagcucuucuucacgguuccugauggugugugucuagauggcugguuguccguauauuuaaguccaguagcagaaauacaaauaccuaggaguccaauagaaagcuacaagugcagaauugacaaucgguaauguucggaaauugauucaaaaguaguuagugagugacagacaggagcuaaaagcagacucugagcucagagugugaaguguggagaaauguguuuucucacaguucugaaggcugaaagucuccccaaggucaggaugugggugguacugcugucucccaacacccaccucuuuggauuauagacugcagccuucucccuguguucugagccggccuuucccacauguggacauccuugguggguguuccaccagcagggccucagcuagugcccuuauuucacuuaacuguaaugauuuucuuaaagacccugucuccauacacagucacuguggaagcugaagcuucaauguaagaguuaaggggggagggggaaauuuaguccauaauggugucacaccaaucucuguagcugaguccaugauucaguucuuuaaaggcucugaguguagacauuaucuuaauuauuuugcccauuuauguauuaucuuuaauuuauuuuauguaacugaaugccuguguauauauguuucugguuccuaguccauauuuuaauuccuuaaaggauggagguguagacuuuugucuuuuuaauuuucuauccuucccuccuggccuccuguggccucuuuuacguauuuauuauuuuuaauuuauuuuauguguuugaguguuuuguaucuaugcauuccuggggcccauggaggucagaaaaacacauuagguggccuacaacugaguuaugggugguuugugaccauggggugcugggacuugaucaccagucucugagaagacucgugucugcugagccuucucuccaguccugggaguguggauauuuuaaggauacuuuuaauugacuuggugaaugacaguagaaaaucaaugaguuaggauccaucggaaaaagcuuuugaacuaaaucuuuuaaagagaaaauauuuuaagugcuaacaaaauuaaauguguauuuuccaugaugcaguuuuacuugggcucuguagaaauaggauuuucagguacauauuguauauauaguuggcaauauuuaaauacuaacugucgcuugaguucugaaauguaguuuuauguuuuuuacucauuaggaguacaguugccuuaauaacuacggagauuaguuauuaaagaauaauugcucuucuuuuuucuuuucuguguaccagcauggaggaauuuauguaaaacgaagugccaaauuuaaugauaaagaaaugagaagcaagcugcagagcuaugugaacgcaggaacaccgguaagugcgcccgcuuuuauuccucaaggcagguuaagaaguuaaguucuuaagucauuuugaaaauauauuaccccauguggagcaauggaacugguucgggguuuuguugagauaagcuguccucuggccgugagguaagauugcugcaggugauuguaagguuucuccugaguaacagucagcaugggcucgggacgggcaagggcaggccuuagugugcagaggauggagcucacugaagccccaaagaguuagucuucacaugagauucaguucuagaagaaguuaaauugcuuucuuucuguguaaauuuggauuuuuauuguagaaauuaaaguuuguuuucuuuuaaaacaaacacaaacccagagcaaagagucuccuagugaagagucauuccgugucaguauuuuacacaacuguuuuucuguaaagggggaaaaagaauucaaaucuucucuuucaagaaugcugacugcugccaacugccucuccccguggccccucucuguauagacaggcauagcuauggugaggacuugggcggcucuugucuuucuccucucucugcuucucuacccuuucucucgugcccuccacuuaccaggcccugggaagcuacacaccaggcaacagugaccagggccucggccugggcuucgaccaauuacuagagcagaaacagcagcagcugcaguguuguuuugugcugugcacuguauuagguuguguuuucaucaccuuuggguuuugugauguuuugaugaaguccugguaccauucuaguuuuuacauucuggguagauagaguuuauucaaggucucaaggcauaugaauggaagagcuccucuuuacagccauucguguagcaugcauaacugcucuucuguauucucucuagugucuuuuuuuuugugugugaaucugaugucuuguuauucaccuacaauguggaguaauggucauaaacauauaaaguacuuaugccuuuaucugccaaauuguauuuaacuuuucagcuuuuaauauaacuuuuuauauaauaauuaauuuauuuuaaaaaaaauugaauaccagccuguuauaguggcauaugccuguguuccuagcacucaggagacaaaggcagaagugugagaacuucagacucauacucagcuauauacaagaccccaaauuugugcuagauucugcaguacagccaugaguguccccaucuuagagggagaucgcucauccuugugcuguucuuuaagucuuacccugcaacccacuguaaguacacucuugcucacaguccuuuagaaucucacacucuuucucuuuacagacaccaugucauugcccacuuuauuauuuaucugaugucuacaaagauuaugaaagagaaacuuguaugcauucuguguaaaguacuugacacaaauaauaguauucaagaaugacuucuuaaaugaacacugaaugaauaguuuguucuaauuuuuuugaucaacaaaucaaaaaauauuuagauuaaauaucuaagauacaaagcauaauaccacaugaaucauuaaagugaguaaucaaucuuauaagugacugacccuaaaacucauagacauuaauaauugcuuucauugcuuagauauaaacuuuauugauuaauacguucucaugaaagugguucuuggaagguucuggaaacgaaaauauuuuucuuacugcuuuuuucuucuaguaacugauugaauuuuucugcaguuccauaaagcaucuggucaauugcuauuauccaauaugaggauauauaacaaaguauugauuuuuaaauuuggcggugauaagacaagacugggcgugugaaugagggggucucuguuucuugucccuucucuuggguucuuuuccuuuuguugguuugccuucuccagcugcuaugugauggguucugauuaucuuauuauaucuuauuuuguuauuuuucauuguuaucucuuagaagccaacauguuauaucaccuccacucccaccauuaggugucucacaaauaccccaagcuaaacaaccacaucaugucauguucuguauacuuccauaaguguuguuaacucuacugacucuugugagcaggcccaauuggcuuuaucccuagcugggugaccuggguuccuccccaacaccauaccguccaucaaacugaguccuuuuccaagcacacaccagauacugcucaucugaggacucuucucauccaccuaaggacugccugcuccucggcagaaagggccucuagucccauacccuuacgcccucaccaaugccuuaggaacaugugcucaaugccccugugggucauuuccguuuacaguagggaaauuugccugauaacuugcagcacaccuauaaagaggccuugcuugcucucauauuuagcuggagaagauaauguacucaccaacuccacucuaugcaacccagucugcucugcccaugccagucagacgugaaucuuacaccuggauucagauugaugaaucuacaacaucacccacuccaugcuuccuucuaaaucagcaguucuagccugaaugacagaugcuacccaagucucaucuaguuagcccuguccggaguaacccugaccuugaggauuagaccaggaugcacauccugcaccaguucccuuuguccaccugacuucaucccacccgggccauagcccaugcucaggcuccacccuccaugcacaaagcuggcuuuuccagcuuccuucaccuguaucagacacaaauagcaaaagggguccacgugccuaggucccaucacaagaccaugugcgguaguuuggaaaacagucuccacuugaggcucagauaguuggaaucuuggcucucauguaguuguacugauuagaucaguuuaggaaguaugaccuuucuggaaagaacauauaacugggaggggcuuugagauguaaaggccccacacaauuccuaguucaaacucuacugccugcucaaagcuugaggcaugaacucucacuguuccugaugucaugguuccugucugcuuccacaauucccuaucauuaggggucccuuuccuuccuggaauuuuaaguauaaauaaacacuucuuucuaaaacaacaagaacaacaaaucugacacugauaauggauucuaaggcgucuucucuggauaagaaaaaaaaaagaauauauuugcauaggugcuguauuacuuuugucauugguauaaccugacuggaagcaacuuaaaggaagaagaauguaucuugauuuguagauuaagagcaccaugacuaagaaggcauagcagcacaggugcaccagcaagaacauaggcugcuagcucagaucucuguagauaugggaacagggcaggaagcuaguagucuauaaaccucaggacccaucccauggaguuccuugucuuccagugauguccugugucuuaaaguuucacaguucccacagcagcaccugccgucugggaaccaaccugugguggauauuuuacaacgugauaggcauauuucgucucuagcccuguagguuuauagccauccuauacuucaguuuaucuaguccaccucagucugauggucuuauaguuccaacacuucaaaacuacaaagucuuaagggccaugggcucggguuuauuagagcaguaacaccucuacuagcuuucuguguuacccacuccucuuaaggucugguugaaauccuaauaggaagcagcuugagaggaggguuuauuguggcccauacuuuguugguacauucuaucaugcaaggguggcacugugauacagccgaggccauccgaggaugguacuguuggcuuacaucugggugggacaggaaaugguaauucucaaggcccaccugcuuggugacuucuuucaguuaagccccauacucuaaauccucuacaaccucccaacauaaugccaccagcuggggaucagcuguugacagugcuggcccaggggagcaguuuaaauccagaccaggggaccugaaaacagagaacugcagaggggcugugggacuuuauaccagcuuugcagacaaaucacggcauuucuuugugagcuugguucauaaacaaauauauauucuccuauaggcuccuuuaguggguguuucauauccacaaauuuguucagaaaaacacuguguuuuaugcuagcuguguaggagauaauaccgcugggagucacuugagcauggauaagugacauaguucguccucaugagucccuguccuguuucuguauuauguuuacuugaugaguuuaguuugucaguuggccaccaauuaaaaaguaucauuuuauuuuuuuuacaauacucaguucucaaguuaggaguuuuguuauuauauggcuucaauauucacauuuuaaccuuuccaggaguuaaguauaaaaacuuauaucaacuguugacuuaguaaauaucuauuacagauacuauauucuucuuaguuuauaucaugaauaugagguugcuuaaaguaagugauguaaaauacacuaggggaugcuuauaaaauggaauguugugaguuuuuugaaacacgaguacuaaauucauaaguuuuuaaauaguuacacuguuagcuucaguacugcuagauacaugucuauaauggcugaagaguggagcuuggauauuauaaguguacucuguauauucaugcagacauauagcagauuccacuaguaugugugguuaauaugugcuaauaaaaauuuaauacaaaagucauguuuuauuacugggaaccagagggguugguugugcugauuuuaagucagugacuauuagcauauucuaagaaacaguuuuaggauuuuaaagauuggcuuuaccauaaauguagagcuauguuuuacuauaauccauauuauggucggccuuaauucaaucucugcaguuugguuacucugcucaaagugaaggucauuuauaaaugauacacauuuucucaccauaggaaauacuaccuggccaauaacagaguuagaauugcuaaauugaugguaccaacaauggacucaacacaaacuaaaguuuauuuaugcccacagauguaucuugugauuuucccagagggaacaagguauaaugcaacauacacaaaacuccuuucagccagucaggcauuugcugcucagcgggguaaguaaagauuuaacuguauucagaaaaacacuuuuuuaagaagagugaucuuuguuuccuucagagucauacuaaagaauaugcguuucuuguaagagcuaagugagagaauauccgaucuucuacagaguuagguauauucuuauuagucugugucugagagguuagagacgcaggcuugcuauggcacauuucccaugcugugaauugaguuaaaaauguagguaaaugauauccccaagaaaguauacuuuuggagugacucaguauaaagccugguguuauaacauaaacacgcacgugcggauguauauguagcacauauguaaacacagguguaugcauuguaauaagaaaguggaggucggggcccacugcaggcaagucuuuuagugaugcugagcuaaugcugagagguagaaagaccaagaaggcuggaguugcucauucggcaaaggucagagcucacugugugccauaacucgaguguucugucucccuuuugauacaguuuucuuguuuuuaauuauuaguuuuuacaauuaucccauaaaaugugggcucauuguggucaucguuuucauaaaguccuucaaguauacacccagcaaguaucuaaauacacugggaagaaucagucagcugauggcuugaaguuucaggacaucuagugccacaucaugcuucagaaccgacccgcacuuagucagggucauauucaugccacgugaagacgagaggaggccaugccgucugacuuaggauggaaauuuccuucgagcaaacacgaacgggcuaggucuuaguuauaggcauagugucugugguuauacuaggcagacauuaguggacuggguguuagaagguacagacaggcaagaauuugcuguagauuuguuucccucauguguugacaccacaucuaaccugcuuuuugagcuucuaguccuaauaaucucauaaaaauacugguugaaccagaaaugguguugcaaagcuaugaucccagcuccugggaucuagggugggaggaucauaaauuugaggccagcuugggucugucuuagagaaaaaagaaaaauaaaaagucuggucaagguaacauggagccuggaaguuucacagggugauucuguaaagguccugagacaagauggccucuaguggcgaaugacuuagcugacaagaaaacuuucccagcuugguugacuuuucagacuucauacaaguuugugaauaaauuacacuccuucugcccuugggacugaacucagauaugugguugugggaauggcuuucuuucccacaccacccugcauuuuaaaaauucuucuguagacagucccaccauccuguagcuguucuuccuuaugucgccacuuucccuggagagaggcagugcagacuucaacccgcuucucccuagucgcuguucauagcacaucgaaagaccuagugcuuccugugaaauuguaaguacauacuggaguccaggagaggaggaagccgaacagaguggagggaaugcugaguucuguccuaagaaagacugcgugcuuagcaagaugcugcugcucuccugucgugucuuucuugucagaacuuaucaaagagaaggcucgcagugggucauaaucuucccaaggaccagccuucccagcuucucgcagcauaucucauucauguagauguuuaauggauaugugucaaugggguugaccuaagugagauggcaauguaugugagcauucuaggugugagguuauggcauuaaacuuuaauuuccaucuauuugugguaguugauaaguaauuuagauguugacuuucauguauuccuaauuaugaccacauugaaucuaccugcuuucuaggccuugcaguauuaaaacacguacugacaccaagaauaaaggccacucacguugcuuuugauucuaugaagagucauuuagaugcaauuuaugaugucacagugguuuaugaagggaaugagaaagguucaggaaaauacucaaauccaccauccaugacugguaaguccguauuuccauagaagcugaauaguacaugguacagguaagauaaacucuuguuuguucgcuuugcuuagcuugguucaguuugguuuucaguagaggguuccacuaugaagcucuggcuggccgggaacucacuauguagaccaagcuggccuugggcuccacuacacccagcaccaaucacccacucuuaucuuuuaugcuuuuuguuuuugcuuugagcuuucuuuauaacauguuugggaaggacauugucauuauuuacaagaagaaauauggucuuuucccaacaugcuagaauuuaaagacucagaacucuugccuuugucagugacaaagugagaauggcugugaagugacguggcuuugagugagaauaguucagguaacuauagccacagacucaacauuugaacaugggaacaggugagaacggagugauggaagauucuggccccuuucagagaauucauuuuagagagagaugagaguaguaaggaagagagaagagagagacgugguauuuugcugcagacuaaagagaucucuuauaaucgcaguacuaaggaggaagaagcagaagaugaugacuacagggccaggcugaacaaucuaguaaaauccuaagucaggaagucagggcugaggugcagcucaguaggagaguuguugucugcccuacacaaggccuggauuuagcucccaguagcaacgaagggaggcgagggugggcaaaaucgaacacuuacucuuggagacucccuguaugaauauuaccacacuccaguaaauacucuccagagauuucagaugagauucugcuuccugguaaacaggaggccaagaauauuaugucacacugaacaugggauggaagacauguucugaggaaugucugcacuccagugugaugaagacuugaaguuuagggacauuuucccucccuggccccacucaccccaucuguauugaguauuccccuagugcucaucuuuauuuguauguuaacuuucaggaaggggaagcagauugauauucaaacccagccaguuuucuuaaauacuuuguggaugggauuggcuuugacaguaaaugaggaaauguaaaauguaaaagauucuaauuuuuaauauuuuaaaggugagguuuucuguuaguacgcagagugagagguuucuuacugaugucugcguaccuagaggaaggauggcuacuucuccaaggcuugcuguuagaagucagugacaugggcuuaacaagagauaugugcuaaugagguuuuaauuucagcuuaauacugcaaaucauaagugcauagcuuuauuguuuuaaauucuuuuagucuuaauguuucauuuuuaccguaaguuacuuuguauaaucacaaauucuaaacuaguaagacgugaaauuuucuucuucuuuguuagaguuucucugcaaacagugcccaaaacuucauauucacuuugaucguauagacagaaaugaaguuccagaggaacaagaacacaugaaaaaguggcuucaugagcgcuuugagauaaaagauagguaagugguaagagcuccagcauuuagaaagugcaguucaaccaaauuuuacucucagacccugcuugaaaggagucuuuuuaucuucauuauuuaguaaauacuaaucauaccugcauagacaagaccacauauacuuaaauguagcauguuucauggugcguuacccuuguuuaacaauuaaguuuaacauccuacaucaguuugccuguugauuucuguaccaugacaacucaacacagcgaugcguuuauuccaaagucgauagcacagcaaaagugaaacuaaagucuguauuguuucaagaaugcuuuuugugaacucggguuaaaucuuauucuauccuuucguguucacauuguacauuuucaugagucacuauaaaaaucaugacaugguggccuaccugcaguguuugcuggacaguaggcugcugugugauaagagccuuuccucuucagcuacacgggggacacgaggcuuugggguucaagacugaagcacgggugagcacaacaccuuuguguugugggaaggaagggaauuguucuuuucauaaugaaauuguccccuuucuugaguuaguagaaaguauuacuaggauagagaguugaaaugaagcuuuauauuagauuuaugccuuguguugucacguguuucuaccugacauaacuuuucaacccagccgcucaggauuauuuugaugaugggaacaauguaagaaggccuauguaucgguaacucacuguuguagcucuguggaagcggcucacaggcaguagggacgcuucugugcuuuugugccuguccugcuguuagaaucuuacagaggaggaugaaugaaugacccuuuuuauuucucuugucugcuuuucuaauuuuaugggaauaagaacuuuugguaggucucugucacuggccucuuguugugaagagacaccuugagcaaagcaacucuucugagagaaagcauuuaguuggggaauuccuuacagcuucagagguugaguucguuuucaucaugcugaggacagggaggcacucaggcaggagaaguaguugagagccacauucugaucuacaggcagagagagacagacugagccuggcauggguucuuggaaccucaaagccucucaucccuaccccaucuccccaccccuauacacacuuccuccaacaaggcuacaccuucuaauccuucuuaaagagucaccacauccagcggcuaagcauucagauaugugaaccugucggagccuuucuuacucagaucaccucaggaggaaaacuccuaugcuauaagaauuucuuuucuuucgcaucuuugaaagcuuguuuuugugugauuagauccuggccucacacaugcucggcaaucauuuuacuguugagcuccagccucagccguuuucauuggcuuaugggaugcgagcuaugggagagaagcuagaaggccuuucguuuuaugagucggguugguggaaccacuuacagauggaagauuuacaaacaaaaaugaagcuggggccaucaaggcucagcacucgcugcucuuccagagaguucagguucauuucucaguaaccacaugguggcuuuguaaauguaacuucauauucaaugacccugacacccucuucuggccucugugggcaccagacacaaucaugguauacagacacacacacuagccaacacccaucuacauaaaaguauauaaacauaucuuuaucuuaaaaauccccgaaguccucauuaaauaucuuagauccccgccguguuuugauuuuuguuucccacguggugaggauauaauaucauguccauacuguaaggcgugaaugcccucccgugccucucggacaccucugcacucauccaaguuuucuaaggagcuguacuugcucagcaaguacucaauaccuaauaaaugguuuauguuuguuucaacaccaaaaauguccaaaacugaaagaucaauucuguuguuuuccuucuggccauagguugcucauagaguucuaugauucaccagauccagaaagaagaaacaaauuuccugggaaaaguguucauuccagacuaagugugaagaagacuuuaccuucaguguugaucuuggggaguuugacugcugucaugcugaugacggaguccggaaggaaacuguacaugggcaccugguuguauggaacccuccuuggcugccugugguuuguuauuaaagcauaagcaaguagcaggcugcagucacagucucuuauugauggcuacacguuguaucacauuguuuccugaauuaaauaaggaguuuucuuguuguuguuuuuuuguuuuguuuuguucuguuuuaagccuugaugauugaacacuggauaaaguagaguuugugaccacagccaacaugcauuugauuuggggcaaacacauguggcuuuucaggugcugggguugcuggagacauggaagcuaaguggaguuuaugcuguuuuuuuuuuuuuaauguuuucaugaauuaaucuccacuuguaaagauuauuggauacuuucuguaauucagaagguuguauuuuaacacuaguuugcaguauguuucgcuauauugguuaucuuccauuugacuacuuggcagcucagacucuuaauacuaaaguauuuuacauuuugaagcuaugugauacugguuuuuuguuguuguuguuguuaguuucugaaagucaaugaaagacacuguaaugaugcguuaagauguuccaagaaaaaggugagaauuauucauggcaaaaaagaucugucuaguguauauuuuuauuauauugcucuauuuagcuaauuuucuuuauauuugcaaaauaaugaacauuuuuaauauuuauuaaaaugcuugauuugcauacccccgauucuacagagaauaauguguaaagugucagaauagacuugaagcucugcugugacucagucuccuuugucagagcuucuaguagcccagcuacugagcugcuuuguuaguaccuccagcaccugagccguuaaguacuuauaaaugcaagggacccguuaucuucauaucggaauagacaugaacagagcucuaaggcgaugaaagucugccagcauccucucuguccucgcacgugccuucugccuggcuccauuugcuuuggcacugcguucgaucuagaguguaggugcucacugcuuauuucagcccuggcucugugguuuuguguccuccaguggugcuguucacuguuggggugcagguggugcugcccugacucagaggggcagcucccuggcuccugagggugagccuucuuggcuacuacagaaguauugugcguuuguuuauggcaagaaccaucaggauuggauaaauguguuauuucucuuugauuuccauggagccacacuguugguacauguccccugugaacagagcuaccuuucaggagcacaucauacugucgugagucacggcacgguguguccugugagaagaggcuuucuaacgugugauuugccguguuucuauguugugauuuaagcgugauugccuacuagucauucaagguaacauuucugcaaauuucauacagauuuuugucacaaaauuacuauaccaaugaucuaguugaaauagaccaauugaaucacaauaaauaauuuuuuuuaauugagggaaaauuugcuucuuguuuuuucaaagccagaaaacgagccauuucaaacaucuuugaagagucaugugcugucacuuguuuucuauguguuagugucuauauucauguauggauacacaugaacauguauauucauacacacacgccaauagaauauaacagccuaaaaacaauccagcuuguguaucauguuacugugcugaauuguaaugguuuuuacuuacaaagugaggcuaaaaucgauuucaugucuuuguuaaauacguuuuuucagcaauccuauuagagcuuauuuugaccagaucaaaauaaguacaaguucagagacuuuaaauauggcugaggucuagagcgauagcucaguaguuaggaacacaugccacucuuucaagggcuucaguucccagcacucauauggaggcucacagaaggcuggaauuccagcuucauggaauuggacacauccucuagcuuccauggaucugucugucugucucucccuucucucucucucucucucucucucucucucucucucucucucucucacucacucuuuaaauaucauggauaugcugugcauuuaaauuuuaagacacagaaccauuggaauuacauggauuauagcugauucucuuugaacagggcacaguguucugcguaagaucucuugaucauuagcacuggacucacucuccucacaaguagccuaucaaaugugguauuagaaaauacauugugucaaaaucuuugaaagaugagaagaaucuccuaaacauguuuauuuugacuugacaucacuauuuccugaaaauuaacugucuaugauucuuuucacauaguguaagaucuuacuuguaucaccaucagcuugcagcuuaggggcugcaguuguucuccuucauaagacugccauccgugugcaugcuuuuauguuuuucagaaaggauguugggaugaaaguaagaaaacaaauaaagucucuucuugucucuca

SEQ ID NO: 4319 - RNA, 38583 nt, Mus musculus
ugagagacaagaagagacuuuauuuguuuucuuacuuucaucccaacauccuuucugaaaaacauaaaagcaugcacacggauggcagucuuaugaaggagaacaacugcagccccuaagcugcaagcugauggugauacaaguaagaucuuacacuaugugaaaagaaucauagacaguuaauuuucaggaaauagugaugucaagucaaaauaaacauguuuaggagauucuucucaucuuucaaagauuuugacacaauguauuuucuaauaccacauuugauaggcuacuugugaggagagugaguccagugcuaaugaucaagagaucuuacgcagaacacugugcccuguucaaagagaaucagcuauaauccauguaauuccaaugguucugugucuuaaaauuuaaaugcacagcauauccaugauauuuaaagagugagugagagagagagagagagagagagagagagagagagagagagagagaagggagagacagacagacagauccauggaagcuagaggauguguccaauuccaugaagcuggaauuccagccuucugugagccuccauaugagugcugggaacugaagcccuugaaagaguggcauguguuccuaacuacugagcuaucgcucuagaccucagccauauuuaaagucucugaacuuguacuuauuuugaucuggucaaaauaagcucuaauaggauugcugaaaaaacguauuuaacaaagacaugaaaucgauuuuagccucacuuuguaaguaaaaaccauuacaauucagcacaguaacaugauacacaagcuggauuguuuuuaggcuguuauauucuauuggcguguguguaugaauauacauguucauguguauccauacaugaauauagacacuaacacauagaaaacaagugacagcacaugacucuucaaagauguuugaaauggcucguuuucuggcuuugaaaaaacaagaagcaaauuuucccucaauuaaaaaaaauuauuuauugugauucaauuggucuauuucaacuagaucauugguauaguaauuuugugacaaaaaucuguaugaaauuugcagaaauguuaccuugaaugacuaguaggcaaucacgcuuaaaucacaacauagaaacacggcaaaucacacguuagaaagccucuucucacaggacacaccgugccgugacucacgacaguaugaugugcuccugaaagguagcucuguucacaggggacauguaccaacaguguggcuccauggaaaucaaagagaaauaacacauuuauccaauccugaugguucuugccauaaacaaacgcacaauacuucuguaguagccaagaaggcucacccucaggagccagggagcugccccucugagucagggcagcaccaccugcaccccaacagugaacagcaccacuggaggacacaaaaccacagagccagggcugaaauaagcagugagcaccuacacucuagaucgaacgcagugccaaagcaaauggagccaggcagaaggcacgugcgaggacagagaggaugcuggcagacuuucaucgccuuagagcucuguucaugucuauuccgauaugaagauaacgggucccuugcauuuauaaguacuuaacggcucaggugcuggagguacuaacaaagcagcucaguagcugggcuacuagaagcucugacaaaggagacugagucacagcagagcuucaagucuauucugacacuuuacacauuauucucuguagaaucggggguaugcaaaucaagcauuuuaauaaauauuaaaaauguucauuauuuugcaaauauaaagaaaauuagcuaaauagagcaauauaauaaaaauauacacuagacagaucuuuuuugccaugaauaauucucaccuuuuucuuggaacaucuuaacgcaucauuacagugucuuucauugacuuucagaaacuaacaacaacaacaacaaaaaaccaguaucacauagcuucaaaauguaaaauacuuuaguauuaagagucugagcugccaaguagucaaauggaagauaaccaauauagcgaaacauacugcaaacuaguguuaaaauacaaccuucugaauuacagaaaguauccaauaaucuuuacaaguggagauuaauucaugaaaacauuaaaaaaaaaaaaacagcauaaacuccacuuagcuuccaugucuccagcaaccccagcaccugaaaagccacauguguuugccccaaaucaaaugcauguuggcuguggucacaaacucuacuuuauccaguguucaaucaucaaggcuuaaaacagaacaaaacaaaacaaaaaaacaacaacaagaaaacuccuuauuuaauucaggaaacaaugugauacaacguguagccaucaauaagagacugugacugcagccugcuacuugcuuaugcuuuaauaacaaaccacaggcagccaaggaggguuccauacaaccaggugcccauguacaguuuccuuccggacuccgucaucagcaugacagcagucaaacuccccaagaucaacacugaagguaaagucuucuucacacuuagucuggaaugaacacuuuucccaggaaauuuguuucuucuuucuggaucuggugaaucauagaacucuaugagcaaccuauggccagaaggaaaacaacagaauugaucuuucaguuuuggacauuuuugguguugaaacaaacauaaaccauuuauuagguauugaguacuugcugagcaaguacagcuccuuagaaaacuuggaugagugcagagguguccgagaggcacgggagggcauucacgccuuacaguauggacaugauauuauauccucaccacgugggaaacaaaaaucaaaacacggcggggaucuaagauauuuaaugaggacuucggggauuuuuaagauaaagauauguuuauauacuuuuauguagauggguguuggcuagugugugugucuguauaccaugauugugucuggugcccacagaggccagaagagggugucagggucauugaauaugaaguuacauuuacaaagccaccaugugguuacugagaaaugaaccugaacucucuggaagagcagcgagugcugagccuugauggccccagcuucauuuuuguuuguaaaucuuccaucuguaagugguuccaccaacccgacucauaaaacgaaaggccuucuagcuucucucccauagcucgcaucccauaagccaaugaaaacggcugaggcuggagcucaacaguaaaaugauugccgagcaugugugaggccaggaucuaaucacacaaaaacaagcuuucaaagaugcgaaagaaaagaaauucuuauagcauaggaguuuuccuccugaggugaucugaguaagaaaggcuccgacagguucacauaucugaaugcuuagccgcuggauguggugacucuuuaagaaggauuagaagguguagccuuguuggaggaaguguguauagggguggggagaugggguagggaugagaggcuuugagguuccaagaacccaugccaggcucagucugucucucucugccuguagaucagaauguggcucucaacuacuucuccugccugagugccucccuguccucagcaugaugaaaacgaacucaaccucugaagcuguaaggaauuccccaacuaaaugcuuucucucagaagaguugcuuugcucaaggugucucuucacaacaagaggccagugacagagaccuaccaaaaguucuuauucccauaaaauuagaaaagcagacaagagaaauaaaaagggucauucauucauccuccucuguaagauucuaacagcaggacaggcacaaaagcacagaagcgucccuacugccugugagccgcuuccacagagcuacaacagugaguuaccgauacauaggccuucuuacauuguucccaucaucaaaauaauccugagcggcuggguugaaaaguuaugucagguagaaacacgugacaacacaaggcauaaaucuaauauaaagcuucauuucaacucucuauccuaguaauacuuucuacuaacucaagaaaggggacaauuucauuaugaaaagaacaauucccuuccuucccacaacacaaagguguugugcucacccgugcuucagucuugaaccccaaagccucgugucccccguguagcugaagaggaaaggcucuuaucacacagcagccuacuguccagcaaacacugcagguaggccaccaugucaugauuuuuauagugacucaugaaaauguacaaugugaacacgaaaggauagaauaagauuuaacccgaguucacaaaaagcauucuugaaacaauacagacuuuaguuucacuuuugcugugcuaucgacuuuggaauaaacgcaucgcuguguugaguugucaugguacagaaaucaacaggcaaacugauguaggauguuaaacuuaauuguuaaacaaggguaacgcaccaugaaacaugcuacauuuaaguauauguggucuugucuaugcagguaugauuaguauuuacuaaauaaugaagauaaaaagacuccuuucaagcagggucugagaguaaaauuugguugaacugcacuuucuaaaugcuggagcucuuaccacuuaccuaucuuuuaucucaaagcgcucaugaagccacuuuuucauguguucuuguuccucuggaacuucauuucugucuauacgaucaaagugaauaugaaguuuugggcacuguuugcagagaaacucuaacaaagaagaagaaaauuucacgucuuacuaguuuagaauuugugauuauacaaaguaacuuacgguaaaaaugaaacauuaagacuaaaagaauuuaaaacaauaaagcuaugcacuuaugauuugcaguauuaagcugaaauuaaaaccucauuagcacauaucucuuguuaagcccaugucacugacuucuaacagcaagccuuggagaaguagccauccuuccucuagguacgcagacaucaguaagaaaccucucacucugcguacuaacagaaaaccucaccuuuaaaauauuaaaaauuagaaucuuuuacauuuuacauuuccucauuuacugucaaagccaaucccauccacaaaguauuuaagaaaacuggcuggguuugaauaucaaucugcuuccccuuccugaaaguuaacauacaaauaaagaugagcacuaggggaauacucaauacagauggggugaguggggccagggagggaaaaugucccuaaacuucaagucuucaucacacuggagugcagacauuccucagaacaugucuuccaucccauguucagugugacauaauauucuuggccuccuguuuaccaggaagcagaaucucaucugaaaucucuggagaguauuuacuggagugugguaauauucauacagggagucuccaagaguaaguguucgauuuugcccacccucgccucccuucguugcuacugggagcuaaauccaggccuuguguagggcagacaacaacucuccuacugagcugcaccucagcccugacuuccugacuuaggauuuuacuagauuguucagccuggcccuguagucaucaucuucugcuucuuccuccuuaguacugcgauuauaagagaucucuuuagucugcagcaaaauaccacgucucucucuucucucuuccuuacuacucucaucucucucuaaaaugaauucucugaaaggggccagaaucuuccaucacuccguucucaccuguucccauguucaaauguugagucuguggcuauaguuaccugaacuauucucacucaaagccacgucacuucacagccauucucacuuugucacugacaaaggcaagaguucugagucuuuaaauucuagcauguugggaaaagaccauauuucuucuuguaaauaaugacaauguccuucccaaacauguuauaaagaaagcucaaagcaaaaacaaaaagcauaaaagauaagagugggugauuggugcuggguguaguggagcccaaggccagcuuggucuacauagugaguucccggccagccagagcuucauaguggaacccucuacugaaaaccaaacugaaccaagcuaagcaaagcgaacaaacaagaguuuaucuuaccuguaccauguacuauucagcuucuauggaaauacggacuuaccagucauggaugguggauuugaguauuuuccugaaccuuucucauucccuucauaaaccacugugacaucauaaauugcaucuaaaugacucuucauagaaucaaaagcaacgugaguggccuuuauucuuggugucaguacguguuuuaauacugcaaggccuagaaagcagguagauucaauguggucauaauuaggaauacaugaaagucaacaucuaaauuacuuaucaacuaccacaaauagauggaaauuaaaguuuaaugccauaaccucacaccuagaaugcucacauacauugccaucucacuuaggucaaccccauugacacauauccauuaaacaucuacaugaaugagauaugcugcgagaagcugggaaggcugguccuugggaagauuaugacccacugcgagccuucucuuugauaaguucugacaagaaagacacgacaggagagcagcagcaucuugcuaagcacgcagucuuucuuaggacagaacucagcauucccuccacucuguucggcuuccuccucuccuggacuccaguauguacuuacaauuucacaggaagcacuaggucuuucgaugugcuaugaacagcgacuagggagaagcggguugaagucugcacugccucucuccagggaaaguggcgacauaaggaagaacagcuacaggauggugggacugucuacagaagaauuuuuaaaaugcaggguggugugggaaagaaagccauucccacaaccacauaucugaguucagucccaagggcagaaggaguguaauuuauucacaaacuuguaugaagucugaaaagucaaccaagcugggaaaguuuucuugucagcuaagucauucgccacuagaggccaucuugucucaggaccuuuacagaaucacccugugaaacuuccaggcuccauguuaccuugaccagacuuuuuauuuuucuuuuuucucuaagacagacccaagcuggccucaaauuuaugauccucccacccuagaucccaggagcugggaucauagcuuugcaacaccauuucugguucaaccaguauuuuuaugagauuauuaggacuagaagcucaaaaagcagguuagauguggugucaacacaugagggaaacaaaucuacagcaaauucuugccugucuguaccuucuaacacccaguccacuaaugucugccuaguauaaccacagacacuaugccuauaacuaagaccuagcccguucguguuugcucgaaggaaauuuccauccuaagucagacggcauggccuccucucgucuucacguggcaugaauaugacccugacuaagugcgggucgguucugaagcaugauguggcacuagauguccugaaacuucaagccaucagcugacugauucuucccaguguauuuagauacuugcuggguguauacuugaaggacuuuaugaaaacgaugaccacaaugagcccacauuuuaugggauaauuguaaaaacuaauaauuaaaaacaagaaaacuguaucaaaagggagacagaacacucgaguuauggcacacagugagcucugaccuuugccgaaugagcaacuccagccuucuuggucuuucuaccucucagcauuagcucagcaucacuaaaagacuugccugcagugggccccgaccuccacuuucuuauuacaaugcauacaccuguguuuacauaugugcuacauauacauccgcacgugcguguuuauguuauaacaccaggcuuuauacugagucacuccaaaaguauacuuucuuggggauaucauuuaccuacauuuuuaacucaauucacagcaugggaaaugugccauagcaagccugcgucucuaaccucucagacacagacuaauaagaauauaccuaacucuguagaagaucggauauucucucacuuagcucuuacaagaaacgcauauucuuuaguaugacucugaaggaaacaaagaucacucuucuuaaaaaaguguuuuucugaauacaguuaaaucuuuacuuaccccgcugagcagcaaaugccugacuggcugaaaggaguuuuguguauguugcauuauaccuuguucccucugggaaaaucacaagauacaucugugggcauaaauaaacuuuaguuuguguugaguccauuguugguaccaucaauuuagcaauucuaacucuguuauuggccagguaguauuuccuauggugagaaaauguguaucauuuauaaaugaccuucacuuugagcagaguaaccaaacugcagagauugaauuaaggccgaccauaauauggauuauaguaaaacauagcucuacauuuaugguaaagccaaucuuuaaaauccuaaaacuguuucuuagaauaugcuaauagucacugacuuaaaaucagcacaaccaaccccucugguucccaguaauaaaacaugacuuuuguauuaaauuuuuauuagcacauauuaaccacacauacuaguggaaucugcuauaugucugcaugaauauacagaguacacuuauaauauccaagcuccacucuucagccauuauagacauguaucuagcaguacugaagcuaacaguguaacuauuuaaaaacuuaugaauuuaguacucguguuucaaaaaacucacaacauuccauuuuauaagcauccccuaguguauuuuacaucacuuacuuuaagcaaccucauauucaugauauaaacuaagaagaauauaguaucuguaauagauauuuacuaagucaacaguugauauaaguuuuuauacuuaacuccuggaaagguuaaaaugugaauauugaagccauauaauaacaaaacuccuaacuugagaacugaguauuguaaaaaaaauaaaaugauacuuuuuaauugguggccaacugacaaacuaaacucaucaaguaaacauaauacagaaacaggacagggacucaugaggacgaacuaugucacuuauccaugcucaagugacucccagcgguauuaucuccuacacagcuagcauaaaacacaguguuuuucugaacaaauuuguggauaugaaacacccacuaaaggagccuauaggagaauauauauuuguuuaugaaccaagcucacaaagaaaugccgugauuugucugcaaagcugguauaaagucccacagccccucugcaguucucuguuuucagguccccuggucuggauuuaaacugcuccccugggccagcacugucaacagcugauccccagcugguggcauuauguugggagguuguagaggauuuagaguauggggcuuaacugaaagaagucaccaagcaggugggccuugagaauuaccauuuccugucccacccagauguaagccaacaguaccauccucggauggccucggcuguaucacagugccacccuugcaugauagaauguaccaacaaaguaugggccacaauaaacccuccucucaagcugcuuccuauuaggauuucaaccagaccuuaagaggaguggguaacacagaaagcuaguagagguguuacugcucuaauaaacccgagcccauggcccuuaagacuuuguaguuuugaaguguuggaacuauaagaccaucagacugagguggacuagauaaacugaaguauaggauggcuauaaaccuacagggcuagagacgaaauaugccuaucacguuguaaaauauccaccacagguugguucccagacggcaggugcugcugugggaacugugaaacuuuaagacacaggacaucacuggaagacaaggaacuccaugggauggguccugagguuuauagacuacuagcuuccugcccuguucccauaucuacagagaucugagcuagcagccuauguucuugcuggugcaccugugcugcuaugccuucuuagucauggugcucuuaaucuacaaaucaagauacauucuucuuccuuuaaguugcuuccagucagguuauaccaaugacaaaaguaauacagcaccuaugcaaauauauucuuuuuuuuuucuuauccagagaagacgccuuagaauccauuaucagugucagauuuguuguucuuguuguuuuagaaagaaguguuuauuuauacuuaaaauuccaggaaggaaagggaccccuaaugauagggaauuguggaagcagacaggaaccaugacaucaggaacagugagaguucaugccucaagcuuugagcaggcaguagaguuugaacuaggaauuguguggggccuuuacaucucaaagccccucccaguuauauguucuuuccagaaaggucauacuuccuaaacugaucuaaucaguacaacuacaugagagccaagauuccaacuaucugagccucaaguggagacuguuuuccaaacuaccgcacauggucuugugaugggaccuaggcacguggaccccuuuugcuauuugugucugauacaggugaaggaagcuggaaaagccagcuuugugcauggaggguggagccugagcaugggcuauggcccgggugggaugaagucagguggacaaagggaacuggugcaggaugugcauccuggucuaauccucaaggucaggguuacuccggacagggcuaacuagaugagacuuggguagcaucugucauucaggcuagaacugcugauuuagaaggaagcauggagugggugauguuguagauucaucaaucugaauccagguguaagauucacgucugacuggcaugggcagagcagacuggguugcauagaguggaguuggugaguacauuaucuucuccagcuaaauaugagagcaagcaaggccucuuuauaggugugcugcaaguuaucaggcaaauuucccuacuguaaacggaaaugacccacaggggcauugagcacauguuccuaaggcauuggugagggcguaaggguaugggacuagaggcccuuucugccgaggagcaggcaguccuuagguggaugagaagaguccucagaugagcaguaucuggugugugcuuggaaaaggacucaguuugauggacgguaugguguuggggaggaacccaggucacccagcuagggauaaagccaauugggccugcucacaagagucaguagaguuaacaacacuuauggaaguauacagaacaugacaugaugugguuguuuagcuugggguauuugugagacaccuaauggugggaguggaggugauauaacauguuggcuucuaagagauaacaaugaaaaauaacaaaauaagauauaauaagauaaucagaacccaucacauagcagcuggagaaggcaaaccaacaaaaggaaaagaacccaagagaagggacaagaaacagagacccccucauucacacgcccagucuugucuuaucaccgccaaauuuaaaaaucaauacuuuguuauauauccucauauuggauaauagcaauugaccagaugcuuuauggaacugcagaaaaauucaaucaguuacuagaagaaaaaagcaguaagaaaaauauuuucguuuccagaaccuuccaagaaccacuuucaugagaacguauuaaucaauaaaguuuauaucuaagcaaugaaagcaauuauuaaugucuaugaguuuuagggucagucacuuauaagauugauuacucacuuuaaugauucaugugguauuaugcuuuguaucuuagauauuuaaucuaaauauuuuuugauuuguugaucaaaaaaauuagaacaaacuauucauucaguguucauuuaagaagucauucuugaauacuauuauuugugucaaguacuuuacacagaaugcauacaaguuucucuuucauaaucuuuguagacaucagauaaauaauaaagugggcaaugacauggugucuguaaagagaaagagugugagauucuaaaggacugugagcaagaguguacuuacaguggguugcaggguaagacuuaaagaacagcacaaggaugagcgaucucccucuaagauggggacacucauggcuguacugcagaaucuagcacaaauuuggggucuuguauauagcugaguaugagucugaaguucucacacuucugccuuugucuccugagugcuaggaacacaggcauaugccacuauaacaggcugguauucaauuuuuuuuaaaauaaauuaauuauuauauaaaaaguuauauuaaaagcugaaaaguuaaauacaauuuggcagauaaaggcauaaguacuuuauauguuuaugaccauuacuccacauuguaggugaauaacaagacaucagauucacacacaaaaaaaaagacacuagagagaauacagaagagcaguuaugcaugcuacacgaauggcuguaaagaggagcucuuccauucauaugccuugagaccuugaauaaacucuaucuacccagaauguaaaaacuagaaugguaccaggacuucaucaaaacaucacaaaacccaaaggugaugaaaacacaaccuaauacagugcacagcacaaaacaacacugcagcugcugcuguuucugcucuaguaauuggucgaagcccaggccgaggcccuggucacuguugccugguguguagcuucccagggccugguaaguggagggcacgagagaaaggguagagaagcagagagaggagaaagacaagagccgcccaaguccucaccauagcuaugccugucuauacagagaggggccacggggagaggcaguuggcagcagucagcauucuugaaagagaagauuugaauucuuuuucccccuuuacagaaaaacaguuguguaaaauacugacacggaaugacucuucacuaggagacucuuugcucuggguuuguguuuguuuuaaaagaaaacaaacuuuaauuucuacaauaaaaauccaaauuuacacagaaagaaagcaauuuaacuucuucuagaacugaaucucaugugaagacuaacucuuuggggcuucagugagcuccauccucugcacacuaaggccugcccuugcccgucccgagcccaugcugacuguuacucaggagaaaccuuacaaucaccugcagcaaucuuaccucacggccagaggacagcuuaucucaacaaaaccccgaaccaguuccauugcuccacaugggguaauauauuuucaaaaugacuuaagaacuuaacuucuuaaccugccuugaggaauaaaagcgggcgcacuuaccgguguuccugcguucacauagcucugcagcuugcuucucauuucuuuaucauuaaauuuggcacuucguuuuacauaaauuccuccaugcugguacacagaaaagaaaaaagaagagcaauuauucuuuaauaacuaaucuccguaguuauuaaggcaacuguacuccuaaugaguaaaaaacauaaaacuacauuucagaacucaagcgacaguuaguauuuaaauauugccaacuauauauacaauauguaccugaaaauccuauuucuacagagcccaaguaaaacugcaucauggaaaauacacauuuaauuuuguuagcacuuaaaauauuuucucuuuaaaagauuuaguucaaaagcuuuuuccgauggauccuaacucauugauuuucuacugucauucaccaagucaauuaaaaguauccuuaaaauauccacacucccaggacuggagagaaggcucagcagacacgagucuucucagagacuggugaucaagucccagcaccccauggucacaaaccacccauaacucaguuguaggccaccuaauguguuuuucugaccuccaugggccccaggaaugcauagauacaaaacacucaaacacauaaaauaaauuaaaaauaauaaauacguaaaagaggccacaggaggccaggagggaaggauagaaaauuaaaaagacaaaagucuacaccuccauccuuuaaggaauuaaaauauggacuaggaaccagaaacauauauacacaggcauucaguuacauaaaauaaauuaaagauaauacauaaaugggcaaaauaauuaagauaaugucuacacucagagccuuuaaagaacugaaucauggacucagcuacagagauuggugugacaccauuauggacuaaauuucccccuccccccuuaacucuuacauugaagcuucagcuuccacagugacuguguauggagacagggucuuuaagaaaaucauuacaguuaagugaaauaagggcacuagcugaggcccugcugguggaacacccaccaaggauguccacaugugggaaaggccggcucagaacacagggagaaggcugcagucuauaauccaaagagguggguguugggagacagcaguaccacccacauccugaccuuggggagacuuucagccuucagaacugugagaaaacacauuucuccacacuucacacucugagcucagagucugcuuuuagcuccugucugucacucacuaacuacuuuugaaucaauuuccgaacauuaccgauugucaauucugcacuuguagcuuucuauuggacuccuagguauuuguauuucugcuacuggacuuaaauauacggacaaccagccaucuagacacacaccaucaggaaccgugaagaagagcuagggagguggcucaguuuggaaaguacuugucucacaaguuacgaggacccacauuuggaucccuagaaucuaguaaacagcugggcguagcagcacacacuuguaaccuaaguaaagguaaggaggcagagaccgguagaugcccagggcucacuggccggcuagccugggcaacucagcaaaggucuaggagacugucucaaaauaagaguggaaggugccuaaaaagugacacucacacuuguacugaaaauuguccuucgaccucacaugcauccacgugugcacacaagcacacauaugcaugugcacacauauagaauucuaaauaaaaauacuaguaaaagucgcuuuaaaaaaugucugaacuaaggcugucacucaguagcacacauaugaccccauguucaaucacggguaccauaaaacaaacacauaaacaaaaaaaucagauauaguuucauuaaaugguguuaaguuugaaauaaaagggcaaagacaaaguuuaccugagcaaaguagaacccauacagcggaagccauuuuaacuugucuuucaguacguagcgcacauguccuagggcauccugucuggcagccagcauguccgcaacaauccagucaacuguaaggcagacccaagucaguaccucacaagucagcuccaaccuucccucccaggaacaaaaacucaucuucacagcacagucuuuguaacauguccugagaaucuaacuauggaggcagaggcagaaggcgcacaggcucagagucaacccgguguacagagcaagucccaggaacacuagggccacauagcaagaccuagccuuaaaaaagcuuuuaguuuuuuuaaaaauaaaguaugauuaaaaugcuuaaaacaaagccaacuacagacacauuaaaaaauauacccccuccccaaaacucaaaaaaaaaaaacaaccaacaaacaaaaaacccuuaaaucaaggagguguguguuuuuccuguuuuuuguauuuuuuuuuuccucuguguagcccuggcucuccuggaacuauguggacaagcuggccuugaacucagugauccacuuaccucugcugggauuaaaggcuuuucucauuucuuaaaaggccauuuauuucaaggauaaaacacaaagguacaaaauacauggggcugaagagauuuuguucagugguuaaggauucaguugcugcuuucgcagagggcccaggucugguacccauaagccagcucugccucuaacuccaguuccaacggauaugaggcccuccaugagccccaagugcaccaggcacaugcacagugcacaggcauauaugcagggacucaaacauacucaggaaaagaaagaacaaauguuuaaaagcuacaaaauacuaaguaacccaacacccaaauacuaaauaacuguugaauaauauuuaauuacagguaaaaaaaauaagagauauuucuuuuuaaaugaagaauggaaaauuauaaggaaaaaaauggcaagugaaacaacuguagcuaaauaucccauauacacaaugucugacaaaaggcacuacauuaagagcuggagagauggcucagugguuaagagcacuggcugcucuuccagagguccugcguucaauucccagcaaccacaucguggcucacaaccaucucuacugacaucugaugcccucuucuagcaugcagguauauauaugauagggcauauauauuaaauaaguaaauaaaucuuuaaaaagcaaggcaccacauuagguuuuuacuaaugacuuccuggauacaguguucaauucuuacaauacccaaacaagggucucgugugauuuacaauugugcgagguagauauguaggucuuauuuugcagcuuuugaaacuguggguugcaaacugauuuuaguggucaaaaaaauugugaauaaaaguuuuuaaauaagcaaugagcaaaacuuaauucaaaaccacauacauaugaaugaauaagugucucugcccaccgcugccuugugcagcugccccugcgucuucuguuuugaguaugcaacaugcgugcuucucacugcacaugcuagcauauauguaauaccgugccauuaagugaaguacauuucguauacauagagcuuucugcuguuacagaaaguaggugaauauuucaucagugccauuccuuagcauguaaguacaaaacuagugcacuuuugauuguauuacauuagaaugcuugauuuauaaaaacuggcuugaguuccaugaaaugaauuuugaccuagaauuagaauggaguuucaaacaauuucugaaaugacacuaaacacaauucugccauauuguacaauguguuuguggaaacaacauucuuagcacuggcaucuacaaaaucaaaauccugaugaauucugaaaaacaaggaaaugcucuacauccuauaguaucaaauauucagccaaagucaaguucuucuauacaaaccuauccaucucacaguauguagacugccuuuuaucuuuaauaacugcuaaaauucuauguauuuaaaaauaaaucucacucgagaccagcauggucuacagagugaguuccaggauagccagggcuacacagagaaacccuguuucgaaaaaccaaccaaccaaccaaccaaacaaccaaacaaacaaacaaaaacaaaaaaacaaaaaaauauaaaaaucucuccacucuuuauuaucagucaguguuugauuauauuguucuuauaugccugaggucaugcaaaacuucuauggugaaauacaaagaaauaagaaaguguccugagaagcagaauauuugaagacuugagaauaaauggcugcagguaccuuccaugugaacagaaaaugaaagaucaggaaaggucugcuaggauuuagagaagaauucaaggauaugaacagggaugcuguugaaguguacucagggccaugaaaaugacaacaaauggaguuaauuagaggagacaauaucuaauuuaaaucaacaacaaacucuuacauccaggcugacagcacaggccucuaaucccagcuacuucggagacugaagcagaaggaucaugaguucaaggccuacccagguaacuuagugagacaaugucgcaaaauaaaaaauaaaauaaaagaacugggggggggggggugcagcucagugaaggaguauauucuaaucacgugcauggcccuggguucuguccuagcaugaaagaaaguuggggauggggcgggggaggaacaacaaacaaacugcaguauaaagccuggaguucaaaguguguuaaaauggggcacuuuuccacagcuaucgcauaauucuugaccauuuaaauuuuuuucauaaugcauauacaaaugaaauauccuagaauuuuaucucuuuacacgugaauaaucaacuuucuagaaaaaucuuaauuguuuuagaguagggauuauaaaacagcuaucucuuggaaauauaaccaagucugugagaaaguuaucuaauauaaacguuuucuauagaaacaacgagaaugaacccuguaaaggcucuauguggcuauagcucucaaccugccuaaaucugugacccuuuaaugcaguuccucacguuauggugacccucaaccauaaaauuauuuuguugauauugcguaacugugauuuugcugcuguuacaauucauaauguaacuaucugauaagcaggauagguugugacccacagguugagaaucacugcucuacagaguuugcuggccagugaauauucuggguauaaaugagauaaauagguaaaagccaaguuugguaucuuuuccugagacuuuaauuuuuaagcuuauggaacaauaaaucuguuuuuauauuuaaauaagcaguuauauuuuggaguccgguauaccuucuaaaaacuauuaagagaauauauaaauauuuuuaaauaugucaugcauccaagauaaacuauccuacaccauaaccuuaaauuuaaaaauuuuaguaacaacacuuaagaaguaacuuacaagccaggaaugguggcaaguuuggccuuuaaucucagaguuggaggaggcugaggcaggcaaaucucugugaguucaaggccagacuggucuauaugguaaguucaaggccagcugggguuauaugguaagaccuuaucccaaauaaaaaaaaauaaguacagucaaagaauacaauauagauucaauacuguucucuacuuaugcacacugcuuccgagauaacgcuggauuaaaauauguaagggaauguauuacauucacauggauaucuguauuuuguguuuuggcaagaauaauuuaauuugguugucaggacucuuuagcagugaucuagccaugaggcuuaucuagccauaagccauguuuucaguaacuugaagagaggagaacaggcaaauaaaccuuacuuuccucgucuguacagucgugucucaccaauucuuaguguuaugggaugacacauaaggguuuaugcccaugaauccagcacugggcuauccccaccaucauucacaguacugcuaaaugucacccauaugccaggcacugcacuggguuuuugaguggaacuauauguacacugccuuaaagcuucuaucaauagauaucauucagacccaaccagcaggcucagagagccugggugcucugcccacuggcagagaacacacagaagcagcacacaugagcagggucucccagaaugcagagcccucagcuuuacagccaucuacugaaccauauacucuaucagacaggaaaugaaaaggaaugaauuuuaaaggcgaacaguguugaaagcagacaaguuagaagcagcaaggauguagacacagcaggauaccaaguaaaagcagcaacugagacuaagguaaaggucaacucuucaugagcaucaggccagagugaacagagugagagugaacaggcugaaccaacagcagucccagaacacuuucuguaaauuacacuuucagagacugauucuuaagcucucuuuaccuaaauaugucauccccaggaaccaaauccaccuuggguugcugguuugaacccucuggaagccuggaauucaugcaaagucuuccaugagcaguuuuauuagagaagacuccaugccuucuuccaucacguagacuaacaugcaauucuaacgcaguucagucauuccucugguauguucccaacuugugggcuucuuaaaggcauuuggaaugcagcaugcuuagguugagcugcuugcuugugucuguguguguugcacaguugcuugucuaggcagaagaguucuugcuuaacaugcaaaggcucuggguacuuuuuucaaguugccaaaaacaaaaaacaagaauguucucaaaccccaaaggcugguuguuaucagaccuagaggaggucaccuggaggcagagucaagaaaugucucucuaaacuaagaaaggaacuggcuuagccucuugcuugccacguuaucuucagaucucaaacaccaaguaggaacuguuaccugcugcuuacucacagugcuuuccuggaagccugcucuaaaggaaggcaaaggcaaccacagccaugccuucagccgcccuguuacugugagacccacaggagagcaagaguacauggucccaccuguccuuguaggauuacaguuccauuaaggaaagguuauuuccauaaaacugagaagaaagacauugaugggaaacucuaguuuccugcagugggauccaccucugaacaacagaacugcgacaggaugcugccauggcccaugcccuguccugggggccagccagguaaaaauuccccucaccagcaugaggucagauuguggugaggagggccagccagugugucagacaggcuggcuagaagcagagagucacucugggccacucugugguucgacucaaagucaaaugcagagucugagccagucucacgaacaugacccaggauaauacaucugauaucaaaaucccuaucaagcuuuggagcuucaucaguuuuccagugugucacacagagaaaaacguguuucagcuccuuuaccucuguguuagcuaugguccgggugucuguguguguguugggggugcgguaucaagagcuacaaucccaaccaaaugggggugggaggaaaauaaaagccaucagcacaagugaccuuccauucagaauauccuaacgguuggguucuguuagcuuugggaugcuagguccugagcuugucaaagcaaucaaacgaaccauagaacggaugcacacaacguggccgugguuuagaaaauauaggaagugggauuuuggaugaggugaauuauuuggagaaugaaagcacacuuuaggcaaucauuuggccucuuggcugggcccuguaccugugaggugccucauggggaggacccucaugaagggaccgcaggacuagcagcauaauucacaauucaucaauaaucauucaaaaagagguaguuuuaaauauuugacccgccgggcaugguggcgcacgccuuuaaucccagcacucaggaggcagaggcagguggauuucugaguucgaggucagucuggucuacagagugaguuccaggacagccagggcuauacagagaaacccugucucaaaaacaaacaaacaaaacaaaacaaaacaaacaaacaaacaaacaaauauauauauauuugaccugauuggaaguaaauacaguucuauacuggaaacuagucuugugccuucucugacggaaaaauagcaaguuagaauuaagcuaccaggauuaaagagcaacaggaacuacagcuaauuauaacagcacuguguccaggaaaugagcagucagacaccagcauaccaauaagcagcuuaacaacuacacaguuagagugcaaacaguggcagcauacaacugugauccaucacuccagagacggaggcaggagaauuuugaguuugaguccagccugggcaacagagcaagaauaugucucagaguaaauaaaaggcuagauguagaauuaagaauuaaaauguauacacuuggguccaccaaucccacuauauauguguguguguauauauauauguauauauauguguguguguguguguguguauauauauauauauauucuagaaaauauaacguagagacagaaaaccaaauaaacuaaaggguuauuuugagaaauagggaagaagagaagccuggacaaaaaccauaccuuucacauuacuaaccuuacccuccccaccaaaaaaguaaaauaaaauugcaagccagauucaaaauccacagcaaauuuauguuaaaaacaaaagcuagcuuaguuuacuuaaauauauaagauuaauauuuuaaaggcuggagacaaagcccagcaguuaagaguacauauuucucuuucaaagcaccccaguuuaguuccccaaauccauccaggauaacuaaucgcuaccugcaacucaagcuccagggaagaucugguguucuucuucuggccuccacaggcauguguacucacaagcucaaacccacagacagauacacacacacgugauaaaacucauuaaauaaauaaccuuaaaauaucauuuugaugggcuggggauguagcucagaugggacagugcuugccuaguuugcaugaagccuuggguuugaugcccagcaccacauaagcuaagcauacaaagaaagcaccugcaauuccuguaccuuggagaugaaggcaggugugucacaagcuuaaaaucauucucagcuacucagagaguaugaggccauucugggucacaugaaauccugucuuuaaaacauauguguguguacauauguguguuuguguguauguguguguacauauuaaugcucauuuaccauuucuagaaaaacccaaauuucaucaaaugaaauacaaaccugugcuuugaugauucgcuagauauauuacauuuucuuuauuuuuuggcaaaucuccauauagcaauaucuaaaagagaaaacaaaaagaaucaugacuuugacaauuaaaaaaaaaaaaagaaugugaaaggaaacagacaaggacacaauguaacuagcucuauccaugacuaacaaacaucagaguucucuugggagccccacacacuauaaauagcucauacuuauaaaguacuuaaauguaggacagguuaaugaucauaaaguaagacagaaugauugauaucccuguaagaaaaauccacaagaaguuauugaucacuaauaauauauaaggcucuacaguccagcggaagagauggacauauacauaauaacauaaugggaaauaacgcaaauauuaugaacauacucuauauuuuaaggauuuguaaaauggagagcuacuguguccguuggauauauuuuagcaaaugagaggaaaggguuucugagcauaagaccaaaugaaagcugugugcuggagucuuguguuaguccacuugugugcugaacaaaaaugcaggcuaaggagccaggggaguacaacagggaggccagaggucccugugagcuggaacaucaagucagggucacuacaucaugugccacuguacccuccuggcuacacucuguuuuuaaaccaagggacgaggccagguuuucacuguacuguucuguuuuguaaguguuaaguauccagugauuagaaagggacuugaagggagcaaaugacugcuguugcucaucuguucccuuccuuuggaucacuuuuacuuagcaguuguucuuauacuuugucacuaagaauuaugcauaaguuagugaacgcuuuggagucuacuaugccagaaagguuugccuuccugguggugaaauacucacaaauaccauaaugauaacaaaaccugaaagggcauuaauaagcccuguguaaaagcaauguagcuacauaauauaaaguuagaugucaaggacucacacuaaggcugcugcuacugcucuaagacaacugcacaguguguucacacgugucuaauuacuucuaaucaaguuuacaaacgacauaaaucaaacaaauaaguaaccaaugguuaguugaucugugcagaguuaauauugggaugccagcucaugaucaugaucacucuuagaaauaaaguagaacuauuuaaggaccacuggguacacuuuacaagaacuacagauccaguuaaauguaugcauguguguauguauguauguuuauguauguauguauguaugcauauguaaauuauguaagguucuuuggagacaucgcuagccuccaagcuaauaauacccaaaccauccaaagauaccuuucaaccagauguaguggugcaugccugaaaucccggacacuuaaguggcuaaagcaggaggauuaggaauuugaggcuagccugggcuacacagcaagagcuuuagugaaguguagacagggauuccuugagcaagccaguuaguuacacuagccaaucagugagaucuggguucaagugagagaccuugccucaauauaaaaggugaagagcaaugcagaaagacaucuguuuugccugcauguguguuuguacaccccaugcuugccuggggccugcaggaaucagaaaagggcaucagaucccugggaacuauagcuacagaugauuguaagccauuguguggcuccugggaaucgaaccugggucccucuggaaaagcagccugagccaucuccccagucccaguuacuguuauuuuauugacaaguauaaaacuaguuacaagguuguagugcuuuuaaaauuuaaaaagcuaagaaggcagacacaguagcuuauccuuguaauccuagcacuuggggagcugugucagaaggauugugugaaugcgaggccaccuuaggcuucuacaaugaguuccagggcagucugaucugcagaguagggguuagggaauuuuuuuaaaggguuaagaauuuacaaacuauuuacagauaaaaaguguagaucacuguauguuugcccacacccuugauucucagauucucucuggggcuguucucuuggcuccuuacugaugucuuuccgucuugagcccaaccucagacuuauauuuuauauaauuauccaaguaacuuuagauucuuccacuuuuuuucaaaacuuaucuaaggccagugagaugaugcaguguauaaagauuccugcugccaaagcugaugagcuaaaaguucgaucccuaggguucacauggucaaauaucaacuccugagaccugucuuuugaccuagacacacacacacauacacuaaaaaaaugguucauuuaaagucuuuagagaaaggaauuaauuuuccuuuuuuuuucaguuaauuaauuaaauacagacaaaucaaauacucuuaaaauaauuuucugguuacauaguuuuuaauuuguuccaugacauacauguaaguuacuugagagcugguguguucucucucucucucucucucucucucccucccucccucucucucuccuucucucucuccuucuccuuccccccucucucccuccuuccuccccccucccuccuucccuccucacuggcuuauguuugggguguuugcuguccaguuggugguacuauuuuuauuuucuuuuuugggagggggagggaggagguggaaccuucaggaaguggggccuagcuggcagaaguagguuacuagggccccuaguucuggcuuuguucuacacuuccugguccaugaucacaugagcacaguccuguugccacucagugagcugcucuaccaggcuucucugcugugagggacuaaaaucaccaagacugggaggcaaaauaaaccauuucucccagucauguguuuuggucacaguggcaaagaagaacuacaaaguuuaaagguauguucuugauuuaucucaguaaaguccaguagguuuagcaugaaaguugaaauacaauacauagugagaaaaacgucucauuggucucaaauauaaaugauaucgcugaaagaacucaaccccaaauaugcccuuuuggcauaagaaugauuuugaauaaaaacaguuaagaaaucgcaggcacaagaaaagcucucugcccccagucuucggccuagagcuggaguagaacuuucuauaaagaagacaugaauuucucacuuucaaagacguccccuucuucagcaggaagaccugagcugucagucugagucugugugaccacccugaggugugcagcacuuauuucccauacuugguaucccuuauaguagcuucuuuuacacuagucacuacauaaucucaccugaaaaaucccccugaguagggcuucucauuucuuccaaguuuccuccuaccauguaaaaauauuagcaucaauaaaaugggcaguuucucuacaguuaguaugccuuuggucauuuaauucacgggucuugcagacacagucugaaaaagagguugcccuucauaacaugaucaucacuaagaccacaggcugcaaaguauaagacacggacuaagacuuacauuugaaucccagcccuccaucuuacacaagaaauagaugugauguaucagcuuucucuauaucuaucucauuaacuauaaaguauaauguacuaauugcuccucacaggauugcacuggcauaaacgaaacuacauaaacuacuucauauaugccugguacaccuggaacagcuaucugauaaaaaccaauucgaggagugaaggcauacagggaaaaagagugugugugugugugugggggggggucaacaguuaaauuauuuuguaucuaacaugcuuuucauucaaaacugucaucaaguaaaagaaacagcuaacuaguccaugucccuccaauuacaccaaaaugcagcuacaaggacauugacuaagagugcauguacaauuuaaacucugugcuugaaaucauuugaaaugaauucuuuaaucugucuuuagguccaugcgccagucaugugccaugucuagccaaccauggacagcacauacaacuggagaaguaaccccacaaguuucaaagaagcugaaaacuuuccaaggccugaaugacaguagccaccuuguauggguaaaugcugauguaaacagaccuacugcagucacauaaaagaacgcacaaaguauuacacaguauuuuacaguaauaagaggcuuacuggcaugugugcuuauuauacuagcuauuuuggggauuuucuauauauuuaaaaaaaugcucacacacaacacguauggcuuuaaaaggcauguugacugguuagccuaacgggugcagccacaccuccuccuguuuguuuaacguguucuagacauauccuuguaaagaaacacaggauuuccaccuacuaagggacuucuacuauaauauguacaaaaacuguggucuuuuucugaguccaauuugaaauguuucauuaaauaaauaauaaauuuacuaaauuacuaauuaguaaaacuauacuuuguaagaagguuaaaguaguaaacacaauuauuugauuaaugaucagaaugcacaauuaccaugugaauugaguagaaacuuacauaucacaaaacucauacaaucagcauacauguuucucaauacuguccuuauuucaaaaggguucuuuuuuuuuuuuucccucaccauggauuaccuacuacucuaugaacuaaaaaaauaacauauuaucucacuuggucuuuguaugaauuauuuuucuuauuguugugucaaagugucugacaggagcaauuuaagaaggguuucuuuuagccaggccugguggguacuccuguagacccagcacucaggaggcagaugcagguggaccugaguuccaggacagccaaaaaaaauccuggggguggggauuuauuuugccucgccuuuuaagaaaagauacagucuuucgauguaggaaggcucggcagcaagagugugaaguagcuggccacacugugucccuggacaggaaacagauaaaugccgguuuuuauugaguccagggccccacccuaucagaugaggacaccuucaguaaacacuuucuggaaacauccucccagacauaccauaagcacaucuccaaggcgauucuaaauccagucaaggugacaguaaagaucaaccauuaaagucuucagaacagcaugacaaauguauuccagucucaacugaggcugagaagcagaacugcuacagugugacaaagaaaaaggaauuauacccaggccucucacuccaggaucccgaugucuuacuagacacucuccacaucugaagccugcggauacaccccauugguagagugcuggccuagcacgccuaaagcccuggauuugacccuaagcaccacauaaauccuggcacacacccccuaagaaggggcuguccaaaguucaaggucaucuuacauaaugagucugaagacagccugagcuaaagaagagccuacccuaauuaaauaaaauguucugucuucaagaaacuuuuuucacucugaauauuaacuauacggauaauaugcaagaaauccuuaagaaaaaaaaaacuaacguaaaaaauaaaaauaucccucaggaaggaaacaaaacauuauauaggcacacagagaagugacauucaccaugauccauacaacucacagagucaccuacuaauacaaagaacagcuccaaccucacuuaaaaguaacaaaagccugacuggagugagcagagguccuaaaaacccaauucccaacaaccacaugaaggcucacaaccaucuguacagcuauacacaaaauaaauaaauaaaucuuuaaaaaaauaacaaaagcaaaacucugagacucagcugcacuauuccuuaucuccaaaguuguuuguuuauguauuuauuuuggucuuuaacucauuacacaguuacugucuuuuguuauaaaccaacuucuuucuauccugaaugacagcuauuuugucaauguacaacacuggucccuagccuggaacuuaauauaacucuccuagaugugaacucauuuauuucuuguccuuggauucccauagacauggcagcaaagcugccagccugugaacuaccucuuacguggacacagagacacucaaauaccuuccuaauacuuccaucuguaccugccuuaaaugccacgggagaaacaagguaaaccuuggugugcugcaguuuuaacaauuccaagaccacaggcuuuuaaacgcucagacaaagguugcucuguuucuuggcaguccuagaauucuuuuaucugucuugcuuuacccauuuuauauccccauaguccuggggauucaauagucucaguaaaugugaaccucguuagauaaacacaaccaucuuagcaaaccauucaaaagcccccauuccuuaaaaguaaaauuuaacgcagggucacagagccuccugaacaggauucucugugagguauugauugcccuuuuuguucaaaaggaagggucauucuccuuuuacugacuacaaucucgaauaggagacaaucuacacauuaugacauaguaauuucaugccaaaaugauguuauugauucaaaaagggaggguaaggugacggcagauaaggagcagcacaagucuggacugaaccuuaaauguacagaggaccaguuuaaaauacacuauagauuauuuuuaugaugcaaaaaggagcaguugggguggacagagacuggcacagcagggcagcacacagcagggcagcacacagcagggcagcacagaacggagauggccuuaaacacugagccugaagucuucacagcaauucuggugucacauucccucuaguaucaacugaaaaccacuuugccucgcucugccguaugugaguugucuugaagugaagauugaacuugucauaagcagugaagcacaucuuugccucuauuuggaaaagcugguaaacaaccauccaacaaugucagguaucaaguguuuucuguaauuguuucucugugcuuucauagcacaaauaccccaagaacagcgaacucacuucacucgucaacuguaaacacgucuucaaacgcagcccccaaacuggacugccaugaagacuacacaaaugaacugccuggaccuguuuucugucuauaaaaagcuaagaauggugccuaccacguaaggaugaauggcaauacugguauacagcagcauucaguaaaggcuuuguuacuaaccaaaagcaauauuugcuaguguuuuuuuuuuuuuuuaaagaucuuauuuuuaacuuaauuguguguacauguuguacaggugcaucgccaugugcgaaugagugccugagaaggggcacuugaucccucugggacaggagucacaggugguugugacuggggagcagcucaggucaucuggaggcgcaguaccugcucuuaugcucugagccaccucuccagacacuggcuauuuuaaaaauagauguggaaggauuguucucgcucucaucacauauacuucuucacuacacugaccagcaccucuaccuggacuguccuaauguccccaaacaccggaccuuuuucagagaacuugcucuggcacuugaucagagaaacuuuucuaaccaccuacccucuacccgguaggcuaagcgaggccacacagcagucaaugugaauggucuuguuacugcuugucuccccacuaguaaguauaguaugguugcuccauaguucuucacccucuagacaccagcacaguacccgaaacagagugcaaaugugaaugcuggucuauggacacacagaugaagacccaaguucccagaacccuuuugggaaaguauuacuuaguguugcauucucuagcuauuacaauaucagccacuaucuaagaaacuguaacaugaaaauucagaaagaauuaacuucuaauuccauuaagaagugucaauucccaaguucccacagcuccucaaaauuagaucuacuuacaaaagcucuuuuugaagaaaucuaaaguuucacaguagacugcuuauagaccuaaggaagguauguguacggaaagcaguacggaaauguggcuuucucacuaaaaucaaacacuaaaaguguuugauugcaucuguuauuuaaaauagaaaaauaaaguguucaaagacuacacaagccccacccaauaccacacggcauggguggggcagaggacacucagaggacuuuugccuguguggguggagugggagacccccaccaagaugagcaaguaaguaucagagagaggggaaagagaaguggaauaguguuuacacaaugaagagacgcccaggugccgaggaacagccugcacagccaccugaggccacggugagguccuggcccauacugcugccaaggaccaugucuggguccaugacucugcagcaucgggguggguuggggucugugucauugucuaugacccauguuaucaccaaaggccuuuugaauaucccuggucuaggcugcugccuggagccauguugcugucaaaggacugcccagagcuggccagaccccucaucagcuguggcacuggggagagcauggcacugggcagugugggaaagcuggcccugaggacacugaaagcaggagagcuggcauugccucuuguuggcuacagcacccgcaccuagccugggcagcacaguagagcuggcccuggugauguguaugcaagagaacuggcaggcugaccaacucagcugccacucaggccuagauccagggcucugaguuggcacacaccaacaccuaccucaucuaugaacugcuggaguguguaaaggggccugucgggcagauccuaaccuacaggaucuccaugacacagggcaacaacaggauacuggagaagacucccagugaggacccaguauugacaguguagcagaaggcagaggccuagaaccaaaccagugacucauugcaaggaacauuuccaaguaaagaugucugagcuaaaggaugaacugugagacacaccgugacaaaccgcagcuuccacagaucuguuuuuuguuuuguucucuuuuuuuguuauuuauuuuuuuguucccauuggcagagggcagauacagaaggcugggaagaugagugggauuggagugcaugaugugaaauucacaaagaaucaauaaaaaaguaaaacaguaacaacaauaaaacuacacaggcagaagauguggaagaacugcgggaggaaaaagaauauggucaaaauauagaaaauucucaaagaguaaacaacauuguuuuacaagagacuucaaaaauuaaacacuaaaugccaaguuuguuuuauguuuacaaaagauauugaaauaaaaucuuaaccauauuuuucaaaaauugucuuguaaaucucucgcuagccaauuuccuagcagauuuaagcuguguuagacuagaacuacaccugggaaacaauuuccugaaucaaagguuuugcuuauucggcuuaagcagaggcacacccaaguccacaguucugcagcucccagcuaagcaaagcaagucauuugggguuugaaagaaucgcaaagaugauaaauaagcaaaaaggaacaaaacugaacacauaaacaauuaagauuuuuuuaaaaagaucaccgauaguggguuccaaugaauaucugggcagaaugugggaagaauucagucccgauacaagggucagauuggauaaccugugaguccccucuaaguaaacauauuuugucccuggaauuuagcgccuucagcaagauucagaugcaaacuugacucaggaagaguucaggaugcucgauaagacagcgccaaggaaagagcaaaccaguuuauguggccagcacguagaaagucuuuguuucugagacgcugagaggagcuucuguacaagggacaagcccuagaagagucugcgcacuguacagcaacagcagcaccuuacaccuacacacuaucuuauucccaggacuuucacacuacucuauagcguaagcaggguacacugaaacauuuaaaguuauucugcauaaaggcucucagccaaggagugcuggcacaguccucuauaccccuagcuacucugcagaccccgucauggucccaaaauuaauuuguaaauaaaugauaacccaagagucuuguaucuuaucaauacuagaauuuggaccagaggggauuggcagucaaagccaugggaaauauauuuuaagguacauucuaauuguuaauaacaaauguaagcaguauaaugguggugaaagcauucaccagguacugaggagucacauauuguaucacugcacagcuggccugcaaacaccaauaaccagcuuuuauuggauuucacugcaaugagaagauaaauacucuaauacuugaaaacaugaauuaauuuuggggggugggugugaguagcguaugcacacauguguauggccaugcacacucccuggaggcuagaggaggaggacuucuccuggccugcucuaucacucuuugccuuacuccccuaacaaagggucucuacuaaaacuggagcuagacaggcagcgcacaagcuacagugaucccccugucuccauccaccacagugguggggccacaggcacacacagccaugcucggcuuuuaaugugguugcuagggaacugaacucaggucuucaugcuuaagccgucucucuaacuccacaucaaucuaucacccacccaccuaccuaccuaccuacccaccuacccaccuacccaccuaccuauauaucuguuuguguaugggguugacuugagcuugugcuuguagagguuagaagacaacucucgagacuaguucucuccuucuacuauguggguucggggaucaaacucaggucaucagacuuagugacaggugcccuugaccacugagccauuagacuggcccauucacauuaacuuuuaauaacuuaaaaaaaaauucuaaaagggcuauagugaugauucaauaggaaaaaaaaauugcucuucaucaguaccugauuuugaaccacaggugcccaugucuaagagauguugagcaugucugcacaugccaguaauuucagaacuuagagauagaugggcaaaucccaagagugugcuggcuggcuagccucacugaaaaugaugcgcuuuugguugaguugagagacuccaaggcaaggcaauaagcauagaacaauagaagaaggcaacccacauccugcucuggacucccugugugcacacagggccaugcucaccugaacacucauguacaugcaauacucacacaacacacacacacacacacacacucucucucucuaaauaucaaaauguuaaaggcagugugguggcuaaguuuuguaaugcuaggaccugggaugcugaaguaggaggcuuacuguaaguucaagugaauuuaagacaaccugagcuacugagugagacccugucuaaaaauauauauauaaacaaacaagaaaaaaagauauuucauuuuuauuacaacuacuacagucucugugaauauucaucuagaaucuuugauucuaaaccacuaagccugaaauaaucugcuguguuagccuuaagaaaugggcuuuucacaauguuaaagagacuuuucuuuuccuuuuuuuuucuuuuuuuaagauuaaaaauauguuugaaguauauauacuggagguaaggcauauaugccugugagggcuaguauccaugggggucagaggugucagaccucuguccuggagccagaguuacagguaguugagaaacagccauugugggaucuggaaaccaaauccaggccaguguaagagcagacuguccucuuaaccacugacgucucuucagucccuagucccucuggucacauucuaauggauuucaaguuagcaaaaugagcaaaacuuacaaaggcugcauuacuuccccuacagauaggggaacacacugcucacuuucaguacuaauaggagacccgaaaggcucuaauauuggugugggcaguuagcagauguagcuaaaacacuugucacacaagccugaggagcccaaauucagagccucagaacccauacaaggccagacacucaucucucuuuuauggagugcuccuacagugagaugggaagcagauacaggacagaauccagaaauuuagaagccagcuaagcuggcacacacacagugguaagcaagagaccugacucaaaguagaagguaaauaccaauacccaagguucuccuaugaccuccauguccaugccaugguacauuugccccacaaucacggauaugaauauuuaugugcaugcaguacauucauucacacauacacacacacaaagauuuuuuuuaacuugaaaggauacaugaauuacucagaauuuuagcaaaaacgaaaacagaaaagaaccuacauuugcauagaauccaaugcaacgccuuuaaucccagcccuugggaggcagaggcaggcggauuucugaguucgaggccagccuggucuacaaacugaguuccaggacagccagggcuauauagagaaauucugucucaaaaacaaaacaaaacaacagcagcaacaacaaaagaauccaaugcaauguccacacaaucugcuuuugaauagcaaaggaggcccucacccucacccucucccucuuuaaguggaauugguuggauacagcugcuugaacacugcucuccacugugcacauauucuaaaaccauuacaaguaagauuauaggcaagugguggcgcacgccuuucaucccagcacuugggaggcagaggcagguggaguucugaguucgaggccagccuggccuacagagugaguuccaggacagccaggacuacacagagaaacccugucucaaaaaaacaaaaaaacaaacaaacaaaaaccacaaaaaacaaacaaaagauuaucccuauagcuggugaccuaaggcagaagacaagcucacaucucaaacucuugugaccagugaucagcuaauuacuuugauuuuauuuugauccauauuacugccuaaccacauuucucccucauauguaaacuguucaguaccgccaugaauccguuuuaaauuucauauaacuaaaagaguuuaauccagacauggcgguacaugccuuuaguccuaacacucuggagacagaggcaggcagaucucugugaacuugaggccugugaggucuacauagaguuccugcccaccaagacuacagugugagauccugguuugcuucuuuuuuuuuuagagcucauuauuggaaagaauagaagaacucauuuuuuuccuucucuucuccuuaaucuuaguuuuaaggcguuaacuuaaaagcccuaaaaucacuuagaaaacagcugcuguagccugggugggggguaauaagguuugcacuugacuccccucaagugcguguccucucucccaaucaauaaacucacuaacuuugcuucauucugacucauccuaacgucucugcagcaagaauauagguggcacuugaguagaggucccugagcgucugagggguacuugucaugugcaaggucagcaacuuuaaguugugcuccccgcugucuugucccuucugcuagugaaauuaaauacuuauccacgauuagaccauacauucacuugacaaacuuaguaaaguaagagggagguuugaaaccaucaguguggggguuccuaaaaauucugaaugaaauccuauucuaaaagucaauuuuucagaaaccuugaugugcaacagugauuuuccuauucccuaggaaaacauuuaaaaagauagugauucagagaggucuuaauucccuaccucagacauaaucuccaacuggcgcaaaacucaguaagggauccagucgccaaaguaccccccuaacacagaaugaaaagaacugagaaaugggggggaaagucauagauacaucugggagaacccaaacagagcucuucuuugaaacugaaaaccaaaaaggaaguacaacuguagguuuuuaugggaugucauauaacgaauucacauuaggagagcuuucuacucuuuauuguuuucagaguucaaucuccacggggcgggggggggggagggagggguggaaagaaagaaagaaacaguagcaggaagaaagcaaucugacaagagaucagcccacauugaagcccaguccaagcugaagagaacuguaucgacagugaggcuccuauuguaaccaauguauucauuuccucccuaggcccucgcuuucacccgggaggaacccaaggcaggagucguccuucacagcugucacuuuggucagcgccuagaggucuugcuaaucuaaaagaccucggaagugcaaaugaagccagucccagcaucaccaccucggacucagugcccuacuuuggcaggcacugagaugggcaguaacagccggcccggggcggggguggggcggacccgggaacacacucagccucagcaggacguuccagaaggaaccccgaagugagaaccagaaacuuccccccgcggcgggaggccgugagcugcggcacgugcucgccgggcugcgaguguucgcccggguugcaagcgccgccccggccgcggggagggcucgcacgcagcccugcgcggccgcgccucaccuggaccccgguguaguucucgaagaagaagagcaccauguucugguagacgcaguaaagccggucguccacgcgcugguacaggcgggcgggcaucagcgcggagagcacccgccacagcguccaggccagcagguaggugggcgccgagcccagcaacaggacgcuggggagcagguagcgcauagaguacguguggagcaccagggacagcagcauccucucggcucgccagccgcgacuccgccugcguugcccgcgcggccaccaggaccucagccaccgccggccgcccgccaaucacugcgcggggccggccgcgccgccgcccuccgcccuggcuccgcccccagcaugggccgcgggggcccgggacccggcggggacagugacggccucugcucgccgccuuggaaagggcacgccucggcuugccgggcgcacucgccucggggugcucgcuuugcuccgcgcgacccgugcuugucagcggggaggcggggugaagcaaggcucccggguaauaaggcgccuccugauuggccgacuuaugggcguaauacguguucugauuggcucggucccuuggccucgucacgacgcaugcucgacugcgaaugcuggcuggggaugagcccgggaagaagugaggugguggguuuuggccugugcuggcgugcgagagcugcguggagacacgaggaugcuuccugcaagacacgcgugagccgacuaagucguggagcacaggaggagcucgaugccgcagguuauggacaacugcagcgucuucgcgugccggagggccacccgugcccccacgugcauaggaagcacaccuucccuccucuuggcuguugcagaaugaggcuggguccgucuccuguacccuugguucaccuuucacgggacugucaccuccuuguauuaaaucuuucaaagccuua

SEQ ID NO: 4320 - RNA, 18249 nt, Mus musculus
cgggcaggggaaggggcgggcacaggcagcagcagcucagaagaugcacgcggggcuccuggggcucucugcccugcugcaggcggccgagcaaagcgcgcgugagugaggcgcagcccgcgagugcucaccccuccaauacccuacuccaacccagugugcggggcacaucuaccaccgcugugccuccuccuccuccggcaggcaggcaagcggcgaacacugcgccggugcacgcacgaugaucucccguccuagccugcagagcacucccugugugauccccucaccaugcaugauuuccuccauccaguuagacaucccuccaugcauggauccuccccauacuccaaacccggagcccugagucccuucucucuccucucgcuggugcucugcaaagagcugcgugaggaggcuacuuuggagcgccagcacuuggugaggcgcccuggcucccuggacacccgggcuccgggcugggguggcaugcgauccaagagcugggagagguggaggggugggaucccaaaggacacugguuacccuuucgagauugugacacagcagaacgcugguuuacugaagacaaggguccuguggguagcggagaugaagcaagauggccauaguuuucgcgccuuucgcguuugaauuuguaacccuuucagugcuggcauagagugccuccgcccacuucugccacucuccuacaaggcccggucccuggggaaacuccaccauccggauccaacaagguuccgcgucccuucuuggacaugguaucucugaaauuuaccucugauuuacagaauaaucccugcagauucccguccccaacacccacucagaaucccaaagggcgcuaguuuaggcccuaagagacuaggaaguacacuguugcccauaguggccuaguccccuagcuuuccaacaggaaaagaauggauguuuagcaggaagcuugucagugcacugaacauaaccugggacugagaaaggaauaguggcuauucucuucccauagcugauggguucccggcucugccuccaagcagugagguuugugccuacugaucuacauuccuugguaauccuagaaaacucaggacaacgguagugugaaagggucccugaguacccuccacaaucccccucaguaaucaguaauaccaacacagcuucucgcugacauccgagguuauauagguggagccuggucugauggcauaggcguauaauccaagccaaugaagagguuggggguggaugaacguggugaguucuaaaccuaacuaggcugcagaaagaguuuaaagcuagccugugcaacuuagcagaacauugucucuaaauaaacagaaaaguggacucggggauagcagaggccuuaccuagcacaggaacugcccugaguucaguccuuagaaacacaaaacaaaagaaaauccaaagccagccucacacagaaccagcuaugacugaaguccagcacaugcagcccugguuggcuguaaccguguggugacuccaggucacuccugguuguugggucccccagguacuuagcacauaugcgguguaaccccacagacauaccacuaccacuaugccugucuuaucgcuagcaggcccugugggcuccuugcuaaugguaaggaugcugugcugguuauguugagaccuggguuccuuugagguuugguuugguuugguuauguuuuguuuuguuuuguuuuguuuuguuuuguuuuguuuuaguuaaaugaucuguuggauagaacagacuuaagaaagaucacaguuccuagggauaagaggcagggcauacugaguggggccauauggaaagacucaguugaucaggagccagaaccucugcuggaacuucaucaaacaagacaggcugaccauggcgaauagauuuggaggacuuguuuucuauggguacuuuuuugugagcuuugggcuacagauaggucccuagucacuuggccccugaccuuggacagacuaaggcagagaaauagcauuuccuaggguacaugggucuaaaucagaagcucugaguuggauagagugcauaccacaggcacauucuuggaagaacacuguguugucuguggcagaaaggcuucaggcugucagagcaccguaacauacagaagacacguguauaugaaacauugccuaacucugucauuucaacaccccucaucuugucuuuaccccaggccucugcuccauaguuuucuacuuugccacgggucgucuccucuggggguggcuggcccuuucuguccuccugcccggcuucuugguccaggcccugagcuuucugugguuccgagcagaugggcaucagggucagugguggcuggcgguacugcaucuucugcaacuuggcgucuggaagcgguaagagcgcccaccucccuucccucugauacaguggaaaaauuccccuauccguacacacucugaccuuaaagccagggaucuucagggccacagccgugucuggcauuggcauccuaacacauacccagcgucuggggcuccuccucacugcaccaaugaccuuucgaugcuuuuucuugucuuuagccagauucuacaucacugcuguuuccaccccuuaaugaaccucuggauccacauaaaucagcuugcuuaaaguguuccaucugauaacugcuaccuugguccaugaagggggcacagacuuaauugaccacaagcuagacaguaaagcccacgugaugacauuuguuuuaugcaucuguggcaggaagaagugaccugggagccagagccaguggugguuuuuuugguuugguuuguucuucuuuucuuuguauaaaagguugccagguauggaccugguguagguggcuucccugugcccacagugucuccagaggugacaggguauugccaccuggagacaggaagcugugcauuugcagacacagcacacuuccacucccagcugccccauaacccuggagaguugagaggacuuuucuaaagcggggaagaaauaaggacccagacaggugaagccugcgacucaagugcuuacuaaaucacagaugcucaagguuugaagggcauccaaggaaccauugccaagugcugcugucuguccuggucacuugcgucuucuuucucuacccagguuggacuugggucagaguagaaagugcuuccagggaaacaugaagugacugccucuucuucauguucccuuccagcagacccuugucacauagaugcaucaaaaacacguguguuacaccaguucauccuaagcugggccuuccuggcugaggucugugcucuuguaaaacaacagggcuggcacuggcagggggaggagucgucucauagaauuugggacugcagccuucuuggagcagaaccuacucucuaagcccuccuuugccuggccuuguauaagggcagagggcucacugauugauagauaguuagcugcuguauguggugagaccucaaaggcaauggcguaucaaacuagugaaauagcuucaacguaaacaagcauuugauagcucaaaagcagaauucaaaguagccuuuagaaagaagcauccuuaacuauucgcagguaaaucugucuucucgggcucuguagagacccuggggaccuuauaagccuucagggaaguggugucaaagacugguccagauuaugauauuugacagugaacccccuguccucucaauaucacuacuaagugauggcaugguuucugguaccuauuuagaaauuaaucuggauaaauuaaagacaagugcaauucaaaaacugggaggaagaaaaagccaugaauagcuaauugagaaaaaaaacauucaggugauuaaaaacuaauguauacagccuuuauuccuaucccuuaagauaaaaagucaggcagaucccugugagguagaggccaaccugugcuacauaguuaucuccaagccacucaggacuacauaaugagacauauaugucucaaaauuauuauuauuauuauuauuauuauuauuauugauauauuuaucaauuuauuauuuaauguaaauauauuuauuauuuauaauaauuuauuuuauguuuuauuuauuauauuauauauuuuauaauaauacaauaaaucaauguaauaaauacauuaauuuauuaauauauaauuguugaugauaauaaugugggagcuggagccauggcucagggauagagagcacaaacuacuguuaagcucccagaacccacauaagauagcucacgacugccucuaacuacagguucagaggauccggugcccuccuuugucuuucauaggugcacauaugugugcgugcacacacauacauacacacagaggcaagcacacacauaaauaaaaauaaaucugcacuuuuaaauuaauguauaauuuuuaaaagagaggauugagggaaaguaagucuagauuuccaggaagagauaacguugcacauccgaagagaaacccagauugcgcaggucuuagaacuuagaucagagucuuagcucuuagcuuucuggcagcccaaggaagccuauccgacacgcccuccacaguguuucggagacugcuaugagcccagcuacagucugcccccucaacagaaagcacuggaaguugaaagugaugaaucccuuucacgcucugaaagugucucucauaaacaaaaccaggcaauaagccauuccugcagaucaccuuugguuugguuugguuugguuugguuugguuugguuugguuugguuugguuugguuugguuuuguugcaguuugucaaaggcaccuguagggggagccagaacaacuguguuuguacaaccucgaccuuuaucaaaaugaaacccauuaacugacuccauaaugaaaugcagacgaacgaacuagcaacagaaaaaaaaaaucaauaaaaugcaaaccccuugaggugaaaccgcuuauaaaaaaugcaagggcugaagacauaaauggauucugguuuuaauuccaaacaacacaaacuauaauguuaagucuacuguugaagagaaccuggugguaguuacaauucauuuuacaccauggccgcucuuuuuuucaucugagcccuuuguuuccacucuaacacagcauguacuugugccuccuucuuuuuaaagagccugcauaucuauuuagaaauucacccugaacggaagggagacuaccuaagaugucuccuacucagcaugcaucugagcguggcaacuuuucuuuagugaagagaaagcugagacaaacuuuaagagccuauaaggccagcuucacacauaggugcagguucaauguuuuuacgcagguaaaagcacuugccugguggguggagggagagagcuaacucccagaagcuguccucugacugccauugcacaguacucaccaacaagaguguacacacacacacacacacacacacacacuccauaaauaaauaaauaaauaaauaaauaaauaagcaagcaaaugaaguacagcugugcucaaaccuggcacugcugacugucucaacucuaacgucacauuaacguuaauguuaaaauguccaauguuaauguuuaaaacaugagcagaagaaucacuuauccccuaagcugugggcccaggagagacgauucuaguugugguggacaugggugacuuuuuuucuuagccugguaaaaucugagaagcauaauuccaaagaccuguccgguauggcgauugugcuuccaggcuuccaugcagaugcauguugcuuuuacugcagcuaagacucuuagucaucgcugacacgggcucacauggaguacccugacgagcugcagacucaccuaauuaaguacagugucugagacuaacuugggaacagcugaagggagcagugucaucaggaagggccuggaacaaaggggcagaccaggccuuauaaagaugguaacaggaacagcuggcacagucaaaagcccaggaugguuggaaagagaagggggccugaggcagcagcagcauccagaagagaaaucuggugccuuucgggaccucagaaacaagcuccuacagcucccaucucauuccagauccccagggagcuaccccaccccuaccccauccuacuccccuagcuccccaucccgacccccugcagcugccuucuauccucagccugaguucuucucucugaccacacagcauuacaaugccacuccuguugcgguaaauuuccaaucuaaauaugccccggcaaugaaaacacaacucaauuaauaugaauacaagccuugcgccuagauugggcagauuuaccacuacacuaccaucuuccacgucuaugagaucccuuauaacuugugguuucuccaggccgcucucucgcucucucuccccuccucuuuucucccaaaaccuucagcucuaucuuucccucuuuccccacccaaucaccagcucuagucuuuauuuauaaauuaaggugggaagcagauuuacaggaaaucaccugagugcugacuuauuccuuguucaaagccacucacaggagaaaagaauuaacuucaaauacaauuagcuccagggcuaucugcaacacacuccaacaccucauucccaggcaugggccccauuccaacuccacuguccuaucccacuaaucucucauaugcccucucccaacucagcuucacauccacagcuuccccggucucuccaggaugcacucacuggccaccuuagccucuccaaugaggagucugcuacacacacacacacacacacacacacacacacacacacacacacacacucuacucaucugauucccaguuaagugguucccagauagaaccacccugccuccuuucuguagagcacagccccagggaggauguuggugggugaaaguaaaaccuuaccccuguaggcccucaaaggccacagugacccuggggggcagcuggugugguuauucaggcucuugugaagaguggcccauaccacuuccuaguugacuuucacaugaugagaguaucaaaacaaagugccuacugugugcuuguggaaccauagacgagggcaugcucuggcuucuuucuaaguuuugauucuuguugcacacugaaaaggucaccucauugugccuaagcuaaugugugacccuauggccuugcccagcccacagagcccugcuuucuagcugucccucucacaacccagcaaccucuuguuccccaugugccaugugucugcacuugacuuugagaacacuccaugcuuuuucaaacuugcugcccuuaccgccaaccacuucgcugccuaacucacuuuuuagugauuucuuuuucuuuggggugacuaguucugccugggggggggggggaggauuaucuacaccaccuccucuagcuacuuccuauccacuugaccaugccauuugcauggucaugaauacuaauuuacaaccauuugucucuguccaugaguccugguuuauaaccaaaagccccagauccuuccaaggugugagggaaggcuccgcagcuccucgcauuccucauuucuaaaaacaaaauuuguauucuccccugucaaucaagcagcugcuggcaggugucuuucuguuacauguuagcauugccacaaccaagagcuuaagcuugaagucucagagucaucuauaaaccccucuccacccugcucuccguauuccaacauucccugcauucauuccuuccuuucuauacccaacacuucuaucucacccaaaccuucaguacuuacugcuuuauuauaguaaaguaagaaaguacagguuucuuccaguuguucaugucuacugugcacacauacaccuauacauguauauauauguguauguguguguguguguguguguguacauauauauacauuacuuguauaugaauaauacauguguggacauaugcacuguaauaugaacugcaugugcaccuguaccuguguaaaacuacauauauaugcauaugcacugaguuugcauaugcuguacacaggcauauauguuugcacacugcauauauauguguaugagcauacauuuacacaugcauucacuaauacacaacacaaaugcauauauuugcuuucuaucucaaauguagcauacauaacucuuccaauugcaguuuuccagaggaaaaaaagccaacuuucaugggcugaaacugagaacuuuagugugcuucaauaggaccauaucgccccuagauucccccaucuugccccacccaucuuggucucuugcuagccucuggugaggauccuagacccauuuuccccagcuguuccuagaggguuccaggcuuaggguacugggaguucuacacucuaaggacaaaggugagggcucccucaucucugugcucuaaagagaugauuacccacagugccuugcaguagaucucuauuaaagggguucauucccuuuccacaaagaccuggggugaggacacuggucaagauuuccuccaagccucaucaggcccagccuagguuccuuagcccugcaauaacuucagagucuccccaccccuggcccuuccaaccuuggggaaaaucgacuaguggcagccugcugaacacuugaaauacgcagcuugggcucagagcuuagcaacagccuaacuggugaccccagagcacacaguaggcacagagaagcauucuuaaaaaugucuccuaucuccaugggaaagguuguuguggaagccagaguugccagcuucgugguccaugucauaaugucguugcuuucuguaggcacugggacucuguggcaacggcucuguggaagggaaaggaggcucccagcuggggacagcugcaccugcaggaggcugaccugucagcccuacggcuccuggaggcucugcugcagacagggccccaccugcugcuucaggcuuacguguuccuagccucugacuucacagacauugugccagguaggugccuuucaccauggucucauaccaucugcuuccaauaacaggaacauguccggaacaugugccagacuucguaggaccugguguccucucaagauuucuccuauuugggagauuuagggaaacucccaauucucacugacccaaaugaugguuacagcuggcuuuugcugggaucaugaguucagagagagcugguuucuugggcauaaaguaucuaaagucaaucauaagacagaaauugggcagagcagagauaaccuugaaaacuaccuugggaagcccacauguccgucucucuugggucuacuccuauugcagcagaccugacaccugaaagccccacagaaagcauagcucgucuccugaagauaauguccccagcucccauuccagccaggaugccccauuacuuccucuccucuuccucccuccuccuucccccucuccuucucucuccugucccuacccaccuuccucuccuccuucccucuuuccuuuguuuuauuguuuccuugguuugguucgguugucaagacagggucucucugugcaacuggcuaucuuggaacucauuuuguagaugaggcugaccuugaacucaaagagauccuccugccucugccuccugagugcugggauuaaaagugugcacggccaugcccagcuccucuccccucuaaguauccaaacuuacacuagaagaucuaaguguuuagcugugguuguguacucuaccauucuuucaucaaacuucuucauguggggaauacauacuuguaauaaacugugucuagggguccuguaggacguguauccauuuaaucauaguuuagaccuaggccuuagaagcucaagggcugggacauuuuaaacgggcauccagaggaagagcaucuagggcccuaggcagacauuuccagccucccuuguuuccaugggaacauauguucuuacacuguuguuaaguuacccaccaccaagggaaucaguccaugguacauugccauugggcuaguuuuugauaagaaguuggaugcucucagaaagggauguggggugugcaucugugugugugcuucagagccuguaguaagcucugucuauucaaucuucuaggaaucagugcccuacucuccuggucuucacuguccugggcucuagugucauacaaccguuuccugggcaucaugaagccaggccaccauaccaugcuaugggcugcucucuugugccagcagcucuggaggaugggcaugcugggugcucgugugcuaagccugguucuguucugccgaguuuaccguguguggguuuuggugguuggagguaaguggggcuuccacucuauucauaaagccuuaacaguaacuauacaugguucucugucccagaucuguugcugguuggguuuggcagagaguuuuauggagacaguagaaaagcaggucucuguguuuccaagagagcucagcaggcuggauacacagauguggccccucucuucagcacaguaaccuggacucaccuuuguaaugacaguuccaagaaagaggaaguagaaauguccaguccucuuaaaccuagaacagccacagcauggcuucugcuaugcucuguuagucuaaccguucuuggcagcccugacccaugaacauagagguccagagucuaguucccacgagugugcauccaaugcaagggguuguagugaaugcuggcccuuuggauauacuaccacagaaaugucagcuaaagcuggaaccacaguccucagaagacuauuguagaucacaagcccuucccauagaaaguugaugcucauauaggaaagggcguggaucucacugcccuggcugcacagagagagguccagguucaaaaacugugcaaaacugugaaguauauaugaugcuguucagaaccuccauaagcaccccauuugcuuugguuauggaacacugucuuuguuucacacaggaaggcucuacugaaccccagccuucucagagccagcggcucagauaugaaugugaugaccaagagucugucuagcccuucagacuccugaauggggccuguguguccuugccaaggacagcaguguccucuggucaucagugaauacacucugcaagaaggaacaguguacucuuguuuuaaaagaaccaagaacacugagaaauagcuggcccauguaccaagagcaaacauuuaauacaauuauuggcagaagagaacauuauuuuggggggagaaaaaaaaaagcuuguguuuuuacagagaaauuaacuacauuuuauuagucauuuuaaaauucaacuugugauccagaaugaggcuauucauuuuaaaauauaagacuaaaacuuguaacugguccacacggacuucucuuugggucuggaggguugggguuuguagaucaacagugugaaaaggguagagaguuuuauaacugcuuccuuaagugcuugcuggaaacagaagaguacccauccauauguagggucuugugggugacacagaagccagucuguuuucuuagcuccaaacuagguuaaaagcccccugugaggcucagagagauaagacuugcaaagauggaaugaguggcuugucugugccccuugguucuccucuugguucucaccucuucccgucuccucacugaacacugaauucuaucccuuccucccuccaggugcucacuggcuagugaugaccuucuggcucguggcccagcagagcgacauuguagagagcaccugccacuggaggcuguucaaucugcuggugggggccguguucauccucugcuacaucaauuucugggacagcccuuccagaagcaggguggccagcuucuacuuggcaaguggcaauggugguuuucuuuaagcuuggcuuucacauugccggcugcguguuugaugggaaggugcacauaugggagugugugccuguacaucuauuaaagaagggauauuagacacuggggaaucagcuuaguggguaagagaacuuacuaggcaugcaugaagaucugaguucaaauccccggcaaccaaaugcguuugaccucagcccugggggcagacgcaggcagaucccaagaccuuacuagccagccuugccaaaaugucaagcuuccaguuuuguaaaagacccugccucaggcaauaagggagagcgauaauggaaagcacuggaucuucuacaugucugcacacuguguguacaugccaugcaugcaacacacacacacacacacacacacacacacacaggaauagccuaacauaggagaaguuauaaacagugauuguuauaaacagguugaaaauagccuaacaaucaucagaagcuucaggugcagccaacuccacagacaucauuagcagaugcacuuagggacuuuuccaaaguggagagucccaggcccuuccccugagacaacuucaggcgacauugcuggcccaccuuuaauaauugcaacgcauggccucaccuuuuuuuuuuuuuuuggaggugguuacagcucuagaaaguguggcuucacccaugagggguugguucaucucagcaugcacacaaccuaagaaguauguuagaaaugaacuccaggccaacgugcagcucuugguagcuacagauauacaaaggaaugcacccauugcuuucaagagucccagagaaacagagagccucugaggccaagacucugccuuaaaagaggcuuggaggcaucuccggcaaagcuacagugguagcaaaggaaacacagagcacuaggggguccauguggugcugccagggagacaaaggcagagacuaguguaaggagagguaacguccggucuguaaugauacaacugaacucugauuuauaccgagguggugggaaaguuuagaagggagaggagagagcagggagagggaaguaugaggcuugagucauagaaauggagauguguagaaauggagggagggaaggucauugauugacugucucaccugguguguuaacuggaguuguccagagcagggacagauggcggguaucucuaugaguggcaggagacaugggucucuugaguuaaagagcaagugcucgcaagcugggggagugaccuccuugaauguuuguauuucaaagcgauguucucagguccuugaggugggucguugugagggugggguaggagauggauaagaacagugagggcccuaguuaucucucauuguguuuccacccggcagcugugauuccucaggcaggaaguucaaggggcugacaauucaccccaggaauguagccuugggcuguuagaucagugccagcaucugucagccaucuuagugugggcuacauagaaacacuugugccaaagcucagucuauuuuccugugucugugacucuggggauguucccaugaaugacgucagcaagccuuccuggguagaaacauucccccuggagccuagcuucuguucgguggaggcuccuugguuugugaaccccagcagguacuagggacaggagggaagaggugcagauagcagacccccagguauggugacucucucuuguccccacagguuaugcugcuggagaacuccauacucuuacuacuggccacugacuuucugcagggaguaccagggaccagccuguggacuguggugggagucuugucuggauuucugauugguaagaccuacugagccuucuuagccacacuuccuuuccaacuuguauuuguauuuuauguuuauucuuuucauuuucaagugugugcacauauguuauauacauauguaugguauauaugcauggaugugcauauauugguauguguagggaugcucaugugugguguguauguggaggccugcagcugaugucagaugucuuccuuagccacuuuccacuuacugagucagggguucuuacugaacccacagcucacuaaucccugauugucuugcguauaagaagaacaauuguuuuguuguuguuguuuuguuuuguuuuguuuuuucuuauuuaggaaccuaguacuggcuguugcuaggcaacuguugggcggagccuagaggaaaugcuaacaggaaggacagggaacagguuaggggcagugggcaggggaugggacccaugcuguagguaagugcccuaagacucugagcuuagcuuuguagaccugacuagacugaugggggccucaaggaaagguaggagcagccacgucuguccaaaaugcugccuauacauugaguggccgauuucuaagcagcaugcuugcaagugaauggccaaacagcgagguguccaggcaagaguuacuccgccaccuacaaaguggccucugucuagucaucuuccugcggagaggggauccacugggauaugaugugacaguccucacagcugagagaccuaaccacuucguucacaggcgguaugacccaguccaguaaacaggauaggaggaaguaaaacugcccugucaucuuagaaaggacugggcugugucaugcugcuccguugcccaacagcagguggcgcuggacacaucugugacuccuuuggccuccuggcaaucuccagcaggaaagggagaguaugucaaaagacagaacaggaacaaccaaacugagucaguccuuaaacucgggcauuauagaaaauuauauuuaauacauguuuaaagucauaucaucguauguuauugacagacaugaugguuuguuucuauaacuccagugcuuaggaggcagaggcaagaagagcauuguugugaguucuaagccaucauggccuacauaguaaguuuguggcaagccugggcuaagaagaaaaacccuauuaaaauauauauauccagaaacagaucauggguagagugcuuguuuagcauucaagaagccccagguuucaugcccaacacuauuauaaaugaaccguacaagcagugcgauccaaacacuuagcugagacaggaggauugacucagguuugagaccagccugggcuaugaaucaaggcuucaucucaagaaaacaaguaauauuuuuuuaaagagaacuauaguaucaagaacacagacuugagauaguuccugcccaaauccaggcucccuguuuccuucuuucacuggacaaacguguauugagugccuacuacacaccagccuggagcuacagccaagaauccagcagguggcaggauccuacagaaaaucaacacacccggugccucuggccauggcagaucccgcugccuaacuggugcccggggugcacaggguaguguuggguaacauccucuggcuugcuguucuuuccugaccuugcugggauuuguuugccaaagaugagugacugcauauugcuagggcucagugagaauccaaggcauagaagcuaguaugugagcuauguucaaugcagacaggacugcugguccuuguccccacuucugauuuuccacaaaccagugcccugcccagggccugcucuuguccccagagucacugagggucugggggcacuguccuuugggcucuuccuacggucugucaugcugccaucuccuggugccuucagccccccuccucacacuuaguucccaucuucuacucgccuaaugaacaccccugaacacaggcacuuucuccagugcgacaggaaacuggaaacaacguggguggcuuacuggaaugcucugguaaagagauuauugcagcagucaacacuucugaucgacacaaaugaaacugacaacaaugugauuaagcuguuugugcacagaggaaguguuguuguuguuguucauggaaaugccccgacacggcucugaggagcaugacugaccucugcuucgggcucuuguuuuugaggccgcuuucuuaccuccugccugcccuggcuuuggcaucuuuccacacugugcugguggugggauucugaaagauuuugggagaucucuaccaugccucuggugcucacucgcaugcaugcacaaaucugcaagugacgccaagcggucaauggaagaugcccuccaggaaaauggcugagagacucaaaagaagcgaagccaugguguacaguuucaaaacauuccuagcugguaggugcugggcccucuuuaaaaucuugacccauugauagggucaguucugaaaucucagaaccuuguuguuggucaacauuauauuguuccauucaaaguagccacugaaccugucacucgcagcaggauguggggugucccggaacauaacucuauguuaucccuuuugugguuuuuguugucuucuguuucagggugugcaucgcugguuauuuauuacagcuuacuacacccuaaguccucagacauccagcagagcuucaugaggaaaugcuguggccccaucgaggauaacaaaccugaaucagaaccuccucccagggccguggaucccacaggggagaugccagacagcucaagcuggugccaagaggaaagcuaugagcuaacaagucuagauaaggcccccagcccagagcagaacacugcagagguggggcucggggagcagagaucuggggaguccucuuucuucagccaccaccacuggcuguugcugaaacucgcucucaagacaggaaguguaucuaggaucaacgcagcccucggaggugacagcccuggcugcuccugucccccucugcuggggucgagucaacacugugaucugcagaggaaaccccuguuuucccaucaagaccucccauccucucccugugacccuuugaccuuggagaaagggucugaguacguaggggcuccgaaagcagagauggagucauuggaaacuucaagcuaucucuccuuugccagcgagcuugaggacaaugcaacaacccagaagccaccagcuacccaggaggacaguccaaagcuggcuggguccaaggcugaccuugcagcucaggggaaggagacagaagguccccugcaggggaaggaaggacaggagagcacaacacuguauuucagugccgccauggacagaaccacaucccaccaaagaggcagcccaguaguucugcggauaucccacucggagacucugguagagagcagaccugggcagccugcgcugccucaggcagucacuaagcccuuuccuguuaccguggccaauauuagucccauuccagguagaaacuuccgccccagugcagagcuuccuggaagagccccagauaguucagagugugaggaguggaaggacgcggcaagggacccgaguaugcagagcucauugccgaagaugaggcugaaggcagcugaagagcccugcuucacaucuaccccuaagucggaguccauccaaagggacuacagcugcagggacagggugagacaggagaugagcuuuuucaucugacccuagccguggugggauaagacaacaggucaauacaucagacuggccgcucagcaucaugggaagagaaaucccacacgcaacgccugaguucuucuaauucuggccuccaucugcauaccugaaaagacgaagggacgggauuggaugaugucuaaccccacaccccaccccacccccacccccguacgcaucagacuuggcacugacgcacagcaaaacucacggacagugggaagaagcgaaggggccuccaggucccuuuucgagcugcuugaacccuaccuaguaugucucuucucggcuuccaaaaaaugcaaaggaaagaauccacuugcauccuggguccuuuaaccuuuuaaccgauccucacauuggauggcuauuaaucacuuuuuaaaaaauugucuccaaggucccuugaggcaacguauauagcuguuugcaaccauugcacaccaaagccccacggggaaaggaacuuggccagcuuaaucagcugcacuauuaaucaccuuuuuaaaaaauacuuuugggacugaagagauggcccagcaguuaagauccugcuccuccggaggacccagguucaauuaauucccaguauuuauuugguaacucaugaccaccuguaacuucagugcccgggagacaacagucaucuucuggccucugugcacacggcacacccaugauucaugucaucuaggcaggcaaaauaccccuacaccuaauaauuuuaaaaauaaaaccguguuucccagau

SEQ ID NO: 4321 - RNA, 734 nt, Mus musculus
ucugagucccauuuuuuuuuuuuuuaacagacaaaggcuuguuuuauuuuaaagacugauccacaugaggccacagccaggccgcuauguacagacacgagggaagcuuuauuucuuggucuccuccuccuuggacagagucuugaugaucucuuccuucuuggccuggaggcgcuccucccggcgcuuucgugcuuccuuggucuuagaccugcgagccucagccuggucagccaggagcuucuugcgggccuugucugccuucagcuuguggaugugcuccaugaggaugcgcuuguuuuugaacacauucccuuugaccuucagguacaggcugugauacauauggcggucaaucuucuuggauucccgguaucuccugagaagccggcgcaggauccucauccuucucauccaggucaccuucucaggcauccgagcauuggcaguacccuuccucuucccuaugcccauaugccugcccuuccgucgggccaggguguuuuucuggcaacgagcccgggaauggacagucacaggcuugcggaugaucagcccauccuugaucagcuuccugaucugcugacgggaguuggcauuggcgauuucauuggucucauugggauccaaccagaccuucuuuuucccgcagcggaggacacuagaggcaagccucuucuguagccugagcauacucauggcugcggccgcagcagcgaaaggaacgaguccca

SEQ ID NO: 4322 - RNA, 24269 nt, Mus musculus
uucacuuucccaaugucaguguguccaaaugcuggcuuguccauuuggcaucuucucgaguggccugaccaguaggugucauaggggguuggcugaucccaguggcaggccugcuggacgagugggaaggguaccacuuccugcccucuccgcugccuccugcuacuacuggguguugcuugcaaccgcaacucgcccaaaggaggggguccacucagaaauuuucuaaacggcagaauuugcagagcuauuauugcaguuuggggucaauguccaaauuuuuggcuuuggaauauuucaagaaggcccagaacuucuccgauccauagagcuggccagccuaauaguccuucacggucuccuccuggaaauccuugaauauguccagccggaacuuuuucucuagaccauaacuguaguaucaaaaaaggcacuccaaaccgucccuguagccuucuuuggcauccaacagcgccagcugcuugaacucuucauacaucuuuuuauugaagugaucucagaggaagaaggaccaaaagcagaagaggguguuuaucucgugagacuggccagugccaaagugcuucugcucauuaaggcagcgccuccgcuuguggugaacauguugugugaagccauuuuccuugagaagcucaugggaaggaugcuggaacuugggcagugacugagggguacagccauagcugacgacugcagguguucccucugaaggacuggagcuaauagaagcaguccugggccugugcucccgaggauccaucacccagcccacaugacuuuccaaggggggggggggauucgaguugugccuugucuuucuuuuucaaggcacuuuggcaucuaggguucguccuucuuucaccacgggguaaaaucaugguguuugacuagagucuuugagcugggguguccggggugugugggaaguccuggcauuuggagacucugggacagugauugguagagaacgggcaaugguagauggcucgggagcaucuacaauagcuuguuggccagagcaucaguaggaacuuguuggaaccgagguggcccaggaggaaccuccugguuaggauccacaggggguucaggggucagagugucaaacuguucccgacuaaucauauucacuuucuugaaguucuccacuucuugcuucaucugugaauacucaggcucaaacuucucaguccauaggucuuguucauaguagaagaguccaucauuaaugaccuuggccaguucagcacucaucuuggcaugcgaagugugguugacuguaugguccccuccaggguggcgacgcauguaaggugguguuugagugacgaugaggaucuuauugacaucccggucaucaauuucauagucagaguccucuucagaccaggcagugaagguauucuuccacccauccaucugcuccaucuccucgucaaacagaaagucuaguucuucuugcucauccugauccuuagacaugagcugcugggagggaagcugcugaggcagagcaguugggugggagaaccugggcuucucuggcuucuuggggcaugcuggugagggccgagaccuuuucuucacuucaauccagcucucagaauccagaucugggaggcuggcagacaggcccuuaggaagggucuccagguugcugaccuccucuguuuuuguuggcacuggggugacugcauggcgagagccagguaccgacucggucucuuucugguagugcuggcagggaacaaacucugggcuguugagaagcugagaaaaaucaguuugugaaugauccacuacuggggggccaggcaguggccacuuuucagguucuucccuccuucggacuuucuccucaaccaucucuaccaccuugcuguccuuuagagcccaaagaugagugaaaugucagugguuaggguuacggugaaaggaagcaauaagggugaugggaaggaagccaucagcauccauuuuccgucucaggaagaaguuuugcucuaaauuguccaugcugaaguaauauucaaucuggagcuugauauaauccuugagcagcuccugguucauacuguaaaucucauugcugcuggcauugucaaaguaguaagugauguuguucauauaccugugggugcggggccccucuguaccaucaauuugguagucaaacugguagucaaaguggauucgagugccaccccauucacggccccguccacgaccaccccccuccccuguccacagucacggaaggaagcccgugcccuaccagcccuaucacucuucacacucgaugucucauccuggucgugccaggcaggcuccgcuuuggucucugguugccaggcugggguggguggggccacagauacaggcauguagguggcagguucagauccuuucaucuccccacggauagcagguguaugucuugguuccugugggcgagugggacaggaggccaauuucucuggguacuucaggcuucacgccuauuugcaauagaacccacuuguguuugcaccguuucuucuucugucugccucgcuggcaguccucauccccauucuuuuccuccccgauucaucugacuuuguuuuggggcucuccuuacuaucacuuccaucuccuuucuccuguuccuucauguccuucuuggguggcaacuuccgagcaggcugaggcuugugggacuguggcugcacacuuuugugggcuaucucuccaaguguaugccaguugauugcaucuccaaaaucaccaaccuugcuuccccucccaccuuggcuggagcagaagguucuggcggcggcugucuguucaccccggccggcggcggcgcgugccucuuccaccuguucaccuugggcagcggugccuccacgaagucacgccggccgccauccucgccgucgcuccccucuggggcuuccgcagcugcggguggccgcgggcucucgcgcuccgcgccgucgcgacgaggccuggguccgacucggguccaacucugccugggcgucgggcgccggcuucuucuucgccaggccgugcuccucggccugcaguagcggggcgcccgccggcugcagcggccccacuagaguggccguuugcgaggaggggccgggcgcgccgcgggccucgcucgaggccgcuggaggggggccggggcccgggccgcgcagacccugggcggcgcgcacuggcggacgcugagcugcgcgccuggcuccuagcccgccuggcggaccucggucugccccucugcccagggcggcagggcugggggugugcggggggggggggggaggcugcaguggugcggauggccaggagggcagccgcgcggcgcggagagcggagccaaaccaugugauccgcggcggguggcgggcgggcacacgcccuacaauuuuuaaaguccugggaaacauugauuuuguuuguuuguuuuguuuuguuuuuaaaguuucugaguuuggucucauaccuuagaaaguauuauaagaagaacaaaaaucuccugucauuucuuucacgugaggucuucgagagacuaagccaaggcagaaaugacuggauuuuaauauuacagaaaaaaaagugaccuaacuuguccuauauucugcauuaaagaccaugguccccaagaaaaagcugaagaucaggccauucauuucuaaggauggaacacaguggcauauccagucauuccuccuccagaggagcucaucccguuggcuugugggggaugugcauacuucugaggcacugaagaaguccuccuaauaaacucugcauccucugcucagauagagucuccuauaaaacuccaaucguguucgcugcaugaaaugcaagcacuucuccaagucaguacuacauguggacauccuuaagguacuaaguaagauucaagugaacuuauaugugucuauggauuccauugcuccucuuugagacuuuuuuggggauuuuauuuguuuuuauuuuaugcauaugaguguuuucuuaaauguugagcaugccaggagaggggaugagauccucugagacuggaauuacaaaagauugugagaugccacacgggugcugagaauuaaaccacgguccucuggaagagcagccaguucucucagcacuaagacaacccaucagcccauccacugcucuuuuguguucagcaaacuccgccucugaccuuaaccucuggggccugggugugugccacaacgugugucugaggacaacuugcagagauugggucucuccuuccacgacaugggucccacuuugucagacuugauagcaagugacuuuacccacugaguuaucuuguugucccaaagagaaacuucaccucauuuuccuguuuuucuauuauacagaccucuggacacagacacuuguccugaaguccagcaguggguggcaggcucuuaagcugcauuuuagcuucuugcucaagaucgauaagacugaacacaugcacacagcaaguucugugacucaguuuucgaaguacaguucaguagugagguaaaacaugcuagucacucaacacucuggggccaauggagcuuuucagaacaaaaagagucucauccuuacaugccuacuugcaccucaguugagggacuccaaacccagacucuucugacuugugaggcuagugcacuggaggguacuguuucuaggagacagagcagaacagcaccuucucagccagcauuagguggugcaaagccagacaucccgcaguuacucuugagaaccaggaaaagaugggagauuuguguuauuccccaagaucacucauagaacuguuaaagcaaguagguaauauccuagcaccauauaugcccuugcugagaccacccccaccccaccccaacccaaucccauugcccaugcccacucccaucccugccucuaucaauugugccuucuuucagguggccuuaucucuggggauaagaugcaucaucuuggaggccccugaagagacacacauacuagaauaggacucuucuuaaacgauugguuccacaaagaaguggcuuggaacuuuguugcuaugguaaaauaaaacuagaugcaguaugagucggcccuuuaucauuuucuucagggauccacuugccuuguuggcuuacauuacuuuuuuuuuuuuucaacuugauaaacaauacuuuuaaagacauaacuuuuccuugucugguucauucccaagaucucagauuagaaauaccacaaauaugaaauauuacaaacuuaaaagucccauagucuuuaccaauucaaauccuuucaaaguucagucucuguaaaaauccaaagugucuuuuaaaauauuacuuaaaagaaccaacucucugaacugugcgugucuggccagcaacaccagagccagagcuugcugucucccuggcccguguaccucacuagccuucuguggcucccagaccaacugucuccugcuuccuugggugauguccugauaagacacucugcuucuagauuuugucugugaugaaaaaagagaagguugacuuuggaaugucaucaaauauuaagcuugauuuuuuuuuccuagcuaccaacauccaaaucgcaagugagcucaagagccccaguggagccuguugguugugcuaauagaauagagcuugcagcuaggaggaaggaagcccuuugcucucuuuagggggagaugaacaagagggacuguagggcccuauggcucccugggagccagggacaggacaccagcuaaucaaggcccauucagguaagagccuucaauugaaauuuuuuaaaccagagcauuccauaauggugcaugcuugaaaugccaagggucuauugaggucacucugugaaagcugucaaaacugaagaaauaacgcaucauuuguccgcugaacaucuuuugaaagaaaagcccaccacgacacacacaggacacucugugcaaacagaggcagggaaggaauucaccuuucucaccucgguguuugagagaauacagugagaauuaucuuugcagguagaaaacaaaacguaggcuuggggaaaggucuuaggucccaguugguaaccuaagaccccaagggaaaaaccaucauuuucauuaauguaaaggggauaaaagaagacucaggccagggagguguauggcugggguguuaaaagagccuguuggagccuuuggaaagacuugguuacagcuaugagaagaaguucauggauggggccuaaugcugcuucauauaaggaguaggaaaaagggaaaaggauggaacccaggaauauaaaaaaacugacuguuccuaggaaugauaaaaucucucccuuuguagaaggaagaguuagaaacaaaguuagauucuuucuaccaaaggcaguagccuccuagguuggggaaauugguaguucuggaauaggugaccuaaugaguagacaguuggaauuuagaauaugagaucuuguagccuugacugaacagggaauuuagaagaacagaggugacaccuuggcuaauuuuuaaaggggggacuucagagaauuuugucuacauaauggacaaucuuagauucagggagagcagagaacauaagucagaagccagaaccuggccaaauaagauaaggcuauccuggaaucccugagguaguacacuucaggugcauugaguagaaaauggguguuagggucaguccagguaaagacaaaguuguucugggacuagauagaaaagaauacauccuugggaucuaaguaggagaaaugagaaguccccaagggaauaguggaaggaacuguauaaggauagccacaacaggauggagaggaaccaccgcuaauuuuaugcaccugaggucuugaacaaggugauacauuccauuaggucccuuaacuucuaguauaggggaacuaaagggggaagaggucagauggaggaauuuuuuucccuaagagaugauauaggcuuaagacuccugaggcucugaagagaaagaggauauagagcuugagugauguaucuuguagaguccaauaacuggaugacaagaagggaaauauguuuagcaaccgaggguuucugggugacccacacucaggggucuaucugagaagcuggcaaaggaaacaacauguuagaguuaguagguugaguggugaggaggaggaggaagaaaggggcugguagugagcuuaggcucaggugaaugggggaagcaauagaaauagaggcucccaacuuaucuagaagaccccuugccaauagggugucagaacgcauugccacuccugaaaagaaugugugaauucaacuaagggguaggguuggugagggagguaagguuguacucuuccaucauggguaggggaugagaagcugagguggguccccaaaacucugucaggacugaauaaguggucccagcauccaaaaagaagaaugagaugggauucccauaugccaugaugcuaccuggggaugauuccuucuggugauggaaguagucaggucaagggagcucaggccucuucaguuguccauauccaauucuagaagauaaucuggaggguuaccuaagagugauguuccccucuccugaguggcauaacaaaaaucgagggaccauuguccuccugauggcaucaugggcauagaccuuuuggcuuuugagaguuagggcaagaccuuguacaauaaacuuguugaccaacuuuuuaacccauauggcuguggcuauccuaccugguggaguucucugugccccacauugauggcugcauugcaggcuauagaagccucagaccagccugugugguugcuagcugacccguccagcagguccaguuauucgaggaucucgaggggaccuccuccuaauaaccaaaugggggguagagagagacgagggucuuguacgaguaacgacacggaaaccauucugaaguuguaucaagaccccaauguauugagaaagguccaagguuuaaaugcacaagcaaagggggaaguacagauacuugucagugggagggguagggcaauacaagcaaaaggagaaguacuuaugggagggggggcaauagaaauucuuucuuuuggcagcuacacggggaagcaggaacuugguggugucaggguguggucaggagagcggugaugacccagggcuggaacaucccguaguucucggaauccauguguugguggcccacuuuugaccccuuuuuucuucuggggggggggaggcccaauuuagagaucgagaguugucuuaauggcucccaacagcuagcaaguccagggcuucagcaacauuauuaguugaaaacacuucauuaucaccuuuccccagcugaagaguucugaauccuggacagaccaugccaagacagcagaguucacacuuuggggggagggacaggguucacaucuuuuauccuggcugugacauagguaacacagguauaacuugcaggugauacagguaacacaaguguggggagccgugagcaauugccaucaugagccuccgcugugccuaacugguaaacaaguaaugugugcaggugcaagaguaaauucgugccaagucacugcccaucccggggcguaguagugggguaaugagugagcagcuaaucaggagcugacacgucauauggagggguauauaagcaguaucauuuuccuuguuugggguucuucuuucgccuaugcaaucaaugcucucccaauaaacaugugcaguaggauccuguugcagcguuguucuuccuggccaguugagcgcgugcaagaaauggugcugaaacccgggacgagaaacaucuucaggcacgagcaacaucuucaggcacgagcgaagacccccugcuacagggaggauucagaacugcaucucggggaaggagugguugauaaagguucccguaaaacagacuguugagaaggauccagcguggauucagaacucuucagcuggggaacggugguaaugaaguguucccgcaacacagacuguugagaaggauucaacugcguggauucagaacucuucagcugggaaacagggguacccguaaguaaaaggaaauuaaugugagucucugagagguaugcuuucuuacacaguagguccaguaauugucgcugggguucuguugcuugcuuucuuucuuagccuugauauuaugcuauugccuuaauuuuucaucacccuggacacgaguguaucugcuggggguagcucggcagacacauaagaucauaaagcaaguguagauaaacuuguggauugaccuuggggcuaagaaccucacauagauaagugaguaccucaaggacgcuuuauccaggacaagaaaugugagcuagcuguuaaggaagggcaaugacuuuugcaggagcaccagggaagcauaucagaaacagagagaaaugaaaaagaaggcacguguagaaaaauaaguaaaaaagaaaaaaaaguuauuuuagagcucuccuagggacagaauaaaaacgggagauguccugcucuggcuccuauggagcuauuuuuagcuuuggauaagauauuugugucccuuugagaucccaaguuuuauucccugucugucuauugucuguuuuugguguaugauuauuguuuuguguuuuauguugaaaaauauaauugguuaaaacuuuaucugcuggcuguccauccuuuaacuuguuugaaaagcagccucaauuugcacaguagaaagugauaaaagcacuguggcugggagucagguauagcugaaaaagcccugcugagggccgauugcaaauggagcucuuaaaggggcaggcagucgcauauagacggaccuuauguucagggauuuggagagagauuagauucuccuugcugggauguccuauuuucacugaucaagcugaauuugcaugggauagagauaugcugcuugaucaagguugauuugcacaacaacagacaggauauccagugcagguauuugagcaggugaaucagauugccauaaggguguggaaaucauugcccacugguguugacaguguuguagaacuccagagagacaaugaggcacugaaucaggugagagaggagcgcucucaauugguuugggagagagggucuguuuguguuuccucaggaucaucgacaacagcugcaggucccaaagaggcugaccagagcaauucagggcagguggagcugugaggacguggauguuccuguggcuggaggugcuccugcuagugaaaacugaagagcucuguguuccugagaccuaugccauugacgaauucggguguuuccucaauucuuuacaucuaacgccagauuuuaagccuuaauggaacucgaauagcauccauuauuguuggcaauuuuaccucugcuuuuucuuacuuuaaggaauggauggggguaauuuuguuugcugcugccaucugcugugggcuuguguccaugcucugguuggucugcaagcucagaacccaaaacaaaacaaaaccgugacaaggucguuaucacucaagcacuugcagccauugaacaaggggccuccccugaaauuuggcuauccaugcuuaagaauuaauugacaucugaguuuucugcucuugcgcuccucgguucuguggaaaaugagagagacucaauaauuaaagcucaccuuaggccauacucagcucuugcaccccuagaagcuagacucauugcacagggacgagugaguaggucguugauucuuauggauuguugggauaagcaccgcauaggagucgcucagagguuugggcacuccuagaagacaagucgauuugcaugaggguugaguguccaagugucccuccccuaagaaaaacggcacgggagcaggucaggguugcucuggguaaaagucugugagccuaagaggcaauccuguacauggccccuauuucugcacacuagggauucgaccucuaucuucauccauuaaagaguggauugcauuuuaauaaaauaaaaagggggagauguggggagccgugagcaauugccaucaugagccuccgcugugccuaacugguaaacaaguaaugugcgcaggugcaagagugaauucgugccaagucacugcccaucccgggguguaguagugggguaaugagugagcagcuaaucaggagcugacacgucacauggagggguauauaagcagcaucauuuuccuuguucgggguucuucuuucgccuaugcaaucaaugcucucccaauaaacgugugcagaaggauccuguugcagcgucguucuuccuggccaguugagcacgugcaagacacaaggggugugcuaugguugcauuagcaaugaacacagaagacucucauccccuaggaugaugucauugcagguuucagaggcuggcuguaaccaguuucugaugcuaacaccagccauuuccauuggugcuuugcccuguguacaccaccagcucuaguccuaucagaacaucaaagggcccuguaauuucuagaaguuaaaagcuauuuggcaauuuuuuuuuugcuuugauacauuuuaccuaugccuucaagggucuuacuuaaaaaaaaaaucagccauuaacaucuuuucucaguugaggauauuugcuauaaaaacauugugaguccugccauccucuaaaaacucagaauggugcuucacuugcuguagaaaacuucaucucauuccugcaacagucaacagugacuuugagcaucagcuaaacaacaaauuuauaauagauaaaaguauugauuauuaauuccuugaggacagggucuggggagccagguaacaaaaguaaguguauggguuucauucuacaaugaaaaaugcaaaggcuguccuugaauaaaacucaaauacuguauuauuuguggauauuuucaaucacuuccaugugucugaaugugugcuacaaaucauuuguuuauaugugugaauugauuuauguaucuguauuaagacagaaguaaaguguuuucuucaaucacucuacuauauuauaauuauuaucauuauuaaauuuauguguuugguauuuucccuguauguacucuguguaugacugucauaaaggcaaaaagaaugggcuagacccacuagaacuggagcuacagaaggugaugagaugucacuuaggugcugagaaucuaaccagguccuccaaaucuuucauuuagccuguggucguucauuuauucuggcagacuggcuagugaguuuggagauccacaugucuccaucccauccccccagguuagaaguacagacaugcugugaugccugguuuauuacaugggugcucugaaucaaacucagaucugugagcuugcacagcacacacuuaaggacagugcccuggcuucagaacccuacuuuaaauuugaagauacccugcauuuuaguauguaucuucagcuaaauucuuuuguuacuugucaaucaugugacauggacucccuuauucaguugcaucuguccagaugagauaucuuuucucuggggucugauuucuucuuccagacagagaauucugagaaucuaagguauccugcuggagcugaauuauagucaugagcauaaauuguaugcacauaaacagaaaagccccacccaaaccagacagggagcccaucguacuauaaaagccccagugggaaggucaggccuaggacagacucugaacuuuugcuuuuuuagccucuuauuggucuuuacccugcucuuccuucuuauugcuuucuuuaaggccuuguuuuccauaaguuccuugggucuuaugucuacauguaagaaagcccccccccaacugauucaaauuggccauucaauuaaaauaacaugaugcaauauaucccaucaguggucaguacauaaaugaauaaaagagucuggaacucacacuguugcauucagcagcccaaaugaaucuaggggaaaugaguccccacugaggucuaauccuguuaaaaagucuugaccacaaccacagaaggcauaaaugacuaagaggcacaagcuuaagggaagcuggggucaccaucuuugucuugucuggcgauuggguggaugaagcagagguuaaggaggcaaagggaugaagcagccaggcaggauggcugugugugcuggguacaggauguucacuagcauaucagagacaggaacagauagugauaaguucuggaaacauaagagagcccuguuuaugucacugauugacuucugcaaggauuuuagaauccagaacaagagaaaagaaacugcaagcucacacagcucuuaggcaacaguuguuugcauuuaaucaagaaaccuuaauuugguuuaagcuuuguccaucuucuacuauuuuuuuuuuuuugcuucacaggaucuuugacuucuucucuacucuaucuugcagcauaugagguaagaaacucuacaacugccauucuuaugagguauguccuuucaccaacacauuugccuccuaucauccuauauuuguugauauuuuggauaaaagcuuaaagauaaguaagaaaaaacacauuuaaauuaaaagugccaugucagaaauacauaccaauguguucuuaugaugaguuaaucccagcaggcucuucccccaaaucaggaaugucuauuuuaguugggcuagauccauaucuugauagagacaggcauuguugcaguguagagggggugcugguuuuccuaggacccaaauguugaagggucugcuccaugccugacugauuggaguuuucagggccagcaggcaggagcucaggaaugauucugugugagacccuagcugcuuaucagcagaccugccuuugcuuuuccacacacaacucccuuguuauaguaucuuaaacagacacugagugugacugugcacaugaauacacuuaaggcagagauagagagacuggguuucauagccuccucugagcuaugagccucauuaccccuguagacacuguaugcuuaaggguuuccaugggguagggggaaaggaaguucucacacacaggcagggcugguuauucuggagaauucucuagaauaagcagugacucuacuccuuauauguaaagauuucuaaauuaauaccauucuuuucagguaagaaucaaacauucuucauguuauuauuuuuaagcuaccuauaagacacucauuucauaaucauaagguuagcaucaggaguuaggaaaugggagucaagugcugcagaucagcagagcaugugucuaccuuagacuccuacaaaggaaaaagagagaguccuugguuuguguuaguaaucacacaauacacauuuucuaaaaugcuaagaagaaagaaaaaaugcaaaguaaagaggguauccuagaaaaaggagaaagagacacagacagaaacauagagauggacauauacacagagagacaggcauacacacauagagacagaaagacagaugcaugcacagaggaacacacaaacacucucacacaaaaagugagagaaagacugacagacacacaaagauuaagggacagaaacauagacacccacccacccacacacacaccacacacacacacacacacacacacacacacacacacacacacacacacaaacacacuguauggugaugucucucauuucaauuugggaucacccuguuccccugacucaccugcaaguggagacagcagcaccaggagaaaugcaaacagaagguaauggauccucaugacugaagccuggugaggugcagagaugcagagggacuugagcucagugccuuauauagugccaggugcugccuccuggguagauuucgacacugaauagaacgucaaaauuacaauuaugaaacaagagcaccuuaccucucuugucaaggagugacccuuugagagcacacucaguguuccuuaugcaaaugugaggauccccagaugauuuccuccugcacugcucaacaagaacagcuuccugccuuacaucuuagcuggacccaggcuguccugggacauucuuacugguuacaauuggagcucacuugucuauaacucagacauuugacuuggucaucucagaaucuggcaacaggauuagaccucaguggggacuccccuagauucauuugggcugcugaaugcaauagaaugugacccaacauuccccaagcuuuuccaagucagaacaugagccuagucucauagauuucuccaaguuacugcucaguaauggaauucaguugguacaaaaaaaaaaaaaaaaaaaaaaaaaaaccucuagcaugugaugaacauggagucagauaggugugcuguuuucugucucauaaaaagcaaugaguugguaacagguuaccagaacacaagaccccauuccuaccuagaaggaaccagcaaguagcugguucuagcuaccaggugaugggcaagucuugggacuugcuugccuuugggucugugguucuccaguuucugaaacaauguauguaucagaaguaaggcaucaaguuaccuuuuguauuauaucaugagaauucaugacaaugggacuccaguacuucccaccaccuuccuguuguucuugaugugaccuuuucugagggaggccauguggcccaucucagagugaugucuuuuuuauaguucguuauccagcugcucauuuuuguacucuaaaacaauugacaagaaacagggcauaacacaugccaagagcugagaaaugaggauuuaucuaauggaaaauaaguuaaaugaaucaggauuuuuuuccuuccuacaggaagauuaaacaaauaaccauaugagcagaaaucuaaaaugcauaaacaguuuugacaaaggcuauuguauggcgucuccagcaaagacauuugaggcuggagaaugaagaguuuagacccacacuagaaugccucgcucucacugauaugcugugacaauccaugguauugggcuugguggacauauuuuuaaacuggcauucagaagagauuuaaaagaaaaucagacacaguaaguauucauauuuguggacuauuguauacuaucucaguuuauaaauacaguagucaaggaucaauacaggauaauuaauauaucuaucacuucaaguugaauauuuuuacuauacuaagaguagcuucaaucuugucucauuagcuucagugauacaauagaagccaggcauaauucuauuuaaaaaaaaaaacaaaaagaaaaacaaaaacaaaaacaaaacaccacuaacuucccucuauucuccuuaccccuacuuuucucuguuccuuauuagccuacucugcaauuugaggcuuucuuuuuuuuuccauuuuuauuagguauucagcucauuuacauuuccaaagcuauaccaaaagucccccauacccccccccacuccccuacccacccacucccccuuuuuggcccuggcguuccccuguacugggaugggccucucuuugcagugauggccgacuaggccaucuuuugauacauaugcagcuagagaggcuuucuuaaaagcagcugaugauugauuuauaguaaugguuugcuccaaagagguaauguuacacgucugucugggauugcaggauugccacaugccaucugacccaucuucagccuuuuuuucccucugcaaugccugcauguauuuaaaaaguaugcuuacucaucccaaacacuaagcacagacaaaauguaauguggaaaaaaacuaaacuaaaauaaaauaaaauaaaauaaagaauguggaaagaucauugccugcaaaugcucagccugaauuaauaaacucacucugcauuugcauaauuuucucacuuuccacaguaaaaagcaaauguacucauuuucuaucaauguggccaaacacauuugaaccuugauggaagaaaaguuauuuuuaaucaagccuuagagacucaauccauggugugugggcaccacugcuuuguggucuuucacaagccaugcuaaaaauggcaaggagcauguggugagguaaagucagucaccuucugauaaccaggaagcagaagggaggggucugaucugccaauacccauuucugugcucuguguccaaaccuaacucacuaaaacuagggcgauuugcagaauguccaaccaucuuccagaggagucucaggcuaaccaagacuucagcacuuaucuucuugaggacaguuaggaucucagccaagccagguuaggcagugaauauuuccaguggagugcugcuagguguaugucaacucuucagcucagugguacauuguuauucguguguacccucugcccaguguugccuugaugcauaugugugcuccccaagaguagugggcugcucugugugcaccacagcuccaaugaguguguguguauguguguguguauguguguguauguauguguauguguguauguguauguguguauguguguguguguguauguguguauguguaugcguguauguguguguguguguguguguguguauguguguauguguauggguguauguguguguguguguguguguguguguguauguguguguauguauguguucacccucaggugcaguggugguuuccuaugucuccacaccuugucuuccauggugcucugcuuggugugcacccccagcucuaguucuaugugaaaccaaaagguccugucauuuuuagaagugcaaagcuauuuagcauuuuauugcuuauauccaauuuaccuaugcuuucaaaagucggaccuucaaaaaaaaaaaggccauuaaguucuuuucucaggugaagaaauuuucuacaaaaaccuugauuuccuuccauccucuaaagucccagaaugaugcuucacuuguugcaggaaacuucauuucauuccugcaacagucagcagugacuuugaacgucagcaaaacaacacguuuauaagagauaaagguauggauuauuaacaauaauucuuugagacagggucugaugagcccagcaucaaaaugaaguguauggguuuguagugcaaucaaaaguucaaaugcuauccuugaauaaaacccaaauacuucuuuuauuuuuugauauuuuuaaucacauucauguuugugucuguguguuauacaucauuuguuuuuauguguguuuacauaugugugaagacugaauguaaaguguuuucuucaaucacucuacuuuauuuuuaaauuuauuauuauuauguuugguguuuuucuaguauguacuguauauaggcuugacaugaaggccaaaagaaggugaugaauccucuggaacaggaguuacagaaggugaugacauguuacuuaggugcugggaaucuaaucaguccuccagaucuuucauugagccugugguccugcauuuggucuggcaggcuggcuaaugaguuuggagauccacaugucuccaucccaucccccugugcuaagaggaguacagacaugcugugaucccugguuuguuacaugguugcucucaauacaacucagcuugcacagccacacuuauggauaacgcccuggcuucagacuccuacuuuaaauuuaaauauacacuggauuaugguauguaucuucagccaacauucuuuuguuacaugucaaugauuucacaaacacuucauuuuucaguuccaucuauccaggugagauaucuuucucuggggucacauuucuucuuucagacagagaauugugaaaaucuaagguauccugcuggagcugaauuauacuaaugaguauaaauuguaugcacauaaauagaaaagccccacacaagcaagauagggagcccaucauacuguacaagccccagugggaaggucaggacuaggacagacucugaacuuuugcuuuacuaaccauagccuuguuuauccuuuauccugcucuuccuucuuauuucuuucaauaaguccccuuucccccauaagguccuugugucuuaugucuacauguaagaaagcccccaacuaacucaaguuggccauucuacaugaugcaauauaucccaucaguggucaguacauaaaugaacaugagacucuggaacccacacucaagagcauuuauagccaaagaguauauuaaagucuuaaccaaaaacacagaaggcauaaaugacuaagagacacaagaaaaaguaaagcuggagucucccucuuugccuuucauugggacuggcuggaugaagcaaagaggcuuaggaggcaaagagaugaagaaggcaggcaggauggcugugugugcugacuacaggaaaacauuuagcauaucagagacuggaacaguuauccauaaaguaaagaagcauaagagagcccugcuugugccacuuaaugacuucuacaaguauuuuagaauucagcccaugagaaaacaaacugugagcucacacagcuccaaggcagcccuuguuugcauuuaaucaaguaacuuuaauuugguuuaaguuuuguccaucuucaugguggagcaaauucugguguuuucuuugguucacaggaucuuugucuucuucucuauuauaucuugcagcauuugagggcuaaaagcugaaagauaaguaagaaaaaccacacauuagaauugaaaguggcagguaagaaauacauaccaauguguucuuaugauaaguagaucccagcagacuguucugcccaaacaggaaugucuguauaagcagggcugaauucaauucuugauagaaacagccacuugugcaguguagaggggguguugguuuuccuagacccaaauguugaagggucugcuccaccccugucugauuggaguuuucaggguccauaugccggagcucaggaaagauucugugugagucccuagcugcuucucaguagcccugccuuuacuuuuucacacacaagucccuacuucuaguaugugaaacagacacugagugugacugugcacaugaauguuaaugugugcacacgcauguagaggccagagguuggccuaagauguguuaaucaauuccucucuggcucauuacuuguuuuagcucccucuugugaguggucuaaaccuauuauucuauuugucuaaugucaaguaugaaacacagcuuggagccuggaaaauggcucagccuuuaggagugcauacagcuccugcagaagacuagagauaaguuccuaguaccauaucaggcugcccauaugugccuauaaauaacuccgucucugagagauaagauuuccuuuuaugaccucuguggguaauguacuacuuggcacauacccauacacaaauccauacagauacauauaauuaaaaaaauaaaucuuuuccacgaaauaaacuuuaggaaagguuugggagacugguuuucauagccucccaugagcuuugagccucauuaacccuguagauacugugugcuuaaggguagggggagaggaaguucucaaacacaggcaggguugguuauucugaagagcucucuagaguaagcagagacucuacuccuuauauguaaagguuucuaaauuaauaccuuucuguucagguaagaaugaaacauucuucauguuauuguuuuuaagcugccuauaagacacucauuugauaaucuuaagcuuagcaucaggaguuaggaaauggaagucaagugcuacagaucagcaaagcauguaucuaccuuaggcuccuucaagggaaaaagaaagaguccuugguuuguguuaguaaucacacaauacauauuuucuaaaaugcuuagaagaaagaaagaaaaaugugaaaguaaggaggauauccauaaaaaggagaaugagacacagauagaaacauagagauggacauauacacagagagacaggcauauacacauagagaaaaaagacagaugcauacccagaggaacacacacacacacauaaaaugagagggauacaaacaaacacacaaagauuaagggacauaaagauauacacaugcacacacagacacacacagacacacacacacacacacacacagagagagagagagagagagcaagauagagugagagacagacagacacaaacauagagacacagaaacacaaagacacagagagagaugcaaacauagagaaauauagaaagauacauagagagggagacaccagagacaaacacagagauacacagacacacagacacacacacacacacacacacacacacacacacuguggggagcuaucucucauuucaauuuaggaccacccgacucccccgacucaccugcaaauggagacagcaacaccaggagaaaugagaacagaagguaacggauccucaugacugaagccuggugagguacagagaugcagagggacuugagcucagugccuuauauagugccaggugcugcuuccucgguaggauucuacacugacuugaauccaaggaauuacaauuaugaaacacagagcaccuuaucucucuugucaaggugacauuggagagcacacucagagucucuuaugcaaaugugaggauccccaggugauuuccuccugcacugcucaacaagaacagcuuccugccuuacaucuuacaugagagggacccaggcuguccugggagagacuuacugguuacaauuggagcuuacuugccuauaacucagacauuugacuaggucaucuuagagucuggcaacaagcuuaggccucaguggggaguaauuucacauagaucaauuugggcuuggguacacucagcugcuggaggcaacagaauuugagccaagucaagguuccccaagcuuuuuaggucagaacaugggucucauuucauagauuuccccaaguuacugcucaacagucaaguucauuuacuacaguggagucagguaggugugcuuccucucucagaggaagcaaugaguugguaaugagauaccugaacauggggucccaugcccaccuagaggaaagcagggaauagcugguucuaaccacuguguaaugaacaacuugugggacauacuacccuucuggucugugguucuucacuuucuaagauaaugugaguaucagugaugaggggucaaguugcuuuuuggauucuauccuuagaaucaacaacagugagauucuagucccuuaaaccaucucccuacugcucucacugggaacugucuaaggggugcuguguggcucaucucugagugaagucucuuggaaauucuuuaacccagcuguacaucuuuauccuagaaaacugccgcugacccucuagaucccuuugucuguguggaaggggucucuggggcaggugggcaaagcauuggauggaaugacagacaggugcacacaggagagguuguguagaaucugaacguaguuugucaaaucgagcaucaaacuuuuuauacagaauaaaauagggaaguuggaugauacaccagcaugguacaaagagguuacuggauucuuacacaaaacagaugaauacaaacacagaaggucuaacaggaaccaccugggauagaauucauuguuaacaacugggaucaaaaagagcuccaccuaagguccacuuaaucuuagaagccugggucaagggcuuugugcccuugccauaguuccuacuuuagucuauuguauaauccaccuuuccccuaggccauuguaaauacgugucuauaguucgaaguaucuagucugguuccuccuuaggucucaaacuuccuucuucguagaugaugguaaauuccuguguagggcagugacuuagcuuuuacucaaagugauaguggaguaccagaggcaauucugaaugucacugaauaggcaacauucuuacugaauuccaagcccauggucugcucaaugacuuucuagaauguuggaacacuggugaaggcuuagcuaugucagaauucaaucuuaaaaggcacuuauaauaagauaauacuaaaagagagcaugugaaucuauacaccagucuaacucgggaauaggguauaaguauauggguuaaagagaacgccagacuccaggaggugaguuuccgugaaacucucugccuagugaguugcuuccaggccucucggccugucaagcugacucaaccagaguggguggcagaaaaccauugacaagugucagggcuuaacccaucucgagaacggagaaagaaggauuuuguaagagaaaauaauuuaucuuucucaggaucuuuuauucccuacaggaagaugaaauaaccauaugaacagaaaucuauaauguaugaaccguuucgacaaaggcucuuguauggaagucucagcaaagagauuugaggcuggagaaugaacaguuuggacccacacuagaaugccucacucucacugaugugcugugaaaacccauguuuuugggcuugguggacacuuuuuuuuuuuuuuuaaucagauacuuucuuuauuuacauuuuaguuuccccuucaaaaauucccuaaucuggcauacagaagagauuuuaaaauaaacccagacacauuaagugcacauaucuguggacuucuguguaccaucucaguauaugcauaugguagggaauggucaacuccuuucuuuuccauuuauuuguuuuauuagguauuuucuucauuuacauuucgaaugcuaucccaaaagucccccauacaccccccuacuucccuacccacccacucccacuucuugucccugauguuccccuguacugaggcauauaaaguuugcaagaccaagaggccucucuucccaaugauggcugacuaggccaucuucugcuacauaugcagcuagagacacgagcucuggagguacugguuaggucauauuguuguuccaccuauaggauugcagaucccgucagcuccuuggguacuuucucuagcuccuccacugggggcccuguguuccauccaauagcugacuaugagcauccacuucuguguuugccaggcacaggcauagccucacaagagauaucuauaucaggguccuuucagcaaaaucuugcugguguaugcgaugauguuugcguuuggaggcugcuccuaccuggagcuguccgagcugcagaggugagcccugguuugcaagcacuaguacaacauuacaucggaaccccauu

SEQ ID NO: 4323 - RNA, 502 nt, Mus musculus
auagcucuaauuggccauguuuaauucauaguuuugaaaacauugcagauugugaacaguaaauuauacaggacacaaaaugaagacugaccaucuuugaccauaaugggggggggggagauauaacuaaaaaaaaccaccuacacaacagauagcacccuccuucuucacucguuugauggguugaauuggccaagaaaacuuuacugagcacacacugugcaccaagaguuggacugagcagcagaucgggaagagcaauacagaccacagacauccauggacauaagcugggggcuagucuguugaagaaaaaagauucaaagccguuaaauauuuaauacauacaugcagguuauacuuagugugaguuugucuauguucccauccagguacugaccagacccaauccugcuuggcuucugugcuguguucaggaugcacugggugugcuaaggagggaauggacguggacaagugcauccauuuucaggaaaccgcu

SEQ ID NO: 4324 - RNA, 18927 nt, Mus musculus
aauauauauauaaaagauuuauuuauuuguuuauuuuauguauaggaguauacugucugucacucucuucagagacaccagaagagggcaucaaucagauuuuauugcagaugguugugagccaccaugugguuugcuggguauugaacucaggaccucugcaagagcagucacugcucuuaaccacugagccaucucuucagcccaaagcuguuauguucuuaacaagguaacauauuaggcugaauguaaaggagucugggacagggagauggcuccaucaauaaggugcuugcuaugcaagucuaaggacgugagcucagaucccagcacccacauaaucccaacucggagguggacauagauggauccuugaggcucacacugcucagauaaucaagcccaaucagugagcuccaggcuuagugcaagaccccgugccaaaaagaaacaaaaaggggaaagaaauaugacacccaaugucaaccuccaacaagugggcuucuccagggcagaagagcucaguggaugagagcagcaggcccagggcuuccuuaacugcaggaucuucccccugguggcccaggcuaccuccaucuacuuuuggagugacugaguccagaucucacaggcaacucgaugagugacagcucucugagaacuccagaaacuccaauaaaggcucucuccuuccuuguuuguuuuguuuuguuuuuguuuuuguuuuuauucagucugggaugccagcccauaagcuggugcugcccguauauaagaugggccuuucuccuuagugagagcucucuggaaacccucucacagucacauccagagguuugucuucuaggugacuccaaaucuagucaaguugccagugaagaggaaccaucacagagcucugggggcaggcuuugccacuggacagaugaggacuagaguuggggggggggcgaggggcuaggagaggacuuuccaaugggaaugggaaucagauagacuaggugaaagguguugcauuugggcugagcauuaaaggguugggaggccuuggcuggcacagugaggaaggaaaaucaucccagaagcaaaggacggcuugggcaaaggcucagaggcaggaagcauguauggcuauccugggcugaucuacuguguuuagcaaggccaggcagacauauccaggaaggagcuuaguuggagcuaggcacaaguacaugaagcaauacuuggugcuguaauagauuagaucuaacccacacucucaaggccauccuaucugagagaaguuauaaagccuaggacacagagucacacaguaggacuuguacuaggagccucagaauagcuucuguuaucagaagcaucauaugaagaaaaggaaaauuuuggagcagccaaaucugacugcagagagacuauggggagguuugcugccaccaggcaacuucuccgaaggagaucugcucccuguucuucagcgacacuaagcucaggcaggaguaccaaguagucagcccacacuggcaaaaacaagacaaaacaaaagggcaucaagagccaggcaugacuaguguaaacccugugaagucaguaucugagagacugaggcaguaagaucaugaguuugugcccagccugcugggcuauuuggggggaaaggaggaggagaaaguggaggaggaggaggaggaggaggaggaggaggaggaggaagauggaaggaagggauggaaagaggggaggaggggaggggaggggaggggaggggaagggaagggaagggaagggaagggaagugagacaagaccaaggcggguaagacaagcuaguaguaaugauggucauacaagauacagcugaucacuuggcucccaggcaaggcagcagugggcuaggaggggcugggaggaaugcugggagccccacuccugagugcacguaggcagaguggggcgugggacucacuccuggagacucuguggggcauacagucccuggggacccugaagauccucccucagugucccaccccucauucccaugcuugcacaacuccaagaccucacugagggagaacuccaccugugcuccacaccaggccaagcacauccgggagacacaccuggcuaggagaagaaagaggagccagggggugagcuagugaauccuaaagcugguacagaggaagcggggucagagagaagaucaagggagcucugcaaacaagauuaagaucugaaugcaggaacuggaaaagcaugggcagaccccagaagguggagcucccaugccuuuaugcccagcaccugaaagaguaguaaacucagugcuccaagguaugcuaaucauaaaacagauagagacauuccuccacccacaagcuuccuggguucaaggaguguacauucaaagaaagucacccugacccacccugaucauugcuggaaccugcaaugcaaauguacuaucguuaggggcucuuagaaacugucuugagaguuaacaauuaccagguauuccuagugacgccugugacuuuguacuaccuugugacucuuaacugguauuuuugguauuuuccaacaaugcccuucccacauccuuaagucgugguuucuuccuuuaaauacccccuaauccagcuacuuggggcgccaugguccucuaccccugcuugguguaugaccaugggcccgagagcgcucuugaauaaaaaaauccucuugcaauuugcagcaagaccguuucuugugguugauuuuggggugucgccucucuugagucagaacgugggggaguccucacguugugggucuuucacaccaacacugaugaaaccaaaggcauccccuuccugcccuaacauugagugcccacacggugggaaacuuuuauuaacagagaauuacugugacccggaagaguuccacugacacaaggccuaagggcaggaaagccuggcggguaagaagcuucccugagagugaggaaggccuguuucggaauugguauugugcuaacagcaagcucucaaaacucaggcagugucuaauuccuagcuaugguuuccugucuguguagcaaggcuaacaacaacuaaccacaggcuugucucagggggcuaaaugaggagcucuaggcggcggcagcagcagcagcagcagcaacauaguguuucauagucuguuuugauuucaaacaguucuaugccggcuccaucaaugauauuguaugugacuaagccauuuucuccaaugucugggucuucagccuucacccuuccuacuuccucccccagggacagcugcuucugaaacagacaucugguacacgccugaaagaaaaagacaucuacuuuuauuuuacuuuuuauuugggagcuguaagacuucagauuucauugaaucccagcaaauuucucaaaggguuuaaaaucgaacuuuuuauugguagacacagaagugaaguggauggaugggaagaggaucccagauggccagcaugcaggagcaauguguuccuuccagcaugacaaaacaacauugggguccugguaagaugaugaggucacccacaacacgagagaaaggaaaacagugacaagguccuaugcaagaguccacauacuggaacaccugaggcuuccuuuucagggugucccacaaacuaaugccaaagauuccuugaacuaauugcucaaagaaaagcagccacagaagaguaaauuuacccccugcuuaaaaagguuucaucacuucauauuuauuuuagagacaaauacaaaucuuucaagaaucuuucuugagcaaagagauauuucucucaucuuacucuucauccuuuguacuagguaaagcauggaaugcucuggaagcuuuuagacagucaacucccuuuauauuuauauuuuucagaaauaaagaauggugccacaccuauuuauauuuauguuuacaguauuuauuucucaugaaugcaaaugaugauauauuacucuuuuagcucugaagcuaaguaaaggaagaguuaucauucucaacaugacauuuaaaaaaaagagaaaacaaaacauaucuagauacacuaugauguuauaggcuaaguaguauuguaugguaagggauaaagggaaguaggguguguguguguguaagcguuuaagcuacacaaaugaguguguaguuauguaugugauuaugcucuauacgaguuagugugauauguuuuaugcucuauacgagugggguaugauauguuuuucuaugacaauguaugugaguggacaccuaucaugguuaaguauguguagaugagaaggaaaucgggauuuauuuuggacaagguagagacagaaaacuuucguuggaagaaaucugaacuccagugaaggaaaugagcaagacaaguguaugaauaugugggcaauaagugucacagaacaaggaacaaugaaugucagaaagccucaggugaggcugcaaauucugaagauucugaaaauguacagugggacuucuguuacgggagaauaacaguaggacggaggcauguaaacggcauugcugaaaauagucaagauguugaguuccauuuagggaaagcacuagacaguuuucaguaaaggaaugagcuguagcaccaucauuugacacauuugaaaagcaaccugucuaagacacacuaugcgugggcggaggaacccucuccugcagugcucagcccacuggcauuaggggacuccccuagacucuuccuuuccucuacugcagcuauuauaugcugcagugcugcauucuuuucgugauuauacuguacccauuuucuaccuaaucuuguauuguauucacaggcaaggcacagggagugugacuuucuguagaaaugaacaauguauaacaauguucagaagaucuguugcaauguaauuuucuccaaaucucauucaagcccaugacugugaaauauuaaaacugaaauauaaaauuucuauaccacucuauauaaaaaagggcauuaguggacauccaugaauaagucugucugccuacuuuucuggcauauggaacaauuguacauugugcaaauggaauaggcagcuuugacuauguuguaugugccucaauauuaucaaagaugcauaccuuuccaucugacaaggaauagcaugguugacccaucucuuuuggaguccucaagaacuaauaugugucucaugauccucuaccaugauaucuucauuugguagauuguuaucuuggguaacuuugaauaaccauagugccuccuuaauugguauacuuaacugacuuccuuuggguuuauuauuuuuuauauugugugugugugucugucugucugucugucugucugucuuugaguguacgcuaugugucugucugucugucugucugucugucugucuuugaguguacacuauguguaugugggugucugcagagaccagaaagugugucagacugucuguaacuggagccauggguguuuuugucauuacuggaaagcucagagucauuauuuuuguguuauaacucuggacugcccuuugcacauacacacuaaaauaugauuccagaaauuccuuaguccccucaauguccuuucccuaggagccaauuauaucuauaaaacauaggcucuuuuuagauauuuauaacauuagugaccagauauuaaaauuagcagcuaucauuaauuucaauauuucaauaccauugucuccaaagaguuguuuuguuuggugcuagagugauggcucagaacuaagaccguauguuucucuuccugcugaccagaguuugguuauucccacccaagucagcucacagucacacauaauuacagcugcagggaaaucugacaguccuggccucugugggucccuacagauaggaaacauccacauauagacacacucauaaacacauaauuaaaauaguaaaccuaaacauuuuaaugauguaucuuacuuuuagguaugcauaugccugugucuauguggcucugugacugcgaaugcagauacaacggagaccauaagaaggcuacagguccuccuggcccaaauuucagcuguucagagccaauaauauuguugcuaagaaccuaaccauggauuucugcaaaagaauuauauacccucaacugccaaauaauauuuucccucaguaacuucauaaauauuguacaguauucaaaauaacaauggcugaacaauuauugccgguuuuuuuuuuuaaaugauauaaaaauuagcacuagcuggauuaaucugaacaaagauuguauuuagguuaaaugcuaggguaucaucuucuacaaggauacuaguauagcucguaucccacaggccccuccaauguuacuuuaugguccucucauagaacugugaggucuggcugagcuuuacugcuaugcuggcagccuuaaggcuacagggaaagaagucccauggcuucugguaucagcucaaaagauggucacggaguucucaugaucagaacucagccacagaaaggcccauguggagaggaagcacaagcuaaucucaauuugccaggcuuauaaggaaucuuagaaguggguuuuucugccacaggagaacugcccugcugaugcuggagugacaacagaguagcuauuucuccuaugcucugcacaaauuaaagucaagaaacuaauaagugauuguuacuugcaaucaucaagauguggggggggggguuuauggaaugaugagcaucagaucacgguucuguuagcaucagugaagaacacugagacaggagaacguuaauugaugacugccuuuuaugauuaauaccuaauaaguaaaauaucucaagacucagauauucuggucuccagaguuacacaguuuuuaaugacuuccuuacuucucaugaucucuacacuguuuaacuuuccucgguguguuuuuaagucuuugcuaucauguucuaguuuuuugcaagaaucacgaaaaugauucuuggauuuccagacucuuccuuuugaaagcuggguaaauuaggagugaaugaaaagaugaggcucucgcugagcaguggucauuaucaaagaccagcuucgacuccuuacucuguggaaacuuugcugaguugucguugacaucagucagagugaucgucacuuugguuguccccgagaguccacccauguguccacccauguccuuagccuggaucaccacaugguacuccuccuuggcuucucuguccauauugggaagggcuguccugaugauuccuaucaaacgaaaauuuaaaaaucacaaauauucauuuaugacaagauuuaaaaaaauauguuacauccugggaaccuaaagauacauaaaauauagccugcucaaagacaagucauuuuaacauggcaaacauagcagaaaguguugaagauaacaccuguguauuaucaagcaaauaauaaaaauuacuuacaacauauuaguuuuauuucacucugcaugcaaguaacaaugucuuuccucucagacacaagaauccugaagacuggaaugacaagagccuaucuauuguaugauaagucauaucugaaucuauacuucaggacuucuagcaaaaagcuucagaaaucaaguccuacauaaacuaguagaaacaucacuaugggguuggagagauggcucagcaguuaagagcacugacuguucugccagagguccuggguucaauucccagcaaccacaugguggcucacaaucaucuguagugggauccgaugcacucgucuagugugugucugaagacagcugcaguguacucauaaaaauaaaaacuaaaaaaaucuuuuuuaaaaaaaagaaaagaaacaucucuucagcucauauuagguuuacagaggaggcauaaacuuuuuugaacacauuaaauagguacuauuaauuuuuugagugagugaacagaggaguuagaaauaugaacaaaacuugugcaaagauucaguggacaaucacacguccugaauuacugaaaaacaggauaaauucaggauugaaauauucaugaccuguguauauuuaaacaugauguucguaaaaauaugcuuacuuacaucucuagggaucuuauggaagcuuuuacacucagugaauaaagcaguauuuauaguguaaauacaaagagcaaggaagaagugcugggcuauguuacgcagcaucacugagcccaguguuaagguguuucuuugcaacauccuaggacuuaugagacaucauguuccuuauugauuaguuucauggguuccaacuguuagucacuagccuugguucccugagagaaaaaaagaagacuagaguuuuuacuauuuuaaguagucuagaugaaaucccacauuuauccuuaguuuacccaaagacuaaaagcaaagaucuccaugaaaccauagacaauaacuccacaagcuguuguuugaaguaagaauaugaaaaaugaauuaauauauaaguagguaagaguuaagaaagcaaauaaaaaaauaauaaauuaggaauucauguaaaaguugcaaauuguaugaaaaccuuucaagaguacagaacauauuacguaggaaggaaaaguguaauacugcugcagaagaacaauguuauaggacuguaguguucacucuuguugacaaucaaauuaguguaaaugaagcgaaacauuguuuuaguuucuguuguauacugacucacuuuacuggucugcucuuuaucuuacagcauccuuugggaaccuaugcucacagcaggagauugggaaugugcuggaucuucuaguagggugaacauuuacaguuacuccugacacuucuuaguuuacccaguggucuuccaaggauguuuuaaaggcuaacacuacuuuguaacaaccuucgauccuuuuaauauggauccacaagucaaggcauuuccaauucauaaauuuaauuuuaaauauuuguaauuaucaucuuagacacuaauaaauguguauuauuccauucauccauaugcacagaacauacauaggccaucucguacuaacugccaaguggcccuuuaguuccguuuuaauuuaaggaauuuuaaagccaaagcaguuaaaugaugaggcauagacuccucguuuaaaauaagucgugacuuacaaagaugauguaaucgaccauaccuguuugggccuccaccgagaaguaggguuguccuucaaggaugcuauacacuaacuuggcacuuuuuccauaggugggauuaucugcaucagaggcugucacuuggauaacugauguuccugaauaaaggggggucagggggagcaauuagcaacauccaauaaacuuugcaaauuucauugcuguuuacagaauuucauuuaaaaugaagaccuguaaggaagcucacaaugacucugcaugaucuuauuguccuauaguucaagugcagaccacuccucucccugccaaucuucccucucuaguuuccuucuucuauuucuuuuuuaucagcaaggucaaacuaagguuuaaaaggaaacuuucuacuuucacaguucuuccugguugguuugcuauuuaaaauaauaugaacauucuugucaaauacuccuagaaccaugugaauucacuguuuaguauaucacauaaucaaauaaaaaucucuccugagagugcaauaaaugguaauuaaugaagaauggcuuuucaugaaaggagagagggcacuuucccaucugugacaaugaacaaaucauuucacuguugcuuugcaugcaagaaaauuacuucugauacuaaauuuuaauuaauuuguggcuauaaauauucuauagaaugcuguuccccaaugucaugaaaauuacacguuucccucucuguagguagggucuguauccacgucacagaaacgaucagugagggaucaauacgaucuaagacauuccuaugucagaagacaugaaaaucaggggauuaaggaaugggaggaccuuuuuuuccuuuacaagcucuacugucacaauaagcaucugagacaugccauguugagcuucaacagagagggaaggagggaagaggcaauuauccaggaugccucugucaggcacugucugagguaaauuccagguaaagugccuccauucucugcuggacauuuuggcaucuguuuuacuuugggaagauuugggaugagaaauauaacaucuuaaaaucccuuuuucauguuguuucuugucacagcugggaaucugucuugcagggacaucuagcaagaauaaagcccaaguuuccccuuugacauuucagcagaauggugggagggagguccuccuggcaggguacagaaccuguuuacacaacuuacagguagcuauccuuuacuuccgagggguuucugugacuucuaugagaaacgcaagacaauguucacucuuuuucaaaaucaauuuucuauacccauugucuuuugugaaugucuuccuacaaaguagggauuauucuagaaaauggguguuauaccagagaaagacuucauggaaugcuaagaaaguuauaaaucuuuauaauuuaauggaauucuauuuuuuaagaauuuuuuaaaauucuaaaacaaaaauucuaauauugaaggaguuaucaaauauuucuauuugaucuguauauccagaacucauuaguaacuauuaucuugauuucauaguugacgaaaugauaaauuaggaagggauacaaaggagcacugguucacacagcuuucugaugacaaagacaauaauuucauauguagaguagaaagucugagaacugccauaggcuccaaaguguccugcaaggagcaaaaguccaccuggauuaucaguuuggaugacuagcuuccucugcuucuuccauccuuucuucucauuagaauucacaucugaggacaguguagucaagggaccagacaagaauaaguaaaaggaaggaaggagacaaugacucagccuggcuuuuucucaguaaaagaagaucuuaugggauggauccccagguggggcagucucugaaugguccuuccuucagucucaguucugaacucugucucuguaacuccuuccauggauauuuuguucccccuucuaagaaggaacuaaguauccacacuucuucuucuugaguuuuaugauuucugcaaaauuguauauuggguauucuaaacuauugcaacaagauuuugcugacaggacccugauauagcagucuccugugaggcuaugucagugccugguaaauacagaaguggaugcucacagucaucuauuggauggaacacaggguccccaaugaaggagcuagagaaaguaccuaagaagcugaaggagucugcagcccuauaggagaaacaacaauaugaacuaaccaguacccuccagagcucgugucucuaguggcauacguagcagaggauggccuaaucggccaucaguaguaggagagguccuugaucuugcgaagauucuaggccccaguauaggggaaugccagggccaggaagugggaguaggagaguuggggagcaggaagaguuguagucacauaugcauauauauauauauauauauauauauauauauauauggggggguaugcauauauacauauaugcauauagauaaauagauagagauagagaaggaggaggguauagaggauuuuugggaggaaacgagaagaaaacaucuaauaaaaaauaaaucuaaaaaaaaaagaucaucuuaguagacaucuuagggcaauggcagcucugucacaggaggcuccacacacagacugaagucucucagagcccuaaagucacagcugacugucuugaguaagcuaaucuuuauaaucggugcuugguuuuucucuaacugguaaaaugaacaaucuaucccugauggcuucacuuggggccaaugaaucagauuuacucaaaagaccacauucuagaaauucaagcagaaaugauaccaagaggcauguguuagaguuccaucuucaagcaaagcagcaugucuuuaagcauauuugaaaucagcugauggcagccuuauauguauugugggugaauuuaguaacacaaauucguucaucuguuucugcuucgguuucucauuuauccaagaccaacuggaaugacugcuuugcaaaguuuaaucauggggagguuaaacacacugggguguguucgccaucaauuaaugugaaguccaaagcagcaaacauuaucauugcuguuacuuauucaacaucaaugcccuagugauuggaugaauauaaucauuacucuuugaagacuggaaauuguuauugcucuucuacagaggaagagcaaauauuaaauggugucacuucacacagcugaacauaagucaggauuugcuaaacugaaucucauucuucccccuuccagacuuccuaguuaauaggaaguuaauagucgacuuuagagccucaagucuaauauaaacauuugaaaacccgagucucuauaucuguuaugcacuuuuccuuggagucccuuccuuucuguuuguuucuuuuguucaauguguuaggguuuucuuuuuuuuaaucuuauauauucuuuucucacuaucuuuuaggagucugauuguuuacuauggagacugaaaagaaagggugcaucuggauggcaggggauguguggaguaacugggagggguggaaagagcagaagccauaaucaugauauuuugugcgaggaaaaaaaacgauuuuaauuuuuaagaauccaacaaggcauuuuuuuccuuguuaaugugcaauaaugauugaacacaagcucugcuuccuggguugaagggcaggcaccagccugucaaccugcagacauaccagauagaaagagaauaggugaccauuacuuaccuacccacaucggaccucucaggcacauugguaugauagauuucaugcagaaacucuggaggguugucauuaauguccuggaccuuaucaaugaauucuuaagguggcuccagugguuuguuggugucccuguccaccgccugagccaucaguguguacugggcucucuccucucucaguccaaugucuugguggcaugaauguucccugauuugucaucaaucacaaaaaagguucccgcuccuucuccugagagaauguauuuaauguucccaucaccggagucaaugucagaaugaagcuagaaaacaaaaaagaaaagaaagaaagaauguaggauuuguaauuucaugaggaauacaauaaaaacacauaggcugauaguuacacuacguacacaugugugcacauacauacagucacacacauaucaugagacgaagugauuuccaucaccauuuucugaauagagaaauggagucuuagauaacugcuaugacccuggguaaugaugaggcugauggauuugcaaauguuuaauucucagguucauguucucccucucuuauucucucuuugacuguauauaugcauacauacaaaauagaugcaugcacauaugcuucaguaguuauuugggaagaaaugcacauagauauuucaaaaagauauaagcaugaauuuaugcucauauuucucucaguguuuauucccauuucaucacugcuucagcuaugaaucaccuuuuuaccaguuucuuaugacuccuuuaugagauaauaauucaagccuauacauauacaaacuuauuuccacagauucuuaaaagcucuuugcuaauuuuacauaaucagggcuauaaauuguauauuauaaauuguagauuccuguaacugugacuucugcagcuccaucaacaucuagguacaaagggcuuccuuauucaccaugugauauccucuucaaaggacacuuauauuuguuacuacaaauacaaguccaggcauuuguuauuacaaauccuucaacuaaucagauuuuucuagauccacugucuaguguccagaguguaaugucuggagcuauuaucuucuugggagaagaaucuccuaugacccuaugaucauaguggacaguggggcaaagugauagacauguuguccccagacccuugaaagaacuuccaauauccuugggauuuucauguuuuccagaaagccuuuagacaagaugauuuuugccuaaaucuguauugauggagucaagaaucuacuauggucuuuuagcugccaauucgaccagcagcucugcccgaacucugcucuguguuucagagcccacgcccaucaaagacuucauugauuuuccugcagcuauaaagccuaugcacucacuuauuguccucaugauuucggauuccuuaaccuccuuuauauuaauguuacuuuaauuguuauaugaaauuguuacaugguuugaacuaauuuccauauuuuaauaugugaaugcuauuagaugaguuauuuucauugccuucuaguauugaaaauuagcuagauuuaaaaacacuaaucgauuaaaccuguuguguauagaaauucagaaaaauaaaauaaauaaguaaacaaaaacuuauauucaagcauuuacuacaauaaagauuguaacuaauuuuuauuuaauauuaaugacuaauaauuuauaauuucuaucauuauuauaaaaccaaggccuacacaguuugcucgagguucacaaagaaaaacugaauauacuacuuuuuaaaaugguuccaucauuuaaauuuccuaaauauguuuaauuauuuguagaguuuuggugaaacaccaaaaaguucagcuccgacauggauacacaggcauaaucuacaaccauuuugguuguguaucccagggcuucuagggcaaggacaguaggaaaacauuugcuucugaaagguaagaaaauauaauccaccguuuuaaugcaauaugacugauguaauucuuaagaguuuggccauucguggagggaaauaugaaguuacuugauggauuucagugaacuaauagaauauccacaauguucacaguuuccuuaguggccuguguuccccucuccuauccagccuaggauugugguguuuguucuuucucugugcuucauggguaucaaauguuagagguuaagucccgggggcuggugagauggcuuagcggguaagagcacugacugcccuucugaacguccugaguucaauucccagcaaccacauggugguuuacugcuaccucuaaugagaucugacacccucuucuggugugucuguagacagcuacaguguacuuacauauaauaaauaaauauaucauuaaaaaaaaagaaauguacuggagcacauaaucuuugcaagaccaagggccucuccucccucuccucccauugauggccuacuaggacauccucugcuacauaugcaaauagagacacaagaucuagggguuacugguuaguucauauuguuguuguuccuauaggguugcagacccuuuuagcuccuuggguacuuucucuagcuccuuuauuggggcccuguguuccauccaauagaugacugcgagcacccacuucuguauuugccaggcacuggcauagccucacaagaugccacggccaggaagcaggaguggguggguuggggagcagggcauggggaggguauaggggacauucgggauagcauuugaaauguaaaugaagaaaauaucuaauagaaauaaaugcuaauuuuucauaaaaaaagaaaugauauaaauaugaaugucaagguacugaaaguuucuaaggaacuucaugcauuacacaugaaaacauaaagaggcauuucauagaggcaggcagauuucugaguucuaggcaagccuggucuacagaguacucacccaggacagccagggcuauacagagaaacccugucucgaaaaaacaaacaaacaaacaaacaaaaaacaaaacaaauaaaacaaaaaagaggcauuucauaacuagccauggagcugaaauuuuuaccaagcauccagcuuaucccauuuccacuuuguuucuccucccuccaagauuuaaaaguuggguaugucuucccuaguuuuccucugucacaaagaugaucuacuguacugacaauacuauuuauuagguucuacaggaaagcaguuugggaacacagcaagugcuaucaaggggccaguuccugacuccaaagacugauugcuucucgcuuugcacagcacaacaugacacaggcugaacguccuacaugcaaacucuaagucuucugugcuuugccaaauucuaccuuuucagggaauuuucaagcauucaaccuugaacgucaccauucagacuguuagugaacaagccaacuauuccuccuacuuagcuccauuucaaaaggaagauuuugccagaucuuagcaggcacauauggacacacacacacacaugcagaggcacgcgggcgcgcgcgcacacacacacacacacacacacaccccauccaacuaagaguccuuucacgaaccuuacuuuucaaggucauacaugggaugaugccagauuuucccuuccucucuuuauuccucgucuucucccgagugcaucauaugacauuuguuauauccagagacacaaagucaucugacucacuaagcccucuaccccugccaccaccaagccuaaacacacucugucccccacugagacagugacaaagcagagggucauuuucucagagcaauuugauacccagcucuacacauugcuugagcuaaguugcccugcuuuacuguggcugucuuuuuccucuuccuuucuguggacacagcacagcucuuugguuacaggauucugcuggucaauuauuuuccccuacuuccauguuaucaagacuacgucuacaucuuuuucacaugaaugaaauuauuuagaacauuauuucuaaaaccacuuauuuccaauucuaaguuauguugagauuaucaugaacauuuuugagcauaaaaaauaaacgauauaaaaaauggacuguuguuucauauaaaaacaacgacaaagguaacuuguuggcauccuugggguucaaaacuaggaaucucuaucaucuguccuugcauuucucuauauugaaucaguucuguuuaacuucaaugucagggguuauuagauacuugccucuauuuuucauaaggguuaaggacauaaacugaauuucauuacccuccucauuauauuuuaucuucuuccuuaaaugaauaaguggcugccucuuuuucuugcuuguuuggagucagguauugcuucaaccugauuuacugucugucuaccacuuccacauaauagagcuucaauuuguacauauuaaaauaacuaucuccugugaacuagugucaauauuaccuaaaagacugucucuuguuuuaucauaauaaguaguaagaagucaguuugccaaauguguuuugcccucucuacauuuauauuuccaauggaguugaauaagcagugcauaaccuuagaagaggaaauauagcaaaaacauaccuaaagacaaaauggauaauaucauuccuauccuaaagacacauauucacucauuucauuggaguugguauuagugccaagaccugaggauucaaggcuaaucuaauuccucauacaaaguaaaacgaaaugaagugacagaggcagacauguaaaacagcaaaguaggaugaaagggauuggugagacaugggaauauaaaagucggaacaggcaaguugggguuagaauauagucugagaaauuccuccaguugaagaaugguucaauaaauuaaggcaguauuucuuuuaauagacucuaaagcaauccaaagucaaaauggaguccuuauccuauaauaagugaacauuagaagcauucucagugugguuuggucuaugaaugaggaggagaagacuggauguguauacacauaauaugauucucuuuuuaaugauagaucauucuuguucucuuuuucuguuucauuguuuuaguuuuacuuaucuugcuuucgccuauucauuaguuugccuacuguuguucugucuuguuuuguuuguuuguuuguuuguucauuuguuuguuuuguuuugaccuggucauguccuucugcacugauaaugaguacauauagacacaucaacaucaaauauaagcagccuuacccugcccaccagcacagggucgggcccaguguacucgucuaucacaaagaacugauuccagacccaaccucucuuggagcguugcagcaucugccccuccuugcccuucucaugguguccauggaaagagggaugcagguggcuucauugcuccagggcaaacauaccaggcauaccagggcagcuuguaaacaguaguucuccuucauuuuugguuaugcaguaggcacaggagagugcagcugucacuuccuacaccaacagaguggcuuucuuuuggauggcagccucccagauguaucaaguagaccuccucuggaauggaauaucuucacucacugaggacaucacaccaggguuguucaccucuucagucagcuucugcaagcagagaaagagaugagauuagcugcagccuccaaccaccuauuguuucguuuucauuuagcaaacaugugguuugaguaucaguuuaccacuugucagcuuugggaaagcugacagcuuucucugaacccagcuugcucauuucagaaauguagauaagaauaauauucguugaaagguugcugcaaugaucaagagaaaugggaauauaaagccacuaauacaaugucuagaacccagaaacucucuauuauucauugaucauaugugugcauccacagcaaggaugccagaggccagcacaguaaagagaggaugcuuaaaggauauggugccugaauugaauacuaaagcaaaa

SEQ ID NO: 4325 - RNA, 4028 nt, Mus musculus
agggagcucugcaaacaagauuaagaucugaaugcaggaacuggaaaagcaugggcagaccccagaagguggagcucccaugccuuuaugcccagcaccugaaagaguaguaaacucagugcuccaagguaugcuaaucauaaaacagauagagacauuccuccacccacaagcuuccuggguucaaggaguguacauucaaagaaagucacccugacccacccugaucauugcuggaaccugcaaugcaaauguacuaucguuaggggcucuuagaaacugucuugagaguuaacaauuaccagguauuccuagugacgccugugacuuuguacuaccuugugacucuuaacugguauuuuugguauuuuccaacaaugcccuucccacauccuuaagucgugguuucuuccuuuaaauacccccuaauccagcuacuuggggcgccaugguccucuaccccugcuugguguaugaccaugggcccgagagcgcucuugaauaaaaaaauccucuugcaauuugcagcaagaccguuucuugugguugauuuuggggugucgccucucuugagucagaacgugggggaguccucacguugugggucuuucacaccaacacugaugaaaccaaaggcauccccuuccugcccuaacauugagugcccacacggugggaaacuuuuauuaacagagaauuacugugacccggaagaguuccacugacacaaggccuaagggcaggaaagccuggcggguaagaagcuucccugagagugaggaaggccuguuucggaauugguauugugcuaacagcaagcucucaaaacucaggcagugucuaauuccuagcuaugguuuccugucuguguagcaaggcuaacaacaacuaaccacaggcuugucucagggggcuaaaugaggagcucuaggcggcggcagcagcagcagcagcagcaacauaguguuucauagucuguuuugauuucaaacaguucuaugccggcuccaucaaugauauuguaugugacuaagccauuuucuccaaugucugggucuucagccuucacccuuccuacuuccucccccagggacagcugcuucugaaacagacaucugguacacgccugaaagaaaaagacaucuacuuuuauuuuacuuuuuauuugggagcuguaagacuucagauuucauugaaucccagcaaauuucucaaaggguuuaaaaucgaacuuuuuauugguagacacagaagugaaguggauggaugggaagaggaucccagauggccagcaugcaggagcaauguguuccuuccagcaugacaaaacaacauugggguccugguaagaugaugaggucacccacaacacgagagaaaggaaaacagugacaagguccuaugcaagaguccacauacuggaacaccugaggcuuccuuuucagggugucccacaaacuaaugccaaagauuccuugaacuaauugcucaaagaaaagcagccacagaagaguaaauuuacccccugcuuaaaaagguuucaucacuucauauuuauuuuagagacaaauacaaaucuuucaagaaucuuucuugagcaaagagauauuucucucaucuuacucuucauccuuuguacuagguaaagcauggaaugcucuggaagcuuuuagacagucaacucccuuuauauuuauauuuuucagaaauaaagaauggugccacaccuauuuauauuuauguuuacaguauuuauuucucaugaaugcaaaugaugauauauuacucuuuuagcucugaagcuaaguaaaggaagaguuaucauucucaacaugacauuuaaaaaaaagagaaaacaaaacauaucuagauacacuaugauguuauaggcuaaguaguauuguaugguaagggauaaagggaaguaggguguguguguguguaagcguuuaagcuacacaaaugaguguguaguuauguaugugauuaugcucuauacgaguuagugugauauguuuuaugcucuauacgagugggguaugauauguuuuucuaugacaauguaugugaguggacaccuaucaugguuaaguauguguagaugagaaggaaaucgggauuuauuuuggacaagguagagacagaaaacuuucguuggaagaaaucugaacuccagugaaggaaaugagcaagacaaguguaugaauaugugggcaauaagugucacagaacaaggaacaaugaaugucagaaagccucaggugaggcugcaaauucugaagauucugaaaauguacagugggacuucuguuacgggagaauaacaguaggacggaggcauguaaacggcauugcugaaaauagucaagauguugaguuccauuuagggaaagcacuagacaguuuucaguaaaggaaugagcuguagcaccaucauuugacacauuugaaaagcaaccugucuaagacacacuaugcgugggcggaggaacccucuccugcagugcucagcccacuggcauuaggggacuccccuagacucuuccuuuccucuacugcagcuauuauaugcugcagugcugcauucuuuucgugauuauacuguacccauuuucuaccuaaucuuguauuguauucacaggcaaggcacagggagugugacuuucuguagaaaugaacaauguauaacaauguucagaagaucuguugcaauguaauuuucuccaaaucucauucaagcccaugacugugaaauauuaaaacugaaauauaaaauuucuauaccacucuauauaaaaaagggcauuaguggacauccaugaauaagucugucugccuacuuuucuggcauauggaacaauuguacauugugcaaauggaauaggcagcuuugacuauguuguaugugccucaauauuaucaaagaugcauaccuuuccaucugacaaggaauagcaugguugacccaucucuuuuggaguccucaagaacuaauaugugucucaugauccucuaccaugauaucuucauuugguagauuguuaucuuggguaacuuugaauaaccauagugccuccuuaauugguauacuuaacugacuuccuuuggguuuauuauuuuuuauauugugugugugugucugucugucugucugucugucugucuuugaguguacgcuaugugucugucugucugucugucugucugucugucuuugaguguacacuauguguaugugggugucugcagagaccagaaagugugucagacugucuguaacuggagccauggguguuuuugucauuacuggaaagcucagagucauuauuuuuguguuauaacucuggacugcccuuugcacauacacacuaaaauaugauuccagaaauuccuuaguccccucaauguccuuucccuaggagccaauuauaucuauaaaacauaggcucuuuuuagauauuuauaacauuagugaccagauauuaaaauuagcagcuaucauuaauuucaauauuucaauaccauugucuccaaagaguuguuuuguuuggugcuagagugauggcucagaacuaagaccguauguuucucuuccugcugaccagaguuugguuauucccacccaagucagcucacagucacacauaauuacagcugcagggaaaucugacaguccuggccucugugggucccuacagauaggaaacauccacauauagacacacucauaaacacauaauuaaaauaguaaaccuaaacauuuuaaugauguaucuuacuuuuagguaugcauaugccugugucuauguggcucugugacugcgaaugcagauacaacggagaccauaagaaggcuacagguccuccuggcccaaauuucagcuguucagagccaauaauauuguugcuaagaaccuaaccauggauuucugcaaaagaauuauauacccucaacugccaaauaauauuuucccucaguaacuucauaaauauuguacaguauucaaaauaacaauggcugaacaauu

SEQ ID NO: 4326 - RNA, 611 nt, Mus musculus
uacuaugaaugacacuuuaucagucauuuucuuuacaacugaaacucugggaauuccaaauuaacauccuugccugugggcuucuuguacacaccagaaaaaguuccaaccuugugcuccuaauuguucugcugugcuuuguauaaaugaacuuuuaugagcuggcugccauccaguuucacacagauccucuacccacaauuucacuugggaagaccaagucugcugucaugcacuacugucagggugugguuucuggggcgcuucugcuuauuuuucguacggauuuuccagguuggcuugggcagaauccuccucugagcaaugaacacuacuugcuucccacugaauuuuuucuccaauucacgaacuagccugacaugaauuuucuggaaagacuuaaagcugaggaacugguacaaaaauuaugguagcuuuccgaccaccaccaacuucaauuuccuugguuguggugauguugacuuccugcagcagagccuugacaucugcguucaucuccagcucgagcagcaccugagagaugccagacuuggaacucauccggcuucuccccauuuggcuucacagucuuggcacuggagcugaacaug

SEQ ID NO: 4327 - RNA, 611 nt, Mus musculus
cauguucagcuccagugccaagacugugaagccaaauggggagaagccggaugaguuccaagucuggcaucucucaggugcugcucgagcuggagaugaacgcagaugucaaggcucugcugcaggaagucaacaucaccacaaccaaggaaauugaaguuggugguggucggaaagcuaccauaauuuuuguaccaguuccucagcuuuaagucuuuccagaaaauucaugucaggcuaguucgugaauuggagaaaaaauucagugggaagcaaguaguguucauugcucagaggaggauucugcccaagccaaccuggaaaauccguacgaaaaauaagcagaagcgccccagaaaccacacccugacaguagugcaugacagcagacuuggucuucccaagugaaauuguggguagaggaucugugugaaacuggauggcagccagcucauaaaaguucauuuauacaaagcacagcagaacaauuaggagcacaagguuggaacuuuuucugguguguacaagaagcccacaggcaaggauguuaauuuggaauucccagaguuucaguuguaaagaaaaugacugauaaagugucauucauagua

SEQ ID NO: 4328 - RNA, 983 nt, Mus musculus
cgccgccaucuuugcccugugcacuucccaaaccgcuccggcggacacugcaacagacccaaccccaggucugcguuccauccgccauucuaccguguccgagcugggcgccuggccauaggccccgcccaaugcggugccacaggaaaaguccuccuugcgggaaacccauccgccucgcgcccucugguggccccuauaugaaccucaccuuaauggcugaaguaaaaggucgauggaagugaguagggaggggcucguuuucccacaggaugaaggagucccgaaaucagauccugcaaauuacucauggucucaucccuuuauuucguuaaguauuuauuugcacauuaauuuccuuuuugaagcauuacacucucuauggcuugaugcucuuccaagggcuguggaaauaacagagauaaaacaaaugaaggaagaugaaauauuggaacuuguuuaggagcccacagcccggaucugggacugagaacaaagcagaacagcccccaggcaggccaaggcagggcuguuguuaaggcauuccuaagaacaucuuggccguaaagaugaaaagguauucaaggacaaauggggcuacauuaucuaagcuaacaccaucuggccagaaucaccccucaaucaggggacaggcagggccaucuuaucuaaaguccacaccaucuggccggaaucuccuuucugucuauuaccccuuagcaccgaguaaagucauauacaucaacugguuguuagauaagucccaagcccaccggaacaaagcucugaugccccuuuuugcugacauguaaucuuucuguuaaugaaucaaccccgugccuuuugucaaaauuccuuguacucccaaccuuuugcuucuuuaaaaaccccuagcuuccgagccucagcaucgacuccccugccuccggugugagguaagugucgacccagagcucugccaauaaagccucgugugucuugca

SEQ ID NO: 4329 - RNA, 15454 nt, Mus musculus
ugcaagacacacgaggcuuuauuggcagagcucugggucgacacuuaccucacaccggaggcaggggagucgaugcugaggcucggaagcuagggguuuuuaaagaagcaaaagguugggaguacaaggaauuuugacaaaaggcacgggguugauucauuaacagaaagauuacaugucagcaaaaaggggcaucagagcuuuguuccggugggcuugggacuuaucuaacaaccaguugauguauaugacuuuacucggugcuaagggguaauagacagaaaggagauuccggccagaugguguggacuuuagauaagauggcccugccuguccccugauugaggggugauucuggccagaugguguuagcuuagauaauguagccccauuuguccuugaauaccuuuucaucuuuacggccaagauguucuuaggaaugccuuaacaacagcccugccuuggccugccugggggcuguucugcuuuguucucagucccagauccgggcugugggcuccuaaacaaguuccaauauuucaucuuccuucauuuguuuuaucucuguuauuuccacagcccuuggaagagcaucaagccauagagaguguaaugcuucaaaaaggaaauuaaugugcaaauaaauacuuaacgaaauaaagggaugagaccaugaguaauuugcaggaucugauuucgggacuccuucauccugugggaaaacgagccccucccuacucacuuccaucgaccuuuuacuucagccauuaaggugagguucauauaggggccaccagagggcgcgaggcggauggguuucccgcaaggaggacuuuuccuguggcaccgcauugggcggggccuauggccaggcgcccagcucggacacgguagaauggcggauggaacgcagaccugggguugggucuguugcaguguccgccggagcgguuugggaagugcacagggcaaagauggcggcggaggagcaggaggcguugagggaguucauggcggugacgggcacugaggaggaaagggcucguuucguccuggagacggcuggcugggaccugcagguagcgccgcgaggcgggccgcuucgggcgggcuguggaaugcggagugcggcguccgcucugcgauuccuacgcggccgaagcucacaguuauccgugcggggcugggcccugccuggcccaggccucauggugucuggggucgcuugccacgcgucuccggccuggcuuggaaguucauggacgcgggcgggcccggccugcuuuucagggccuccguuuuccggcgggcucgcaguguuagcgagacuuugggcgcuguggcagucugcguggaguugucgcuuggggacguggcugccgcggcgagugcuugcggguggccggguggaaucgagugcccggcuuccagauggcgccccaccgaggucgcgguggccuuccgauuccgcuucugcaaggaugcugugcuggugggggaaacccugcagggcaucagcccacgccccacucuugccuaauuucagggagaaacuaccugugggacuguggugcacguuugggaucucugcacauuucguaguuaacuguaaaaugagaauuucuuaggacuuacugucuuguucgcuggcauguaguaaauauuccuuaaggaauuaauuuaaaagacaaagcuccaccaggcaugaaauauugcacacuucugauuccuagagcaacgcccaucucuuagugcucagaagcacaguaauuaauguuagaaagaacugauugcaugaauguccuuggccagccuacaucuuagguagaugaugaugacuaauauuucuagaguaccuacaacaagccaggcacuguucagcauuacaaaaugucucauuuacauaucucacauugcagcuaagacuuuggaggauaaauaacuugcugaagaacuuacuaacuacuaauuaaacagguaaagacuaauccuaucuuauggaugaggaauuggacccucaaagggacaccgaaugugcucacugugugagcuuucugauguaaccaugucuacugacuguaauauauaaauagcuucccaaacauuagggaucuuuauuccugaaacucuuucagcacucuggaggcagaagaucucugaguucgagaccagccugaucuacauaguuccaggaguaaauagucccucuuucaaaaucauaacaaacaaaaagaggucagaugcucuuaaaggcgcugugaagccucugugcugaguggacauacaugagagaaaagcuucuaucccagcagaucauccgaacugaggcucuuaacugugugguaacuugacuaacagcgccaggacuugaaugcagguucucaaaaugucaguuuaguacaccuccuacgauggcacaugacuucccagaagcugguuauacuacaugaagaauaccuucagacugauugucccaugacagcucauuuccuccuauacaguugguuaccuuuuagacaggaggugccuccuccaucucuguggaacuucauuguucugucuucucucuuuguguggagaaugugugauaaaucaaugccuucucguugaguuggcgacaguacaaaugaccaaaggacucauaugaagggcuuccacauguguaaagcuaaggugacugcguuaacuuuagugcuuaucuccuucaguuuuauagguuuguuggaacagcauccccauuucaaacaggaaccgggcuucacaaagaaaggaaauguagcaucugucccuaugcucuucuuccucuuagaacauaagcgugagggccugagcaugcugccugggguugaaccugaccccauuucuuaccuccagaagcugucuucauuuugcaguccguuugugccugcuauaaaaugagacaauaauaauacuaauuacgaaauucugaguagaugaaaggaauuaacauauaguguacagacaaauaauaguugguggucuuccuuuauguuuuucauauuaauuuuauuuaguaucuuuguuccccuugguggguggauuucccccugaaguaauauauccccaucuccacuuccaggcuaacaugucuauugccuuuccaucucaucuucuuuaauugugguuuccuguuauuuuuguugugagaguuaagauucuguucaugugacuuucuucuuuuagguguuuugaaagauuucuuucuugcuuuuucuaggguguaauuucccuccuuguguuggaguucucacuuuaucauccuuugaagggcugguuuuuguggaaaaauaaugugugaauuugguuuugucauguuuuucugaugauuuccuuuagugggcacccgagauacaaagcccuucauuucacaggcaugaagaugggguugaggacaugaagcagcaagguagucguagauaucaggugccccauacagcaucauuucuauaacuucauucaucaacaaacauuaccuucuucagagguuaguuuucacaucuaagacagugagugacuacuaaaguguuuuacagggacuuuaauaaccucucagaauagcugaucaaagugacuuaaauggaacuagugcauuaagacacuugggacuaaagcguaacuugaaauaauuuuaagagcuauggacaaugggguccccuuagaaccuuaaaaauacuauauucugggauuacuuuaucucuguuugauuuagggugugguaaggaauuuuguaaguuucccaggugauucagguguucagccaggguaagaguggauagucuagguauucaauuucaugaagguaaaaucaauuuguucucaugauccuuuguacacaauagcaaggaguaaugaagaguuaccaucuaaaauuuuggagaauuaaauguauccuacauuaucuucuguugaaacauccuauuugaauuuguuaaucaacaaugugauccaaaggaaaggaaauuggcauuucuaacugaggaaaaugaaaggggaaaccuuucuuuauuauggcacuaauaaauuaaaaacaagguacaugauuuuuaauuuguuuugccagaaauguguguggaacaauagauuauucuuguacauaaguaaaaaucacauuaguaauucucagcaggauuaaccuaggauuauagaaacuaauuaaaugaguccucucucugugacccuaaaaggacacuugacauuaccuugcaaaguuccaucugucuagggugguaggcucaugcuuaguaaguacuaggaggcaugggugaguuugcuguauccaauugcuuuucuuucaucaugacuucaaaaauaucccauucuuucugauaaauggcauuaauuuacugaaggaaaaaaaagaguguuuuaauggauggauuuauugaaacaacagugagauaauuaugaagcuuucuaaaaguaaauggguaagacauccuuuguaauauacacaggcauauaaaagaggcauuuaaauaugucccaugguuuauuuagacugcccugagccauauggggugguccagacagaacauuaagaaaaagaccucugaaauagcccacccacacucuggagaaaaccaggcuucugguaauuggaagcagcuugacucugcauuccucauuccucugguugagcuaaagugaugcuuguggaucuggguggcuaacaccauggauuauaaaucucugacagaagaucugguacuggguucuggugacuucaggcacucccuucccugguuguagugaucaguuugcaagacuucaucaagccuuuuuuuagggaugaagcccaacuucagacaagacuuucucucacuaucuaucagaaaacagacugacaguagcucugugagaaaccucagguacuagggagaauauacagagcaguaucuuuuauuucuuccaccucugacucuuuaaagagcacucuuagauugcuuaagauauauuucccuucaugaaucugaggauuuuguuuccauagauaugacaugaauggaaaacuauauuuaaugcaggagacaacaauccuaugaaaauuaauuuucacuuccugauauuuucuuucucucuccagagaguagggggguuugaggcucacuugaucuaguuuuaaauguuagccaucagcuccuauauuuguuuccccuuuucuaaugaaaugaaaaaacaaaacaaaacaaaacaaguccaaaaaaaaaaaaaaacacccuuaauaguugagcaucuuuaccuugucaucuaauucuggauuucugaaaauuuacaguguagcauaaucucccaaccugaagcagacaugguuucauuucaucaugguuucauuuauucauucuacuaguggaagaauuuugggacuuucagugauuucacacauucaaaguuuuuaaaacauagaucuuguucccaauccagcccuucuacugaggcuaagaacauaagcaucuuucccuccaucuaccuucccagugucuccuuuaggaucugcugauuucaaaggccaucugaauguuuucccaaauaaauaguugucuaacuaacuaacuaacuaacuaacgacagcagucuuaauucacuaguucuucacucagaggauuguuaucaccagaaagucuuugaucacccuccucuaugaaaagguuuauggucuucugauuauucuuccuugucuacucguggcuacuuagcuaguaaaaguauggcugcucucaacugugacuuaaguaugaaauauacacugagccuaaaacagaacauuaaaaaaaaguagagguaaaauaagauaguuuauacacuggguaaaugcuguaauuaucugauggggauaugacuaugugauaaaauaugugguuaaaauuaauggacuuuuuauaacuuuaaaaaaugugucuuucugaauauuuaccauucuccagauuucaaugaauucuauguuagugcguccuaaugaaguucuauaugagcaggccuacuagcugaccuuagaccauuaccaaggguugaaaacuacaauccaggaauggcugccucagcacugacccacagacagacgcuuguauacagagaggcauuuaaugauauauuucuguccuuuuauuuuagaggagaauuuugauccuaaggaagaauacuuugucuaaguugcaccguuauguacuaacagaacuuauauuauagcauacucaucuucccuuauggucuagagaucuuuggcccaauggccuuuggaaauucagagauuuaaaaaaaaaauggcauuuuauacaauugcacuaaugaucuucacaguggcaauauuucacaguuggccaaaaaaagaacugccaauuuauuucuuuaagauuaccauaaauuucuauauuugcuguuugggugaugaaagaaaguucccaggcuaacucaugcacaggagguacacugucaucuuauagguagggugcugacaaacagcuuagggcccaugguggcagcaaagaagcauagucgccuaggucuucagagaaaugagaucacguguucugccauuugcaugguuuggggagagagagaugcuauaguuugacuuuugcuucuaacuaguuugguuguugccuugaucuuauugaaaucugaacaauuggauauuacuuuguagcuacucuaugcuuuaggugccuccuaaccugacuuugcaaggccuuucacuaguuacaaauauuuucugucguuuuucauugaaguucuuggaaaaucugguucccauagccaaucauuugaauacaggucgcccuggccgcaaugaucaaugguuaguuuaugguuuacuugucagaacagcaggaaagguuucaucagccauaccucagagaaggaguagguaaggcauuggagacuauggacaagcuuguuugcuuggaagaggccacaagaauaaccacgguguuacaaguucaucugccaaacugauucugguuguuggaugcuuuguuuguaguguuguuagauccacucauuccucgaagacuuuuaccaaguucuauaauugucuaagcaucaaaaacacacugauuccuauguaucaccgagacccauccagacuugacccugaaugaaugaaggagaaaauaaggauaaagaacacuuuuuauauauuuacuguuugggcccagagggagguuugacuguaugcuuuucaaauuauaaaugaugucacaguaagcuaagcaucuugucauugccacuucgugcaugucuucccucagguaguuuuguucaggaacaagaaaagucagaaguggaaucuaauuuuuuccacauauucauauggaacauuuauucacaguuggagcugacauugcucacaauguuguuucggauauguguugauguauuuuauucauaucaaugaguaaaauuuagaaauauuaagaguuagaaaagcugucucaagaauugaguggagcaugaauaauagaagauauucuuuguacucauuggauauaacuaccuuauugcucaaauaugauugaauuauugugagacaggaggucuuuggaguccuaugaccaugggacccacgaguaucauuuauauuaaguuauguugaaaaugcuaugaaaugcugcauagcaugcuuuauacugcuggccaguauuauaaaaaccagaugacuaagaagagaugaaacuacuauuaccauagcugcuacuacugcuacuauggcuacuacuacuacuacuacuacuacuacuacuacuauuacuacuacuacuacuuaaguuaaugaaaucuauaaaggauuuaaucagaugguugacuaagcuuugcauaacucucugguuauuaaaugucauuccuauuuccaaaacuguguguggaggcaaaaagugacacuuaucuuugagcuccuguaaaauucuauugaaguuucaaauuaucuucauuuuuguuucuuugcuaugacucacuauaguauuugugucuggcauuugagaauggaacgauauacauuaugauauuuuguguacugcccacuguauauucuguacccaagaaaaagugaauccaaacuuaagucuugcaccaaaugcagaaaucugagcuagagaauuacguuucaaccauucuuguaauacuuccuugucgcagacccucugggucccuggucugcgaggaacgggauuacuuaagcagaugggcaaaagagucggaugaaaugacaaucagacacacgcaagagagguguugaaucugaauguaauguucugguugagcuucagacuuauauuacaaugaauuaucagaggauacaaaucacaaaagacaagauacacugaaauucaccaguuacagcagaaaggaauuugcagggacuaauuaaauguuuacauuagggauaacaagcccugccuaggaucagccuaaugccaggcaagaauuucacacuuuaagguuaaaagcaucaggggguuguuaacucuugacaggccuuaagaguaauguguuaucacagagcucuaaauucuuaggucuaguaaaacuuauccugucuggugaguucccccuuaucaggguaguauaucaacuuauacuugacauggaauguagccuguaguaaaagauuucuaucucagugagacuuuuagucucuuucugcagacagcugaguuaauggcaagugcuuuauuuuuuuaugguagagcuuaauuaguuacugaauagguuaaacuccuugcugcuaucaggaaucuaagaacacugggaaaaggcuuuagcuauguuagaauucaaucuuaaaagucauuuacuauaagguaaugcuuaauagagugcacgugaaucuauacacuagacuaaugugguagaaauuugaauauuauggguuagggaaagaaaugccauaacucugggaggaaaauuuccauggaacucuuauccucgugaaacagcuuccaggcuuuucgccugacaaaccgauccaaacuggagaguugacuuucgccagacaucuaggaggaaaguccuagaaauucauuucucaugagcagcuuuuuggcauuucugccucacaagcugacuccaccagagugcccugacacuuccucucucccuccucuacgauuuucacagacaaggcauaauuccugugauuugaauugaaagagggaccagcucugugcugagugaugagaucugagcgcagaauaaaauauucuugaguuaauuugcauaauagaauccgauugguuacaaagcuguguuuguugaaggagagaccagagucccuuugcucacccacaaggaaaccuugcagauacaaaaauaggauuuugagcucugguaagaaccuugauaauauacuuugcauaauaauaaccugucuuuagcuguaaauuagcuugcuagauauaaaaagauugggucagugugucugauucuuccagcucuguggggaggagaaaacugaaaaccaaaucugcuugcuuuuugcuaacuguuuuugucuuucauuuccuacccgauaacaauuuccagcaggaguccaaauauacuuaaacacccauauaugucauuuucuuuuaaggagacaagcaggcucagcagccugcuuaagaaggacucucugcucucuagauagaggggugagccuuccacuuagaacuggugauuuugcaaauccauuuccugucacacuauuacucuugugacuuucaacaacauuuauuuuuucccuccaagcacugugcucccaucguaaagugaagucuucuuacauguguuaguggaacccugaugcuuaggcauccuggccagcugcuaggaagagcuuuaaugggaagauugccauugggguggcaagugcuuugggguuuuuuuuuuuccauuuuuuauuagguauuuagcacauuuacauuuccaaugcuauaccaaaagucccccauacccacccacccccacuccccuacccacccacucccccuuuuuggcccuggcguuccccuguacuggggcauacaaaguuuacguguccaaugggccucucuuuccagugauggccgauuaggccaucuuuuuuuacauauguagcuagagucaagagcuccgggguacugguuaguucauaauguuccaccuauaggguugcagaucccuuuagcuccuuggguuauuucucuagcuccuccauugggagcccugugauccauccauuagcuuacugugauuauccacuucuguguuugcuaggccccggcauagucucacaagagauagcuacaucuggguccuuucaauaaaaucuugcuaggguaugcaauggugucaguguuugggugcugauuaugggguggaucccuggauauggcagucuuuacaugguccauccuuucaucucagcuccaaacuuugucucuguaacuccuuccauggguauuuuguucccaauucuaaggaggggcauaguguccacacuucagucuucauucuucuugaguuucauguguuuagcaaauuguaccuuauaucuugggaauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguuggggcaucuucuggauaaaugcccaggagagguauugcuggauccuccgguaguacuauguccaauuuucugaggaaccgccagacugauuuccagagugguuguacaagccugcaaucccaccaacaauggaggaauguuccucuuucuccacauccacgccagcaucugcugucaccucaauuuuucaucuuagccauucugacuggugugagguggaaucucaggguuguuuugauuugcauuucccugaugauuaagguugaacauuuuuucaggugcuucucugccauucgguauuccucaggugagaauucuuuguucacuacugagccccauuuuuuaaugggguuguucgauuuucugaaguccaccuucuugaguuuuuauauauguuggaucuuagcccccuaucugauuuaggauagguaaagauccuuucccaaucuguuggugguuuuuugucuuguugacugugucuuuugcuuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguucuuugauccacuuagauuugaccuuaguacaaggagauaaguauggaucgauucgcauucuucuacaugauaacaaccguugugccagcaccaauuguugaaaaugcugucuuucuuccacugcaugguuuuagcucccuugucgaagaucaagugaccauagguguguggguucauuucugggucuucaauucuauuccauuggucuacuugucuguuucuauaccaguacaaugcaguuuuuaucacaauugcucuguaguaaagcuuuaggucaggcauggugauuccaccagagguucuuuuauccuuaagaagacuuuuugcuauccuagguuuuuuguuaucccagaugaauuugcaaauugcuccuucuaauucguugaagaauugaguuggaauuuugauggggauugcauugaaucuguagauugcuuuuggcaagauagccauuuuuacuauauugauccugccaauccaugagcaugggagaucuuuccaucuucugagaccuucuuuaauuucuuucuucagagacuugaaauucuuaucauacagaucuuucacuuccuuaguuagagucacgccaagguauuuuauauuauuugugacuauugagaaggguguuguuccccuaauuucuuucucagucuuuuuauccuuuguauagagaaaggccauugacuuguuugaguuuauuuuauauccagcuacuucacugaagcuguuuaucagguuuaggaguucucugguggaauuuuuagggucacuuauauauacuaucauaucaucugcaaaaagugauauuuugacuuccuuuuuuccaauuuguauccccuugaucuccuuuuguugucgaauugcucuggcuaauacuucaaguacuauguugaaaagguagggagaaagugggcagccuugucuacuauacccguccaaacucucaauuaccauagauggagaaaccaaaguauuccacgacaaaaccaaauucacacaauaucuuuccacgaauccagcccuucaaaggauaauaacagaaaagaagcaauacaaggacggaaaucacgcccuagaacaaacaagaaaguaauccuucaacaaaccaaaaagaagacagccacaagaacagaaugccaacucuaacaacaaaaauaaaaggaagcaacaauuacuuuuccuuaauaucucuuaauaucaauggucucaauuucccaauaaaaagacauagacuaagaaacuggcuacacaaacaggacccaacauucugcugcuuacaggaaacccaucucagggaaaaagacagacacuaccucagagugaaaggcuggaaaacaauuuuccaagcaaauggucugaagaaacaagcuggaguagccauucuaauaucggauaaaaucgacuuccaacccaaaguuuucaaaaaagacaaggagggacacuucauacucaucaaagguaaaauccuccaagaggaacucucaauucugaauaucuacacuccaaaugcaagggcagccacauucauuaaagacauuuuaguaaagcucaaagcacacauugcaccucacacaauaauagugggagacuucaacacaccacuuucaucaagggacagaucguggaaacagaaacuaaacagggacacagugaaacuaacagaaguuaugaaacaaauggaccuaaaagauaucuacagaacauuuuauccuaaaacaaaaggauauaccuucuucucagcaccucacgggaccuucuccaaaauugaccauauaauuggucacaaaacaggccucaacagauacaaaaauauugaaauugucccauguauccuaucagaccaccauggccuaagauugaucuucaauaacaacauaaauaauggaaagccaacauucacguggaaacugaacaacacucuucucaaugauaccuuggucaaggaaggaauaaagaaagaaauuaaagacuuuuuagaguuuaaugaaaaugaagccacaacauacccaaaccuuugggacacaaugaaagcauuucuaagagggaaacucauagcucugagugccuccaagaagaaaagggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacuuacuaaagggcacagggacaaaauccuaauuaacaaaaucagaaaugaaaagggagacauaacaacagauccugaagaaaucuaaaacaccaucagauccuucuacaaaagguuauacucaacaaaacuggaaaaccuggacgaaauggacaaauuucuggacagauaccagguaccaaaguugagucaggaucaaguugaccaucuaaacagucccauaucaccuaaagaaauagaagcaguuauuaauagucucccagccaaaaaaagcccaggaccagacggguuuagugcauuguucuaucagacuuucaaagaagaucuaauuccaguucugcacaaacuauuucacaaaauagaaguagaagguacucuacccaacucauuuuaugaagccacuauuacucugauaccuaaaccacagaaagauucaacaaagauagagaacuucagaccaauuucucuuaugaauaucgaugcaaaaauccucaauaaaauucuugcuaaccgaauccaagaacauauuaaagcaaucauccauccugaccaaguagguuuuauuccaggaaugcagggaugguuuaauauacgaaaauccaucaauguaauccauuauauaaacaaacucaaagacaaaaaucacaugaucaucucguuagaugcagaaaaaggauuugacaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcuuugggguuuuuuauuaauauuaauuagaacauugauagauuucucuaauuauuacccacaucaaggucuccuuaggagggcagccuuuuauuaauuuuuuugugagaucugugcuaaauuucuacaguauucaacaguccagucuugagaaguuccaggucuuucuuuaaaaaaaaaaaucacagaauuaaauaaacaaaacucccugaauccauccuuuaaaggcuaccuuuagaaauuuuaagauagagauuuaaggauaagaaaauaaagauuaguuauacuacauuauuacacuuaauauugauaauuuauacucuuguguccaucuuuauuucaauaucuucuauggaauauuuucuccuuuacuuucuguucugauuuuuuuuuaacacuugaucuuagccaaaaggcagagaagcgauggcauuuuuuuuuuuuuuaaauaucaucauguauguacucacuucagguuccucagucuugaguuaguaucaagaaaaggcaauuauaagcugggcaguggugguggcacaugccuuuaaucccagcacuugggagucagaggcacguguauuucugaguucgaggccagccuguucuacagagugaguuccaggacagccagggcuacacagagaaacccugucuggaaaaaaaccaaaaaagaaagaaagaaagaaagaaagaaagaaagaaagaaacaaagaaagaaacaaagaaagaaagaaagaaagaaagggggggggaaggaaaggaaaaaggaaaggaaaaaggaaaggaaagaagagagagagagagaaaaggcaauuauguagauucugaggcagagacaucucucugu

SEQ ID NO: 4330 - RNA, 15454 nt, Mus musculus
acagagagaugucucugccucagaaucuacauaauugccuuuucucucucucucucuucuuuccuuuccuuuuuccuuuccuuuuuccuuuccuucccccccccuuucuuucuuucuuucuuucuuuguuucuuucuuuguuucuuucuuucuuucuuucuuucuuucuuucuuucuuuuuugguuuuuuuccagacaggguuucucuguguagcccuggcuguccuggaacucacucuguagaacaggcuggccucgaacucagaaauacacgugccucugacucccaagugcugggauuaaaggcaugugccaccaccacugcccagcuuauaauugccuuuucuugauacuaacucaagacugaggaaccugaagugaguacauacaugaugauauuuaaaaaaaaaaaaaaugccaucgcuucucugccuuuuggcuaagaucaaguguuaaaaaaaaaucagaacagaaaguaaaggagaaaauauuccauagaagauauugaaauaaagauggacacaagaguauaaauuaucaauauuaaguguaauaauguaguauaacuaaucuuuauuuucuuauccuuaaaucucuaucuuaaaauuucuaaagguagccuuuaaaggauggauucagggaguuuuguuuauuuaauucugugauuuuuuuuuuuaaagaaagaccuggaacuucucaagacuggacuguugaauacuguagaaauuuagcacagaucucacaaaaaaauuaauaaaaggcugcccuccuaaggagaccuugauguggguaauaauuagagaaaucuaucaauguucuaauuaauauuaauaaaaaaccccaaagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaauccuuuuucugcaucuaacgagaugaucaugugauuuuugucuuugaguuuguuuauauaauggauuacauugauggauuuucguauauuaaaccaucccugcauuccuggaauaaaaccuacuuggucaggauggaugauugcuuuaauauguucuuggauucgguuagcaagaauuuuauugaggauuuuugcaucgauauucauaagagaaauuggucugaaguucucuaucuuuguugaaucuuucugugguuuagguaucagaguaauaguggcuucauaaaaugaguuggguagaguaccuucuacuucuauuuugugaaauaguuugugcagaacuggaauuagaucuucuuugaaagucugauagaacaaugcacuaaacccgucugguccugggcuuuuuuuggcugggagacuauuaauaacugcuucuauuucuuuaggugauaugggacuguuuagauggucaacuugauccugacucaacuuugguaccugguaucuguccagaaauuuguccauuucguccagguuuuccaguuuuguugaguauaaccuuuuguagaaggaucugaugguguuuuagauuucuucaggaucuguuguuaugucucccuuuucauuucugauuuuguuaauuaggauuuugucccugugcccuuuaguaagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccuuuucuucuuggaggcacucagagcuaugaguuucccucuuagaaaugcuuucauugugucccaaagguuuggguauguuguggcuucauuuucauuaaacucuaaaaagucuuuaauuucuuucuuuauuccuuccuugaccaagguaucauugagaagaguguuguucaguuuccacgugaauguuggcuuuccauuauuuauguuguuauugaagaucaaucuuaggccaugguggucugauaggauacaugggacaauuucaauauuuuuguaucuguugaggccuguuuugugaccaauuauauggucaauuuuggagaaggucccgugaggugcugagaagaagguauauccuuuuguuuuaggauaaaauguucuguagauaucuuuuagguccauuuguuucauaacuucuguuaguuucacugugucccuguuuaguuucuguuuccacgaucugucccuugaugaaagugguguguugaagucucccacuauuauugugugaggugcaaugugugcuuugagcuuuacuaaaaugucuuuaaugaauguggcugcccuugcauuuggaguguagauauucagaauugagaguuccucuuggaggauuuuaccuuugaugaguaugaagugucccuccuugucuuuuuugaaaacuuuggguuggaagucgauuuuauccgauauuagaauggcuacuccagcuuguuucuucagaccauuugcuuggaaaauuguuuuccagccuuucacucugagguagugucugucuuuuucccugagauggguuuccuguaagcagcagaauguuggguccuguuuguguagccaguuucuuagucuaugucuuuuuauugggaaauugagaccauugauauuaagagauauuaaggaaaaguaauuguugcuuccuuuuauuuuuguuguuagaguuggcauucuguucuuguggcugucuucuuuuugguuuguugaaggauuacuuucuuguuuguucuagggcgugauuuccguccuuguauugcuucuuuucuguuauuauccuuugaagggcuggauucguggaaagauauugugugaauuugguuuugucguggaauacuuugguuucuccaucuaugguaauugagaguuuggacggguauaguagacaaggcugcccacuuucucccuaccuuuucaacauaguacuugaaguauuagccagagcaauucgacaacaaaaggagaucaaggggauacaaauuggaaaaaaggaagucaaaauaucacuuuuugcagaugauaugauaguauauauaagugacccuaaaaauuccaccagagaacuccuaaaccugauaaacagcuucagugaaguagcuggauauaaaauaaacucaaacaagucaauggccuuucucuauacaaaggauaaaaagacugagaaagaaauuaggggaacaacacccuucucaauagucacaaauaauauaaaauaccuuggcgugacucuaacuaaggaagugaaagaucuguaugauaagaauuucaagucucugaagaaagaaauuaaagaaggucucagaagauggaaagaucucccaugcucauggauuggcaggaucaauauaguaaaaauggcuaucuugccaaaagcaaucuacagauucaaugcaauccccaucaaaauuccaacucaauucuucaacgaauuagaaggagcaauuugcaaauucaucugggauaacaaaaaaccuaggauagcaaaaagucuucuuaaggauaaaagaaccucugguggaaucaccaugccugaccuaaagcuuuacuacagagcaauugugauaaaaacugcauuguacugguauagaaacagacaaguagaccaauggaauagaauugaagacccagaaaugaacccacacaccuauggucacuugaucuucgacaagggagcuaaaaccaugcaguggaagaaagacagcauuuucaacaauuggugcuggcacaacgguuguuaucauguagaagaaugcgaaucgauccauacuuaucuccuuguacuaaggucaaaucuaaguggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaagcaaaagacacagucaacaagacaaaaaaccaccaacagauugggaaaggaucuuuaccuauccuaaaucagauagggggcuaagauccaacauauauaaaaacucaagaagguggacuucagaaaaucgaacaaccccauuaaaaaauggggcucaguagugaacaaagaauucucaccugaggaauaccgaauggcagagaagcaccugaaaaaauguucaaccuuaaucaucagggaaaugcaaaucaaaacaacccugagauuccaccucacaccagucagaauggcuaagaugaaaaauugaggugacagcagaugcuggcguggauguggagaaagaggaacauuccuccauuguuggugggauugcaggcuuguacaaccacucuggaaaucagucuggcgguuccucagaaaauuggacauaguacuaccggaggauccagcaauaccucuccugggcauuuauccagaagaugccccaaccgguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccccaaaccuaggauucccaagauauaagguacaauuugcuaaacacaugaaacucaagaagaaugaagacugaaguguggacacuaugccccuccuuagaauugggaacaaaauacccauggaaggaguuacagagacaaaguuuggagcugagaugaaaggauggaccauguaaagacugccauauccagggauccaccccauaaucagcacccaaacacugacaccauugcauacccuagcaagauuuuauugaaaggacccagauguagcuaucucuugugagacuaugccggggccuagcaaacacagaaguggauaaucacaguaagcuaauggauggaucacagggcucccaauggaggagcuagagaaauaacccaaggagcuaaagggaucugcaacccuauagguggaacauuaugaacuaaccaguaccccggagcucuugacucuagcuacauauguaaaaaaagauggccuaaucggccaucacuggaaagagaggcccauuggacacguaaacuuuguaugccccaguacaggggaacgccagggccaaaaagggggaguggguggguaggggaguggggguggguggguaugggggacuuuugguauagcauuggaaauguaaaugugcuaaauaccuaauaaaaaauggaaaaaaaaaaaccccaaagcacuugccaccccaauggcaaucuucccauuaaagcucuuccuagcagcuggccaggaugccuaagcaucaggguuccacuaacacauguaagaagacuucacuuuacgaugggagcacagugcuuggagggaaaaaauaaauguuguugaaagucacaagaguaauagugugacaggaaauggauuugcaaaaucaccaguucuaaguggaaggcucaccccucuaucuagagagcagagaguccuucuuaagcaggcugcugagccugcuugucuccuuaaaagaaaaugacauauauggguguuuaaguauauuuggacuccugcuggaaauuguuaucggguaggaaaugaaagacaaaaacaguuagcaaaaagcaagcagauuugguuuucaguuuucuccuccccacagagcuggaagaaucagacacacugacccaaucuuuuuauaucuagcaagcuaauuuacagcuaaagacagguuauuauuaugcaaaguauauuaucaagguucuuaccagagcucaaaauccuauuuuuguaucugcaagguuuccuugugggugagcaaagggacucuggucucuccuucaacaaacacagcuuuguaaccaaucggauucuauuaugcaaauuaacucaagaauauuuuauucugcgcucagaucucaucacucagcacagagcuggucccucuuucaauucaaaucacaggaauuaugccuugucugugaaaaucguagaggagggagagaggaagugucagggcacucugguggagucagcuugugaggcagaaaugccaaaaagcugcucaugagaaaugaauuucuaggacuuuccuccuagaugucuggcgaaagucaacucuccaguuuggaucgguuugucaggcgaaaagccuggaagcuguuucacgaggauaagaguuccauggaaauuuuccucccagaguuauggcauuucuuucccuaacccauaauauucaaauuucuaccacauuagucuaguguauagauucacgugcacucuauuaagcauuaccuuauaguaaaugacuuuuaagauugaauucuaacauagcuaaagccuuuucccaguguucuuagauuccugauagcagcaaggaguuuaaccuauucaguaacuaauuaagcucuaccauaaaaaaauaaagcacuugccauuaacucagcugucugcagaaagagacuaaaagucucacugagauagaaaucuuuuacuacaggcuacauuccaugucaaguauaaguugauauacuacccugauaagggggaacucaccagacaggauaaguuuuacuagaccuaagaauuuagagcucugugauaacacauuacucuuaaggccugucaagaguuaacaacccccugaugcuuuuaaccuuaaagugugaaauucuugccuggcauuaggcugauccuaggcagggcuuguuaucccuaauguaaacauuuaauuagucccugcaaauuccuuucugcuguaacuggugaauuucaguguaucuugucuuuugugauuuguauccucugauaauucauuguaauauaagucugaagcucaaccagaacauuacauucagauucaacaccucucuugcgugugucugauugucauuucauccgacucuuuugcccaucugcuuaaguaaucccguuccucgcagaccagggacccagagggucugcgacaaggaaguauuacaagaaugguugaaacguaauucucuagcucagauuucugcauuuggugcaagacuuaaguuuggauucacuuuuucuuggguacagaauauacagugggcaguacacaaaauaucauaauguauaucguuccauucucaaaugccagacacaaauacuauagugagucauagcaaagaaacaaaaaugaagauaauuugaaacuucaauagaauuuuacaggagcucaaagauaagugucacuuuuugccuccacacacaguuuuggaaauaggaaugacauuuaauaaccagagaguuaugcaaagcuuagucaaccaucugauuaaauccuuuauagauuucauuaacuuaaguaguaguaguaguaauaguaguaguaguaguaguaguaguaguaguaguagccauaguagcaguaguagcagcuaugguaauaguaguuucaucucuucuuagucaucugguuuuuauaauacuggccagcaguauaaagcaugcuaugcagcauuucauagcauuuucaacauaacuuaauauaaaugauacucgugggucccauggucauaggacuccaaagaccuccugucucacaauaauucaaucauauuugagcaauaagguaguuauauccaaugaguacaaagaauaucuucuauuauucaugcuccacucaauucuugagacagcuuuucuaacucuuaauauuucuaaauuuuacucauugauaugaauaaaauacaucaacacauauccgaaacaacauugugagcaaugucagcuccaacugugaauaaauguuccauaugaauauguggaaaaaauuagauuccacuucugacuuuucuuguuccugaacaaaacuaccugagggaagacaugcacgaaguggcaaugacaagaugcuuagcuuacugugacaucauuuauaauuugaaaagcauacagucaaaccucccucugggcccaaacaguaaauauauaaaaaguguucuuuauccuuauuuucuccuucauucauucagggucaagucuggaugggucucggugauacauaggaaucaguguguuuuugaugcuuagacaauuauagaacuugguaaaagucuucgaggaaugaguggaucuaacaacacuacaaacaaagcauccaacaaccagaaucaguuuggcagaugaacuuguaacaccgugguuauucuuguggccucuuccaagcaaacaagcuuguccauagucuccaaugccuuaccuacuccuucucugagguauggcugaugaaaccuuuccugcuguucugacaaguaaaccauaaacuaaccauugaucauugcggccagggcgaccuguauucaaaugauuggcuaugggaaccagauuuuccaagaacuucaaugaaaaacgacagaaaauauuuguaacuagugaaaggccuugcaaagucagguuaggaggcaccuaaagcauagaguagcuacaaaguaauauccaauuguucagauuucaauaagaucaaggcaacaaccaaacuaguuagaagcaaaagucaaacuauagcaucucucucuccccaaaccaugcaaauggcagaacacgugaucucauuucucugaagaccuaggcgacuaugcuucuuugcugccaccaugggcccuaagcuguuugucagcacccuaccuauaagaugacaguguaccuccugugcaugaguuagccugggaacuuucuuucaucacccaaacagcaaauauagaaauuuaugguaaucuuaaagaaauaaauuggcaguucuuuuuuuggccaacugugaaauauugccacugugaagaucauuagugcaauuguauaaaaugccauuuuuuuuuuaaaucucugaauuuccaaaggccauugggccaaagaucucuagaccauaagggaagaugaguaugcuauaauauaaguucuguuaguacauaacggugcaacuuagacaaaguauucuuccuuaggaucaaaauucuccucuaaaauaaaaggacagaaauauaucauuaaaugccucucuguauacaagcgucugucugugggucagugcugaggcagccauuccuggauuguaguuuucaacccuugguaauggucuaaggucagcuaguaggccugcucauauagaacuucauuaggacgcacuaacauagaauucauugaaaucuggagaaugguaaauauucagaaagacacauuuuuuaaaguuauaaaaaguccauuaauuuuaaccacauauuuuaucacauagucauauccccaucagauaauuacagcauuuacccaguguauaaacuaucuuauuuuaccucuacuuuuuuuuaauguucuguuuuaggcucaguguauauuucauacuuaagucacaguugagagcagccauacuuuuacuagcuaaguagccacgaguagacaaggaagaauaaucagaagaccauaaaccuuuucauagaggagggugaucaaagacuuucuggugauaacaauccucugagugaagaacuagugaauuaagacugcugucguuaguuaguuaguuaguuaguuagacaacuauuuauuugggaaaacauucagauggccuuugaaaucagcagauccuaaaggagacacugggaagguagauggagggaaagaugcuuauguucuuagccucaguagaagggcuggauugggaacaagaucuauguuuuaaaaacuuugaaugugugaaaucacugaaagucccaaaauucuuccacuaguagaaugaauaaaugaaaccaugaugaaaugaaaccaugucugcuucagguugggagauuaugcuacacuguaaauuuucagaaauccagaauuagaugacaagguaaagaugcucaacuauuaaggguguuuuuuuuuuuuuuuggacuuguuuuguuuuguuuuguuuuuucauuucauuagaaaaggggaaacaaauauaggagcugauggcuaacauuuaaaacuagaucaagugagccucaaaccccccuacucucuggagagagaaagaaaauaucaggaagugaaaauuaauuuucauaggauuguugucuccugcauuaaauauaguuuuccauucaugucauaucuauggaaacaaaauccucagauucaugaagggaaauauaucuuaagcaaucuaagagugcucuuuaaagagucagagguggaagaaauaaaagauacugcucuguauauucucccuaguaccugagguuucucacagagcuacugucagucuguuuucugauagauagugagagaaagucuugucugaaguugggcuucaucccuaaaaaaaggcuugaugaagucuugcaaacugaucacuacaaccagggaagggagugccugaagucaccagaacccaguaccagaucuucugucagagauuuauaauccaugguguuagccacccagauccacaagcaucacuuuagcucaaccagaggaaugaggaaugcagagucaagcugcuuccaauuaccagaagccugguuuucuccagagugugggugggcuauuucagaggucuuuuucuuaauguucugucuggaccaccccauauggcucagggcagucuaaauaaaccaugggacauauuuaaaugccucuuuuauaugccuguguauauuacaaaggaugucuuacccauuuacuuuuagaaagcuucauaauuaucucacuguuguuucaauaaauccauccauuaaaacacucuuuuuuuuccuucaguaaauuaaugccauuuaucagaaagaaugggauauuuuugaagucaugaugaaagaaaagcaauuggauacagcaaacucacccaugccuccuaguacuuacuaagcaugagccuaccacccuagacagauggaacuuugcaagguaaugucaaguguccuuuuagggucacagagagaggacucauuuaauuaguuucuauaauccuagguuaauccugcugagaauuacuaaugugauuuuuacuuauguacaagaauaaucuauuguuccacacacauuucuggcaaaacaaauuaaaaaucauguaccuuguuuuuaauuuauuagugccauaauaaagaaagguuuccccuuucauuuuccucaguuagaaaugccaauuuccuuuccuuuggaucacauuguugauuaacaaauucaaauaggauguuucaacagaagauaauguaggauacauuuaauucuccaaaauuuuagaugguaacucuucauuacuccuugcuauuguguacaaaggaucaugagaacaaauugauuuuaccuucaugaaauugaauaccuagacuauccacucuuacccuggcugaacaccugaaucaccugggaaacuuacaaaauuccuuaccacacccuaaaucaaacagagauaaaguaaucccagaauauaguauuuuuaagguucuaaggggaccccauuguccauagcucuuaaaauuauuucaaguuacgcuuuagucccaagugucuuaaugcacuaguuccauuuaagucacuuugaucagcuauucugagagguuauuaaagucccuguaaaacacuuuaguagucacucacugucuuagaugugaaaacuaaccucugaagaagguaauguuuguugaugaaugaaguuauagaaaugaugcuguauggggcaccugauaucuacgacuaccuugcugcuucauguccucaaccccaucuucaugccugugaaaugaagggcuuuguaucucgggugcccacuaaaggaaaucaucagaaaaacaugacaaaaccaaauucacacauuauuuuuccacaaaaaccagcccuucaaaggaugauaaagugagaacuccaacacaaggagggaaauuacacccuagaaaaagcaagaaagaaaucuuucaaaacaccuaaaagaagaaagucacaugaacagaaucuuaacucucacaacaaaaauaacaggaaaccacaauuaaagaagaugagauggaaaggcaauagacauguuagccuggaaguggagauggggauauauuacuucagggggaaauccacccaccaaggggaacaaagauacuaaauaaaauuaauaugaaaaacauaaaggaagaccaccaacuauuauuugucuguacacuauauguuaauuccuuucaucuacucagaauuucguaauuaguauuauuauugucucauuuuauagcaggcacaaacggacugcaaaaugaagacagcuucuggagguaagaaauggggucagguucaaccccaggcagcaugcucaggcccucacgcuuauguucuaagaggaagaagagcauagggacagaugcuacauuuccuuucuuugugaagcccgguuccuguuugaaauggggaugcuguuccaacaaaccuauaaaacugaaggagauaagcacuaaaguuaacgcagucaccuuagcuuuacacauguggaagcccuucauaugaguccuuuggucauuuguacugucgccaacucaacgagaaggcauugauuuaucacacauucuccacacaaagagagaagacagaacaaugaaguuccacagagauggaggaggcaccuccugucuaaaagguaaccaacuguauaggaggaaaugagcugucaugggacaaucagucugaagguauucuucauguaguauaaccagcuucugggaagucaugugccaucguaggagguguacuaaacugacauuuugagaaccugcauucaaguccuggcgcuguuagucaaguuaccacacaguuaagagccucaguucggaugaucugcugggauagaagcuuuucucucauguauguccacucagcacagaggcuucacagcgccuuuaagagcaucugaccucuuuuuguuuguuaugauuuugaaagagggacuauuuacuccuggaacuauguagaucaggcuggucucgaacucagagaucuucugccuccagagugcugaaagaguuucaggaauaaagaucccuaauguuugggaagcuauuuauauauuacagucaguagacaugguuacaucagaaagcucacacagugagcacauucggugucccuuugaggguccaauuccucauccauaagauaggauuagucuuuaccuguuuaauuaguaguuaguaaguucuucagcaaguuauuuauccuccaaagucuuagcugcaaugugagauauguaaaugagacauuuuguaaugcugaacagugccuggcuuguuguagguacucuagaaauauuagucaucaucaucuaccuaagauguaggcuggccaaggacauucaugcaaucaguucuuucuaacauuaauuacugugcuucugagcacuaagagaugggcguugcucuaggaaucagaagugugcaauauuucaugccugguggagcuuugucuuuuaaauuaauuccuuaaggaauauuuacuacaugccagcgaacaagacaguaaguccuaagaaauucucauuuuacaguuaacuacgaaaugugcagagaucccaaacgugcaccacagucccacagguaguuucucccugaaauuaggcaagaguggggcgugggcugaugcccugcaggguuucccccaccagcacagcauccuugcagaagcggaaucggaaggccaccgcgaccucgguggggcgccaucuggaagccgggcacucgauuccacccggccacccgcaagcacucgccgcggcagccacguccccaagcgacaacuccacgcagacugccacagcgcccaaagucucgcuaacacugcgagcccgccggaaaacggaggcccugaaaagcaggccgggcccgcccgcguccaugaacuuccaagccaggccggagacgcguggcaagcgaccccagacaccaugaggccugggccaggcagggcccagccccgcacggauaacugugagcuucggccgcguaggaaucgcagagcggacgccgcacuccgcauuccacagcccgcccgaagcggcccgccucgcggcgcuaccugcaggucccagccagccgucuccaggacgaaacgagcccuuuccuccucagugcccgucaccgccaugaacucccucaacgccuccugcuccuccgccgccaucuuugcccugugcacuucccaaaccgcuccggcggacacugcaacagacccaaccccaggucugcguuccauccgccauucuaccguguccgagcugggcgccuggccauaggccccgcccaaugcggugccacaggaaaaguccuccuugcgggaaacccauccgccucgcgcccucugguggccccuauaugaaccucaccuuaauggcugaaguaaaaggucgauggaagugaguagggaggggcucguuuucccacaggaugaaggagucccgaaaucagauccugcaaauuacucauggucucaucccuuuauuucguuaaguauuuauuugcacauuaauuuccuuuuugaagcauuacacucucuauggcuugaugcucuuccaagggcuguggaaauaacagagauaaaacaaaugaaggaagaugaaauauuggaacuuguuuaggagcccacagcccggaucugggacugagaacaaagcagaacagcccccaggcaggccaaggcagggcuguuguuaaggcauuccuaagaacaucuuggccguaaagaugaaaagguauucaaggacaaauggggcuacauuaucuaagcuaacaccaucuggccagaaucaccccucaaucaggggacaggcagggccaucuuaucuaaaguccacaccaucuggccggaaucuccuuucugucuauuaccccuuagcaccgaguaaagucauauacaucaacugguuguuagauaagucccaagcccaccggaacaaagcucugaugccccuuuuugcugacauguaaucuuucuguuaaugaaucaaccccgugccuuuugucaaaauuccuuguacucccaaccuuuugcuucuuuaaaaaccccuagcuuccgagccucagcaucgacuccccugccuccggugugagguaagugucgacccagagcucugccaauaaagccucgugugucuugca

SEQ ID NO: 4331 - RNA, 40022 nt, Mus musculus
cuuuuacuucagccauuaaggugagguucauauaggggccaccagagggcgcgaggcggauggguuucccgcaaggaggacuuuuccuguggcaccgcauugggcggagccuaugaccaggcgcccagcucgggacgcgguagaaugguggacggaacgcagaccugggguugggucuguugcaguguccgccggagcgguuugggaagugcacagggcaaagauggcggcggaggagcaggaggcauugagggaguucauggcggugacggacacugaggaggaaagggcucguuucguccuggagacggcuggcugggaccugcagguagcgccgcgaggcgggccgcuucgggcgggcugcggaaugcggagugcggcguccgcucugcgauuccuucguggccgaagcgcacaguuauccgugcggggcugggcccugccuggcccaggccucauggugucuggggucgcuugccacgcgucuccggccuggcuuggaaguucaugcacgcgggcgggcccggccugcuuuucagggccuccguuuuccggcgggcucgcaguguuagcgagacuuugggcgcugcggcagucugcguggagucgucgccuggggacaugccugccgcggcgagugcuuguggguggccggguggaaucgagugcccggcuuccagaugcagccccaccgaggucgcgguggccuuccaauuccgcuucugcaaggaugcugugcuggugggggaaacccugcagggcauuagcccacgccccacucuugccuaauugcagggagaaacuaccugugggacuguggcgcacguuugggaucucugcacauuucguaguuaacuguaaaaugagaauuucuuaggacuuacugucuuguucgcuggcauguaguaaauauuccuuaaggaauuaauuuaaaagacaaagcuccaccaggcaugaaauauugcacacuucugauuccuagagcaacgcccaucucuuagugcucagaagcacaguaauuaauguuagaaagaacugauugcaugaauguccuuggccagccuacaucuuagguagaugaugaugacuaauauuucuagaguaccuacaacaagccaggcacuguucagcauuacaaaaugucucauuuacaugucucacauugcagcugagacuuuggaggauaaauaacuugcugaagaacuuacuaacuacuaauuaaacagguaaagacuaauccuaucuuauggaugaggaauuggacccucaaagggacaccgaaugugcucacugugugagcuuucugauguaaccaugucuacugacuguaauauauaaauagcuucccaaacauuagggaucuuuauuccuguaacucuuucagcacucuggaggcagaagaucucugaguucgagaccagccugaucuacauaguuccaggaguaaauagucccucuuucaaaaucauaacaaacaaaaagaggucagaugcucuuaaaggcgcugugaagccucugugcugaguggacauacaugagagaaaagcuucuaucccagcagaucauccgaacugaggcucuuaccugugugguaacuugacuaacagcaccaggacuugaaugcagguucucuaaaugucaguuuaguacaacuccuacgauggcacaugacuucccagaaacugguuauacuacaugaagaauaccuucagacugauugucccaugacagcucauuuccuccuauacaguugguuaccuuuuagacaggaggugccuccuccaucucuguggaacuucauuguucugucuucucucuuuguguggagaaugugugauaaaucaaugccuucucguugaguuggcgacagucacaaaugaccaaaggacucauaugaaaggcuuccacauguguaaagcuaaggugacugcguuaacuuuagugcuuaucuccuucaguuuuauagguuuguuggaacagcauccccauuucaaacaggaaccgggcuucacaaagaaaggaaauguagcaucugucccuaugcucuucuuccucuuagaacauaagcgugagggccugagcaugcugccugggguugaaccugaccccauuucuuaucuccagaagcugucuucauuuugcaguccguuugugccugcuauaaaaugagacaauaauaauacuaauuaugaaauucugaguagaugaaaggaauuaacauauaguguacagacaaauaauaguugguggucuuccuuuauguuuuucauauuaauuuuauuuaguaucuuuguuccccuugguggguggauuucccccugaaguaauauauccccaucuccacuuccaggcuaacaugucuauugccuuuccaucucaucuucuuuaauugugguuuccuguuauuuuuguugugagaguuaagauucuguucaugugacucucuucuuuuagguguuuugaaagauuucuuucuugcuuuuucuaggguguaauuucccuccuuguguuggaguucucacuuuaucauccuuugaagggcugguuuuuguggaaaaauaaugugugaauuugguuuugucauguuuuucugaugauuuccuuuagugggcacccgagauacgaagcccuucauuucacaggcaugaagaugggguugaggacaugaagcagcaagguagucguagauaucaggugccccauacagcaucauuuguauaacuucauucaucaacaaacauuaccuucuucagagguuaguuuucacaucuaagacagugagugacuacuaaagcguuuuacagggacuuuaauaaccucucagaauagcugaucaaagugacuuaaauggaacuagugcauuaagacacuugggacuaaagcguaacgugaaauaauuuuaagagcuauggacaaugggguccccuuagaaccuuaaaaauacuauauucugggauuacucuaucucuguuugauuuagggugugguaaggaauuuuguaaguuucccaggugauucagguguucagccaggguaagaguggauagucuagguauucaauuuccugaagguaaaaucaauuuguucucaugauccuuuguacacaauagcaaggaguaaugaagaguuaccaucuaaaauuuuggagaauuaaauguauccuacauuaucuucuguugaaacauccuauuugaauuuguuaaucaacaaugugauccaaaggaaaggaaauuggcauuucuaacugaggaaaaugaaaggggaaaccuuucuuuauuauggcacuaauaaauuaaaaacaagguacaugauuuuuaauuuguuuugccagaaauguguguggaacaauagauuauucuuguacauaaguaaaaaucacaucaguaauucucagcaggauuaaccuaggauuauagaaacuaauuaaaugaguccucucucugugacccaaaaaggacacuugacauuaccuuggaaaguuccaucugucuagggugguaggcucaugcuuaguaaguacuaggaggcaugggugaguuugcuguauccaauugcuuuucuuucaucaugacuucaaaaauaucccauucuuucugauaaauggcauuaauuuacugaaggaaaaaaaagaguguuuuaauggauggauuuauugaaacaacagugagauaauuaugaagcuuucuaaaaguaaauggguaagacauccuuuguaauauacacaggcauauaaaagaggcauuuaaauaugucccaugguuuauuuagacugcccugagccauauggggugguccagacagaacauuaagaaaaagaccucugaaauagcccacccacacucuggagaaaaccaggcuucugguaauuggaagcagcuugacucugcauuccucauuccucugguugagcuaaagugaugcuuguggaucuggguggcuaucaccauggauuauaaaucucugacagaagaucugguacuggguccuggugacuucaggcacucccuucccugguuguagugaucaguuugcaagacuucaucaagccuuuuuuuagggaugaagcccaacuucagacaagacuuucucucacuaucuaucagaaaacagacugacaguagcucugugagaaaccucagguacuagggagaauauacagagcaguaucuuuuauuucuuccaccucugacucuuuaaagagcacucuuagauugcuuaagauauauuucccuucaugaaucugaggauuuuguuuccauagauaugacgugaauggaaaacuauauuuaaugcaggagacaacaauccuaugaaaauuaauuuucacuuccugauauuuucuuucucucuccagagaguagggggguuugaggcucacuugaucuaguuuuaaauguuagccaucagcuccuauauuuguuuccccuuuucuaaugaaaugaaaacaaacaaaaaaaccgaaacaaaacaagaccaaaaaaaaaaaaaaaaaaaaaaaaaaaaaaacccuuaauaguugagcaucuuuaccuugucauuuaauucuggauuucugaaaauuuacaguguagcauaaucucccaaccugaagcagacaugguuucauuucaucaugguuucauuuauucauucuacuaguggaagaauuuugggacuuucagugauuucacacauucaaaguuuuuaaaacauagaucuuguucccaauccagcccuucuacugaggcuaagaacaugagcaucuuucccuccaucuaccuucccagugucuccuuuaggaucugcugauuucaaaggccaucugaauguuuucccaaauaaauaguugucuaacuaacuaacuaacuaacuaacgacagcagucuuaauucacuaguucuucacucagaggauuguuaucaccagaaagucuuugaucacccuccucuaugaaaagguuuauggucuucugauuauucuuccuugucuacucguggcuacuuagcuaguaaaaguauggcugcucucaacugugacuuaaguaugaaauauacacugagccuaaaacagaacauuaaaacaaaguagagguaaaauaagauaguuuauacacuggguaaaugcuguaauuaucugauggggauaugacuaugugauaaaauaugugguuaaaauuaauggacuuuuuauaacuuuaaaaaaugugucuuucugaauauuuaccauucuccagauuucaaugaauucuauguuagugcguccuaaugaaguucuauaugagcaggccuacuagcugaccuuagaccauuaccaaggguugaaaacuacaauccaggaauggcugccucagcacugacccacagacagaugcuuguauacagagaggcuuuuaaugauauauuucuguccuuuuauuuuagaggagaauuuugauccuaaggaagaauacuuugucuaaguugcaccguuauguacuaacagaacuuauauuauagcauacucaucuucccuuauggucuagagaucuuuggcccaauggccuuuggaaauucagagauuuaaaaaaaaaauggcauuuuauacaauugcacuaaugaucuucacaguggcaauauuucacaguuggccaaaaaaagaacugccaauuuauuucuuuaagauuaccauaaauuucuauauuugcuguuugggugaugaaagaaaguucccaggcuaacucaugcacaggagguacacugucaucuuauagguagggugcugacaaacagcuuagggcccaugguggcagcaaagaaacauagucaccuaggucuucagagaaaugagaucacguguucugccauuugcaugguuuggggagagagagaugcuauaguuugacuuuugcuucuaacuaguuugguuguugccuugaucuuauugaaaucugaacaauuggauauuacuuuguagcuacucuaugcuuuaggugccuccuaaccugacuuugcaaggccuuucacuaguuacaaauauuuucugucguuuuucauugaaguucuuggaaaaucugguucccauagccaaucauuugaauacaggucgcccuggccgcaaugaucaaugguuaguuuaugguuuacuugucagaacagcaggaaagguuucaucagccauaccucagagaaggaguagguaaggcauuggagacuauggacaagcuuguuugcuuggaagaggccacaagaauaaccacgguguuacaaguucaucugccaaacugauucugguuguuggaugcuuuguuuguaguguuguuagauccacucauuccucgaagacuuuuaccaaguucuauaauugucuaagcaucaaaaacacacugauuccuauguaucaccgagacccauccagacuugacccugaaugaaugaaggagaaaauaagcauaaagaacacuuuuuauauauuuacuguuugggcccagagggagguuugacuguaugcuuuucaaauuauaaaugaugucacaguaagcuaagcaucuugucauugccacuucuugcaugucuucccucagguaguuuuguucaggaacaagaaaagucagaaguggaaucuaauuuuuuccacauauucauauggaacauuuauucacaguuggagcugacauugcucacaauguuguuucggauauguguugauguauuuuauucauaucaaugaguaaaauuuagaaauauuaagaguuagaaaagcugucucaagaauugaguggagcaugaauaauagaagauauucuuuguacucauuggauauaacuaccuuauugcucaaauaugauugaauuauugugagacaggaggucuuuggaguccuaugaccaugggacccacgaguaucauuuauauuaaguuauguugaaaaugcuaugaaaugcugcauagcaugcuuuauacugcuggccaguauuauaaaaaccagaugacuaagaagagaugaaacuacuauuaccauagcugcuacuacugcuacuauggcuacuacuacuacuacuacuacuacuacuacuauuacuacuacuacuacuuaaguuaaugaaaucuauaaaggauuuaaucagaugguugacuaagcuuugcauaacucucugguuauuaaaugucauuccuauuuccaaaacuguguguggaggcaaaaagugacacuuaucuuugagcuccuguaaaauucuauugaaguuucaaauuaucuucauuuuuguuucuuugcuaugacucacuauaguauuugugucuggcauuugagaauggaacgauauacauuaugauauuuuguguacugcccacuguauauucuguacccaagaaaaagugaauccaaacuuaagucuugcaccaaaugcagaaaucugagauagagaauuacguuucaaccauucuuguaauacuuccuugucgcagacccucugggucccuggucugcgaggaacgggauuacuuaagcagaugggcaaaagagucggaugaaaugacaaucagacacacgcaagagagguguugaaucugaauguaauguucugguugagcuucagacuuauauuacaacgaauuaucagaggauacaaaucacaaaagacaagauacacugaaauucaccaguuacagcagaaaggaauuugcagggacuaauuaaauguuuacauuagggauaacaagcccugccuaggaucagccuaaugccaggcaagaauuucacacuuuaagguuaaaagcaucaggggguuguuaacucuugacaggccuuaagaguaauguguuaucacagagcucuaaauucuuaggucuaguaaaacuuauccugucuggugaguucccccuuaucaggguaguauaucaacuuguacuugacauggaauguagccuguaguaaaagauuucuaucucagugagacuuuuagucucuuucugcagacagcugaguuaauggaaagugcuuuauuguuuuaugguagagcuuaauuaguuacugaauagguuaaacuccuugcugcuaucaggaaucuaagaacacugggaaaaggcuuuagcuauguuagaauucaaucuuaaaaggcauuuacuauaagguaaugcuuaauagagugcacgugaaucuauacacuagacuaaugugguagaaauuugaauauuauggguuagggaaagaaaugccauaacucugggaggaaaauuuccauggaacucuuauucucauaaaacagcuuccaggcuuuucgccugacaaaccaauccaaacuggagaguugacuuucgccagacauccaggaggaaaguccuagaaauucauuucucaugagcagcuuuuuggcauuucugccucacaagcugacuccaccagagugcccugacacuuccucucucccuccucuaugauuuucacagagaaggcauaauuccugugauuugaauugaaagagggaccagcucugcgcugagugaugagaucugagcgcagaauaaaauauucuugaguuaauuugcauaauagaauccgauuaguuacaaagcuguguuuguugaaggagagaccagagucccuuugcucacccacaaggaaaccuugcagauacaaaaauaggauuuugagcucuggugagaaccuugauaauauacuuugcauaauaauaaccugucuuuagcugucaauuagcuugcuagauauaaaaagauugggucagugugucugauucuuccagcucuguggggaggagaaaacugaaaaccaaaucugcuugcuuuuugcuaacuguuuuugucuuucauuuccuacccgauaacaauuuccagcaggaguccaaauauacuuaaacacccauauaugucauuuucuuuuaaggagacaagcaggcucagcagccugcuuaagaaggacucucugcucucuagauagaggggugagccuuccacuuagaacuggugauuuugcaaauccauuuuccugucacacuauuacucuugugacuuucaacaacauuuauuuuuucccuccaagcacugugcucccuucguaaagugaagucuucuuacguguguuaguggaacccugaugcuuaggcauccuggccagcugcuaggaagagcuuuaaugggaagauugccauugggguggcaagugcuuugggguuuuuuauuaauauuaauuagaacauugauagauuucucuaauuauuacccacaucaaggucuccuuaggagggcagccuuuuauuaauuucuuugugagaucugugcuaaauuucuacaguauucaacaguccagucuugagaaguuccaggucuuucuuaaaaaaaaaaaaaaaucacagaauuaaauaaacaaaacucccugaauccauccuuuaaaggcuaccuuuagaaauuuuaagauagagauuuaaggauaagaaaauaaagauuaguuauacuacauuauuacacuuaauauugauaauuuauacucuuguguccaucuucauuucaauaucuucuauggaauauuuucuccuuuacuuucuguucugauuuuuuuuuuaacacuuggucuuagccaaaaggcagagaagcgaugacauuuuuuuuuuuuuaaauaugaucauguauguacucacuucagguuccucagucuugaguuaguaucaagaaaaggcaauuauaagcugggcaguggugguggcacaugccuuuaaucacagcacuugggagucagaggcacguggauuucuaaguucgaggccagccuguucuacagagugaguuccaggacagccagggcuacacagagaaacccugucuggaaaaaaccaagaaagaaagaaagaaagaaagaaagaaagagagagagagagagagagagagagagagagagagagagagagagagagagagaaaggaaagaaagaaagaaaagaaagaaagaaagaaaaagaaagaaagaaagacaaggaaagagagagagagaaaaggcaauuauguagauacugaggcagaggcaucucucuguguuuggucuuucaccuucucuuagagaugcagaauuagcuagaacuggagaggguagaauccaggucugggaucuguuaucccacaggauucaaucccaucuuuuucccuggcauucucaaaaacuuuggaaaaguuacuuaccucugugugcuuuauuccacuugcauauguaauggacaugacaauaccauuuauguuugugugguuuuuguaacuuaagucauggaaaguccacuugaggagguuuggaggauaauacuaaaaauacuagcuauucuuuuuuuuuuaaucacaggucuguuauugcuaucuagccaacuccagacaaugaacuaacauucuucaguuugauaggucuuagguaauauuuuucauuucuuuaugcacuuuaaaaacagacaaaggggggcugaagagauggcucagcaguuaagggcacuaacuguucuuccagaggucccaaguucaauucccaguauccacaugguggcuuuugaccaucuguaauaaauaggaucugauuccuucuuuggguaugugugaagacagaacacucauguagaauagauaaauaaguaaauauuuuaaaaauuaaacauuaaaaaaagagaaaagggaaaagaagguuuuugguguuguuuuguguuuuucaaaauagacagcagaguuagauagucuaggcucaaaucaauuuggcuaucaacagaacuuuauaguggcacaaauuguauuuaauuugucuagaucucaauauuaauauccuuuuaacagaauauucacuguacccauuaauaggguuggcauauuaaucaauaaauuacuuaauaauuaugaagcuuuuagaaugauggcuaauaaacccuaauuuuaucacguuuauuuuacucuaaagagaauaauugacuuaaaauucaaauucuauaaaacaaggguuaauuaucaagguagcuaauauauugaauuauauucagucauauaagcauuuaaaaaucacaagaccaauuaguuaauuuuaugcauuuaguuuugcuauuguuuucaacagaaauuuuauaauguuaucuuuuuuauaaaaagaguaaaguucauuguuuauuggucacauuggaacucuuacuaauuaguaugaaacuagaagguuuuuuuaauauguuuauauaaaguagaaaaguugucauguaauuucagcacuuuagugucagaaauaauugugcuuuacagcaacauggcaacaaaaaaaagaggguagaaauaucaacuuuaauuaaacccuuucuuucaaauacacuucaaaguuuauaugcaggaauaauuuaucaccuugugaaugaacacuuaauacuuggcaugauauaaaaugggcaggaacccuacaccauauguucucuccuuucucuucuagaauuuccaaagagacagaauuaaguuugaaguucaagggugugcuugaucucauacacugaguuguuauggauggccccuuugaacucagguccuaauccauguguaguaaauacaacuaauuaagaagcuaccagucacagcccuagcaucugaaacagaaaagacacuccccacaaucauucaucaaaaccccaaucacauauaagaagauggaagccacugguagaaaauuuuauucaggacuuuccccaauuaggaggcagaggggaacuucagagcuucagguacaaaucagcauugggggccugguguccucaguuaagccagacuucucucuguuguuuccuguggccucacuuuaagaucuuuuccugcugcagacuucacugugcuuuuuccacauagugcucuggacuugccgcaagcagcacuuugugcaucauuaaacugaugcuuuucugggcaguagagauuacucgguggucaagaacauuugcugaucuuacagaggaccugagcuggguucccuucacucauguccagccugucauaaccauauagagcuccaucuucaguggaucugauggauucuggccuugugaacaucugaacucauguacacaacaacagcaacaaugauaagaacaacaaccuccccucaugagucacacacagacacacacacacccuuacauacacagacacacgcauacaccauuauacacuuacagagagagagagagagagagagagagaugucagugugaaucuauaaauauauuucaugugaggagugagguuggugugugacagcaaggcaucuuuugccuuuauuccuucauacugcauuuuacacauuccaaugcaucuguaaacaacaaauacuaaguaaggucuucaacucccuauuucuugagaagagacaggaguaauccuauggagaaguuguauuuggaugauagcagacaccuuuguaucugcagcauguccaaauauuaucuugguguaagaccaaagacuugaaaaagcuaagucagacuaccaagagaaaagggauuugcuaugugaauaagaagucuaccagagccgggcggugguguugcacaccuuuaauccuagcacucgggaggcagaggcaggcggauuucugaguuugaggacagccagggcuacacagagaaacccugucucgaaaaaaaaaaagucuaccagcccucuugugcccaagacuacuaaagccaaauggcuaaguaacucuacuuccuuuuucucugagugcuucccugcccguuuuuuguuuuguuuugguugguuugguuugguuuuugucaucuccaguuucaaggcacaugugcacaaugugguuagcaacagugacaggcuugcauuuugccucccugggaaaaugagaggaaucuagguucucacucuguguuuauccauggguaauggguuaauagagaaugcauguguuuuugagaacaccuggacucuggauaccacccagaagaagcagauauuucuaaacaaggaaagaugaauuuuaagugggaggaguaaucaaaaaauguuauauagggggaaauucaagaagucugggagcuagagggacucuaggucagagaaauacaaggaaucugggaagguaaacuaugccaauggcuccaucuuacugcuaaugaguaggagugugcugguuggguuugaagaagcaauaauaugcugccugcaacagguuaacuguucaauuuuucuucuugugauuggggugagacuggaaagcauccuaugaaaagcuguccagcaagauaggaugcugagcuggugagggaaaugucagaccauaaaagaacaaauugaugcgguagcuguaauugacuucaguagcauuaguagauccuccagugagucaaugggaauuugaccuauuaguugacacuguaguguuaauugaucagcaaaauuuaauuaauugauucacaaagcucaaugaagacuugccuuuuuaaacuuuuucucuauaaauacaguaccuugcuagguugggcugugcuggauggaauucacuaugaaagucagauuagaucaaacuagccucugacuucuuaaaauuucugugauccuucugugccugucuacagagcucuggauuccauaccuguaccccucccacacacauaccuuagucauucauuucuucauugauuauuuucauuaccaucaucauuuccugaggucugccuugucuuuccuuccaucucacagacuaugacauaagauuccucuuauuuuccauuugugcuuaagucuugguuuaugcugugguuggccaacuguaaugguuauggaauucugguguuuuuuuuuuuccaugguauccuaucuucuccauucuuaaaauagaagcuuuugcuuuaguauucaauucagucaccauauccuuuaagcauccucucuuugcugugcuggccucuggcauccuugcuguggaugcacacauaugaucaaugaauaauagaguuucuggguucuagacauuguauuaguggcuuuauauucccauuucucuugaucauugcagcaaccuuucaacgaauauuauucuuaucuacauuucugaaaugagcaagcuggguucagagaaagcugucagcuuucccaaagcugacaagugguaaacugauacucaaaccacauguuugcuaaaugaaaacgaaacaauagguggauggaggcugcagcuaaucucaucucuuucucugcuugcagaagcugacugcagaggugaacaacccuggugugauguccucagugagugaagauacuccauuccagaggaggucacaucugggaggccgccauccaaaagaaagccacucuguugguguaggaagugacagcugcauucuccugugccuacugcauaaccaaaaaugaaggagaacuacuguuuacaagcugcccugguaugccugguauguuugcccuggagcaaugaagccaccugcaucccucuuuccauggacaccaugagaagggcaaggaggggcagaugcugcaacgcuccaagagagguugggucuggaaucaguucuuugugauagacgaguacacugggcccaacccugugcuggugggcaggguaaggcugcuuauauuugauguugaugugucuauaugugcucauuaucagugcagaaggacaugaccaggucaaaacaaaacaaacaaacaaaugaacaaacaaacaaaaaaaaacaagacagaacaacaguaggcaaacuaaugaauaggcgaaagcaagauaaguaaaacuaaaacaaugaaacagaaaaagagaacaagaaugaucuacugucauuaaaaagagaaucauauuauguguauacgcauccagucuucuccuccucauucauagaccaaaccacacugagaaugcuucuaauguucacuuauuauaggauaaggacuccauuuugacuuuggauugcuuuagagucuacuaaaagaaauacugccuuaauuuauugaaccauucuucaacuggaggaauuucuuagacuauauucuaaccccaacuugccuguucccacuuuuauauucccaugucucaccaaucccuuucauccuacuuugcuguuuuacaugucugccucugucauuucauuucguuuuacuuuguaugaggaauuagauuagccuugaauccucaggucuuggcacuaauaccaacuccaaugaaaugagugaauaugugucuuuaggauaggaaugauauuauccauuuugucuuuagguauguuuuugcuauauuuccucuucuaagguuaugcacugcuuauucaacuccauuggaaauauaaauguagagagggcaaaacacauuuggcaaacugacuucuuacuacuuauuaugauaaaacaagagacagucuuuuagguaauauugacacuaguucacaggagauaguuauuuuaauauguacaaauugaagcucuauuauguggaagugguagacagacaguaaaucagguugaagcaauaccugacuccaaacaagcaagaaaaagaggcagccacuuauucauuuaaggaagaagauaaaauauaaugaggaggguaaugaaauuuaguuuauguccuuaacccuuaugaaaaauagaggcaaguaucuaauaaccccugacauugaaguuaaacagaacugauucaauauagagaaaugcaaggacagaugauagagauuccuaguuuugaaccccaaggaugccaacaaguuaucuuugucguuguuuuuauaugaaacaacaguccauuuuuuauaucguuuauuuuuuaugcucaaaaauguucaugauaaucucaacauaacuuagaauuggaaauaaguguuuuuagaaauaauguucuaaauaauuucauucaugugaaaaagauguagacguagucuugauaacauggaaguaggggaaaauaauugaccagcagaauccuguaaccaaagaucugugcuguguccacagaaaggaagaggaaaaagacagccacaguaaagcggggcaacuuagcucaagcaauguguagagcuggguaucaaauugcucugagaaaaugacccucugcuuugucacugucucagugggggacaguguguuuaggcuuggugguggcagggguagagggcuuagugagucagaugacuuugugucucuggauauaaaaaaugucauaugaugcacucgggagaagacgaggaauaaagagaggaagggaacaucuggcaucaucccauguaugaccuugaaaaguaagguucguaaaaggacuuaguuggauggugugugugugugugugugugugcgcgcgcgcgcgcgcgccuguguccauaugugccugcucagaucuggcaaaaucuuccuuuugaaauggagcuaaguaggaggaauaguuggcuuguucacuaacagucugaauggugacguucaagcuugaaugcuugaaaauucccugaaaagguagaauuuggcaaagcacagaagacuuagaguuugcauguaggacguucagccugugucaugcugugcugugcaaagcgagaagcaaucagucuuuggagucaggaacuggccccuugauagcacuugcuguguucccaaacugcuuuccuguagaaccuaauaaauaguauugucaguacaguagaucaucuuugugacagaggaaaacuagggaagacauacccaacuuuuaaaucuuggagggaggagaaacaaaguggaaaugggauaagccggaugcuugguaaaaauuucagcuccauggcuaguuaugaaaugccucuuuuuuguuuuauuuguuuuguuuuuuguuuguuuguuuguuuguuuguuuuuucaagacaggguuucucuguauagcccuggcuguccugggugaguacucuguagaccaggcuugccuagaacucagaaaucugccugccucuaugaaaugccucuuuauguuuucauguguaaugcauggaguuccuuagaaacuuucaguaccuugacauucauauuuauaucauuucuuuuuuuuaugaaaaauuagcauuuauuucuauuagauauuuucuucauuuacauuucaaaugcuaucccgaauguccccuauacccuccccaugcccugcuccccaacccacccacuccugcuuccuggccguggcaucuugugaggcuaugccagugccuggcaaauacagaagugggugcucgcagucaucuauuggauggaacacagggccccaaugaaggagcuagagaaaguacccaaggagcuaaaagggucugcaacccuauaggagcaacagcaauaugaccuaaccaguaacccccagaucuugugucucuauuugcauauguagcagaggauguccuaguaggccaucaaugggaggagagggaggagaggcccuuggucuugcaaagauuaugugcuccaguacauuucuuuuuuuuuaaugauauauuuauuuauuauauguaaguacacuguagcugucuacagacacaccagaagagggcgucagaucucauuagagguagcaguaaaccaccaugugguugcugggaauugaacucaggacguucagaagagcagucagugcucuuaccugcuaagccaucucgccagcccccgggacuuaaccucuaacauuugauacccaugaagcacagagaaagaacaaacaccacaauccuaggcuggauaggagaggggaacacaggccacuaaggaaacugugaacauuguggauauucuauuaguucacugaaauccaucaaguaacuucauauuucccuccacgaauggccaaacucuuaagaauuacaucagucauauugcauuaaaacgguggauuauauuuucuuaccuuucagaagcaaauguuuuccuacugucccugcccgagaagcccugggauacacaaccaaaaugguuguagauuaugccuguguauccaugucggagcugaacuuuuugguguuucaccaaaacucuacaaauaauuaaacauauuuaggaaauuuaaaugauggaaccauuuuaaaaaguaguauauucaguuuuucuuugugaaccucgagcaaacuguguaggccuugguuuuauaauaaugauagaaauuauaaauuauuagucauuaauauuaaauaaaaauuaguuacaaucuuuauuguaguaaaugcuugaauauaaguuuuuguuuacuuauuuauuuuauuuuucugaauuucuauacccaacagguuuaaucgauuaguguuuuuaaaucuagcuaauuuucaauacuagaaggcaaugaaaauaacucauauaauagcauucauauauuaaaauauguaaauuuguucaaaccauguaacaauuucauauaacaauuaaaguaacauuaauauaaaggagguuaaggaccuccgaaaucaugaggacaauaagugagugcauaggguuuauugcugcaggaaaaucaaugaagucuuugaugggcgugggcucugaaacacacagcagaauuugggcagagcugcuggucgaauuggcagcuaaaagaccauaguagauucuugacuccaucaauacagauuuaggccaaaaucaucuugucuaaaggcuuucuggaaaacaugaaaaucccaaggauauuggaaguucuuucaagggucuggggacaacaugucuaucacuuugccccacuguccacuaugaucauagggucauaggagauucuucucccaagaagauaauagcuccagacauuacacucuggacacuagacaguggaucuagaaaaaucugauuaguugaaggauuuguaauaacaaaugccuggacuuguauuuguaguaacaaauauaaguguccuuugaagaggauaucacauggugaauaaggaagcccuuuguaccuagauguugauggagcugcagaagucacaguuacaggaaucuacaauuuauaauauacaauuuauagcccugauuauguaaaauuagcaaagagcuuuuaagaaucuguggaaauaaguuuguauauguauaggcuugaauuauuaucucauaaaggagucauaagaaacuggcaaaaaggugauucauagcugaagcagugaugaaaugggaauaaacacugagagaaauaugcugcauaaaaucaugcuuaaaucuuuuugaaauauauaugugcauuucuucccaaauaacuacugaagcauaugugcaugcauauauuuuguauguaugcauauaugcagucaaagagagaauaagagggggagaacaugaaccugagaauuaaacauuugcaaauccaucagcuucaucauuacccaggucauagcaguuaucuaagacuccauuucucuauucagaaaauggugauggaaaucacuucgucucaugauaugugugugacuguauguaugugcacacauguguacguaguguaacuaucagccuauguguuuuuauuguguuccucaugaaauuacaaauccuacauucuuucuuucuuuucuuuuuuguuuucuagcuucauucugacauugacgccggugauggaaacauuaaauacauucucucaggagaaggagcgggaaccauuuuugugauugaugacaaaucagggaacauucaugccaccaagacauuggacagagaggagagagcccaguacacacugauggcucaggcaguggacagggacaccaacaaaccacuggggccaccuucagaauucauugauaaggaccaggacauuaaugacaacccuccagaguuucugcaugaaaucuaucauaccaaugugccugagagguccaauguggguagguaaguaauggucaccuauucucuuucuaucugguaugucugcagguugacaggcuggugccugcccuucaacccaggaagcagagcuuguguucaaucauuauuacacauuaauaaggaaaaaaugcuuuguuagauucuuaaaaauuaaauaguuuucuuuuccucgcacaaaauaucaugauuauggcuucugcucuuuccaccccucccaguuacuccacacauccccugccauccagaugcacccuuucuuuucugucuccauaguaaacaaucagacuccuaaaagauaaugagaaaagaauauauaagauuaaaaaaagaaaacccuaacacauugaacagaagaaacaaacagaaaggaagggccuccaaggaaaagugcauaacagauauagagacucagguuuucaaauguuuauauuagacuugaggcucuaaagucgacuaucaacuuccuauuagcuaggaagucuggaagggggaaaaaugagauucaguuuagcaaauccugacuuauguucagcugugugaagugacaccauuuaauauuugcucuuccucuguagaagagcaauaacaauuuccagucuucaaagaguaaugauuauauucauccaaucacuagggcauugaugucgaauaaguaacagcaaugauaauguuugcugcuuugggcuucacauuaauugauggcgaacacaccccaguguguuuaaccuccccaugauuaaacuuugcaaagcagucauuccaguugguccuggauaaaugagaaaccgaagcagaaacagaugaacgaauuuguguuacuaaauucacccacaaugcauaaaaggcugccaucagcugauuucaaauaugcuuaaagacacacugcuuugcuugaagauggaacucuaacacaugccucuugguaucauuucugcuugaauuucuagaauguggucuuuugaguaaaucugauucauuggccccaagugaaucuaaaagccaucagggauagauuguucauuuuaccaguuagagaaaaaccaagcaccgauuauaaagauuagcuuacucaagacagucagcugugacuuuagggcucugagagacuccagucuguguguggagccuccugugacacaacugccauugcccuaagaugucuacuaagaugaucuuuuuuuuuuuuuuuuuuuuagauuuauuuuuuauuagauguuuucuucucguuuccucuccaaaaauccucuauacccuccuccuucucuaucuauaucuauuuaucuauaugcauauauauauauauaugcauaccccccccacacacacauauauauauauauguauaugugacuacaacucuuccugcuccccaacucuccuacucccacuuccuggcccuggcauuccccuauacuggggccuagaauccucgcaagaucaaggaccucuccuacuacugauggccgauuaggccauccucugcuacguaugccacuagagacacgagcucuggggaguacugguuaguucauauuguuguuucuccuauagggcugcagacuccuucagcuucuuggguacuuucucuagcuccuucauuggggacccuguguuccauccaauagaugacugugagcauccacuucuguauuuaccaggcacugacauagccucacaggagacugcuauaucaggguccugucagcaaaaucuuguugcaauaguuuagaauacccaauauacaauuuugcagaagucaugaaacucaagaagaaggaagaccaaaguguggauacuucguuccuucuucgaagggggaacaaaauauccauggaaggaguuacagagacagaguucagaacugagacugaaggaaggaccauucagagacugccccaccuggggaucuaucccauaagaucuucuuuuacugagaaaaagccaggcugagucauugucuccuuccuuccuuuuacuuauucuugucuggucccuugacuacacuauccucagaugugaauucuaaugagaagaaaggauggaagaagcagaggaagcuagucauccaaacugauaacccagguggacuuuugcuccuuacaggacacuuuggagacuauggcaguucucagacuuucuacucuacauaugaaauuauugucuuugucaucagaaagcugugugaaccagugcuccuuuguaucccuuccuaauuuaucauuucgucaacuaugaaaucaagauaauaguuacuaaugaguucuggguauauaggucaaauagaaauauuugauaacuccuucaauauuagaauuuuuguuuuagaauuuuaaaaaauucuuaaaaaauagaauuccauuaaauuauaaagauuuauaacuuucuuagcauuccaugaagucuuucucugguauaacacccauuuucuagaauaaucccuacuuuguaggaagacauucacaaaagacaguggguauagaaaauugauuuugaaaaagagugaacauugucuugcguuucucauagaagucacagaaaacccucagaaguaaaggauagcuaccuguaaguuguguaaacagguucuguacccugccaggaggaccucccucccaccauucugcugaaaugucaaaggggaaacuugggcuuuauucuugcuagaugccccugcaugacagauucccagcugugacaacaaacaacaugaaaaggggauuuuaagauguuauauuucucaucccaaaucuucccaaaguaaaacagaugccaaaauguccagcagagaauggaggcacuuuaccuggaauuuaccucagacagugccugacagaggcauccuggauaauugccucuucccuccuucccucucuguugaagcucaacauggcaugucucagaugcuuauugugacaguagagcuuguaaaggaaaaaaagguccucccauuccuuaauccccugauuuucaugucuucugacauaggaaugucuuagaucguauugaucccucacugaucguuucugugacguggauacagacccuaccuacagagagggaaacauguaauuuucaugacauuggggaacagcauucuauagaauauuuauagccacaaauuaauuaaaauuuaguaucagaaguaauuuucuugcaugcaaagcaacagugaaaugauuuguucauugucacagaugggaaagugcccucuuuccuuucaugaaaagccauucuucauuaauuaccauuuauugcacucucaggagagauuuuuauuugauuaugugauauacuaaacagugaauucacaugguucuaggaguauuugacaagaauguucauauuauuuuaaauagcaaaccaaccaggaagaacugugaaaguagaaaguuuccuuuuaaaccuuaguuugaccuugcugauaaaaaagaaauagaagaaggaaacuagagagggaagauuggcagggagaggaguggucugcacuugaacuauaggacaauaagaucauguagagucauugugagcuuccuuacaggucuucauuuuaaaugaaauucuguaaacagcaaugaaauuugcaaaguuuauuggauguugcuaauugcucccccugaccccccuuuauucaggaacaucaguuauccaagugacagccucugaugcagauaaucccaccuauggaaaaagugccaaguuaguguauagcauccuugaaggacaacccuacuucucaguggaggcccaaacagguaugguugauuacaucaucuuuguaagucacgacuuauuuuaaacaaggagucuaugccucgucauuuaacugcuuuggcuuuaaaauuccuuaaauuaaaacggaacuaaagggccacuuggcaguuaguacgagauggccuauguauguucugugcauauggaugaauggaauaauacacauuuauuagugucuaagaugauaauuacaaauauuuaaaauuaaauuuaugaauuggaaaugccuugacuuguggauccauauuaaaaggaucgaagguuguuacaaaguaguguuagccuuuaaaacauccuuggaagaccacuggguaaacuaagaagugucaggaguaacuguaaauguucacccuacuagaagauccagcacauucccaaucuccugcugugagcauagguucccaaaggaugcuguaagauaaagagcagaccaguaaagugagucaguauacaacagaaacuaaaacaauguuucgcuucauuuacacuaauuugauugucaacaagagugaacacuacaguccuauaacauuguucuucugcagcaguauuacacuuuuccuuccuacuuaauauguucuguacucuugaaagguuuucauacaauuugcaacuuuuacaugaauuccuaauuuauuauuuuuuauaugcuuucuuaacucuuaccuaauacauauuaauucauuuuucauauucuuacuucaaacaacagcuuguggaguuauugucuaugguuucauggagaucuuugcuuuuagucuuuggguaaacuaaggauaaaugugggauuucaucuagacuacuuaaaauaguaaaaacucuagucuucuuuuuuucucucagggaaccaaggcuagugacuaacaguuggaacccaugaaacuaaccaauaaggaacaugaugucucauaaguccuaggauguugcaaagaaacaccucaacacugggcucagugaugcugcguaacauagcccagcacuucuuccuugcucuuuguauuuacacuauaaauacugcuuuauucacugaguguaaaagcuuccauaagaucccuagagauguaaguaagcauauuuuuaugaacaucauguuuaaauauacagaggucaugaauauuucaauccugaauuuauccuauuuuucaguaauucaggacaugugauuguccacugaauuuuugcacaaguuuuguucaucuuucuaacuccucuguucacucacucaaaaaauuaauaguaccuauuuaauguguucaaguuuaugccuccucuguaaaccuaauaugagcugaagagauguuucuuuucuuuuuuuuaaaaaaaagauuuauuuaguuuuuauuuuuaugaguacacugcagcugucuucagacacacacuagacgagugcaucggaucccacuacagaugauugugagccaccaugugguugcugggaauugaacccaggaccuccggcagaacagucagugcucuuaacugcugagccaucucuccaaccccauagugauguuucuacuaguuuauguaggacuugauuucugaagcuuuuugcuagaaguccugaaguauagauucagauaugacuuuucauacaauaggcucuugucauuccagucuucaggauucuugugucugagaggaaagacauuguuacuugcauucagagugaaaagaaaacuaauauguuguaaguaauuuuuauuauuugcuugauaauacacagguguuaucuucaacacuuucugcuauguuugccauguuaaaaugacuugucuuugagcaggcuauauuuuauguaucuuuagguucccaggauguaacauauuuuuuuaaaucuugucauaaaugaauauuugugauuuuuaaauuuucguuugauaggaaucaucaggacagcccuucccaauauggacagagaagccaaggaggaguaccacguggugauccaggcuaaggacauggguggacacauggguggacucucagggacaaccagagugacgaucacucugacugaugucaacgacaacucagcaaaguuuccaaagaguaaagagucgaagcuggucuuugauaaugaccacugcucagcgagagccucaucuuuucuuucacuccuaauuuacccagcuuucaaaaggaagagucuggaaauccaagaaucauuuucgugauucuugcaaaaaacuagaacaagauagcaaagacuuaaaaacacaccgaggaaaguuaaacaguauagagaucaugagaaguaaggaagucauuaaaacuguguaacucuggagaccagaauaucugagucuugagauauuuuacuuauuagguauuaaucauaaaaggcagucaucaauuaacguuccucugucucaguguucuucacugaugcuaacagaaccgugaucugaugcuuaucauuccauaaaaaaucucccccacaucuugaugauuguaaguaacaaucacuuauuaguuucuugacuuuauuuuguacagagcauaggagaaauaucuacucuguugucacuccagcaucagcagggcaguucuccuguggcagaaaaacccacuucuaagauuccuuauaagccuggcaaauugagauuagcuugugcuuccucuccacaugggccuuucuguggcugaguucugaucaugagaacuccgugaccauuuuuugagcugauaccagaagccaugggacuucuuucccuguagccuuaaggcugccagcauagcaguaaagcucagccagaccucacaguucuaugagaggaccauaaaguaacauuggaggggccugugggauacgagcuauacuaguauccuuguagaagaugauacccuagcauuuaaccuaaauacaaucuuuauucagauuaauccagcuagugcuaauuuuuauaucauuugaaaaaaaaaaccggcaauaauuguucagccauuguuauuuugaauacuguacaauauuuaugaaguuacugagggaaaauauuauuuggcaguugaggguauauaauucuuuugcagaaauccaugguuagguucuuagcaacaauauuauuggcucugaacagcugaaauucgggccaggaggaccuguagccuucuuauggucuccguuguaucugcauuccuagucacagagccacauagacacaggcauaugcauaccuaaaaguaagauacaucauuaaaauguuuagguuuacuauuuuaauuauguguuuaugagugugucuauaugugguuguuuccuaucuguagggacccacagaggccaggacugucagauuucccugcagcuguaauuaugugugacugugagcugacuugggugggaauaaccaaacucuggucagcaggaagagaaacauacggucuuaguucugagccaucacucuagcaccaaacaaaacaacucuuuggagacagugguauugaaauauugaaauuaaugauagcugcuaauuuuaauaucuggucacuaauguuauaaauaucuaaaaagagccuauguuuuauagauauaauuggcuccuagggaaaggacauugaggggacuaaggaauuucuggaaucauauuuuaguguguaugugcaaagggcaguccagaguuauaacacaaaaauaaugacucugagcuuuccaguaaugacaaaaacacccauggcuccaguuacagagagucugacacacuuucuggucucugcagacacccacauacacauaguguacacucaaagacagacagacagacagacagacagacagacacauagcguacacucaaagacagacagacagacagacagacagacacacacacacacacacacacacaauauaaaaaauaauaaacccaaaggaagucaguuaaguauaccaauuaaggaggcacuaugguuauucaaaguuacccaagauaacaaucuaccaaaugaagauaucaugguagaggauccugagacacauauuaguucuugaggacuccaaaagagaugggucaaccaugcuauuccuugucagauggaaagguaugcaucuuugauaauauugaggcacauacaacauagucaaagcugccuauuccauuugcacaauguacaauuguuccauaugccagaaaaguagguagacagacuuauucauggauguccacuaaugcccuuuuuuauauagagugguauagaaauuuuauauuucaguuuuaauauuucacagucaugggcuugaaugagauuuggagaaaauuacauugcaacagaucuucugaacauuguuauacauuguucauuucuacagaaagucacacucccugugccuugccugugaauacaauacaagauuagguagaaaauggguacaguauaaucacgaaaagaaugcagcacugcagcauauaauagcugcaguagaggaaaggaagagucuaggggaguccccuaaugccagugggcugagcacugcaggagaggguuccuccgcccacgcauagugugucuuagacagguugcuuuucaaaugugucaaaugauggugcuacagcucauuccuuuacugaaaacugucuagugcuuucccuaaauggaacucaacaucuugacuauuuucagcaaugccguuuacaugccuccguccuacuguuauucucccguaacagaagucccacuguacauuuucagaaucuucagaauuugcagccucaccugaggcuuucugacauuuguuguuccuuguucugugacacuuauugcccacauauucauacacuugucuugcucauuuucuucacuggaguucagauuucuuccaacgaaaguuuucugucucuaccuuguccaaaauaaaucccgauuuccuucucaucuacacauacuuaaccaugauagguguccacucacauacauugucauagaaaaacauaucauaccccacucguauagagcauaaaacauaucacacuaacucguauagagcauaaucacauacauaacuacacacucauuuguguagcuuaaacgcuuacacacacacacacccuacuucccuuuaucccuuaccauacaauacuacuuagccuauaacaucauaguguaucuagauauguuuuguuuucucuuuuuuuuaaaugucauguugagaaugauaacucuuccuuuacuuagcuucagagcuaaaagaguaauauaucaucauuugcauucaugagaaauaaauacuguaaacauaaauauaaauagguguggcaccauucuuuauuucugaaaaauauaaacauaaagggaguugacugucuaaaagcuuccagagcauuccaugcuuuaccuaguacaaaggaugaagaguaagaugagagaaauaucucuuugcucaagaaagauucuugaaagauuuguauuugucucuaaaauaaauaugaagugaugaaaccuuuuuaagcaggggguaaauuuacucuucuguggcugcuuuucuuugagcaauuaguucaaggaaucuuuggcauuaguuugugggacacccugaaaaggaagccucagguguuccaguauguggacucuugcauaggaccuugucacuguuuuccuuucucucguguugugggugaccucaucaucuuaccaggaccccaauguuguuuugucaugcuggaaggaacacauugcuccugcaugcuggccaucugggauccucuucccauccauccacuucacuucugcgucuaccaauaaaaaguucaauuuuaaacccuuugagaaauuugcugggauucaaugaaaucugaagucuuacagcugccaaauaaaaaguaaaauaaaaguagaugucuuuuucuuucaggcguguaccagaugucuguuucagaagcagcugucccugggggaggagguaggaagggugaaggcugaagacccagacauuggagaaaauggcuuagucacauacaauaucauugauggagccggcauagaacuguuugaaaucacaacagacuaugaaacacuauguugcugcugcugcugcugcugcugcugcugcugcugcugcugccgccgccuccuagagcuccucauuuagcccccugagacaagccugugguuaguuguuguuagccuugcuacacagacaggaaaccauagcuaggaauuagacacugccugagguuugagagcuugcuguuagcacaauaccaauuccgaaacaggccuuccucacucucagggaagcuucuuaccugccaggcuuuccugcccuuaggccuugugucaguggaacucuuccgggucacaguaauucucuguuaauaaaaguuucccaccgugugggcauucaacguuagggcaggaaggggaugccuuugguuucaucagugguggugugaaagacccacaacgugaggacucccccacguucugacucaggagaggcgacaccccaaaaucacccacaagaaacggucuugcugcaaauugcaagaggauuuuuauucaagagcgcucucgggcccauggucauacaccaagcagggguagaggaccauggcgccccgaguagcuggauuaggggguauuuaaaggaagaaaccacgacuuaaggaugugggaagggcguuguuggaaaauaccaaaaauaccaguuaagagucacaagguaguacaaagucacaggcgucacuaggaauaccugguaauuguuaacucucaagacaguuucuaagagccccuaaggauaguauauuugcauugcagguuccagcaauggucagggugggucagggugacuuucuuugaauguacacuccuugaacccaggaagcuuguggguggaggaaugucucuaucuguuuuaugauuagcauaccuuggagcacugaguuuacuacucuuucaggugcugggcauaaaggcaugggaacuacaccuucuggggucugcccaugcuuuuccaguuccugcauucagaucuuaaucuuauuugcagagcucccuugaucuucucucugaccccgccuccucuguaccagcuuuaggauucacuagcucacccccuggcuccucuuucuucuccuagccaggugugucucccugaugugcuuggccugguguggagcacagguggaguucucccucagugaggucuuggaguugugcaagcaugggaaugaggggugggacacugagggaggaucuucaggguccccagggacuguaugccccacagagucuccaggagugagucccaugccccacucugccuacgugcacucaggaguggggcucccagcauuccucccagccgcuccuagcccacugcugccuugccugggagccaagugaucagcuguaucuuguaugaccaucauuacuacuagcuugucuuacccgccuuggucuugucucccuucccuucccuucccuuccccuccccuccccuccccuccccuccccuccccuccucuccuccccucuuuccaucccuuccuuccaucuuccuccuccuccuccuccuccuccuccuccuccuccuccuccuccuccuccuccuccuccuccuccuccuccacuuucuccuccuccuuuccccccaaauagcccagcaggcugggcacaaacucaugaucuuacugccucagucucucagauacugacuucacaggguuuacacuagucaugccuggcucuugaugcccuuuuguuuugucuuguuuuugccagugugggcugacuacuugguacuccugccugagcuuagugucgcugaagaacagggagcagaucuccuucggagaaguugccugguggcagcaaaccuccccauagucucucugcagucagauuuggcugcuccaaaauuuuccuuuucuucauaugaugcuucugauaacagaagcuauucugaggcuccuaguacaaguccuacugugugacucuguguccuaggcuuuauaacuucucucagauaggauggccuugggaguguggguuagaucuaaucuauuacagcaccaaguauugcuucauguacuugugccuagcuccaacuaagcuccuuccuggauaugucugccuggccuugcuaaacacaguagaucagcccaggguagccauacaugcuuccugccucugagccuuugcccaagcuguccuuugcuucugggaugauuuuccuuccucacugugccagccaaggccucccaacccuuuaaugcucagcccaaaugcaacaccuuucaccuagucuaucugauucccauucccauuggaaaguccucuccuagccccucgccccccccccaacucuaguccucaucuguccaguggcaaagccugcccccagagcucugugaugguuccucuucacuggcaacuugacuagauuuggagucaccuagaagacaaaccucuggaugugacugugagaggguuuccagagagcucucacuaaggagaaaggcccaucuuauauacgggcagcaccagcuuaugggcuggcaucccagacugaauaaaaacaaaaacaaaaacaaaacaaaacaaacaaggaaggagagagccuuuauuggaguuucuggaguucucagagagcugucacucaucgaguugccugugagaucuggacucagucacuccaaaaguagauggagguagccugggccaccagggggaagauccugcaguuaaggaagcccugggccugcugcucucauccacuaagcucuucugcccuggagaagcccacuuguuggagguugacauugggugucauauuucuuuccccuuuuuguuucuuuuuggcacggggucuugcacuaagccuggagcucacugauugggcuugauuaucugagcagugugagccucaaggauccaucuauguccaccuccgaguugggauuaugugggugcugggaucugagcucacguccuuagacuugcauagcaagcaccuuauugauggagccaucucccugucccagacuccuuuacauucagccuaauauguuaccuuguuaagaacauaacagcuuugggcugaagagauggcucagugguuaagagcagugacugcucuugcagagguccugaguucaauacccagaaaaccacaugguggcucacaaccaucugcaauaaaaucugauugaugcccucuucuggugucucugaagagagugacagacaguauacuccuauacauaaaauaaacaaauaaaucauauauauauauauaaauauauauauauauauaacagcuuuauugacuggaagucauauaugaagcucauccuuuuauuauaguauaggauucaguguguguguguguguguguguguguacucacugauccucaguacuuaaagaauacuggcaucaccuccugaagaaucccaaccccucccccagccccuggugguaaucucucuucugucacauggguuuucacacaaauggucucauguuuaugacguggccuuuugugacugguuucuuucacacugcacaauguuuucaagggcuauggugauguagcaugcaucaguaccccuacagagcauggucacuguaugggucuacccuaguugguugguccauccaucagcugauggauaucuggguccuguccucccuuucaccaucaugaguaaggcugcucugaacauggcugugcaguguuuuuugugugaacauuuuaaauucuuccagcacugcagaucuaacaguggauuuacggaaucaccgaacuugcaacuccauuuugaaucuuuauaggcuucaucaaacuauuuucccaagcagaggcuaugauguuucaggaugguguuucucugcuucuucaggaaugcaggcuguuaucuuuuuuauuggacuguuccuggugggcucgaagucucaucucauuuugguuuugauuugcaucucaccagggacuuuucauauguauaugaauaugcauagcuucucugggaaaauagcaacucaaaucaucugccuuuuaaaguuuuaauuggguuguuugcccucucauugcuggguguuaaagaguuugcagggacugagaagguagcucaguggaugaguauuugucuagcaugggagaagccuuuauucaauuucuagcacuggguggcaucagcaucagcggcuucuucuuucuuuuucuucuucuucuucuucuuccucuucuucugcuucuucuucuucuucuucuucuucuucuucuucuucuucuucuucuucuucuucuucuucuucuucuucuucuuccucuuccuccuccuccuccucuuccuucuccuccuccuccuccuccuccuccuccuuuuccuucuucuccucuccuuguccuccuuccuacucuuccuccuccucuuccucuuccuccuccuccuucuccuucuucuaaaguguccuggguguaagucugucauuaaauucauuaaauauguaauuauaaauguuuucaacuaaaccccaagccuuuuaauuguauuuguaguaucucuugaaauacaaaugcuuuuaguuuuaaggaaguccaaauuaucuauuuuugcuguauuuugauauuaaaggggaaaagaaguauuuuucuucccauuuuagguccuauaacagccuauauaggcugagauccuauaacagcgauaggaagauaaagaugaaugcucauuugcuguaaguuucacauugugacagacacgaagaaccaauggcggagggaaaccucaguauuuuagggugauauuugccagaguguggauaguuguaggagcugugguggacaauggagauguaagccaagggucauuaacugagggagucuugccaggccugugcguucagauuccuuucugagucucuccugaaauaauggcccuccuuugcucuucauauaaggagaauacuucuuuuuguuuauuuuaagauagaaugucccuauguagcccaaguuggccuuagcucuugauccuuuugccucuaccucccuaguguugggauuauagccuugcaccagcagacugcacucaggaggggaggccuugcugaugaucuuaugaccuacuucagggagaggccuugagagacccucugcuuaucuuucaaucgccaaagguccauguuuugaacuacagcauccguuggaaggagccacagucucaggaaaugaaggaaagcugugauuguggucuguucucagugugaaucgcccaggcugccaugaaccacugguucagagcuggagcugaccuugugggacugaaccuguaacuugcccuagauaccugguuaccaucagaacuugcuugaauuguugggugugaaguuggugcugcagucugaaaaaagguagaaauaaaaccagucagccucuuucggggcagcccagcaccuugaauuccagaaauuucucccucucuaaggugacucugaaagccuggguugacuagcaacauuggcaaauccugaaggccuaccaggcuuuggcgccagggucccaggaagugagugacucuugccuugggcugcaguagaauuguuggggguggggugggguuggcucuuucccccagcacuagggaagggggugcauaucuagaaauucugaucuacuuagcaugggauggcuggaccucacuggcuuuaaaggucccugcuugugugcgugcuugugugcuugagugagugcguccuagugugcacccugaacuagaucccugcuggggaggacuggccuccaaggucaguccccugguggagaaacaucucugaaugaagaauggcacugaggaggaaggagggggcaauaguccuaaauguugacauuccuucccccaucuuacuauuccuuuauuuaauacaaaaccccgugagauuccacaggaguucauuugggagaagaaaaagaauuuugacgucgccaucuagcggccaguggugagacagacguuucugagaacugagucuaauuuacaaaaggcuuccuuugugaaggaguuuaaagacuggugauugggaugauaaucccagaugcuugcuuagcaugcagaaagccguagguuugauccccagcacuucuuaaaaccuggccaugguggugcucgcuggaaacugcaucacuggggagauaagaagcagggggaucugaaguucacggcugucuuuggucacacaguucaacacgugagccaccugccucagaacaacuaaacggaacuggagauaagggucccaggcugcacagaaaaugauggacacucaccaggagggacagcucuuccuacccucagggcuaacugacauuccuuugacaaacagcuggaggaagggguuggcuuucagaugucuggggagguguauggauuauuccagguguuuagugccucaaggagcuggggccagacaagaguucagaaaggauuucaggacugggaugcuccagggucucacuccaucaggacauggaaaaaccaaaacccuuucaggaggagaaaguggguguugugagccuggguguguacaaaggaagaggugauuuuuuuuuucaauaaaaauaguucgguguggacagaacugauuuaagaacuuguauggcuggagggaaggccugguauggaagucuccaugagauauuugcccuuguuugcuaacauuauuauuuuuauuuugucuaggaucuuuuagccccaaacacacccaccacuuggagggaagcaaaaauuccaaaguacacaguuugggaaacacugaccaguaagaaagucuccaguuuugugccaggagacugugaagagucccucauccuagcuaccuggaagccaguauucugcuagcauccuucagaugaagauguagaacacucagcuccuccugcaucaugccugccuggaugcugccauguucccgccuugaugauacuagauugaaccucugaaccuguaagucagccccaauuaaaugaguguugcguuggucauggugucuguucacagcaguaagacccuaacuaagacaguauucuuuauacugucaggcccauucaguucauggcuuuccacacaguuccaaaauggacccuccaauuauggaccagcucugguuucuggcauguucucagguuuagcugcuuggaacaguucuaucauucaaugucuuccccuuuccacccuucagaaaucagcuauuauuuauaagaaaccuuccucuucaguaucucaugacugcaguccucucucuaguccccaccuccaccucucuccuggggcuucuucacaacccaggccugucuugaggucaaacuuagcugcccucucacucucaagacuccagucugguugccauagugaucugucccuuaugcaaaccugggcacaucacuugcagaucuaauaccccucuaccuguggaaauauuuucccaggacccucagaaccaagggaccucccaccuccaugggaggucaagagggauggggggugugugucagaccucgagggucuuuuacugcagguucuacuuguauggucuuacauggacagaggagagguuuaaaauaaccaagggugcacccuguccuaccugccccuuacuccugcaccccugaagcagggcucucugguggccuugaggcauggaugggguaugggauaaacaugagacagcucccuucucuuaggagccagguuuguuugucuuggaacacuuccugcaagaugggaaacggggaacgacacaacaacugcgcccucuucaggccaagaccaguagguucacuugcacagugaggccuccugcccuugguucaguuaguacuuggcucagauagugagcaggcucccucucuuuuaaaacacaucgcuggccuggaggugguggcgcacgccuuuaaucccagcacuugggaggcagaggcaggcugauuucugaguucaaggccagccuggucuacaaagugaguuccaggacagccagagcuacacagagaaaagcugccucgaaaaacaaaaaaaaaaaaacaacaacaacaacaacaaaaagaauacaguugauaaugcaaaacaaacaaaaccaaaaaacacaucgcugaagagugacaugcacacugugaguuuauagaacuuaaauauaugguucagugggggcggggggaauacauuccuaaucacccggaaguugccugaugucccugccaaguccacauccacacuuucccagccagaggugcgcaggagucggaccaugccgauucuucuugagaguuauggagcuguguauaaacagggucuccaggcccagauccgcuguguacagguucuuucucagcaucgugccugugcaacuucuuuguagugacuguguggauuuuuaacuugcagggaaauacuccauuaugugcuauauacaaugcaaccugguaccuuuuguuuacccagcuuuccguuuguacuugggcuuuuuuucuucuucuccugugugggggcaauuacagauagggcauuuccuacacucagggcuucuguuccaugccuggcauuguccuauuguguuccgguccuggccgucuguccugcuuuccucccucucugggaaccuauuuggcugcugggacuuagggugugugaccuggaccuuugaugguccuauggggucucacacuaccuuggaaggccaagcuguggcucuuagucccuuagagcuguggcucuaagcugugacagucuuagucuggggagacugagacuugcuucaugggcuugcuucucuauucuugcugaugcuaacaucuguggaccaccuuuuagcacugguugcucuugccuaacucuugucugcaucccuuggcugucagccaguugggaggcuucuuguaugccuccaaugaaccuucaaggaugcuucuggaacugggauauuuaucagagacagaucaggaaagccagcaccauuagacaugcagcucugugcugccuuggggacacauucuuggcugucuuuccaaaacguucgugguaugguacugucugucaguauuaacaagcauggguuucccuaaauguuuuuaucuuuguguguguguguguacuugggugcacacaacuaguaguaugugcauuccugcauauaaguaugcauuuauuugauuuguacguuaucauaaaauauuuucucuuugcuaggcaugaugguguguguguauaaucucggaguccaggaggcuggggcagguagguaaaaggccagccugggcuacagaacaagaccgagucucaauaaaacagcacaaaacaauaaauaugagauuucuccuaaacagugugguuuuguuuuaaagguaucuucuccacuuccuuccuuguccccucaaagauguugacuaacaucaaggcaacaccuucuuuguagaugaaagagguaagauccauguuuauucugccccuucccauggcauagccacaggcaacagauaccuuagcuccugccauaggcagggaacaugggcuugagcuauguuuggaaggggcaggaucugggggacccccacuuaaugcuguaggugauaaagugcuuggaagagauggugaaugucuguugaccaugcacgcaaaucugaguuguaacauguuacuuuuagcuguuuugaucuugagaaaacuacucucugugcuucugugucucaaagaagucaucucuaguugcgagggccaauauggcagaugccauuuaccuguggccagagcgcucagaaccugagaccagauuuuaguuuaauuuuaauuaacauuuaaauucaaauugcugugacuaauggcugugauauagaauccaccacuaaaggacagcacuggguggcuucaagccacauacauacacaaccuucccuccuaccccaguguaauccaacguagugaaaauaaauaaaugaauaaauaaauaaauaaguaaauaaauaaagcaagcucugccugcucuuucuuuguuucccacauguauuuucucuuuccuuuugaacuacugauaccaaaggcuaggagaggcugaccuucuuaauggggacacuggagggcagcaauggguacuuucaaaaugcucaaucccaagagguuucccgaguccccuggcagugcuuugcuuguggcugauggccagcagccucaggggaaugccagaaagcuguguuugcugagcucuguccucucuuuccugugcugggcagcgugguggggaggucguggaaguggcggguuggauguuuuacaaacaaguucaaguucucuugucuguugguccccauagcaguugggcugucagcugcucaaaccguuuuguugugcaaccucguuugaaaacgaugugaggaagaauaaacaaccgugaauguggagucaaggagaccugagggugaagcccagcuuggcugccugccugcuguggaccuuggacaaauugcauggcaauucugggucccuga

SEQ ID NO: 4332 - RNA, 4062 nt, Mus musculus
agggagcucugcaaauaagauuaagaucugaaugcaggaacuggaaaagcaugggcagaccccagaagguguaguucccaugccuuuaugcccagcaccugaaagaguaguaaacucagugcuccaagguaugcuaaucauaaaacagauagagacauuccuccacccacaagcuuccuggguucaaggaguguacauucaaagaaagucacccugacccacccugaccauugcuggaaccugcaaugcaaauauacuauccuuaggggcucuuagaaacugucuugagaguuaacaauuaccagguauuccuagugacgccugugacuuuguacuaccuugugacucuuaacugguauuuuugguauuuuccaacaacgcccuucccacauccuuaagucgugguuucuuccuuuaaauacccccuaauccagcuacucggggcgccaugguccucuaccccugcuugguguaugaccaugggcccgagagcgcucuugaauaaaaauccucuugcaauuugcagcaagaccguuucuugugggugauuuuggggugucgccucuccugagucagaacgugggggaguccucacguugugggucuuucacaccaccacugaugaaaccaaaggcauccccuuccugcccuaacguugaaugcccacacggugggaaacuuuuauuaacagagaauuacugugacccggaagaguuccacugacacaaggccuaagggcaggaaagccuggcagguaagaagcuucccugagagugaggaaggccuguuucggaauugguauugugcuaacagcaagcucucaaaccucaggcagugucuaauuccuagcuaugguuuccugucuguguagcaaggcuaacaacaacuaaccacaggcuugucucagggggcuaaaugaggagcucuaggaggcggcggcagcagcagcagcagcagcagcagcagcagcagcagcagcaacauaguguuucauagucuguugugauuucaaacaguucuaugccggcuccaucaaugauauuguaugugacuaagccauuuucuccaaugucugggucuucagccuucacccuuccuaccuccucccccagggacagcugcuucugaaacagacaucugguacacgccugaaagaaaaagacaucuacuuuuauuuuacuuuuuauuuggcagcuguaagacuucagauuucauugaaucccagcaaauuucucaaaggguuuaaaauugaacuuuuuauugguagacgcagaagugaaguggauggaugggaagaggaucccagauggccagcaugcaggagcaauguguuccuuccagcaugacaaaacaacauugggguccugguaagaugaugaggucacccacaacacgagagaaaggaaaacagugacaagguccuaugcaagaguccacauacuggaacaccugaggcuuccuuuucagggugucccacaaacuaaugccaaagauuccuugaacuaauugcucaaagaaaagcagccacagaagaguaaauuuacccccugcuuaaaaagguuucaucacuucauauuuauuuuagagacaaauacaaaucuuucaagaaucuuucuugagcaaagagauauuucucucaucuuacucuucauccuuuguacuagguaaagcauggaaugcucuggaagcuuuuagacagucaacucccuuuauguuuauauuuuucagaaauaaagaauggugccacaccuauuuauauuuauguuuacaguauuuauuucucaugaaugcaaaugaugauauauuacucuuuuagcucugaagcuaaguaaaggaagaguuaucauucucaacaugacauuuaaaaaaaagagaaaacaaaacauaucuagauacacuaugauguuauaggcuaaguaguauuguaugguaagggauaaagggaaguaggguguguguguguguaagcguuuaagcuacacaaaugaguguguaguuauguaugugauuaugcucuauacgaguuagugugauauguuuuaugcucuauacgagugggguaugauauguuuuucuaugacaauguaugugaguggacaccuaucaugguuaaguauguguagaugagaaggaaaucgggauuuauuuuggacaagguagagacagaaaacuuucguuggaagaaaucugaacuccagugaagaaaaugagcaagacaaguguaugaauaugugggcaauaagugucacagaacaaggaacaacaaaugucagaaagccucaggugaggcugcaaauucugaagauucugaaaauguacagugggacuucuguuacgggagaauaacaguaggacggaggcauguaaacggcauugcugaaaauagucaagauguugaguuccauuuagggaaagcacuagacaguuuucaguaaaggaaugagcuguagcaccaucauuugacacauuugaaaagcaaccugucuaagacacacuaugcgugggcggaggaacccucuccugcagugcucagcccacuggcauuaggggacuccccuagacucuuccuuuccucuacugcagcuauuauaugcugcagugcugcauucuuuucgugauuauacuguacccauuuucuaccuaaucuuguauuguauucacaggcaaggcacagggagugugacuuucuguagaaaugaacaauguauaacaauguucagaagaucuguugcaauguaauuuucuccaaaucucauucaagcccaugacugugaaauauuaaaacugaaauauaaaauuucuauaccacucuauauaaaaaagggcauuaguggacauccaugaauaagucugucuaccuacuuuucuggcauauggaacaauuguacauugugcaaauggaauaggcagcuuugacuauguuguaugugccucaauauuaucaaagaugcauaccuuuccaucugacaaggaauagcaugguugacccaucucuuuuggaguccucaagaacuaauaugugucucaggauccucuaccaugauaucuucauuugguagauuguuaucuuggguaacuuugaauaaccauagugccuccuuaauugguauacuuaacugacuuccuuuggguuuauuauuuuuuauauugugugugugugugugugugugugucugucugucugucugucugucugucuuugaguguacgcuaugugucugucugucugucugucugucugucugucuuugaguguacacuauguguaugugggugucugcagagaccagaaagugugucagacucucuguaacuggagccauggguguuuuugucauuacuggaaagcucagagucauuauuuuuguguuauaacucuggacugcccuuugcacauacacacuaaaauaugauuccagaaauuccuuaguccccucaauguccuuucccuaggagccaauuauaucuauaaaacauaggcucuuuuuagauauuuauaacauuagugaccagauauuaaaauuagcagcuaucauuaauuucaauauuucaauaccacugucuccaaagaguuguuuuguuuggugcuagagugauggcucagaacuaagaccguauguuucucuuccugcugaccagaguuugguuauucccacccaagucagcucacagucacacauaauuacagcugcagggaaaucugacaguccuggccucugugggucccuacagauaggaaacaaccacauauagacacacucauaaacacauaauuaaaauaguaaaccuaaacauuuuaaugauguaucuuacuuuuagguaugcauaugccugugucuauguggcucugugacuaggaaugcagauacaacggagaccauaagaaggcuacagguccuccuggcccgaauuucagcuguucagagccaauaauauuguugcuaagaaccuaaccauggauuucugcaaaagaauuauauacccucaacugccaaauaauauuuucccucaguaacuucauaaauauuguacaguauucaaaauaacaauggcugaacaauu

SEQ ID NO: 4333 - RNA, 984 nt, Mus musculus
cgccgccaucuuugcccugugcacuucccaaaccgcuccggcggacacugcaacagacccaaccccaggucugcguuccguccaccauucuaccgcgucccgagcugggcgccuggucauaggcuccgcccaaugcggugccacaggaaaaguccuccuugcgggaaacccauccgccucgcgcccucugguggccccuauaugaaccucaccuuaauggcugaaguaaaagguagauggaagugaguagggaggggcucguuuucccacaggaugaaggagucccgaaaucagauccugcaaauuacucauggucucaucccuuuauuucauuaaguauuuauuugcacauuaauuuccuuuuugaagcauuacacucucuauggcuugaugcucuuccaagggcuguggaaauaacagagauaaaacaaaugaaggaagaugaaauauuguaacuuguuuaggagcccacagcccggaucugggacugagaacaaagcagaacagcccccaggcaggccaaggcagggcuguuguuaaggcauuccuaagaacaucuuggccguaaagaugaaaagguauucaaggacaaauggggcuacauuaucuaagcuaacaccaucuggccagaaucaccccucaaucaggggacaagcagggccaucuuaucuaaaguccacaccaucuggccggaaucuccuuucugucuauuaccccuuagcgccgaguaaagucauauacaucaacugguuguuagauaagucccaagcccaccggaacaaagcucugaugccccuuuuugcugacaaguaaucuuucuguuaaugaaucaaccccgugccuuuugucaaaauuccuuguacucccaaccuuuugcuucuuuaaaaaccccuagcuuccgagccucagcaucgacuccccugccuccggugugagguacgugucgacccagagcucugccaauaaagccucgugugucuugca

SEQ ID NO: 4334 - RNA, 7287 nt, Mus musculus
agagggucaaaagcgggccaccgacacauggauuccgagaaccaugggagguuccagcccuaggucaucacugauguccugaccacacccugauaccaccaaguuccugcuuccccguguaacugccuaagaaugugcaauucuauugccccccucccacugauaauuacuuccccuuuugcuuguauugcccaaccccucccacugauaaguaucuguacuucccccuuugcuugugcauuuaaaccuuggaccuuucucaauacauuggggccuugauacaacuucagaacgguuuccgugucguuauucguacaagacccucgucucucucuaccccccauuugguuauuaggaggagguccccucgagauccucgaauaacuggaccuguuggacgggucaaguggcgcccgacguggagcacgagguacgacugcccuccggacaacggauuaaggauuaaagagguaccgcgcagacugagaaacagugggacaguccaccgacacuucacucgagugucgaguacggacgucgggagguaagccuaggcauucaauuguugucccauuaaccauggggcauuuagugaagagauaaaggguucucuuaaggagagagggauaagaguuuuuuuuaaaaaaggggaauuuaauaaaauauuuuuguuuuguggacaagagauguccauggcugguauuaaaugguucugaaacuuagaauaaaguaggcaaagaaaucaauaguuuaauaaaacaaggagaagauguccaugaguccuuuuuuaguuauuggggaaucaucagagaucuccuugagcaggcagaaaagggcggaaaaggugcucgccucuuugcccuuacugaagauuuuuuagaaaacucccaaucgccaucucgcaaaagcaagacuaagccgccugcgcacaguaucucuauuagaagguuuagcagaaggcuacuugguacccaauaaauaaaauaaaguuauucagucuguccucacuagaggccaauauuuaacuugaaagucagaguuuguggaagacagccuccuggacugcugacaaaaucuguuguuaaggcaauuucgcugcagacauaaaacaauuagggcucuccccugguguccucgcccagaccgcacaagcggcccugagagcuuggcgcgcugucccugcuacaggggcacuaacuaugccccuaaccaagauuauacaagggccccaagaguccuaugcgcaguucguugccagauugcaggaagcagcugagaaaauuuugggaccugagggucuguuaguccgacaacuugcucuugaaaacgccaauucagcauguagggcugcucugagagguaaaaccaagaguuuagauauaaaugguaugaucaagcuuuguaaugagguagauguguuuucucaacaaguuucuaagucuauuaaccuggccauuggggcugcucuaacuccagcuccaagauuggugucaagccccauuggcccaaguuaaaaguagacaucuguguccucacauuggguauagaugccgccuggggcaccccugauuauuauaugccucaauuaacagcgguuaacacaggugaauuugggcccccuccucaaaagacguuuuuucucaucaucggccgaguguccagacuuuuacaaggccuaauggugacuccuacagggguugacaccgacuaccauggggagauaaaaaucuuagucaccgccaugcaggaaccacuuacccuuagggcuagagagcgcauagcccaagccuuaccacucccacuauucagccauuucccuuauaugaaagaggagcgaggaccuuccucccugggauccucggaagucuacugggcacagaaaauaaccgauucauggcccaugccuacuuuguuucuagaggacaaacaguucaaagggcuccuagauaccagggcagaugugacaguaauucccucaacacauuggccugcagccuggcccuuacagcccacuaagggaugguguaauccacugaucauaaaauuuacugcuaagaggaggaacuuagaggcuugagaaaguucucgcucucucaccuggggccuaagauuguaucaagauaacuaugacaauggccugaccuuuaaaaccaucccuaacaaucauaaaggauccauaggacuuccaggcacccgccccccuguuccugccccagggugugcuacgacccuguuucagcccacucucccugcggggaggccccccucuuccacugauuuacuguggucuauauugaaugcuucugcuuuagccuuguugcauaagacacaaagagauaaugcgucagaaucugaagauuguuggaugugcuuuucugcuucccugcacuuuuaugagggcauagccuuauuugaaaauuuuacccugcuuucagacgcuaggcagcuuccccuugagucaguucagcuuaccuugacagaacucucugggguaagaaguuguguguugggcccaggcaugcuucgaggcccuugcuagagauuugcaauaacacauuuauaguaaauaaaaauggguuuuaaagagacuucguaaaggucaaaaaauucauagauuagguuuuauuggaaguuaagaaaucauuuccuaaaacacauauaauucauuuugucaaugguguuuuuguugguugcagaaaauagagagcguuuuuacagauggcuauaaaauauuuaacuaaguguggacugauaauggcuucaaaaaagauuuagcaugguaaacuuuuaggcuauuugagacauuuaguguauagagauuguguguuuucucaaaaauuugcccucagauuaaauaaauuaaaaguuuuagaugcuugccagaaacuguuagaaaauuuuggauuuuaaucuugguuugacaagcuaccucuucuuacaagcaggaaaggaaagaaaggaauaaaagaaaauggauuuuagaacucucccagggacagagagaaauugggggacgcccuguuuuauucucucuggccccuacaggagaagcucucuacccucuuucuauugucugguuggugcaccaaucacgugucaauucauguauguuuucuguuuuguugucugaaugacuguuucguugucugaaugacuggcuguuuuauguuucauguuaaaaagaaaagaaaaaaaaaugguuaaaacuuuaccugcugaaucacucucaguuugcacaacugaggcugagaggcccuucccuuuagccaaaaucaagcacagcaggagagguccugcugaaaaacuuagaaucuacaaccucuuaguucuaaggcaaauaagcugauaguuguuuuuuccuaaaaaaaauucucugcaauuuugugauuauuguguuuagcaaaugacaaagugugucuuuaucuuauaaguauagcuauaaaaaguaaaagucuuuaauugaucuaaauuuauaagauucgugaagccacuucauuugguuuuugauuggucuuaaagguauaaauaugaucuacauaucuuggucauagagaacuggcuuauaaguuauuuggguaugauuaaaaagguauaacacugguuacaaaguuagcuuaaguaauaacuuaaggcuagagucauuuucaaacaaaagcaccuggcauaaaacagcccagaaaacuaguccucuaaagauacuucuaaauugagauaaaauuuuguguaauucuuauccuaaaaaauagacuuauagagauaagauuuuaaaacaaugucucuuuaauaaaacauuaaaauucacacugucaugcauucaggaaugagcagccaaacuucguaacgugauagugauguuucuaguauugauuuuaaagaaaauaaauuguuuaaaauugggucuugcuuuccaaaacuuauagauacauucuaauauuacaacgaaaacuuaaaaauuaugguuaaaauugcuaguguuccauugacugcagcuugcaguuugauuacaaauuuaagaucuuuaauucaccuguauauuguaauuaagauaauuauaagaguaaucauccuuaagaaagaguaucaaaaauuagaggcauagacaguuaaauuguuccucuaaaacugguccuuauuacaggagggccaagaugcucagauuaaaaaauauucuacguuuaaguuaauguagcccagagaagauuguggccuucuuuuauuuugcaaacagugccuaagaaaguuuuucccuguguucaaaaaaaguucuuuuuagcuuuguuacagaucuauucagauguuuaaaauaaugcuuaaauucaaagaguuuuacuuuuagugaacuggugaucacuagauaauuuugccuguagguauggcuaacauagcuuuacaauauguauaaaauuuuuauugucugcuucaauacaagaaacaaauuuuaaaucuuucaguguauauuguuuccuaagugaaaaaaaaaaaguauucuauuagcuaaugccuccaaagagaaguuuaaaguucuaaaaaguaaucguugcuccauaagauuuagaggcaacauauuuuuaauauuuaggauuuuaguuacagaaaaucuaaaaaagaaauuuauuugcuucaaaauuuuuauuuucaaaaccuccaaaagauguuuugucaacaauuuaauguuacacauguuacugagauauuuuauaauucucaaagacaagguauuguaaaacuuuaaaaacuauaccuucuuuaaaaacaaagaagggggagagaaauuauauccccgugcacauuauuuggaucacauauuuguuuuggaaaaacuggauagaauagugucuagggcagauaaaaaggauccacuuauuggcacuugccaugauccuguucagauacuuaauauggggaaaagggggaauguuucuguuuuuuccacagaaugcuacaagagcaugcuagcuuccaaugugacaggcugaccugugaccugugagugccugacaguggugaccaaaaagcugugcugagugcacaaaagaggagaaaucggagagcauccacuuacaaacagauaaagaaacuucguaucuccaccaugcgcugcagcaaggaguaccaaccuggugccaacuuaaaauaaaaacaacuaaaaaagcugacucgugaggcaaaaagacugguacagagauuguacaagaugcuuucgucagagagacacuguuuuuggccacucaggccagcuccuuauagcuaugaaaguuuguguaccuuaccuauaugcuuauuguuagauaauuuuaagaguuaagauugccaaucuuggcaagucuuuuuauauucauuguaauucuugucaauuaacuaauuguguagauccuaauuuagauaaggaaucuacuguuauguuuuuguuagagaccugcuuaugcuuugcugcccauuagaguuagaaaaugauccuugguuuuaaaaaucugaaaaugcaaacuuuaaaagguaucuaccacagcuuuagaucagcagcuacauacugcccauuuuguuaaugauaagcauagggauauuuccauagcuuugucagagcaacauauuauauagauaaaaauuuagaggcaaaagaugucuuaaaguaguaguuuuaguaagaagacaggauauaacauacauuaaggcuagaaagguagaaauuuuagacauagccaagccuugaccgguguuccacuguccuagaaaguccuugagcagaccauggguuuagaauucaggaagaaaguugacuauucagugacauucagaauugucucuggcauuacacuaucacuuuaauaaaagcuaggucauugccuuacacaggaacuuaccaucaacuaggaaaaaggaaguuuaagaccuaaagaggaaccagaguagauacuuagaacuguagauagcugaguuacacccauacacaaguauuuacaauggccuagagggaagguagacuaccaaaacugguuuuucaaccucccccuggcuuucgaccuuguugcccucccuuuugggaccccuauuggaauuccuauuauugaucuccuucgguccuugggcauuucagaaauugaccugauuuguuaaaucucaaguugauucaucucuuucaagcgcauuuguuucaguucauuaccauuggcuagacguuggugauaacaagcagguuacuggagaagaggcagauggugauaacaagcagguuacuggagaagaggcagacaaggauaccgcuucaucacccucuucucggggagagagacucaauuuccauaaaaugcuuaaguaagaucauucaccucccccuaaauucggccaucagucucaugccacaaaucauuuauagauugccguagucugugcuuuuccgacaugguaauauacguucucgccacauuggaaacuaaacagucaucccaggcuagacacaucaaaaaauuaaaacuuaaagccgucgcccgugagaguuguaagacuaaguacugcacagagauuagucuagaagcuguuggacagucucugagaggcaugucugauugcauaaagguugagugccccagggaccuuuccccagaaaaaaacggcacaggagcaggucaggguuacucuggguaaagaucugugggccugagagucaauccuguacauggccucuaacauuacacacuggggaucagaccucuaccucuacccacggagcuugcuucauuccuaauucccuuggcuagcccaaguuauauccaaaagacuggaaccauuaauucaagccuuauagaugacuuguccuuguguccuuccugguuuuagagaaucauccggugagcaaacagacguuuaggugaucuuuaaaaacguggcuacaaauuuauuauacaauaugccuuuauaaaaauauuaaaacgggggagauguugggagccauuaaggcaacgcuauuguccugaucucugaauugggccucuccccccaagaagaaaagagggucaaaagcgggccaccgacacauggauuccgagaaccaugggagguuccagcccuaggucaucaccgauguccugaccacacccugauaccaccaaguuccugcuuccccguguaacugccuaagaaugugcaauucuauugccccccucccacugauaauuccccuuuugcuuguauugcccuaccccucccacugauaaguaucuguacuucccccuuugcuugugcauuuaaaccuuggaccuuucucaauacauuggggucuugauacaacuucag

SEQ ID NO: 4335 - RNA, 611 nt, Mus musculus
uacuaugaaugacacuuuaucagucauuuucuuuacaacugaaacucugggaauuccgaauuaacauccuugccugugggcuucuuguacacaccagaaaaaguuccaaccuugugcuccuaguuguucugcugugcuuugucuaaaugaacuuuuaugagccggcugccauccaguuucacacagauccucuacccacaauuucacuugggaagaccaagucugcugucaugcacuacugucagggugugguuucuggggcgcuucugcuuauuuuucauacggauuuuccagguuggcuugggcagaauccuccucugagcaaugaacacuacuugcuucccacugaauuuuuucuccaauucacgaacuagccugacaugaauuuucuggaaagacuuaaagcugaggaacugguacaaaaauuaugguagcuuuccgaccaccaccaacuucaauuuccuugguuguggugauguugacuuccugcagcagagccuugacaucugcguucaucuccagcucaagcagcaccugagagaugccagacuuggaacucauccggcuucuccccauuuggcuucacagucuugucacuggagcugaacaug

SEQ ID NO: 4336 - RNA, 4027 nt, Mus musculus
agagcucugcaaacaagauuaagaucugaaugcaggaacuggaaaagcaugggcagaccccagaagguggagcucccaugccuuuaugcccagcaccugaaagaguaguaaacucagugcuccaagguaugcuaaucauaaaacagauagagacauuccuccacccacaagcuuccuggguucaaggaguguacauucaaagaaagucacccugacccacccugaccauugcuggaaccugcaaugcaaauguacuauccuuaggggcucuuagaaacugucuugagaguuaacaauuaccagguauuccuagugacaccugugacuuuguacuuccuugugacucuuaacugguauuuuugguauuuuccaacaacgcccuucccacauccuuaagucgugguuucuuccuuuaaauacccccuaauccagcuacucggggcgccaugguccucuaccccugcuugguguaugaccaugggcccgagagcgcucuugaauaaaaauccucuugcaauuuucagcaagaccguuucuugugggugauuuuggggugucgccucucuugagucagaacgugggggaguccucacguugugggucuuucacaccaccacugaugaaaccaaaggcauccccuuccugcccuaacguugaaugcccacacggugggaaacuuuuauuaacagagaauuacugugacccggaagaguuccacugacacaaggccuaagggcaggaaagccuggcggguaagaagcuucccugagagugaggaaggccuguuucggaauugguauugugcuaacagcaagcucucaaaccucaggcagugucuaauuccuagcuaugguuucgugucuguguagcaaggcuaacaacaacuaaccacaggcuugucucagggggcuaaaugaggagcucuaggcagcggcggcagcagcagcagcagcagcagcagcagcagcagcagcagcagcagcagcaacauaguguuucauagucuguugugauuucaaacaguucuaugccggcuccaucaaugauauuguaugugacuaagccauuuucuccaaugucugggucuucagccuucacccuuccuacuuccucccccagggacagcugcuucugaaacagacaucugguacacgccugaaagaaaaagacaucuacuuuuauuuuacuuuuuauuuggcagcuguaagacuucagauuucauugaaucccagcaaauuucucaaaggguuuaaaaucgaacuuuuuauugguagacgcagaagugaaguggauggaugggaagaggaucccagauggccagcaugcaggagcaauguguuccuuccaggaugacaaaacaacauugggguccugguaagaugaugaggucacccacaacacgagagaaaggaaaacagugacaagguccuaugcaagaguccacaugcuggaacaccugaggcuuccuuuucagggugucccacaaacuaaugccaaagauuccuugaacuaauugcucaaagaaaagcagccacagaagaguaaauuuacccccugcuuaaaaagguuucaucacuucauauuuauuuuagagacaaauacaaaucuuucaagaaucuuucuugagcaaagagauauuucucucaucuuacucuucauccuuuguacuagguaaagcauggaaugcucuggaagcuuuuagacagucaacucccuuuauguuuauauuuuucagaaauaaagaauggugccacaccuauuuauauuuauguuuacaguauuuauuucucaugaaugcaaaugaugauauauuacucuuuuagcucugaagcuaaguaaaggaagaguuaucauucucaacaugacauuuaaaaaaaagagaaaacaaaacauaucuagauacacuaugauguuauaggcuaaguaguauuguaugguaagggauaaagggaaguaggguguguguguguguaagcguuuaagcuacacaaaugaguguguaguuauguaugugauuaugcucuauacgaguuagugugaagaugggguaugaucuguuuuucuaugacaauguaugugaguggacaccuaucaugguuaaguauguguagaugagaaggaaaucgggauuuauuuuggacaagguagagacagaaaacuuucguuggaagaaaucugaacuccagugaaggaaaugagcaagacaaguguaugaauaugugggcaauaagugucacagaacaaggaacaacaaaugucagaaagccucaggugaggcugcaaauucugaagauucugaaaauguacagugggacuucuguuacgggagaauaacaguaggacggaggcauguaaacggcauugcugaaaauagucaagauguugaguuccauuuagggaaagcacuggacaguuuucaguaaaggaaugagcuguagcaccaucauuugacacauuugaaaagcaaccugucuaagacacacuaugcgugggcggaggaacccucuccugcagugcucagcccacuggcauuaggggacuccccuagacucuuccuuuccucuacugcagcuauuauaugcugcagugcugcauucuuuucgugauuauacuguacccauuuucuaccuaaucuuguauuguauucacaggcaaggcacagggagugugacuuucuguagaaaugaacaauguauaacaauguucagaagaucuguugcaaaguaauuuucuccaaaucucauucaagcccaugacugugaaauauuaaaacugaaauauaaaauuucuauaccacucuauauaaaaaagggcauuaguggacauccaugaauaagucugucugccuacuuuucuggcauauggaacaauuguacauugugcaaauggaauaggcagcuuugacuauguuguaugugccucaauauuaucaaagaugcauaccuuuccaucugacaaggaauagcaugguugacccaucucuuuuggaguccucaagaacuaauaugugucucaugauccucuaccaugauaucuucauuugguagauuguuaucuuggguaacuuugaauaaccauagugccuccuuaauugguauacuuaacugacuuccuuuggguuuauuauuuuuuuauauugugugugugugugugugugugugucugucugucugucuuugaguguacgcuaugugucugucugucugucugucuuugaguguacacuauguguaugugggugucugcagagaccagaaagugugucagacucucuguaacuggagccauggauguuuuugucauuacuggaaagcucagagucauuauuuuuguguuauaacucuggacugcccuuugcacauacacacuaaaauaugauuccagaaauuccuuaguccccucaauguccuuucccuaggagccaauuauaucuauaaaacauaggcucuuuuuagauauuuauaacauuagugaccagauauuaaaauuagcagcuaucauuaauuucaauauuucaauaccacugucuccaaagaguuguuuuguuuggugcuagagugauggcucagaacuaagaccguauguuucucuuccugcugaccagaguuugguuauucccacccaagucagcucacagucacacauaauuacagcugcagggaaaucugacaguccuggccucugugggucccuacagauaggaaacaaccacauauagacacacucauaaacacauaauuaaaauaguaaaccuaaacauuuuaaugauguaucuuacuuuuagguaugcauaugccugugucuauguggcucugugacuaggaaugcagauacaacggagaccauaagaaggcuacagguccuccuggcccgaauuucagcuguucagagccaauaauauuguugcuaagaaccuaaccauggauuucugcaaaagaauuauauacccucaacugccaaauaauauuuucccucaguaacuucauaaauauuguacaguauucaaaauaacaauggcugaacaauu

SEQ ID NO: 4337 - RNA, 4027 nt, Mus musculus
aauuguucagccauuguuauuuugaauacuguacaauauuuaugaaguuacugagggaaaauauuauuuggcaguugaggguauauaauucuuuugcagaaauccaugguuagguucuuagcaacaauauuauuggcucugaacagcugaaauucgggccaggaggaccuguagccuucuuauggucuccguuguaucugcauuccuagucacagagccacauagacacaggcauaugcauaccuaaaaguaagauacaucauuaaaauguuuagguuuacuauuuuaauuauguguuuaugagugugucuauaugugguuguuuccuaucuguagggacccacagaggccaggacugucagauuucccugcagcuguaauuaugugugacugugagcugacuugggugggaauaaccaaacucuggucagcaggaagagaaacauacggucuuaguucugagccaucacucuagcaccaaacaaaacaacucuuuggagacagugguauugaaauauugaaauuaaugauagcugcuaauuuuaauaucuggucacuaauguuauaaauaucuaaaaagagccuauguuuuauagauauaauuggcuccuagggaaaggacauugaggggacuaaggaauuucuggaaucauauuuuaguguguaugugcaaagggcaguccagaguuauaacacaaaaauaaugacucugagcuuuccaguaaugacaaaaacauccauggcuccaguuacagagagucugacacacuuucuggucucugcagacacccacauacacauaguguacacucaaagacagacagacagacagacacauagcguacacucaaagacagacagacagacacacacacacacacacacacacaauauaaaaaaauaauaaacccaaaggaagucaguuaaguauaccaauuaaggaggcacuaugguuauucaaaguuacccaagauaacaaucuaccaaaugaagauaucaugguagaggaucaugagacacauauuaguucuugaggacuccaaaagagaugggucaaccaugcuauuccuugucagauggaaagguaugcaucuuugauaauauugaggcacauacaacauagucaaagcugccuauuccauuugcacaauguacaauuguuccauaugccagaaaaguaggcagacagacuuauucauggauguccacuaaugcccuuuuuuauauagagugguauagaaauuuuauauuucaguuuuaauauuucacagucaugggcuugaaugagauuuggagaaaauuacuuugcaacagaucuucugaacauuguuauacauuguucauuucuacagaaagucacacucccugugccuugccugugaauacaauacaagauuagguagaaaauggguacaguauaaucacgaaaagaaugcagcacugcagcauauaauagcugcaguagaggaaaggaagagucuaggggaguccccuaaugccagugggcugagcacugcaggagaggguuccuccgcccacgcauagugugucuuagacagguugcuuuucaaaugugucaaaugauggugcuacagcucauuccuuuacugaaaacuguccagugcuuucccuaaauggaacucaacaucuugacuauuuucagcaaugccguuuacaugccuccguccuacuguuauucucccguaacagaagucccacuguacauuuucagaaucuucagaauuugcagccucaccugaggcuuucugacauuuguuguuccuuguucugugacacuuauugcccacauauucauacacuugucuugcucauuuccuucacuggaguucagauuucuuccaacgaaaguuuucugucucuaccuuguccaaaauaaaucccgauuuccuucucaucuacacauacuuaaccaugauagguguccacucacauacauugucauagaaaaacagaucauaccccaucuucacacuaacucguauagagcauaaucacauacauaacuacacacucauuuguguagcuuaaacgcuuacacacacacacacccuacuucccuuuaucccuuaccauacaauacuacuuagccuauaacaucauaguguaucuagauauguuuuguuuucucuuuuuuuuaaaugucauguugagaaugauaacucuuccuuuacuuagcuucagagcuaaaagaguaauauaucaucauuugcauucaugagaaauaaauacuguaaacauaaauauaaauagguguggcaccauucuuuauuucugaaaaauauaaacauaaagggaguugacugucuaaaagcuuccagagcauuccaugcuuuaccuaguacaaaggaugaagaguaagaugagagaaauaucucuuugcucaagaaagauucuugaaagauuuguauuugucucuaaaauaaauaugaagugaugaaaccuuuuuaagcaggggguaaauuuacucuucuguggcugcuuuucuuugagcaauuaguucaaggaaucuuuggcauuaguuugugggacacccugaaaaggaagccucagguguuccagcauguggacucuugcauaggaccuugucacuguuuuccuuucucucguguugugggugaccucaucaucuuaccaggaccccaauguuguuuugucauccuggaaggaacacauugcuccugcaugcuggccaucugggauccucuucccauccauccacuucacuucugcgucuaccaauaaaaaguucgauuuuaaacccuuugagaaauuugcugggauucaaugaaaucugaagucuuacagcugccaaauaaaaaguaaaauaaaaguagaugucuuuuucuuucaggcguguaccagaugucuguuucagaagcagcugucccugggggaggaaguaggaagggugaaggcugaagacccagacauuggagaaaauggcuuagucacauacaauaucauugauggagccggcauagaacuguuugaaaucacaacagacuaugaaacacuauguugcugcugcugcugcugcugcugcugcugcugcugcugcugcugcugcugccgccgcugccuagagcuccucauuuagcccccugagacaagccugugguuaguuguuguuagccuugcuacacagacacgaaaccauagcuaggaauuagacacugccugagguuugagagcuugcuguuagcacaauaccaauuccgaaacaggccuuccucacucucagggaagcuucuuacccgccaggcuuuccugcccuuaggccuugugucaguggaacucuuccgggucacaguaauucucuguuaauaaaaguuucccaccgugugggcauucaacguuagggcaggaaggggaugccuuugguuucaucagugguggugugaaagacccacaacgugaggacucccccacguucugacucaagagaggcgacaccccaaaaucacccacaagaaacggucuugcugaaaauugcaagaggauuuuuauucaagagcgcucucgggcccauggucauacaccaagcagggguagaggaccauggcgccccgaguagcuggauuaggggguauuuaaaggaagaaaccacgacuuaaggaugugggaagggcguuguuggaaaauaccaaaaauaccaguuaagagucacaaggaaguacaaagucacaggugucacuaggaauaccugguaauuguuaacucucaagacaguuucuaagagccccuaaggauaguacauuugcauugcagguuccagcaauggucagggugggucagggugacuuucuuugaauguacacuccuugaacccaggaagcuuguggguggaggaaugucucuaucuguuuuaugauuagcauaccuuggagcacugaguuuacuacucuuucaggugcugggcauaaaggcaugggagcuccaccuucuggggucugcccaugcuuuuccaguuccugcauucagaucuuaaucuuguuugcagagcucu

SEQ ID NO: 4338 - RNA, 807 nt, Mus musculus
acugcggacaauuuauugagaaguggacaucaggccccagcaucaguggccucagugcucauggaagucuuguccucuggggucuccauguucagaggcagcagaguguguacauuaaaugacccuuucugcaggucccauuaaugcguucucuucuugugcagccucuuuuucuacaauagcaucccagaucucucaacgcuggggacacaaaaagaaucaggcauuaagauuugagguuggcgcaguaugugauccuauggggaucugugauaaagcaugagagugcugcuuuggucacaguacagccuucagcauggacaucucaaccaauagugcaguucagggguguuacuaguccuguucuagaagcaacuacucagaguauuggagcagucugauuguugaacuuccgauguguaucuuuuuauaguaaaagccuuaugagaaagaaauuuuauuagaguuacuuuacacucguuguuacuguuauaaauauaaaaggaauuaaaauagaguugcuaagggagccacauuacucuaccaggauucuagggcucaucuucaucacaaucucaggagacugcaaguguccaucacacugagcaccaguacucacauucuucuugaagaucagagccuucuggauuuccaaaggagacagacauagccugcuccucuuccucuggcugcaccucaguauuagucucuucaucuguuuuuuggauaggaucagccuggacuuggaaggccagcaggaaaagggcagagaggaggacaagugucuucauggcugggagucaccug

SEQ ID NO: 4339 - RNA, 3452 nt, Mus musculus
gucacaugacaaauauauucuucauguuccuagugcuaaggggcaacagaguuggaagguguggccuugguaagugcuggcuccagaacaacaauuguuguuguccaaaacaacaaucugugagucuacaaucacagaucaagucugacuucacaucuggggauacagagaucauaugaaguacuuaguacuuggaucagcaggacagaagaggucugggcaagauaugugcugggugaaauggcuucuccacauugauaauuacugacagcagcaugagcaaucaggaucaauauaaauaaauaagcaugguaagcauaaaacuaaagacuaagccccacuugucuucauuuuugugagcuugccauuacauaaauaucuaaacacacaucuccauuuucuaaaauauaauagacauaauuaaauaguccaagacuagccauuuagaucuugaagaaaacacuagcuacuaauucucuuuauuuauuuguucccauguuaguuacaaacaaaucuuugcagaaagaaauugaucuguauaguucuugcuguucaaugaggaaaauaaagaaguaauaaaguuaucccgucccgcgggauucaguuauucguaguuucgaggaggacugaaaaccuggaaggaaaugggaggaagggaaggagaggcaggagaccaagaagaugguaccuaucaaggucuccuuuauuaugcugcagugccuucuuuuaaagcauacaucacagggaauaggggaggggucgagggggaaauuuacaaagaacaaaucagcaggcaucuacugacaugggggcugaagucaggugccaggcagcgggcacucugcaucuuaucucuagaacauagguccuccuugacagccuuaggugucaggcugggcucagguguaacucauguccuugaauggcauggaaguucaggaagagauagggaagaggggacuauaauugagcuuuuacagauucagguaccaggaagggaauaggaaggagggagugauaaccagcuccuagaaggaggacauuuggccuguuagggagauugugaagggcucgcuuucucacaggauggucucugacaucucccccaucugaauuaaauuuaauaaggccacacauaauugaggugaucauauaaucuuucucauucuugaaugagugggcauuaccauggcugggggggacauugacccgauuccucccaugggugcugucacugacccacacuuguggcucuugguaucuuuuggggaggggaagcagagccuuagaaaaauucacuugcaacugaaacuagauaccaaccuccauccaaaccggguuugucucucagguaacucagaaaaggucuauauggaccuuccccugcaauucuuagcuugcaccuaugcugggcccauuccggauucauauuuaucaagaaccagcaugcacaguucugaguucugugcagcucccauaggagaauugucaaccucagacucaguaaggccucuacaagaauuaugccaauuguaacaccacaauuugugacucuuaagcuauauuaggagcuggaggucaagcuuccucaucccuauugucuucaaagccugaggaaccaaggggaccucgcauuagcagcaaagguggaaaauuggagaccaguugcucuuuuugccucagugggaggaggauccucuuagucugagucuuggauauccagcugaugguaguggacugcaaccggguuacuuaaagcagcuucaaucugugacuuaacaaaacugguuaauuuucuaaaggcccaggggccaagagaaaaagcagcaaaauacccaugaaagaucccgaaaugcugggaaguaagguggugacucaaggagaaguagaaaaccaauuuuuauaccaauauucuuguuucucucuguuguguuuucucucuucuaaacuagcucuaacuuugucuaugcuaucuuuuuuuuaugauauauauauuggguauuuauuucauuuacauuuccaaugcuaucccaaaagucccccacaugcucccccacccacuccccuacccacccacucccauuucuuggcccuggcauuccccuguacugaggcauauaaaguuugcaagaccaaugggccucuuuuuccacugauggccgacuaggccaucuucugauucauaugcagcuagagacauaaggucugggggguacugguuaguucauauuguuguuccaccuauaggauugcagaucccuucagcuccuuggguacuuucucuagcuccuccauugggggcccugugaaacauccaauagcugacuguaagcauacacuucaguguuugccaggccccggcauagucucacaagagacagacauaucuggguccuuucagcaaaaucuugcuaguguaugcaauggugucagcauuuggaagcugauuaugggauggauccccagauauggcagucuccagaugguccauccuuucgucucagguccaaacuuugucucuguaacuacuuccaucguuguuuuguucccauuucuaagaaggggcaaaguguccacauuucaugcguuuagcaaauuguaucuuauaucuuggguauccugaauuucugggcuaguaaccacuuaucagugaauacauauuuugugaguucuuuugugauuggguuaccucacucaggaugaugcccuccagguccauccauuugccuaggaauuucauaaauucaaucauuuuaauagcugaguaguacuccauuguguaaauguaccacauuuucuguauccauuccucuguugagggucaucugaguucuuuccagcuucuggcuauuauaaauaagacugcuaugaacauaguggagcauguguccuucauaccauuugggacaucuucuggauagaugcccaugagugguauugcuggauccuccaguaguacuauguccaauuuucgaaggaaccaccagacugauuuccagagugguuguacaagcuugcaaucccaccaacaauggaggaguguuccucuuucuccacaucuuugccaccaucuucugucaccugaauuuuugaucuuagccauucugacuggugugagguggaaucucaggguuguuguuauguuacuguuaagaauauaaaaggaauuaaaauagaguugcuaagggagccacauuacucuaccaggauucuaggccucaucuucaucccaaucucaggagacugcaaguguccaucacacugggcaccaguacugacauucuuuuugaagaucagagccuucaggguuuccaaaggagacagacacagccugguccucuuccccuggcugcaccucaguauuagucucuucaucuguuuuuuggauaggaucagccuggaccuggaaggccagcagggcaagggaagagaggaggacaagugacuucaug

SEQ ID NO: 4340 - RNA, 3113 nt, Mus musculus
uggagucugagugcccuuucuaccagccaugaggacucucugcucucugcugcugauaugcugccuccuuuucucauauaccaccccagguaagccugaggaccuucagcaccugcucaggacauggagaugcagaaaacugaagcagggagaagaugugauccuggcagggauuuggaccuauucaggagcagacccaaguccuaugccugacauggaggaaagucuuguagcaaagggauucuucuucaucuucagugaagcuccucacacacacacacacacacacgccagcuucugguccacagacaggcauuuccauacucacccaagucacuaagaggucuuccccaugugcccugacucagggcaugugccaccacuccugcaacagggacugggacuuucccaaagcauguucaagcagucaggguaguauucuauucccugagggaaugucuccauuguuuaauggguacuucuuguccagcuuagaagaucccacaugcucugagccaacacaaucuaucucugacucaggagcaaguggguuccaguaaaaagaaaugaaagauauauuuucccagucuguuacuucuguugauccagaucaagucacaaguuucugguucuuacuuccuucagcugaacagugaaguuauuacagaaaucgaagauaugaaagucuauggauaacauuaguauacuuuucuaaaaacauccucucucucucucucucucucucucucucucucucuaccuaucccucccucccccucucucucucuuucuuuauguguuuguguguguguuuguuuguguguguguguguguguguguaagagagagcaccauagaugcucucucuagguggguaugagcacugauaaugcucuguguaugugaguguauaccaaugauacucgcuggauaugucuaugagcacugaugaugaucuuuguguguguguguguguguguaagagagagagagagagagagagagagagagagagagagagagagaaccacgaguguucucucuaggugggucugugagcacugaucaugcucugcguaugugacuauacaccagugauacucucuggaugugucuaugagcacugaugaugaugaugaugguguguggguguguguguguacaccaaugauacucucucugaguuuuucugaguaaacugcugaugaucucuguguguguuugugugucuauaggcacugaugaugaucuguguauguguuuguguguaugugagaacugauacagccagaggaagcaucauuggugcucacagacauacccagagauaacaucaucagggccuuuuguaguccucagagcagaaaagaugucaaugcaagagaucugucuacugcucagcaggauuaacagaaguaucucuaaacaaacucaaugucugaucacagcagacacccacagccaugggaugcugcaguugugaggauagagucauucacccucacagguagucuccuuggauugggaaaaugaaaagcaguaagaggauauucugagacucuuuccauggugaacugcaaacugacuugucaacuucugucugaugccauacuguuucuguauacuacaauacagcucugaacuauacauggaagggauaucaaagccccuacaacauuguucuuucugcucagaaaugcuuucacuguuuuuuuuaguccuuuacauugucauaugaacuuaaggauuguuauguuuucacuauuccugucaaaaauguucuuuggacuuugguaggaaugccuugacucuguagaucaauuuuagugugguugccuugggaaagggcuuuguaucauuaguaaguaagcugacacacaaauauggaagaccuuccuaccuccuagugucuuuuucaguuccuuucuucaaugcugaagaucacucauugucaugguuuuuaacaucuuugaauaaguacauaugagccuguacauauuuuagagacuauugcuuggggcucagcaacuuucuagacagcaaacuugaacaaacaaagccucuucucuuggcuggugauaaauacauaaaauuccuuguauauucuuucugccaaucaauucagauuagugucugauauaaauagcuuauuuaaugucaauuacccguaaauaccuaucuccaaaaacaaucacacucuauaauccuaaaggauuugaauuucugagcaggaauuuucagagcauuugugucagcccauaaauuaccagaggguauguguaaaauuaccacuugaugguuaccagguguaucacagaguaauuuuuuuccaucguggaugcuguugaagauuaaugucggauauauuuuauguguacugugaugucucacagaaggcagaauaaguaugaauuucugaaaccuaugaaaauuucccaaggcaaccacgauaucagaauagcacuaaugaucauaagguuugcuagaaauuguggugagaagacuggaaacuuggaugggagucagaaggaccaaucugauuaaagaggagaaaaggggcacuucagaauaaguuccuggugcaguaaugacuauaguguuaagaaauauuguauauggcaucuuaggcacaacuguaauauggaauaauauguguauuggggaagaagcgagagucuaaauaucaaacauaaaagcuacacucauaauucugcuucucauucuuccaaaaugugugauuucauuacccgucuucaagguucaauuccaagacaauugcuuggaagagaaaauugucccaugaacuuaaacauguuaucuaucuaucuuguauccccaaaauguucuccaauauuuggcauuauagcuaugacucuaaaggauauuuacucucuccuugcagcuguuggagaucuaaaacaucuuauacucaaagcacaacuuacacggugcuacaaguucggaggguucugucacuauaauauuuguccugguaauagcagguuuaugaguaacugucacccagagaaucuccgcuguugcaagaacauaaaacaauuuuaaggaagcacauggaagucaagugacagauguguaacugauuuuuaauaaag

SEQ ID NO: 4341 - RNA, 1061 nt, Mus musculus
uaaagaaauguuuccuuuauuaaaacaucaguuacacaucugucauuuggcuucuaugugcuuccuuccaauucuuucauguuuaugcaacaguggagguggucugggugacaguuaccuauaaacuugguaugaggaggacacauggaauuguaacagaacccuccgaacuuguagcaccgugcaaguugugcuuugaguauaagauguuuuagaucuccaacagcugcaaaggagagagcaaauauccuuuagagucauagcuauaaugccaaauauuugagaaacuuuucuggauacaagcuagauaacaugucuaaguucauggggcaauuuucuccuccaagcaauugucuuggaauugaaccuugaagacggguaaugaaaucacacauuuuggaagaaugagaagcauaauuaugaguguagcuuuuauguuuagacucaagcuucuucccaaauacacugacuacuucagcuuacuauugugucuaagaugccauauacaauauuucuuaaugcuacaggcauaacugcaccaggaacuuauucugaugugcuccauaucuccucuuuagacagaugggucccagucccuguugcaggaguaguggcacaugcccugagucagggcacauggggaagaccuuucagugacuugggugaauauggaaaugccugucuguggaccagaagcuggccucugugugugugugugugugugugugugugugugugugugugugugugugugugugugugaggagcuucacugaagaugaagaagaaucccuuugcuacaagacuuuccuccaugucaggcauaggacuugggucugcuccugaauagguccaaaucccugccaggaucacagcuucucccugcuccaguuuucuguguccguguccccaguccugagcaggugcugaaggcccucaggcuuaccuggagugguauaugagaaaaggaggcagcauaucagcagcagagagcagagaguccucauggcugguagaaagggcacucagacuccagagagucagugacuacagcaggacug

SEQ ID NO: 4342 - RNA, 922 nt, Mus musculus
gcagcacaguagaaugcaggaaacagacagcugauucuucagucccagcugaccagcauccaucaucucagcaaagacaagguaucguuuuuuagugguucucguaucuuguuagucauaauggauucuucagccccacuuaaccagaaccacagauucuuaacucaaauggccugguaguaucuuugcuucccucugaaacaucacaagccagguuuccauccucugcacugcucgcaacacucguaucucccaagcucccacagaacgguucacugagcucucaacacucaaugacuuuuguaacccaaaguuccucaaaacagugugaucaggucugucacaccaguaacccacuccugacaccaacuugucuuaggguuucuauugcuaugaucaaacaccaugaccaaagcaacuuugggaggcaaggguuuauuuggcuuucccuuccauaucaguguucgcugaagucaggacaggaggccauggaggagcgcugcugacuugugcuuuccauggcuugcucaggcugcuuuuuuauagaaugaagaaccaccagcccaaggacggccccacccacgaagggcuggacccuuccccaucaaucacugacugagaaaauguccucaggcuugugugcagccaaucuuacgaagacauuuuccuaauugagguucccuccucuuagaugacuucagcuugugucaagcugacauaaaaccagcuggcacagacgggauuugugcuuuccaccugggacgaugcagcuucugccacagcacauccaagaugguucaagauacagcccaaagacaauucaagacaagccuccuuucgguuaggcguuuggcuccucccacccuggcuccuccccaugauuacucuuuaucaucuucuuaaacuuuugccuucucuuaaa

SEQ ID NO: 4343 - RNA, 14271 nt, Mus musculus
ugacgaaggcgaggucguccgguccgcugggucucggcccgcgcuccccgcccgacucccggaacagcccgagcggagcggagcggcucggcgcggcggccuccgcaccucagcagccgccgagcgcccgcccgcccgcucucccgcucgcucgcccgcccgcgcgcggcugcgucaccgccccgcccccgucccggccccgccccgucccguccaguccgggcccagccgcgggcugcgagcugcugcgggucagaucccgaccugggugucucugcgggcggagugagcggggcggcugcagcgugccuaggguccccggagcccgcagagacgccggcgggagcgugcggcgucccgucgcgggaggacuguccuguaugucaccuggaacagauugcacaggcucgggggaggggggcggcggcuggaggaggccagguuugggcgucagaucugugugccaccucugcgccucccguuccccgggucccuguggccuugggaucucagagccaccacugucaccuguuauugaguugcagugcgucaaagcaggaugggugcaaaaagaaaaaaaaaauuacucgaacguguacugcgcaguccacaggccucagcuaugcuccguccucuaggauggggugaaagccugugaccuuguucccgucuguuuuaggaccucaaacgucgcagugcuucagagagucaggagaaugaaucuuccccucaugguguuuggguuccguuguuagaaauuauguguagucugaauuuccgugagagaguaacaaaagucccacgugagaggcagaaaauagcauuccaagcgagguggcagguucuagaacggaguggacaaacuuuaaaacuuaggauaaugucucaugauuaccugaaaaggauuuugucacccaaaaggaggucagccuuaaacuaaaucccgauggaugcguuuuuugaugucaugaucucuuaauaugcguguuuaaccugcagcuuaaaucagcuccaucuagcuagcaucuuucuaaugcaauaauaguuuaaacauuacaucaccggacagcugagggaagaugucaguuuucccauaagagcccagaaugucacucucagcaucaaucuacuagagcauuaacuugccugaaaugaaccaaccccuggacauuuuacuuuagacugaaggggaaaggcgcauauccucacacuugguuagguuacacaaagugcgugggaggcgugguuaaaguaccuccaugucugcacuguggacucugaacucuccauuccugacucuuccaaagcguggccuugauggugucaggacuagcaggagaggccuagcuucagugcagacccuuuaaacugugggucuaaggaaacucauccacccaggaccuguggagcagcgguguuauugcauacuauggaugguuuuauagaaucuguuuugccauccugggucagcaaugguuagaaaagcuuuuucuaaguaugauuaaaguguaauauaguaggaagccaucaaucucuggguagaaguauauuauucacaccauggcagguggacaggguugugucgaaaaccuucgcaagaaauuaaccggguucagauccacuaggcauuaggaaacauuguguuaauuugucagguaaauaauuggcacucacuccggauccuaguggccccugccuuauugaucacugauucuuuccugauugguuaacucguaguucugagggcuaugacuguuaacacuuuauggucugugcucucgguaccaucuccagucacuuagguuuuaccaaauaugaucauggcuauugccauuuuaggaucguggcauuuacaacggucuaaagugccacagguuaaaggcaguuuuagcauuuggucuuccggaaaucuccgucuaaaauagacugacuacuauaaaucaaaaaaagucagagaacccugaaauugggguuaaaagauaagauuugaacaugugacucugccaccuauccuauucuucccacacgaccaaaagcccaucgcuacggccauuaauauuugggaguuaggucuacccaaauaucuagauaguaaaguuuuacgucuuuuacaguuaaauucuguucauuguuccuugaccaaaauauuuuuacaagaccaguguuuauaccaauaccuguagccugccuaaaacugccugaauuacuuucagacaucccuuuuguguucaacauggaggaagaacuuugcccucagggaaaaauucagcucucaaacaggaauaagaaaccuuuauucuuuugcuacacuuguguuuaucaccccugcucucugugggaauuucuccaaagaaugugugauuaugacuacguagcaaagucacuuuuaaucucauuacuucuuuuuagccagauucaguaaaccggccaagcuugguccagcucccgauggacaggcauguuggaagguacaggaugagcagcuagugugcgccuguucucuucuagguugaugucgugagagaggcugcccucagaaucccagcccuugucugggucuauguuuggaaggguuucauucccguuguuuucaucugagugacugcuacaguuuggaaacuucaguagcauuucaaauucgguucuuuuagcaauauuuuuguaucuuaacaaacagugauaauagugugcucugugccuuuuaaagauuuauuuauuuuauuuauguaugugaguacacuguagcuguacagaugguugugagccuucauguaguuguugggaauugaauuuuuaggaccucugcucgcuccggucaacuccgcuggcucagucccugcuggcuccggcccaaagauuuauuuuauuauuaaacauaaguacacuguagcugacuucugacacaccagaagaaggcgucagaucucauuacaggugguuguuagccaccaugugguugcugggauuugaacucgggaccuuuggaagagcugucagugcucuuaccugcugagccaucucacgagccuuagacucuagaauagacuuagacucuauaaauacugaggaaaauugaagcagggucauaguguaccaauuuaggaacugcaggcuagcuuaggguagagagcaugcuuaguauauguauaaccugaguuugacaccccccagcacccccaaaaauacaugcaaggaaugaauggcaugcaucuacuucaaaauguaaagucauucuuagcucuaggccaugcaacaguuagugaccacagcuuagccaacccugccuucucuucuuccuuacaguucccauggccggaaguuauggugugauggcugaugacgguucuauugauuacacaguccaugaagccuggaacgaagccaccaauguuuacuugauaguuauccuuguuagcuuuggucucuucauguaugccaagagguaaguaaggguauauaagauacugcucaucaaagcagucuggugguuguuguuuuguuuugguuugguuuagcagaauuaaguguauuaaaaaugucucuucagaaaucuuguuccuggauggagaggugcuguccaugugggugcuggugacaggaguuugauuugaaaaccccauacucaguucugggugacagaccuguugcucuaaaguuugaugcuagcacuucuaaaauaccugucucugucaccagcuuugauacacugucuccuuggaaugagcacacuuuaaaguauuuuucacccaagugucugaaaugcaaagguacucugaugcccacguaguuagcagaccucuccucaccgguuugaccuaucccuugcuucuuacgcacagcacuuguacuaauucgcauccuaauugcuuuaagaccaggauggaaagcagcuugcagaggagagcguucguuucaguuuacaggcccaggagagcauucguuccagcuuaaaggccacaguccgugagugcagucaguacaggaaccccagacaggaaccuagagucagggacugaagcagagagcauggagggacacugcuuauggcuuguucuccaugacuuguccaguuugcugucuuccgcacccugagaccgcccacccauagugagcugggcccuccuacagcaguuauugaccaggagaaugccccacagacuuaaauaccggccagccugauagcagccaguccuccacuaagguccugucuucccggugacccagcuguauaacaaguugacuggaaaccagcacacuacuucucuguucuuuauuuauaaaaaugccaguuccuugagaacaagaaauggggcuuuuaucuuugugucauugauaagccacuugguccaaauucuuaagagacaauuuuucugucuuaauuucuaguauagcuuaauuuaaauacuguuuuaacucuuccuggcuuuguuccccucaauccagcaaacaauaauagaaguaauuaugaugguggugguggugguagugguggugguggugguaguggugguagugcugguguggugaugaugauaauguggugguggcaguggugaugaagaugaugaagaugaugaugaaggcagagguggcuaagguguauuauaaagaggaaaaucaguauucugcuuguagguauauacuuugggacauucucuacugagguuuaaaaagucauuaaguaauucauaauaauuaauacuccagaaaucguuucuguuuggccuuagauaucccucuccuauuugugcuugcccuuguugccugguagcucucucucaguggcuggauugugggcgugguguggguggaagaaggcgccacacgucaucacggauccacuugcaugugacaacuuuucucucaaaagagcuaccgccuccuucccacuucucuuuuaaaagcagagaugcaugcucuuguuucuaaaacaauaucccaagaaacugugucauuaaagaacaguuuuauucacgaauuuuccaagcuaaggucugcuuacaucagggcuauuccccacugcagugauuugucucuaucugggugucguggaaggaagaagaauggcaucguccucgucuguauacuguggcuuuaauacgccauuuucccuaggagcugaggggaaucacaaggaaagguccucguuuugugguccuuccuuuguggcgcgauagcucuacacagagagcuuucuauguuuguggagaucaggguacuuuacagggaaguuuuuaauucacacuuuuaauggaucaugagauaaacauacauguauuaaaacaaacccgcauuguuuuuguguuuuaggaauaaaaggaaaauuaugagaauauuuagcgugccucccacagaagggauguugucagagccaagcuuuuaugacacagugagcagaauucgcuuaagacaacaaguggaggcgcaucccguuuguaagugcauuuugugccaaguuguagacauaauguguugaacgcagauucugugccaaguuguagacauaauguguugaacgcagauuuucuguugcacuuaguuaacaaaagguuauaaaacauggcuauuuagaagaacuuacuuuuccaacacagauuuaucucaacaucauggcuguuugauccuuugccuuccuguugugugaggccucucugcggccuugagagaugaucauacucuuacaggguuugcagugauggagacugcaaacaccagucgauaccuccauuucuuccuccucuuacuucucccgcuuugugcucacuugggaugacauugaaauggucaaacaacugaacaccaaaguaguauacaaauggcuuucaggaacucugagaucaaggugcaaggccagaaguuauauuugaacaauaugaauacacccuaugguucuaaucacuggaagaaauggaaaaucugccucguguacacagaacaaagaaacaaacguuaggcaguauagguccagaaucaacugucuguacauugaagccuuuugugauaucugagagaugaaggccuggcuuccauggcacauuagggaggacaagcaagaugguguucaucuuagaacuccaggcucaucucagcuguccaccugauggaguuuagagucacaaaggaaacagagcucugggcagguccugggggacuuucuagauuaggccaacuuaggugggaggauguugucugaagguagcacggcaucauggccugcgcuaaagccaaggacagggugagaaaggagaaagcuggcuggguccaucgguuuuagacugaggacgcagugugcuugcugcucgucgguaccacugugugucccugccuugauggacuguguccuguaacuguaagccacaguacacuccgcuugucuucagugaguuuugucagguauuugcuguggugguaaggaagugauacuuuguuguaaagucaagcaggcagcacuucuuuuaucuucucuauauaacccaaguguauacguauaugcauaaugcaagugcuccgagggugauagaggcacagagaugugccccagcuuacugagcucacacaccuguugauugccacuuggaguuucacguagaaggacugggagcugcuuuuuuguuuuccguugaggugguguauugcgguuuuuauuuuguucuuuuuuuuuuauuuuaguuuaaaaaaauucuuucuugaggauuuuauucauguguaaaauaaaaugagaucauauuaugagacacagugguccucacuucauaauaagaguauugggaccgcagaguagguccggaaagugagacaggcuuauuuuggcaucgcggaggcaugguaguaggcugaacagauggggaagaaggcuggcauacuggcuugucacaaagcagagaugcccaucuuuccaguuguguguuuuuaguuuuuaguuuuuauuuuauuuuauuuuauuuauuuuuuauuggaugaauucuuuagggagguaaaagcuucccaguauagaguauuuccccucaccaaauuccccaucccguugggucaggacguagagccauaucuaauaucuggggcucaagguucccugucuuuugauucauggcuccauuauguagcaggucacgaaauaugucagcucuuagauggcccagagcuccuagacaagccggcaccagcugcuaaggaggaaggugggccaugggccuugggccucucuguucucugaugagcucuaagugcagcuccugcugaaaauggaccguaaugauucauuucuuaaauucuauucuccuuuuaaaaaguuuauuggucuuauuuuuagguuuauuuuaacucuguaaauugcucugacauuuuugacucucucauaguauugauggucuggucuggucuggucugguguguaaagcauuagauuauguugcuguguuuggggcaugugcuugauaauuguuguuuuaauggguuuuuguuagcacuugcacacagggaauguuaucacuguacuguaguuaauauuucuucaugcauauuaacuauaauuaguugaucauggcuauaguuacaguuacaaagggaaguuggcaaugaagccuucagccuuuucuaucucuacagucugaaauggaccaucaauuucugagcuuuuuguuaauucuguggcaaggguaauuaaccucgcuggucucugcugacucgaggaucccaccuugacuuccucugugauagacuguagacuaagcugaagaauccauuccuuuuucuaauaguccccuuaugucuuuuugacgugcugaggagaggccagggaacggcagaaguccacccagagguggggcagggugcggcuuugacucucagaggcuucucccuccaaauagagcaguccugggauacggaccaccucccagacugugaggaacagucuccguacuucauaauaagagcaguggagucucaggagcagcaaaagcaagacacucuauuuucaguuugcggaaacugggauccagccagcacagaaggcaaaagucacugugcuuccuauuuggcacaaaacaguggcuugugugucccaugucgcgguucuuugcccuuuuaauucuuauuggcugagcucuuuagagaaauacaauguuccuagugccuuaguauugcucuuuaccccacuuccccaucagaccgguuccagacacagccuuauccaaugaauaucuugaggcauucuuuuaaaaaaaaauuauuuauuuauuuauuucauguaugugagugcacugucacuaucuucagacacaucagaagagggcgucagaucccauuacagaugguugugagccaccaugugguugcugggaauugaacucaggaccucuugaagaacagucagugcucuuaagagccaucucuccagcccccaucuugaggcauucuuaauccucuccucucuuuguauaugggcucagucaaguggcaaucucccuguuaaguuucaacccuacacaugcaggugcaagccaccaucuaggaaagguaagaugucggugccuccugcuuaucuggauucucugcugagaucugaccacaccucagacugacaauggaccauaacuaguuccucucucuguguaccgccauuccucuccaacaccgucagcucccucgguaccgccucccgcagccucaaguucucuucugaaguacaaaagcccaaccaagccacuaaguuagguuacugccgacuguaugcacauggguaugggcucuccauuagagcauagguaacccugcaguggcuagucucucaaagagucauugauucucccucggccaaccagcuauuaacugcccaugagaacuccugccccaugugugcuugaguuuuaguugacuugucuuguguaccuucugggcagguaaucccugccacggaguucaugaguucaacagccauguuauuuccagaagacauuaucgcauagcgcuucccccacccucuguucuuacggucuuucugucuucuccccucggauguucucugagccuuggcagcgaagggagaugugucauuucauaaggauggagccagagagacagcucagugguuaugagcacuggcugcucuuucuagaagacucagguuugaaucccaggacccauauggugguucauaaccaucuguaacuccauuucaggagaucuauuuucuucuuuuggccucacacacacacacacauaguucacauacacacacacacgcagauaaaauacccauacauauuaaauuaauaaauauucaagaugucccauuuaagcacuaguuaauuauucucaguucuuugggggcaguuaugacuuccuucacugacugcugccugcugccacgugaagauucuguaaccagggcugacuguaagcauaaauuguuaaaaggcaaugugacacccugaccaguuagcaaaaacacaaucagguucuaucucagggccuauggucuccucagccauggacuuuugaucagguuuacaguaccagacauaaaauagccaccugucaaguagaccucaccucaaagcagaaagugguuggucacucauacuauccaggccccuagugccccgguggauacaucuugccuggcaugucaguauauuagcaugcaggguccaacaaggggugagaccauugauggcuuuucugccccagaagcaugcauaaugucuucgagcacuaugaaagcuaacuaguagggaaaauucauuccagucaguuugagacucaucucuguuucuugcagccugagugugguguucuagcaacugaguuuuugugugugguuacauugaguagccagggacaucagcaacaacccaugcuuuggagacaucuggggcgaauuccccugugagggguaucugaugcccuacacugcaguuuuuguuuaauaacucauauauucugggggcaucauugucuucccaugugggguaccuccguucaaacguuuucuuuuuuacaaucauauuuugaaauuaucuuacuaacuaguauguuuuuauaagacuauaccauaauccugugguaguuuaaauaugcuuggcccagggaguggcauuuuuaggagguguggccuuguuggaauagguguggccuugcuggaggaaauaugucacuguggggugggcuuuggaagccagucuucuccuguuugccuuuggaacaacaauguagaacucucagcuccuccagucccaugccugccuggaugcugccaugcucccaccuugaugauaauggacugaaccuaugaaccuguaagccugccccaauuaaauguuguccuuuauaagaguugccuuagucauggugucuguucacagcaguaaacccuaacugagacacauccuuaguguuggucagcccgcccacugcccccuucuuucauccacugcucugcucucguccccgccuccuuucaugcgugcucugcuuucuguccagucauaguucugguuggacugagacucgagguuuccgcgcagcuuuuccuauucuccuucuuuaugcuaacccuucuccauccauucugcuccuccucucagcccugcuuacugccacuccuaaugcaucguccccagaagagacuuuguaguucacugcuucuaccugugccccaagcuaaacacacaaagcaaaacauuuacaugugacauuugucuuacugcgccugaguucccucacuauaacuuuuuuuccguuuccuuaaagaguucaugauuuuguuuuucuucauuacuaacaugcagucuuguaaguguaccacauucccacugucgaucuguugauggacauguagguagauuguguuccauagcuauucucagcagagcggcagugagcauggaugggcuagugugucuguaguaggauaugaaguccuugggugcaugcccaggagagcuguaaccggguccuaugacaguucuauuucuagcuucuuugagagucguggccauaguuggcucccgccaacuguguauaagaguccuuuagccgcauccauuugucauuuguaccccugacaguggccacucggacugacaugagucagaaucuuaaaguaauuugaauuugcaauuccuuaaucucgagcacuuuuaaagcauuuacuagcuauuuguaauucuguuaugaguucugcucagucucauagccuguuuuuacauuggauuauugauuuucuuaauguuuucuuuucuauguucuuuguguguuuuagccacuaauccugucagaugaauagauagcaguuguuuacuuacacucugugggcugccucugcacuugauuggcaguuuccuuugcuguauaaaagucucaugaggccccauuugucauuguucaucuuccuugugccgcaggagucugauucagcauugucaucugugucuguaagcugaggcacacuucuuuuuccuccagcaguuuccgggcaucauguuguauguugaggaccuugaagucgaguuuugugcagggugggaauuaaggaacugguuuuacuugucuccacauugaaagccaguuuucucagcaucauuuguugaagaugcuauuguuuuguuuuguuuuuugaucccauugucguagguaggguugccguugcugugaacagacaccauaaacaaggcaacucuuauaaaggacaacauuuaccugaggcuggcuuacagguucagagguucaguccauugucaucauggugagaagcacagcacugucuaugcaggcauggugcaggaggagcucagaguucuacaucuuguuccaaaggcagacaggagaagacuggcuuccaggaagcuaggggagggucucaaagccuacccccauagugacacacuuccuccaacaaggccacaccuccuaaaagugccacuugcugggccaagcauauucaaacuuccacagcuguuauauguuuuuggcauugucaaaaauucagugguuauagguguguggacuuguagcuggguccucaguucuuuuuuuuuuuuuaauauuuauuuauuuauuuauuauauguaagcacacuguagcugucuucagacacuccagaagaggacaucagauuuuuguuacggauggcugugagccaccaugugguugcugggauuugaacucaggaccuuuuugaagaacagucggugcucuuaaccacugagccaucucaccagcccccggggguccucaguucuauucccuuggucuaugcaucuguuuuugugccaguauagcacacuguuuuuauuacuaugacccuaguuuaguuugaaauuagauacgguaauauguccuguaguauucuuuuuuugcucaggacugguuuugaaaucccaacauguaagcuguauggcuuaagaaucuguauuuacccuauguagcauuaacaagaauaaugucucucuuagcuagauacaacuuaaaaaggaagaaguugcaaguuuuaaagcuaaauaauuuaaugacauucacaaaucuuuuuagcucuaucaucuccggguucaccuuaagauaguuuuucuuuacuaaauaguuuuuaguaagaagaauuguguauuuguuuuggcuucuagugaauaguggugaccuuuauguucaauaagucuguaggcuucuaaguuuaaauacaguaaaaaagaagaagguguugauaucaaagugcugagguaaguuauuauugagaacucaguccuguggggacagcgaccauugaggaaggaagauaagagccagagguuaaagaagaacugcaaaauaguguuuuccagaugugacagaaugcugcacacaugcacucacagcgacugggguugcuuauacaagaucaagccagucagauuccaggcuggauggguaaaggaugcaugaagcccuggcagaggagauagugacagcuacugguugcugagguagaguuaguuucuuuuagggaaauggccccuaguagguuacagcggguggccccacuaccaugcacaaacugaaaguacuaguuggacuuugugaguuuaaaaaaacacacacacauuuggaaaggaaaaugugcagugacgaaagagucugggagaagacggguggaagaacaaaagcuauaaucagaauacacuguaugcaugcauauggauggauggauggaagucucaaaguaacaaagaaaaauauauuuaaaaguagcaauguguaguaagaaagaaaauuuaaaauugugauagcuuauucaauuauuucuuagauuuuaaaguucagaaugauccugauaguuaaauaauaauuauaaauauaagaucuauauaaauaguguugaaauuggaaggucuuagaauauaauuaucuuccuguggagaaaagcagauguuuaauuuuaacuaauuucuuaccaaguaucacuauuuaaugugacuuaaugacauuagcucauaauuauuuuaugcuucaucuuucuccuuauuauuuucucauagcaagaaaguaugaguaucaacagccacaaagccaggccgacagugugcagcucucauuggaauaaaacuucagacugagcaacagaagugaaugugacgaaguacgagaaacacguuccucgccccucuauaagcucagcccaguugugccccucccccaagccugcuuguguugcuucuucugggacuuccugcauaagugcaaaaaugcuuagaaagaaaaugcuuagugacuggagauggggacuuauccuuuugaagaucaaugaugacuccaggauacagugaaaaauacaagcacaucuuuggaagcaagaauccuagaguuaaugucucuucagaauauuucuacagcauuaaaacaugauauccuagcuguugggguaguuugcucuuaggacguggucuauaaugauauuuaacaauuguagcagacuaauuuguguugcuuccacgauuguuccuggcucuuugagucaacuuuacuucaagacuuguaugacacacaaggaccuucuaggcucuucagugucaugaagguuaucccaucugcugccuguggguacuuucuguaucggguuugucucccuuuaauugcauccccaaaaguuguuauuuuguuucggaucccacauuucccuugccuccauaugguuccugggggccauccuguuagacaaggagacaucucugucuugcucccuguugcuguggaugguuacagcagugucuucugcugcuuaaagcuuugcugaaaacccag

SEQ ID NO: 4344 - RNA, 92919 nt, Mus musculus
cggggcggugacgcagccgcgcgcgggcgggcgagcgagcgggagagcgggcgggcgggcgcucggcggcugcugaggugcggaggccgccgcgccgagccgcuccgcuccgcucgggcuguuccgggagucgggcggggagcgcgggccgagacccagcggaccggacgaccucgccuucgucacuuccugccggcccgcgguuuccggagggaacgagaagccagguuuuguuauugguuuuucuuccuucccucugugcgggaucggagcccgacgccgcggcggcaccgcgugccgcguguggcgggagccgagcgcagcgcggugcagcgcggcggugcgucucuccgcgcgccgcggcccgggucggcgcgggcgggaagcggcgggcucaggccggagggcgccgaggcuccuccgcgguggggcggucucggggugucugcgcgugcucccgggacgaagcuggcuggcuggguucucggucuccucaucuucccggcugugaggccgaggcgacugcucucucgcaucuuugcuugaauggcuaggguguuuuuaaaagaaaaagaacaaaaaagaaaaacaccauuugcguggggggacuugaauaagguuacguuuuccagggugaggcagguggugaucguuaaugagugagugcaguuucgccauuaaaccgaucagucgguccccccagguuagugcggccaugcaaauaaagcggcccauuguccacgugcuuaagggcuuagcaauuccagcagggcaaguucuccgggaucaucugacuucuuguuaccauucuugcucgcaguguagcgguucucuugaguuggcgugcagagauaagagcaaauaauuagacuguaacuuuucacaaguugucuugccuauuacaaacucaccuucccuuaggaucaguaacauguuuuuguaguaucaguguaugugcguuuacguauauuauacacacaaucauuuauauaauuuuuaaaccauuuaguuugaguuuaaaguuagagaauuagaaagaguaguacacgugguguuugcugccuguuugccgggacagugccagauguucauagauguuuuauaucaguucauucucaaggggaacuucuuacauaggcguagauuguucaguuucucaauacuuaaguuugauuagcucgcaccacuauguagaacguuggcuuuaaauaguuguuucucuucugaaaauaagggugcugaucacagaauaacuuagcaaauuaguguggcuuuagaaagaaguucauagaaguguguuuaguccauuuggguguauaagaguuuuaaaagccuuguggcucuuuucuuacuccuaagugcccauuauauaacauggucagaaguugaucuagauagggugggcaccaggcaaagguacagagccguuacucaaauuugggguccuuuguauuucuuacuacacuuccuaacugaaggcaaacaaacaugugaaaugauuuuuuuaacaccaaacuaagaaaauuaaacaaaaacaagcuguaggcuguuagauuuuuuuauuuugcuugacugcccccccccccuuuucucuuuuagguagggucucacuguguaucucugacuggccuggauuuauguagaucaggauauaucucugaacucaagagaccugccugccucugcuuccugagugcugggaucaaaaguguccccuccuacacucagcuaggaguuuugggguuucgcugagcauuugaauauuaagaauguuagauuuuucuguauugugcauacuugugccuaacuuuuaaauuaggauuuaaguauuuuaaacacauauucacuuauuauauccaguguaagauuaaacuauaaaaacaccauuuaagguuuagguagccauaacaguucaaaagcugauuugugagggugaugguagagaguagaaguggcuggaaaguuuugacagacucgggaaggagcuuggaagcuuguacuuguggguaaauuagcauauuggaacuuacauaucagguaacucuaauggucagucacugggaagaauuaaaaguugacagagcuuugugaguugacauuuaccaaaggguuucucccuuuacuugaggacauggccuuuggggagggaggcaaauagagaagagaaaguugcaaauugucuuccggagugaauucucugugugaauaacucguacuaccacuuaugaaccuugucaagcacuuugcaagcguugagauuuguggguagguguugguaguugaaagacagagaaagggaagagagaguagugguaggaauuuccucacugucuuuugggcaaaguuuggaacugaacagagucuaucuaucccaauaauagugacaacaaauuuauaaaucacaccauuuuuaucaagaaauauggaaacuauucccuuaauauauaaucuguacccaacugaguagauuuaaaauaaccugcaauauaugaaaaaaauuacuaaauaauucauaugugccauuucuacguuugugacagcuguagugagcacagcacagucuuagcuccugccuguaagucauccaaguaaugauaggaaggggagccugucucguucuucacuucagaacuggaccccugggcugggggugcagcuuaguggaagcauucaccuagaaugcuuggagcccugggugcuauccccguagugcaaaagcugagauggaaacccuugucucuggggccagugcccuucagcccacagauuacaaguccguuugugcuaagcaugaguuguugcuuauccccagggccuggugcagagccuggccaggaaaaguauuuauggaaugaacaauguagcaagugcaucuguuuccuuuaguuuagcuccgucuuucuugccuuugaguguagggcuguuccaggcuuacuucuauaauugaauccuacauuagguuuucauggaguuuguuuccucacuucggauacaauguugguuaaggccauaccuauuuauucaguacuauuuuugagaauugcuuuggcauuuauauacuguugucuuguauguaccuaucgaauaaauacuuguuaucaugggaaaacaucaaacguauuuuaagcuauagguaauaauauuaguugggcaagcuuuguauacauuuaugaaacaauguaaaaacugagugccaaaaaaaaauagguaauacuuacguagcacauaaaacaugccagccacugugcccuuuacauguuccuauauuuguguuuuaacauuuuuuuuaagauuuaagcuaauuauauguguacacuguagcuguuuucaugaugcaccagaugauggcaucggaucccauaacagaugguugugagccaccaugugguugcugggaauugaacucaggaccucuggaagagcagucagugcucuuaacugcugauacaucucuucagccccaaaauuucauucuuaaauggugugugugucucugugugugucucugugugugugugugcguguguaagggauagggugaggguggaggggguggagauggcagggguggggguggcugcaaguacacagaggccaaaggaagaugucauauauccugcccugucacugccugacuuauuuccuggagacaggggcucucacugagccuggagcuguguuggugacuagcaagccccagugaucccacagaacagggacuuuuauguugguauuggggaucauaacucacguuuguguagcaauugcuugugcuguguaacucugagccaccucuccagcuuaggaauauuauuuuauaauuugaaagaucuaaaaaugcauuuucuuuuguaguuauagaaggugcucuuggcuagaguggaggaguggcuagggagaugacucaguugguuaaagcacuugcugcucuggcagaagaccugaguuugguucucagcaccugcuuggcagcuuauaaccguccacaguaucuccaguuccaggagaucugagguccucuucugcucuccaugaccaugcaugcaugugguguacauucacacaugcauguaaaaaaccauguacauaaaagaaagagaggaaaaaacagaugcuccguuuauuauuuauuuauuuaaucguggugccaguggucagagccucgugcaugccaaaugaauggccuggcacauguccaucccaacccuaaggaugcuccuuuuaaagcuucagagugggacuagcaggauggcccaguagguaaauaaauggugguuaucaccaagccuguugaccgacccaaguuccauuucuaggacucaugguggaaagagagagccagcucccagaaguuaucuacugaccuauacacagacaagaaaaaaaaauuuuuuuuuuaauccuuaaagaguucaggguagcaagaacaaaguacagcgacugugcuacacgugugaguuuuacagggagaagagggugguucugaaauggucaaagaccauugcagagacggaagaggaggguggagaaacugaauuuugacucacagcugaguaaaguuuuggugcuggcuguuggauucucggauaaugauuuaccaggacagggacuuguuaggucuugcuucggguguuagaacacuuuugccaaauuagacagugcugagcggcacaugacaguuugcuggcuacuuuucauaagcacuuacuagaucuaaagcauugugggaaucuacagugguguggguauuacugaugugcguuacccuuggguuaucgucccucugguggaacacugaucccacguugucaaucugcguugagcaauagauaacgcuccacuagaaaaggucaggcguccucuucugaccaaaugcucauucuuuccuuuccuuuccuuuccuuuccuuuccuucccuuuucccuuuucccuuuucccuuuucccuuuucccuuuucccuuuucccuuuucucuucuuuuccuucuuccuuccuuccuuccuuccuuccuuccuuccuuccuuccuuucaaugguggaccaagauguacaauuguauguugaucugguagagaccuggaauagagucagacguguggguuaaaugaggaccuaacuaacuaauccagcaagguaaagaagaaucguauucucccaaggccuagacacuuuuccuuucugucagcacuuggugguauuucgggagcaccggacaucaacaucuuugaauguuaguuacagcacagauaggggacuguacauccccugacaguucucuaggaaccaugaagacaucccuuuaaaugaagcaugggccaccaaccugcucagcagccagggugcacguacccuaugaagguacaguauacugcauuauuagggaucauuuucacgggacggaugucauugucauuuaucuugggauugcuuugugaggcagugaggaagcgcugugagcugcuacugguuugcccuccuuuacuuggagagguccuggguagugacuuacacauuuugcaucacagcucauguucuauuuaaauauuucagaaacuaacuuggaacguuugaguugaaauagacuguauugaagugcuugucaaggggcuggagaaauggcucagagguuaagagaacccggguucgauucccagcacccacauggcagcucaccacuuacugucuguuaacuccacugcagugcuucuaaugcgcaugcucuccaugggugccggcgcacucauggugcacaggcaaacacucaucaaagaccgaaagaaauguuuauccaacugguguguuagacuuaauuucaaacucuucgcuaaaugguuuuaguguaagaaguucugaugcacugagucauuuagugaaccaaggacauguaaaacuuaagucauuagaacguccaucuaggauuuuuauuucaagaaauuauaguuacaauauuguuauuauagugaaaacuuaaaauuuccuauugacauuacuuuugacuuuuagcuaaacuaucauuuuguaugagaaucugcacuauguuaagagcuugggguuuuaaccugguugauuuuuaacuucuuuuuuuuaaggaaccuuaacuugaaagcagcgugauuggcuuccauaucaucuuugaauauaaauugauauuccuaguuucagcguguccucauagagaccaacagaccagguuuauucuuucaggaaguuuuucaacaccggaaguuguguguuaucugcacauggacuggauugcccacugacucauacaaacaucggaaaaaaggacugaagaaaggcggguuucaggaaccaacuccagcccacuuacggcuuuugagcagcuugaaagaagauaauucuagaaaugagugacgagauccuagucauuucuacauuugucuguagacauucaucgucuuuauuaaccugucugcuuggggaaugguauuugagcuauuguccaucacuguagcagcuaguaaucuacuuguggucagaguuuuuaccuguggguacagaaaucacaucaguaguagauggaagagaaaccacucaucaagacagugaugucccacacacccgcagaaauugacuuucauuaaacaaucacuaaaagagugugguacccaccaacaagugucaguuguuucuuuauaauccacacuggaucaucgggaguucuguuuuucuuuuucuacucaaggcauucucgaacaaauuuuagcacaggagaucugauaaucauauuuggggguguuaaaaacaagaauugagcuggucgugguggggcacaccuuuaaucccaacauucaggaggcagagacagguggaucucugaguucgaggccagccuggucuacagagugaguuccaggacagccgggacuacacagagaaacccugucggggguggaggggacagggcuucccucuuuguaaauagaacuuuaauagacuugcuauuuuacccuauguuuuccagaaucagcaacacuuucuaaugacucugacacacaccaggaaucuuagcaccugggagggugaaggcaggagaaucaagaauuuaaaucauuuucagcuuuguaguuagcuggaggcuguucuaagcuaaauaagacccugccucauaaaauuaggaagggaaaaaaagaguaacuuccauucuuuucaguauugguuguuuguuuuguuuuuucuuuucuuauccaagguuuuguugcucucauucauugguguugucuuuguucuccuuccaguaaccugaguauccccaaagaagcagacaguagaauuuucuaaucuuuuaaacuucauguuacaguucagacuaguuuugagucugaugcaaugacgucaccuucuuacucuucccacuuaguguguugggaaagguguacaaaggaaagagaaaacauuuauguagauacccuaagugaaagucuuaaggucauucaugucccauaugcauucagaugggaauuaguuuguuguuuagaauuaagacacuugguacuguaaauuguauuuucaguucuuucuacccuaacugaagaugacuugauuuuuuucaauacauuucuguaacuaaaggaacauuuuugagcuuacaauucauguuuuacccaacaacgacaaauacaagaaaaagaacaaguuuuuaauuuagugaagcaaaguucuguaaagcauuugguuaacuuuaauauuuuccccuguaggaggccugcuuuccuucuccuucuuccccuucugcgugaucuacuucaaccacuuguucucaguugugcauuucuuuuuacugucugucaggaauuuaauuucuagguauuuuguuucucccaugggucaaauucccccccucccccccagacaggguuucucugugcaguccuggcuguccuggaacucacucuguagaccaggcuggccuugaacucagaaauccgccugccucugcuucccaagugcugggauuacaggugugcgccaccaccgcccucuuugugucuuuauauauaucaauuagauguguagauguaucugugcguaugcgcaugugagugcaguacucucagaggccagaagagggcagcagauccccauggagcuggagucaugggcuguuaggaagcaaacuucugaaagagcaguauaugcuccuuaggaucuccagccccuuuucuguucucucucucuucaccuggcggugccuuccucauagucugccacuagccaacuagcuucaucucuuguccaucuugucaguauuuugguccagacuccaguguuuuggcacuuggucuauuuuuuggcuacaaacgaaugcuguuucugugaugguguucucucugcugcaggcccuugcuuccuuuguccuuaggagacagguauuacuagaugcauuugauaccaggcgucgccuagaacccagcuccuuucuuugcguuuucugaguauuucagaaaacuaguuauugacuuuuccugggaacauugagguuucuguguuuuccgaguccaagaauuaagauuggugcucuagacaacugacacuauucagaaucagucaagguagcuguauggcacugugacuaacuagccaagaggugguggcauguauuacuccuuugucuuaaagauuuugucauaagcacaccacgucagaaccagagacaaacaugccccgucuuuuccaccaugccagaauuaauuuccaucucgggcagcaguuucccagaugaucccauuuuccuugguaaucuggcugaggugaacacggguuccuuuuuucuuaucuuuuuuuaagguugacucauuuaugaguaaauaaaaauaaauuuaugugcucugugcauagaaucccuuacacucuuguacagauaagaagaugagucaaaaucccugaaauuccuaguacaggcagguguaagcccccagugcagguacggggagccaaacccagguccccugcgggauuaguguuccuaacccugagccaccucucccaucuuagucuaaccuuuacuaauauuaacugucaucauuacagacguuagaacaaaaaccgcaggguugggaaaagagcugacacgaaauucuuuuucggaaagagcuuuacuaggagagaggagagcacgacugagugggugcuucacaaccauggggaaguggcugcacaucaggccuugagugaaacagcaauuaggacacucaugaugggcccuuggagagacggugggaggagauagauccgagggggaagagcaagccuucaggucuggaacagaguuacuguaggagagagagcugccuuauauaguaagaaggaaagccuucacucccucagcagucucaaaaugaaguuugcgaguuacagcuuuucaagugggaaggacgugggcaguucccuaccacucucuagacucuuggcagagagccaagcacuggcuaggaccauaaucuuaacaauugugugugugugugugaguguguguguguugggggccggggggagcucuagucaucauagcagggacuugucagcucuucugucccucaguagggcacagguauggccuaguagacuggaagacaaagaggcuggcagagaggguugcacaguaaauccaucucuacagaugacagaauggauacaaaaggcugaugccgaguucuggagaugucaaaaguaaacugauaggaguacaagccggucuguacgauaauaacagacccaaaccagcugcagagaggaguugcuacuguggagucggaccucuggcucauggauugggggcgggugugugugugugugugugugugugugugugugugugugugugcugcagaguugaguccagucacagcggugaacggaaagaguaagucuaggcacaagaaaggucagaaggguagaagucccugcaguugguaggcugugcugagcuaaguggaagccacagagacaauuggucccgugagucuugauuuguacacgaggugccaggucaugcuagaggucauggucucagucacaugcugaccucucagggguccggaugaaggaguuagaccaguuccucagucuggaauguauaagaaguucuuagacccuuuaggggguggggguuguucuuuuguuuguuuuugagucaggguuugucuguguauagccuugccgcccuggaacucuugauacauaaaccaggcuggccugccuccaccuccugagugcugagauuaaaggagugaaccuggcuuccuaguaggguuuaaaaaagagcccauacaguuacaauucacucagauaggauggcacccgucuucucuucagcaacaagacauuuugucagucugggcaacuugggugguacuggacugacugugaaguucgugaagccagccaggaguugccaaggaaaccgaauuuuccuacuggggcucuuagucucauuaauaaaacaaauuagaaaugggagguaauuugagaacaguuuuacugaaguuuaaaggaaaagcaugguggaaggaaggugacaauccugguagucacagggaggagagguggagaaaguucaucauggaauagaaauugggauagcucuuuacgaaaggagaaagcaucccauagaauggaagaauacggcuugucuguaagauauugaagcucccaguuacacaggguuuuguaggccucucugcccagcucuuguugguaucucacggguugcgucuuguguauucuguucacacaggaagaggcggcuuucuagccuugcucuugauguaucuuuuuccaguuguuacucugucacauagguaaaauagagucucucagggcaaggcccaguguaaagauuuaucauaucacacacuagggaguaagcuagagcaaggcacagcaugaccucaacauuuucucggcaaaaacaugaguggugaagucaacacggggucagggagagaaaguaaagacuauugaaaaggacuucuauggacagucaguuucuaggaauggagcgagugaacucgacagauuuuagcauuuauuagauagaagccucugccccaaauaaaaguagcgguaauucuaguaacuagauuuacuugugcauuugccacacauuguggguauuuuucauuuccuuuuuuaaaucucuaaaacuauguuguggcuuuuuaaacuuacugguucuuugugaaauucacaucaugugccccaaucccacucaucucucccuucucucauacccacccucuacccuugcaaccuccccuccucaagaaaaaaaaaaaucuuauaguggaggcuguagugugucccagaguacacccuuugguccacacuucuuugcuuacaaguguucauugccgugacuccuuggucugguacaaggccucuggcuucugcugcuuuaucaguacuggaaccucacugggacucuucuagaauauucuguuguuacccugugucgugggaauccugcagcuuuggcucuguaggaccagccccuucgugcacuccaauaguuccucuauugauggggugaaugcugggguuagccaacacaaaagcccugggacccggccugagagguaucuguaagcauuuuauuuugaaagacugcuggucuccuuacaauuaaccuaugucaguuuguaacuacacuguaacauucugcaaaugcuuugaacaauuggcucauuaguuucuuacauaagaaaguuuauagauuguguggucugcaauucuaguugcuuuauaacagaaucguggcuuauagcuagcuagacuuuuaucuuaaaugccaggcacaccccauuaaucccagcacucaggaggcagaggcuguuugugauagccaggccagccuggucuacauagugaguuccaggucagccaggaacaagacaagacccugucucaaaaugaaagaaaggaaaaggagggaaggagggagggagggagggaggggaaaggaaagggaagacuuuguuguuauuaauuacaaaagaaaauagguuucauuaugauguuuuuauacaggcauagaauguacaggaaaugcccauguggaaauuaacauauggugguguugagcuaugaagaacaacccuauaaugugggauucaccucacugaauaguuuucugccugagcccuuucuaaccacacuagugauuauuggguaucucagagcugaagaaacuuuaauagccacuagugaaaaguagucucaaagcuauaauugggcugcuaacaaggaauuuauauaaauaugcuaugucauaguugaguggggaaauuuaguaaguaaagaauuauaauacauuguaguaaauggcaaaauuuauuaagcaugagacagagaacauggacuauugaaaccucaaagccacacccagcaacacacuugcuccaacaaggccacaccuaauccuucccaaacaguucugccaacugaggaucaagcauucaaauauauuauuagccuuuggaggcaauucucauaaaaacuaccacauaguucuuuagacuggggggggggugguauuuagaaaccuuauaggaauguguguguguguguguguauguguguauauauauauauauauauauauauauauauauauauaguguaaauucuaacuaugguaauuucucucuuuucaaccuauauaaacugggcaaguuauaagacauucagcagccuuggcuucuuuaucuaugaaauguuaauaauaucuaguaguguuuauauaaauuaaauuuauuacuauauaagauuccaguauguccuuguuuuuuauuguuuuuuaguuuuugagacagauuggccuuugaacucauaagagaucagugcagggauuaaaggcacaaccccacaaccccacaaccccaauagcuuuuuacuugguaggagacaugagaguuuauuuggaguacagcuucaggcuacagucagucucuuauugugggacuaacauuuuccauucugaaaguuaacggugacaaguauaauauucuugcuucaugcuuauuuauuuucaggguuuaaaauauuucauuccauguuuuucuggcuuuguauguauguugacauuuucucaugccccuucuagugcugggcaaaagucuuuacuuuguauuuuuaaccuccugaccgauguauuguggaaagcgucuucucuggucauaucuauuuguaguucuguaugccucugguguuugggguguccaaauugaaucuagguccucuggaagagcagcacugaucauuaauucuuuucaaaacuacaacugugaauucuuuucagaccuuucagcacuucugauuuuggauucuguuguaggggagucagccaguugugcuugggucauggcugauggcuacgucauagucuuugaguuauuuugucagaguucacacugagguugaaaugaacuugcuuucagguuugacuuugccucccaauuccacuuggaugccuuguuucuucugagucuuucuggugggcugucugcaugaaguucagccuuggggacuugugaggauuagaguugauuguaaaguaaaaucauugaggcgaucuguauuaggcaggaacagaacuuaaagaaugaauagauacguguucauauacauuuacauauacgugguggauuuauuagaauggauuaaaggcuguggauuagaugguccagcuaguccauccguggcugucuaccaaccgaagguauaagaauccaguauuguaugucagaauccagggaaggaauagacuuggcagugaguaccagcagguaggcaaagaacaagcugcuucuugcacacccuuucuauaggcuacccgcagaaaguguggcccaguuuaaagcuggcucuucccaccucaaaagaucuggacuaaaggugggucuuccuauuucaaaugauuuaauuaagaaaucugcugagcaguaguggcacacaccuuuaaucccagcacucaggagguagagacaaguggguaucugaguucgagaccagccugguuuacagaguuccaggacagccaggcacagagaaaacccugucucaaccucccaccaccaucccccagaaaaaaggaaaggaaaggaaagggggagagagagagagagagagagagagagagagagagagauaucuuucauaggcauaucugcuugcuuagguuuuaguuaccuccagauauaguaaguugucaaccaaaaauauccaucacaaguccaucccugucaccuugucacacaaucauaucuccuuagaucauuucuaauuucccaauggaaaucauaacugggccauaauuacaccuuacauauuauagcuaucccaucuauaaucacaaacauuauauauuuaagcaagucauaauuaugccuuacauaauauaacacucauacaaccacgaaugcauuauaaauuuuagaauagauggcaauaucccuaaagggacauucuuuuagugucucagacuuaaauaugauaaccacugauacucucuuaauugaugucacuacaugaaaaggaaaucaaggaaagaaaacacaaauauccaugcuagugcauucuugccaaaauaugacagaaauacucaugucaacuguaagccuuguuucaguaacuggucauguggccuuagcugguauuuauaacuaucuuccucuauuacccauucuguauuugauccacccucagcaagcacuuaauuaagcaggucuuggguuuuuuucccggaggagugacucauaccuucauuccugaaggaucuguugcccuuugucauccugacuggguuaggauguggcaguuuccuguugacuaauacaggacuugguaacaccaagagacugcacuaaaagaucuccugcauuccagauguagucuuucuuaaccuccauuguaaucuaauuuccccuggcaauuuggaccagucacuccuccuaacacaguuauuccuuucuuaacuuauuagcuuaagggcaucagaagcccaaagcggccugggggggugagucugagcuuccagcucaaugugauguguguugugacuccauacaggagcauuucccucucuggaaccaaaaugucuagaucaacaaaauuuaaggucauggaaacaggaagcaaaacuuuuccuaauggaucacuaggggugaucaugaguggaaccauugcauuuuccaccucuuggcccuguuaggccacuugcuucuggauagaagcauuuguuaauuccaugugcaauggauuccaugaucgugggcccacugucgcacuucucaggcugugaagugagcuacuuggccagaagcaaugcuguguggaaaaccaucacaauggauacggcauuuuuuaaguccuuggacaguagucuugcagaaacauguucaggaaaggcaaaaccacaagcagaguaacugucuacuugaguaaggccaaagucagccugccaccaggucacuggcaggucauccccaggaaugaugccauauauggggcucagugucauucucugcuguuggcagaucuggcacucaccaacaacuguagccgaguggcaguccauguuguccagcccaugucuaauccccucugccaucauggcccauugggcaaugacaggaauggcuggcaaaagagacagaccuguccacagaacaguucauccugucuacuuaguuauuggacucuccucugcuggucacuuugaugagcauuuucaugggacacagguaucuucacauccuuugcccauuugcagaaaccugccaacacuccuuccccagaaguccuucucaccaaucauacuuauuucucgucccugaucauccagccaguccauuggcuucagcccaugaaccagugaacaacuguauuaucuccccuugagaaugaaaugcaugucuguguguacugccugaaauucugcccacuguguuuuuuucaggguugccccugaaacagguugcagugcugcaacucuccacuucuggguggugucuguagaacaugcggaaccauuggugaagcgagccccagucuucucuuccaaucauaauguguacaccaagaggcuauaggcacaggcuuagcagcagauggcauuguaacaggaguagaaaccauaggcauuugagcaacuucuucauguaacuugauucugccuucaggaccugcucuggccuaauuauguauaucccacuuucauuugauaauggauagcuacuguguacauaguacuugauuugguggaucagagaacacuuagcucgugaagggcagcccaggucacaugauaacuugguggccuguuaucaaacauuuaguuuccacugaggcccaagagcaggccaagagcugucuguuaaagggagaauaauugucugcagaugaugguagagccuugcugcaaaaucccaaaggucuuuucugugauucaccuacaggggccugccagaggcuccgaacagcguuccucucugcuacugacaccucagguaucauugggucugcugggucauguaguccaaguguuggagcagccugcuuaucagcugggacuuguugaagagccuucuccuguuccuggcuccacuuaaaccuaacagcuuuccaagucacuugguauaugggcuggaguaacacacuaaagaaugugcuaucuccacagucuaaaucagccuacuaaaauacguaucgugcuucuuuccugguggugggaggggucaaaugcaauaacuuaucuuucacauuaaaaggaguaucuuugcguauuccauacuaaccaagaauuuuauggagguagcuugaguuuugguuguauuuauuucauucauaucuucuggauuacaaguuacaugguaacauaugaguugccaacaagccuagagugguugcugucuccugcuaacucgauccaaucagcauaaugucaucaauauaguggaccaaugugauauucuguggaagagacaugaucaagaucucuucaaacuaaguuaugacagagugcuggagacuugaaacaaacuuauacauuucucuagaaguguguccggucucaaaauauauauaagucaggguucucuagaggacuaacacacacacacacacacacacacacacacacacacacaaacagagagagagagagagagagagagagagagagaauaugaauauacggcaaucuaccaaccuaccgaucuauauaucuguuuauuuauuagaauagcuuauaggcuaaaaagaucuggauuaaagguauaucuuagcaccucagaagauccagauuaaaaguugaucucccugguuggaagguuggcccagugguuaagagcacugacuguucuucccgagguccugaguucaauucccagcaaccacaugguggcucacaaccaucuguaaugggauccaaugccuucuucuggugugucugaagacagcuacaguguacucauauacauaaaauaauaauuuuaaaaauuauuuuuaaaaaguuggucuccccacuucaaaugauuuaagaaaacccucauaccuagcagcuuggguuuuaguuaauucuagauguaaucaaguugacaacuaagaacagccgucauaagauuccaucauggcuaggcuagaugccaaaagcaccaagagcgagcagcacagaguacaaagguaaccagauggagaaaaaaccuggucacauuuugaauugugcgauucugcuggagccaggacuuggacugccaagggcuguggucagaaucucuggucucagaugaccagugggaacaccggaguauaacauguuggcccugcagaggccagagucagagccugguaucaagguacccucugaaucugccacugauuucuguguaucccagccuucaaggaagguauuuucagacuucagaguucucuggucagucuuuaaggucucucgucuguccagucauaacaucuacaaauaaagacacguggacuucuuuuccugacuguguuccacuugcugcucaugucuuacugccccagcuaagacuauacugaauagcacugaagaaaguggacacgguucaugucucuauuuuaguggaaaugcuuugaguuuugccuucugcaugguauuggcuauagguuugugaugugaaaccuucguuaugcugagaugugcucuuccaauuuuuuagugucuucaaggguuuuugucaaaagccuugucacaucuguuaagaugaucaugugauuucuguucuugaguccacuuaaucagauguauuauuuacugauuugcuuauauugaacugucccugagucaaagcuggugagcauuuuauugauuuuuuuucuuggugguaauguuauguggggugugugugugugugugugugugugguguguauguggucaucagaaagauugcucuauacuuuucuuuuuauuauucuuuuaucuggcuuagauaucaggguaauaauacuagcuuaauaagagaaguuugguaacauucuuuccuuuuuguuuuagagagagagugauguuaacucaucucaaaaggcaucacuucagacaagggacuaauaccuagaauuuacaaagaauugcagaaauuaaauaccaagggaauaaaaccacuaaucaacaaauggaccuuuguauugaaauaggcaguuuucaaaaagccaaagcacaaauggcuaacuguuuugaagaugugugcuaucccuagacaccagggaaaugcaaaauuaacacuacuucaagaugcuaccuuaccccauucugaauggcugucaucaagaaaucugccauggauguuagagaggauaggaagagaaaggaacuuuauuuaugguugcaggagguacaacuucauacagccacaguggacuucaguuuggggauuuccucaaaaauuaaaguuagaacuacuaugugccccagcgguuucccuccagggcaggaacccagagaucuccauuuccuaccauagagauauuuggaccucaaugauuguugccauaguuaccguagcaaacagaugggaucaaccguuugaaaaugaaguuuugguguguguaugaguacugcucaguucuuaggaggaaugaaguuugaaauuuguaguaaaauggacaggcuuagacuuauaacauggaggccaaacucuuuuagucguagguuuccaaaaggccuuggguguuagcugucccuugccguauucucuccuuacccuucccccaccccucccuauguuucuacuuucccccuuauauucuaguuuccuuuucuugguaagaccuccacccccaagugccuuuacuagguaccuaaccucuguagcuauuuggauuguaguacaacuaaaagcuuaaaagcuaacauccacauaugagagaaaaaguacauauuugucuuagggggggucucaccucacucaggauugauuguuucuaauuccaucaguuugcuugcaaacuuaauaaucucauuguuaacagcugaauaauguuccauuguguagaugcaccacauuuuuguuaugcauucaucuuuugauggacaucuaggcuguugccaguuucuggcuguuaugaugacaguaagaaaguaucucuggaggaggaugguccuuuggguauaucccugacuuagucgggguucuguugcuaugaaaagacucugugaccaaggcaacucuuuaaaaaggaaguauuuaaugggcuggguuacuguuugagaggcuuaguccauugucaucaugguggcccggaagauagguguuagagcagcaacaggcagaggcagaggcagagaggcagagagacagagagacagagagacagagagacagagagacagagagacagagagacagagagaggggagggggaggagggagagggagggagagugugagccuagacuagggcuuuuaaaacuucaaagccgggcuggugagauggcucaguggguaagagcacccgacugcucuuccgaagguccgaaguucaaaucccagcaaccacaugguggcucacaaccauccguaacgagaucugacgcccucuucuggagugucugaagacagcuacaguguacuuacauauaauaaauaaauaaauaaauaaaucuuuaaaaaaaaacaaaaaaaaaaaaacuucaaagccaacccuacaugacacuuccuccaacaaagccacaccuacuucaacaagaccacacuuccuaaucuuucuaaucuuuucaguuucucuccuaguggacuguucaucuaaauagaugaaugagccuauggaggccguucuuauucaaacuacugcagugcccaagaguacucuagcuggaucuugaggcaaaucaaguuucaguuuugugagggaacuccacacugauuucccuguaauaguugaaccaguuuacacccccccccccagcaaugaauaaguguccucuuucacuguguccucaccagcgccugcucuguccuugguuuuauugaucuuggccaugaguaguuuaguuuguaauucccuguuggcuaagaauuucuuuuaaguguuucuccaccauuuguguuuacacuuuugaaagcucugucuggaucaguacccccacuuuuaauuaaguuguuuucuugauuuauuuauuuauuuuuaguucuuuaggugcaaacacuuauaucaauaaguagccguguucauugccuaaauuauacuguccuuugccgugcagaaggcuuucagcuuugugaagucauauuuauuaauuguuagacuuagugccuuuugugugucaaaugaguugaagccuuucccauaguuuuucggguuuuauguuaagguccuugguccauuuguaauugaguuuugugcaggaugauagauacuguggagcuauagaagaugggauggcaguggaaggugagguagguauacaggcucaucgugaggacugcugugguguacgcuugcccagcuaacaagccaguccuuuaucguguggcucuaagacaauacacuccugggaaacuauucccagaauacagucuccugccucaguccuuaucuguacuaauagcucuuccagaaugccuuccacuuuuuccucucccugggcauuucugaugccuucuccacacuauggagaaagaugcauguaccccuuacuuuggcucuguauuaacaauuacucauggaucucuuuuccagaauacccugacguccaaaucucauuucccugguggccguauaaguaagaacgaucaggcagcauccugccuggaguggaggaagguucagaaaauguguguguguguguguguguguguguguaugugugugaguaaauacagcccugagcugauuaggaaguguagcaggcuuguagucuucuguuauuauucauacugcaaaaaaauaggaagaccagagccguuaaggugacucagagggugggaguacuagcgccuguggcagccucaugaccugcucucuagcaccagcuccuuauuguccucugaccacacacaugcgcgugcacacacauucgaguaaauaauuauagcaauaauaauaaauuuucaauuaggaaagaucaaaguauaugaaguuuauuaucugcgacuaaaaaaauuaagacauugucccaaggguuguguaucagugagucccugagauuccccggaggguuugaaugugauuggcaaucaggauacugccagcuguuuccugggcucagcagauuauuccaauuuagcuacugagauagugaaauauaaacagacauguguugguaauuuugaucucauucccagccuuuguguuguggcuguugucuaacccuugacuauuucuaguuccccuuuucuauguauucuaaagaauaguagcuuaaaugugauuuuuuucuuccuauuuuuuuucagaacccaugauuaauuuaaguugauuuuugagagaaauugccuucuucuguaaacgaucucagagagacucuuggauauugaugugggaugucuggaguuguuauguucccaucaucugaauucuuugucaugaacacuaaccaccagaagaggcucaggagaggcaauauugauucagaaccgauacagcaguggcuucugguuugaucuucguccccacagcuuggagggggcucuucagcaacuaucuuacuuguugucaucgaaguagcugcuuauuuuuuaauaaucgugaauaagaaggacagaaucccccccccuuuuaguucauuuuuauuuuuaugauuuauuuauuuauuuauuuauuuuaugugaguguacugucgcugucuucagacacaccagaagagggcaucagaucccauuacaggugguugugagccaccaugugguugcugggaauugaacucaggaccucuggaagagcagucagugcucuuaacugcugagccaucucuccagcccuguaaauuuuuccuuuuuaaaaaccaaacuaaugguugaaauuuauggguguuacucuuacauuuucaucuagccuuuaaauauagaauuuuuucuuagcuuugaaggaaucuaguuuuuuaaagagccuccuuuuucaacacaaucuacacgaaagguucucaacugaggagaucagaagggauaguuuucagucauugucgaagagcuuucugauggugggaucaaacaacugggaaaugugucuucgccuggcaauuugaggaaugugaugucaaaaaaaagauaggaaccaauucuucuaaugaaaacaauaaggucuaaaauagauaauugucuauucuuuuguaguauacagcaaccaagccugucccaggacucuguccaucuucuugagaaccagugcuuguuagagaacccauuucucuguuuauaagaccagccuccuggauuauuauaaucauugaguuauuauaguucuuagagcuaaguugcuuauccuucugauuugggguuuuuauugcuuuguuuuugucucuuguuguugcuuuaacaaaugaguaguccuuggaguacuuucgaaacgaaguacauuauaucuaaggauacacucaaguacguuguuggcgucagccaucuguuggauuauagccagauauaaccggaacaguccaucuccaugauuucaaguuaguuuuaaacugccuucccuaaacuucucagguuaucuggugggaaacagaucauaucugaucacaacaaaaagaaggagaaaauuagaaauuaaauuagcguguuaguaaguaacaccguuaaucccagcauuugagaggcagaggaagguggaucucugugaguuuuagcucagucugaucuacaaaguaaaguuccaggacagccagagcuacauagagagaacagaaaaaggaacguucucaaaaacaaacaaacaaacaaacaaaccuugggaaaucaguuuuuuguugucugguucuuaaguuuuccuguguuuggauaagguaaacugagaaacggacacaugauucucaaacuagcauaacucauuaauucaacaaaaaauaagcagugaaguuugauuuguaaucaguaaaguuuuauuuuuccauguuucugaacaagaaguuuucuaaacaaauaagugauacagauaugauuacaagaaaauauuuauuucaucaucguggggcagggguaguuucaaggacuuuuagcagacucuuaguauaacuugguaacugucuuuaguuuauucauuuucaaaacagagacugauucagguaauaaaaguacauuuaaaauuauuuucaaggcaggaaaauaaaaguauuuucagggcugggguuguacuguggugccaggcacuuuacuagcaugcaugauguccuguguucaauuuccagcacuacauaugcacacaaacacacacacaugcacauacacacaguaauuuuaguuagaagcuauaacuaaaguaaaauuagucuaaaacuaacaagccuuugcuaaucuacuuuuugaauuacugugacuuuaaaucuaauaucugacuuugcuucugauucucaaauuagaguucauuuaagauuucuuguuuuacauuagcuuaaacaacaauaaauuauaaaaaugaagauugcguguaauaagccuauguuuguuuuuccauucauuaacgcuccuuccuuugaagccgguggccaugcugugucuguguagcagaguuaggcacagugacuuguauuaccagcuacagaacuguugccugaaagaaaggaggaaaccuugucugagacuagagcagucucagccucacuccucguaauugaaggagcugguguugagaaacaggaagacaugucugagccuuguacuccaauauaaguaguaucuaugagugcaaggcaaaagagaagaggggaauuuuaaagcgcauucagcaccuucuacuccaugguaguauuuugauaaaauuguaucaggaugaggcuagagaaaaggcucaguggcuaagagcgcuuuaucagggaacccagguuccauccccugcgccauuuuauggaggcucacagcugcaugugauucuccaggggaucucaugcccuuccuggcccucuggauuccugcacauacaugauacacauacauacccucaaccacacauacacacauucagguacacacacacacacacacacuaaaauaaaauaaaaauuuaaaaaucuguauccacauaucuagauccauguuuaucucuaucugucuaugacuagggacguaacucagugauaggaccuuugccuagcaugcacaaagccuuggauucaggcccugauauuacacacaugcauacacacacacacacacacacacacacgcaagaauggagaacauauccaucuauccauaguccauaccuucaucugucgccucuccaucucauugugcauguguaagcauguauuuaacaaaaugcuuauaccaggcacucuucugcacacacagcucauuccaccuucauaaucacacuguaggcaucucuaauuaugauccucauuuagagaccaugggacugaggcacucagcguggacccauccucucauugcuccuucauggcguggauuuggagaccucaggugacaucagugauaacauuaguugauggagcugaagcugagucuagcugucauuaccgcucuuuguugucucugugguuccagcuucuguaaaaugcuccuuauuacuuugcugcugaaaacuuggaucugcuugcagaagccucaauucaaaugucguuuccucuaaaauaccuuuuuuaguuaccaucucuggaagcuucuuucccuacauuccuauaagagugaauucuuaguuagcccuuuggacgguugcuucuucauaagguaaaaguucaugugcacugcccugacucagacuguacaacucuuaaaggaaggcugccauaggccucuugcuguucuuaccuaagcugcuugcaaaugcuuggacguuuaaaguagcaagagucaauggcuuaaaaauaucaagugcaugacuauugguaguauaaaguuccuaacuggggacuggcgagauggcucagcagguaagagcacugacugcucuacugaagguucugaguucaaauuccagcauccacaugagaucugacgcccucuucuggugugucugaagacagcuacaguguacuuaauuauaauaauaaauaaaucuuuaaagaaaaaauaaaguuccuaccugaauucuaguauacuuaaaaaaauuuaaccucuauaugagauauuuuauuauauauauauaaaauucucaaugaauaggaaaauuucuaaauaugaaaaauauaggcaccauaaugaaaauauuuucauagcauguaguuuuguagagaaaauagggaucaaaauaaaacuuuucgcaagaaaguuuuacaacaacaaaugaaauaacuguucaaguacagcaacaauaauacugccuucgcucucaaaaccccgaugcaaauuacaucaaggaauuaugaugaaguagcuaauuaucagaggcuuuuuuuuuuaauguuuugaguuugcuaguuauuuacauuuuuuuaaaugauaggaaauaaguagagaagagagguuauuuaaucuuuuggaguucugcauuuguguauauauauauauauauauauauauaucucaguuuauuacuaaagucuucuauggauaauuccagugugaucuuuuggaagcuaagaugaaggcacguguguuagugaguguuugcuguaugaggagacaccuaauacacuguggugcuagugacaugugcuggugauuccccacuugggagacugagacaccaggauuaugaguucgaggcuauccuagacuacagagugauauuccaucucaacaacaagguucuggguaccuuuuaccacuguccucaugaccaagccagagucagcaugggaagggacugcccaguuguuaggcuagagucaauggagacacuguggcaauagucuacagcuuggugucccuuggaauuccuuagccagcaucccaaauucuaaucccucccaacaguagguauguuaggugauauaauagaggaaaauuaaaaagaucacugcaauaacaugguuuuaagagcauuuucacacccaguuucuuuggaaugcuuagcagucguuugaaauuccuuucaacuuuuccuauuuugaagcucugagcuuugaaagagaggaucuuuugauccucacucauuaaaugcccaauugaucuucgccaggugcuguauugcuaugacacaaucccgacagcacagccauuuauugagagcacccacagaccagugugaaagccaucucauggagcucucugcuguccuuugaugucagcauuauuguuaccauuuaacaugaggaagcagacacacagagaggccagcaaagccccugaugucacauaguccauagguggugucuuaugucuaagccuacagcuuccauccgaugaauuuccucccgaauggguugcuacauuuguuuuuucuuuuuuuuuuaagcauucacuuuguuaaggauuugaauguuuuguauaaucuucuaaaaaacuggggacccuuguaaacccugaaauuucccccaguucuacugcuuccaauaucuagaucaacuauaaagagcucagaaucgacuccuuguuacugugucuaggugcaauuuuuagauauuuuggacuauuccaucucucucuucaccauccaugacucuuugaggacuccaaaguaaaauauggaauguucauuuauuccggauccuaaaugucaacuucaucagaaaacaaucuucauuuaagagcgaagguuugugugcucuuggcucucugcagcaucacuugauaacuaaggugaacuccuucacuaccuaggcguugggucucaucccugcccuuuucccuggugugggaacuggagcuccccagggcugcgccacagucuuguaaccgaguaccacaccucggagagacccuuccucuggcucguguguugcaaugaacacaagccauuuuguuuauuuuagagguugaggaugcaaagucuuuagucuuugaauuccagaggucaaauguacccuaaggaucucuaugaauaugaaccaauaaacuuauuaaaauaggacauuuuuuauggaaaaaaauauaacucgaucgcagguuguccagguugaacuuugcaguaucagggguucgauacaccuauucuagaucuagaagaucagucuuuucacuaacaaagacgggguggccaagugucugaaguauguuaggggugcacuguuuucccuguagguuuugguuccuccauuuucaggcagguguggcugcuguuaaaggaagcauuagacucgcacuuuguguguuugacguaagaggaacucgagaacgcucucagaguuucuugcuucgaaguagaccuuccaguguagucuggaucaucugugguacaaaccagaugcugaggucaguucagcuuuccgugccagauuaggacagagaaaacgcuuugcuauuacaugcaggcauuugguuauaguaauaauucugucaaaaucaaccucacaauguccucuucuggcauuauggauucuagcguaaguuugcugaaaaugcuuauuaauuagagucuagccuucugauuaucauaacuuacucucuuucaucacgggauggaugacagugcccacguccaggaacuuugguugaagugacguagaacacauaccaguggcuguuacagagaggcauaugugcacucucuggagaaccuaaguuggacacgggacagagugucagaugugcagccagcagucuuuaugaacagcgugaggaguuaccaguuauucacagucaccaguuucugccagugagaguacggcagcggcaauguuuggcaugcuuagcauagacaggcugugcuucuucagagucugguuguguuucagugguccaugcaguagaugcaaggcuauagagcaacgauucucaaccugugggucccaacccuuugaggggccauauaucagauacccugacgauucauaacaguagcacaauuauaguuaugaaguagaaacaagaaacuuuaugguuggaggucaccaugauauggugaacugucugaguagcggccaggaagguuaagaaccauugcuguggagggacaugcugaagaccaugaccccagaccuagguuugccgugugaagaccaugaacccagaucuaauaaacccccugaagucuaagucuaauaaauccccguggcguuuuuaaaucaggaaaacaaguagcccugagaagauagauaugaggacuuuaggugugcucuuaauauggagucaugucauagaggguuuuggagaaagaugguguaauccaguugcuuucgagccauugaauuacuuuguauccuguguggggggugugacugugugacuggagguuugauugaugaaguguccacucagggcaaaguuugccaucagaacugaaaugccuaaaguaaaccagucugaaucauccagguuagacgcugcagacugcgccuuuguucuacguuguaguuagugagagcauugguggguuuuaaacaaugcauuguguucugguuuucuuuuaaguauuggcugcguucuuggagucuugaacuguuugcuuggguuucaguacgcuuugaggauguucauuuguuccaauagaggaucuccuuuccaguuguagccagccacacagugagauagaugcgcuguaaagcgcauuugcuaaguuggagauguuuguucucagugguggguuuuguuuuuuaagugaacguguguccucacagcaccuucuugggaaguacagaagaaaagccgaaagcugguggguaaucucacagaugugcugcgaagagcacaucacaccacugccaccugguugccaaaguugucugauaugaaugugcuugaacaucaagugcuugccuguucuggagaagaccggggaagacuguauuacucuuucucuguugguacuugcagaaccgacuuaaaguaaguuaguacuauucaacugaguucaguaauuagaguacuccugaugccgugcauuguucggcagggcacgccccuuggcggggaucccauuaaagaggacaccaguguuguccuagugaauaaaucccagcccacaugaugcaaagcagcguguuccugccugcugcucggcuguaguuaauuuuagccagcguuuguucugugaguuguaaaacuguuuacccgaguagaaguuaguaagcugaaaugugacuucugggccugugcgauagcugucuauuucagacuucagguuguguucaugguccggagagcagacaucuggagagcugcgguucagauuucuuuucgaacuacuugugaguacucugggaauuuuuaagacuuuucuuuguucuucauaccuuaaaucuuccuaaagugacuaucgugguaauuuuaucugccuugggaaaacugguguugaucuacaacccggccgugucagaauggugguauaguguuuucuuuacaugugcagggcggcgagugucucagaguauucagauuuuccugcagaaaguauuugauucuuaacuuuuauuuuuaucuuaaaaauguagcuuaguucuucuuuugcauguuaaaauguuagauuaguagaaaugguuacagugugucucuaacuuuauuuucugggguaguaacuguugggggaaacauguaaaaaguuaauacccuucuuaaguggauacacugcagacacaagaggcuagcaaguguuaccuugcuaagccuauacauggaagcaucuuuuaaaaggaaaaguuuauacuuagaaaauagaccuuuauucuccuaaagaaaaaaacuuuauaaggaagguuucagagggugacuuaaaggguguuccgguugacugaguuaguuauccacuguaucuaaagcaccuaacugccuuucaguuuggucagucccaacuuauaucuagacugaagcaaacggaauuucaguguuacuuucaguauuacuuuaaauuaaacccgucaccuugcuuaguuugaacuacguuuacacuuaaaguagaacaauuucaaguuaagcaacuuguuuauaucagaaccagaaagaaacccccuugucaguuaccguguaaaguacaccgcuuuaggaauguugauguuuaaugaaacaguugugugcccauuucuccaucuacaagcaaagacagagacaaacccgggauuagugucgugaaugccauguccccauuuugccaaacuguauguaaagacuucuuugagguuaugaguugccugauuuuuaaauacaaaugacauacggugucaacaaugagagaaaaauuucaguggugcauucaguaggaaaaauauguaagaauugaaaauagaacugaauuccucggcuauuuuuagagagaaacauuuuuuugaagcuuagcuuucugagcaggagagaaaucuguaagcauaacagagaagucacucaugucacccugagcagaagggauucucuuccagcagaugcugcgggauaaacagguccucgcaggcauggcacagcccuguccuuacccgaggcccccgggagguguuuguaauggcguacuauaguugugcugguuuuuaagcuaaaauuaauuugaccauuguaguuuuuaauccugccugccccgaagaaaagcugauuagaauuuauccauuuuuaauguaacaaaaagaaguuuaucgaugagugggaagcauguguuaagaugcucaucgacacuugcagagugugcgcuagugguuucugugcggcaaaaaggauguaggagagugggagaggaguucuucagcguggacuuccuggcacucaguguggccaguucugugacucucugcaguccuccucugugccccaugacacaagggacacuugucagaggccccucaugaguggaagcucuguugguuugcugugccuuagaauguaaucggucacaaggggcucagcuauguggucacagauucgaguucacaugcuaagaaacucaggaagagcccagcuaugacccguguguguguguguguguguguguguggccgccucucuacuccaccuccgcccucugguccuguaggcgcugcucucuggcugccugccugaccucuuaccuuccuccucuuugcuucuuuagaucuagcucuccagaggcuuugaccugacagcggcccaggcaguagguaugcuuugauucuuuuaauuacagaguacaaccuucuguuuugaggagcccagcaggaagccuguugccugccuucccuugauucacagccugucuguuuagcugguccgucaguuggucggucuguguggggcugugaacagaaucuaagaccucagauacucacaacucagauacucugaguuacuucuccagagccaucagagggcucugucaguauggauacaagcagcuacguucgguagcaggcugccuuugcucagcgaucacaucccuggaacguucuuuguaaaggcaauccggcagaaagagcuugcucuguaccuccuuucagcuguguuaggugaggugugaggggacgggccgggugauggaagccuucugcagcgccuguguuugacugcccugccgucaacagcugacugaugggaagaaugcugauguuucuggggaauacugggccugcuguuguuauucagcauaugugcuaagcaccuccacagcgcacacaauacacaaagagagcauaguucccacucgcaacgagcucacgugcuaaacagccgcagcaccgaaaaaggggggcccugacacgcaguaaacaaaccggcaagaagacaaugcuggggggagacgugggaggugagagcauggggcgcguggagggcacggcugaguucgguuuaucccugcauuugcaacccgggauugggacuggcucuuugcccuaggcagcaacuguggguaaguggggcagcccagagcccacucccaggccuugucaccuuccugccacaaaggagccacugaagguucacuucaccugaagcuguugcugggugguagcggcagacccaccagagaagugggaagcagccuccucaacgagacuguuuaaauagaccugauuucuggguuauauuuucucucuuggaugccaccuggcccugcucugucuuaaaaugaugggucaucuaucugauauuuuaagacagcuucuugaguuucuuagaagaucagaagauaagcauuaagacggucugugaaacguuacugcagcucacagagagucaguuccccgggcaggcgugaauacaagcgggugaugugugcgaauacgagaaauuggucugaaucguucgguucuugacaccggcuguggcggcucuccgacucagguucugugucuuguuuauggcucuucaucugaaagaaacuuggagggacucugaaaaaaaaaacucaagaaaggggggaaaucacauguuagaaauuauaacuacaauaagagguuggaggacuucuguucuauagccuagaagagacuugcauuuuuguucagauacgugugcccauccuggggauaaugauggacagcuggugugugcuccccuuuggaguguaaagggucagguaccaugauggccaagguguggcugugaccuaucagcacuuccugggaacagauucucaggcccaccaagaccugcugauuccaagugggaaggcuggagugcaaggcuauuuuaacagugcucuaaggugauucugaugucccaugcaugggguauuaggaagaaaauuaucacaaagggggaacacggaugcugggaacuauaaacuuuucuucuuggagucauauaaaccuggguuuaaauuuauuugcaauauuuuuaguauucucucugaaguccggagauaaaugaccucucaaagucccucuaacccugccuugacucuggauuuuuuucggucacuuaauauuuaaccugggaaauacugcguugacuuaccuggauucguuaauuaagacagugccuaucuuuguuuguucguuuguuugggguuuugguuucugugcuagaaguggaacccaggaccucacaccuuacuaaaaguaaguacuccccauugaagcacauccuugccuugauaguauuuuuuaaaagguuucaauuuuauucauauguacauaaguaugugugaggugugccauguggaugcgagggaagaauaaccgguguagcugcuaagcuguugcuucagcuccagcagcagcaguuucaaauggagauacaaagagaugagaagugagugguagugugggcuauacaguauaucaggcauacagcaaugguuuaagcaguguugcuaaagcuaucgggcauacaguaguggguuuaagcagugcugcuaaagcugucagguguacaguaauggguuuagguaguguugcuaaauagauguccccccuucccaguugacuccaccaguagcccacggucacugugucgccgacaguugacuagaucauucacugucuucaugaagucucugucagaagagagguagcugcagacaaagugugacuuuaacugauuccccaacucuuucaccuccacuggaagagacaagucagugggucgcaugcugcggucagaaguagauggccaccuagaaagaccugaagaggguaugagcauaguacaacgcacccugccuccuuugaagacucgggauagggacuuguuucagcugacacgccuuucuggagcaaaugauccaguagugcacauagcaggcacguggaguuggauuauucggucagcauguccagagccagcuaggcucugcccucuuggauuucaugcguucugcugacuugagcaaguagcaauugguaccuugcccaagccaauuauuguguccuagaagucccccaugcugaccccuaacuuuuuuauaggucauguaaaugcaucuuaaucuaaugaugucuuugcccuuucuuacauccuccuuuguagcuuuugcuugagggaaugguuucugguugaaaacauaaccacccugucuagccuuuaguacaaagcuuuuguggcuuuaaugaagaaagagcuuugugagggcaugguuuuucaguguuguuuuaaaaguaucagaugagcaacaccaccguagccaaaagaacauccacucccuuagccagggaacgauggccguaggauuuuagcacuugaaagaggagagguagaaucuuuggcuuuuauagauagaauuaauuacauauuuucagaccauuaaaauguccuuaaagugaaaaggacagguacagacacuuuagcucaaacucuacuuuucccugugaagggacagagagggagagcaggaagugugcauauugauaguugcuuuggucugggcucuuauuauaugugggaaagccucaggcaccaggcugcaaaaguuugguuucguuugguacaucugugucaguuucagaauauuugaaacccugggagcaugguggucgcucaccaauccagaagucauaaagaacugauuucuagaauccugcaugagucuuagcugucuccuuuaaacacacaaaaucucaacugcauacccaguauguuuaaaaaauccaaauauaucauuaacuucuuaaugauagaacucaaaaggcuguuauuggaacgaggggcucagaguauagcauaugauuaugaagugugucuccagaucugguccaaucaugccucccucaaaacaaggcuauuuucaucuguacaaagaggggcuacugaauaggcauucuucuuuggaauuucuuucuuggaaaaauaaaguuguuucaaaaaccaguucaaagccaguucaugaugugccauuagaaguaacaguguggcuuggaauagcaagcccugccuccuuccauguaguuguuucuaaaggccuuagagcgggacacagagucuggggagaagcaaggccuuagagcaggacacagagucuggggagaagcaaggccuuagagugggacauagagccuggggagaagcaaggccuuagagcgggacacagagucuggggagaagcaagaacuuagagcgggacacagagucuggggagaagcaagaacuuagagcgggacacagagucuggggagaagcaaggacuuagagcgggacauagaggcucggggcaagcuuuucauuuauuaauagaaaauguaagaauuaccucuuaauucaauaaaauucugccaaaaauauaaagguugaucuauaguaacucacaguagugcaaaacuguauaacauuugaaauggugauauucuauguguagugacuaaauuagguuauaaaauauuguuuauuuaugacccuguuccuauacaggugacuccuaacaguaccccacacugaccccgacuuuauuuugcaggucguguaaaugcaucuuaaguuagugaugccuuugcccuuucuggcuugaaccugcacaggcgcuaugcaguaauacugccacagucucuaugaguucacauggccgucggucccguuuuaucuagaaaacaugucuacauaugugucugggaacagaaugcuauauaccacauguaagcaguccuucucucuagucaacguuucuaauugaagauacuuuuucauucaguagauucagauccgugguuucaccucccagauccuccccaccucccaucuacccagcuccaugccuucucucuuuauagaaaacaaagauuguuuuaaaauaaggaacaagcugaagaaacacacucacacaacagaaaauaacacacaagcaaaauuaguaagauuuuuuaaaaugucaaaacaaagcacuacagaaagaaaucuauaaaaaaaacaccaucauucuuuucuguugguucuuuuguguugguguauuggccuuuuacuuuggggcaugggcuuauauacccagugagacuccauuggagaaaacguaauuuuuccugugcuagugguuugcaguugguuagggacgggagccugugaaggcucuguucuugcugcugugaguugagucauaugugccuuguucagcugauucagaggaccuucuuuuccugguaucacccauccacucuggcucuuagaaucuuucugccuccucuuccacacagaucccugaggugggagagguuugaagacaauguugcauuuaggauugagugcuccaaggccacucacucucugcauauuguccaguugugggucacgguguuaguuacaccugcuuccagaggaagcugcucugauggcugcugagugagacucugaucucuggcuguggcagaaugucacuugcagucauuuuauuacaauguaucuuuagcaaaacacuaguguuuggguuuccucuaggucuaugacuuagcuagucucagguucucagccacuugagcagugccagacauggguucuguuucaugaggugugucuuaaaucacuucaagcagacagugguuggucacuccuacagcguuugugccaccauuggacccguguaucgugcaggcaggucacuguuguagacugaagaguuuguaguugguuuaauguuuacccuucuccuccggcagcaugcagaguacuuugcagcaccauggacaccaggcgacagcaggggugaggggugggggugaggggugggguggggguggggugaagguucuaguuaggcaccaguguuacuuuguguucaaugagauauguaauuguuaucuucagugaugggccuuaccaucaguuuauggggaacgaccaauaauuuuggcaauugcucgaguuguuuagggguuucuuuggccaacagcuuucugucacuggagguuuuacuuggagguaggggaugagagaugucuaguugugguuuugucuccccuauuuuugagauuucauuuauguuauauauauauauauauauauauuuuuuuuuuuuuuuuaagaagcuucuacugggguagguuuccacauggcccccagauagccuguugugcuaccugucccuuuuuauaucccucccuuagugcccgccuucccugauugacuccccugcuucaguucccgcccacccccaccuuaacuguauguuccguucccccuuccuugggcgagccucccgcagcccuacucccugcagcuaaccucuaugguuauacagauuggagucugucuagacaacuauuggaagcuuauguaaguagggucucagccagcggacaaagcaggcugagcacaaacuuuagugauaaguagcgagcuagaaacagucuucguuguucucuuuucuauaaguacauauuauuuucaucaucaaaaauuugaccuacuuuuaaauuuuuuuauauuugagguuaaaauuuaauuacaguauuuccccuugucuuuucuccuuccaaauccucccaaauuccucuccucgcgcuccuucaaauucuugaccuacuuuuuaaggcaugcgcuucgcugaccccugagaagaagccuaccguagcgacacagaugggugugcggcgggacugaucaaguguaacccuguuaccugugccccacuagaggugguuagcaagagucugacucauggcuacaacuccagucccaccucacauaguccgagaugucacauucaguacaagagaaagaaggugggacccaacguauuuuaaaccagacaaaacaguaguucuguuauuagguuauccauuuaaauuuggcagagcaccaucguucaggguaacgauuacaguaagaagugguggaaccaugugcuguggaccucaggaaacagccaagcgacagggcuaaagcugccuagacacuauugccaacgugaugauccuugucugggccugucucaccagugcguaccaagagccccagcaguuucagagaguacugcuuccccccagucauucugaugccgcuaggagcaucacugcggacaguuccagaacccaccugugucuggaaacacagcuacaugugcuacccugaggugcaaugaauaguuguuuaaaauuugauaagagaauucuuugcaagugcaguagcucaaagcaaaauaacaguggagaggaaggagagagagagugagagagagcaucuuuaccucuucaagauggccugagcagccaagcaagcuugggaacugucaagugaaaaggggguggcauuugggguagggaaggggacggggaggcagagggggaggaggggaauggaauagaucuaaguuugggcuuuuuuuuucccccucuuuaucuguuuauuugaguuuuguuuauuccugccucacucugaagacuagaaagcaggagugagagcugugaauguaguaagccuacguccaguuaggaguuccagcugagcccaucuaguacagagguguuuacaaaguguuuacuguagaccugaccugaaauuaaaguggcgaguggagcagggacagagacucucuuaagccauguugcuuucuucaggcugggcagagcugggcugagaaggaagaacacacagcuaaaugccuuccgggccuguuucggccaucuccucucuugacugcguugcuuguucuuuaugucauagcaaucugcuagacuugccaguaauugauaaaccuaaaauguugcuuaaagaaaaugcuccauagccuaagcuacgaucaagcaugagaguuuggcuuuacuguauucagugcuaagcuuuagaauaauuuuuaaguuaacugccguguucugaagagacagagguguaguaacaggaaagguuuuguugucuacuucccuagggaauauuaaauacucagcuucuggaaauucaguaaugaacugaaucuaacucuuaugagcagcacaguucaaacaucucucuaaauauaaauacugacaacuuuuucacuuggaaaaaaaaauucccuuuuccugguauauaucuguaaacuuuuacacaugcaggcuuuuagaaccauuaccacagauagacuacauaguaguuccaucccccaaagaauaucauugugcugaccuucaaaugugguauuuuagauuuauuuauuucuaguucauguguaucgguguuuugcuuuuguguguuucuaagcacuauguguaugccuggugcccccaaagucaaggccuggagcuacaggugcuuguuagcugccauguggguaccuagaaugaagcgugggucuucugaaacagcaguggugcuguugaucacugacccggcuuuccagcuuugugauguccuuaguuguuaggccucucauguacccugggucccuaagccaaaccuugagagccaucuguaagucacauacaccaugguaaaggguggauuuuugagucuuugagaggguaguauuguguggcaagacuucuuggggagacgcuacacagauaucuacucagaucccccagaugugaguccacgacagagcagaguacagaaucuaccaaaguccaacucuaagacagcugcgcuaccaaagcccaccccagcaugggugacagcuuacaaaguugagaaccuggaacgcacaguacaacccugcagacacucaacagguuagaguucguccuuuccgagugacuccgauggaaagcuucuuccaggcagcucagcuauuuucugcuucuugcagccagugauaggguguuagagucuucuuaacaccuuggcuugucuaagaguggcccucagcugucuuuucugcuuauccugggagcaaggggccugguuaaucuguucaguuucauggacuuccugaagcuauuuugaguuguuuaccuuccuaucaagaagcuucccuguuggauggaauauuucagucucagaggaaacagcuacacaauaggccuuagccaaccuuugaccaauaagugcauucggacgccccacaacaauacacaaguaaaggacagaaagcgagcagagaugucaguggguauauacugugaggaguagguuucacagaacuaguucagucaaauacacaaaaaccccaaggaccuucauacccagaguugaaauucauauuaucugaaagggccaguuuucaacaaaaaauauugugagauauaaggaauuuggacaggguaaugcaugucuagguucaguaaaggagggagggagcucuaaaacuaaauuuuguagacaagacuuucuaauuaacacacuauaaauauuauaguuuuaauuauaguuuuuaacaaaauaaaauuauguaggaagaguucuuuuauagcuaggguuacauuggcaugccauacacacacacacacacacacacacacacacacacacacgggacuguaucagcucaggacccccaggaccacauucuuagcccaaaggagauuuauuugccccagagggucaaagagcagggacuaagagacaaaggcaggagauagaggacagggagaagaguacuaguggggaguggggcacggugacaaugacaaaggaccaccucuggauagagagcagacagauguggcagauaggaaaauggcaguucauaaagauaaaagggaaagccccguauccaaugagguguuuaaguuuaguugggcgcgauaauuaugugagccaaagggagcuuuugauugcugaguuuccauucuuugauagccagaccuugguggucagccucaggaggaggaagaagucacauaaagagaacagaccaugguggcuagcuuuaggaauguaaucuaauggauuagcaaggcagagggaacgggggagaagggcaaggucugccagagccauaagugccaugcuugggcuggaaacugagggcucucauccuaagccacaguaggaagcacuaggaaugacucacagagcccaccccugguggcacacuucuccagcaaagcuaaaccuuguaaacucauccaaacagugccaccaaaggggaccaagucguucuauugggggggggugcuucucauuuaaaccacaauuccaaguauuuauauauacacuauauauacaaauauaugaaccaaauggagauaugagacuaaaagcacaggcaacguuguuagacuauaugaaaauuuaaaacuucuauauaucaaagggcacaauaaagagacacccuauagaaugaaagagaauauugccaaucauguaucugauaaugagguuacuuacuauucagaauauauuauuuuuaaaauacaauucaaccauuaaaugacuugacuuugagacaggcaaaggaccugaucagggaucucucaaaguaaacaaauggccagccaacguggaaacuucucaaucacugagugucgaggagaugagaauuaaagccacaguaaugugucuccucaaccuaucaagauggcuggguauaaaaaaaggggaacuggagggaaaguagccagcaucggcgaggaucuggagaagcugguguguaaggcugcuagcaaacaguauggcagguucucaaaaacaggaaaguagggcugguaagucauuccugugccugagaaagccugguaccaaacaagcauuucuaacacccauuuuaauagcaauaguguucauauggcccagaggcaaagcagcacaagugucccuugguaggugacuagaugcauaaaguugguauucaaugcaagggauuguucagucuuaggaaggagacccugccgugugcucugaagcacauguggccgagcucugaggauccugcagugagcaaagcgguauggccacaggggagaaguaugggccuuacaccagcugcauagcagagccacugagaaaugugagccucuaugaaguacagcaaucguaacgucugaaguagaaacggucgcaguuauuaaagcacuugccuuguaaaggugacuucccuaaaucagaucgcacauaagaagcuaggugugguagccugugugugaugucccagugaaagcacagugggggcuguggggaggggggcagauccauggaaccugcuggcuggccggcacagccugccugggaaaguucuggagcaacccgagggaggcacugucucagagucagggugggccguaccuggggaccagcaccugacauuccccucugacacccccuaucccuccccacaacacaugcacuccuacauacacacacaguggaggggcagagaacauuuaaaccuuucaaaaauaauuaaugauaacuuaaaauaguuuguccuuuuacauuugaaaaauacuaaccuauacauuagauaacgcaaagagaucuacauccagacaugcgacuucagucggaagacugaaaaacaaaagagcaaaucuugaaaggaccaggaggaaagcagccauugcauacaguagaacuucaguaaggccaacuggucacguuuucaaaaacaccgaguccacaaggcaggaggcaagacaacagaaaguauccauagccagcagaacuauccuuuaaaagugguaauagcaaaauaaaguguccaaaccaagcaaacugagagaauucauugcuggcagacuugccuuacaagaaaugaugagguaucucaggcuaaaacggugacuguaggcagggauccgagucucucggcucaggcgugaauggaugcucuggcauaggccaugaaaagacacaaaauaguuauauauuccuuugucuuuccuuuuuugaacuuacauaagaugucaugaaaacaugacuuauaucuggcuacuuccuaauuauguuuucaucacagcauccucccuugguccaacucggccaaagggaagaugaagccacggagcuaguucuugaucaugucucaaagaaaugguccucaaagacaucuuaucaauuguccgaucgcuuuugugucuucagcugguguguuaggucuguguuucuuugaaggcacuaucaaaaggcucuugggauuucuuaauauaguaaaaaaaaaaauuauauauauauaucccugugaaagaagugaagaacuacuaaauuuccaaccgauccuuccaucaaaagagcaacauuacaaaaacuauugugcuguuuaagcugucugcacugcuagcuuggcacauuauuggugacauuugaugaagacuccacacucuaaugaagugcuucugaaacuuggccagacucuucccugugcuaccaaggaagacacaacaugaauccauaucauaauugcuuguccucucuuaccuguucugcugccuagcaaccugugcugcugccuagcaaccugugcucaagaagcucgggaaugggcuggagggauggcucaguggaacaucgguuucucuucucgaggaccuggguucauuucccagcacccacaugacagcucacaaccaucuguaacuccacguccaucacccucuucuggcuucuguaggcacuggacacacauggugcagaaacacaugugcagaugaaacacucauacauguaauuaauaaaccauuauaaagggaaauaaucucaggagucagagcaacaaacagagagcuauaaauuaaacaugaaauauagagaaucaucugucaacucuguucacauuguguuuguggugucuuaggaagccagagugucagugucugugucugugaggguacccacaguggcuagaagcagaacuggaagauacgggcaucugugaguuccccagcauagaugcugggauccaauaccaguuuuccgaaaaagcagugagaacccccaaccacccauccuuaccccagcagcuccagggcagagucguguaaguaccauccguauuuuuuuuugagccccccgaacccaucagaacagaacuagcaaauaaauauguaagagccaagauaucuauuuauauacaagguuccauuuuaaaugcagcuggaggacgguacuuccuuaauauaguucuuggaaccuggccagcaguccaacacuucaggcacagaauuagagcaagccaucccaggacugccaguugauaaaaauuuagugugauaagugauuuauuuccucaccaaaggggggggggauauauauauaaaaacccaggcccuggggguuucaucccauacauacagaaagcaugcaugggagaugccuagaccuuuuuccgucuucagugggaaugaauacauaaagcccugccauuuguucuuguccucccuuucaaacagcacuggaccuaagauacucugcuguagcuaguaaucgaucuauaaagcuccacuacagauguuucugcauuuccagugggggcuggucuugggguacacagcauccacucagaguuuuagcacccgcccagcugugguuucuuagauggaagguggcugcuuccuuaugcuccaguuucuucagauuuuaaucgaugaugcuucuuuacuuauaauaacuuuuuaucagcccacugagauguaaacucaagcuuauuuauaauaacccaccauacaguuuucuguagagaaauaacggcuacccuuuucucuugacuuugaacuucucugugggacucacauaguaccuuguaaauucuucugccaucucgccuuaacuucuugaauuuuaucccaucuuaauugucuuugcuauuuguuuauuucuuuauuuauuuauccuuuaagaauugcuuggcuaggcaugauggcacaugccuuugauuccaguauggagaaagggcaaagacagggagggggaucugaguccagaaccgcccuagucuacauagugagacccuguuucaaaauacaguuuuauauguguauuauguauguauguauguauucagauugaguuagguuuauauaaugcuuucacagagagaaaaguccaugcaggagucaucgaaauagcaacaacaacaaaaagcuggaaaggaaugaaaaugucaauagagaaaacuguaagagcgagaaauaaagcaggaauggggggacaucuuggggacaaaaggguagagaaagccagggccucagcucagaaguagaagcguuagguggagcaaaaguaagcugguucauguuccauaagcucagaaagacccugccuuguccugcuugggaaugggucugaaagcuccacccaccuccucccacaaaacaaucuuguggcucucaguucuaggcaaaacugccucuuuccaauccugcggucucugguuggugccgaauuauagcguugaacaaggcuuggagggaucacgugaccuagacaccuuccaaggacaaagccuugguugcaugccuugcaguggauaugcuucccuguccuguccucaccccggcucuacccuuccaggaccacagggaccaaacgugccccggauggaauaacggccaccaacgaggcccaguaaguguggcccagcacuuccacuccauaggaucuuuguacuguugcacuugagugucuccugcuguagcauugacucccaccagguaguguguuuagggacuccucguuuacagacucucucuuaugccagccacaucuucacaguggcaaaggcugggugagguagcucugaaguccccucgggcuccaguguccugggauucuccagcucuggaauucagugcaggaauaaaugaguaguuauaagcuauuuuguauaaacauuauccuccaguacuauugcagugaaaacgagugcagagagcuugcccugggagcacaguguugucaguucagccuggauggucacaugaagcacacggaagauaaaggaaggaugugagagggaaccaggguaacaagucuacacaaauccuguagagcauagagcggcacccaggaagacuccaagacuaggggccccuccuacuaaguccccagccaccagaaugacagauacccucgaaaguaaaguagaacaugaaggaauggaaaaaguguuuuauaucuugugguacaauacacagccugagcccaaacuguuugaaagucaucagacaauuauuauagucacaguaaauuuauuuugucuauuaaagagaaacaagcguaugcugguggugcauuuaaaaauaauuaauugccuugugguauuuugaaguuuuccagugauagaaaggauaauugcuuacaguagaaaauuccaaugaugucagaaggggugagggugaagaagggcugcgguuguagcucccuaacagagcgcuuaucuaguacccuuuugcagagccuagaguugcuggguuggaggaauaaaugccaccuagagcgcucaguguagacagcaggcaugcuucuccagucuuacgcggguugacuucagguagauagaaccguuguauacacugggugacuuagcuaucacgugugcuagcgucgggaaaacucuuuucaucauuuuagugauaacaguagucguucauucaccuccagaaguugcugguauuuucucacacagcccccgcucuaaggacauuaaacacuuucuucucuuccauguguauaauaaaugacccuaugucaauaaaccuaugucaauauuuuucucauauuuaagauuacuuaaauucucaaacauuugaaguuagcgucauaaauuccuggguaguuuucauucagaauagaguccugagauggccuugcaucugcccagccuggcaaguucaggacagucauuuccuacaugaaaagaagggcugugaggaugguccacaggagcagacgugugcuuaggacuguagauacggccaagagcccaucgcugcgguucucauaguucccagaggugaugucacuacuauuccuuugcuaaauggacauaguacaguaucucuauacccagagaauaguauggcuaucacccuucaucaggaaaauuccuuuguaugccagauguuggguaacacaaaaaauugcaaccugucagaauacagugaauaagugucuauggaaugcuccaccauaaauagaacauacagcauaucacauuaauuuccccacacacauucacaccuacccacccaggguauacuuggggaauauggaagaagagggggcagaaagacuguagagccagagguuggaguggaccagagcaaagcaguaucuucugaccaugacaagauacugcccucgugaaguaacaguagcaguggcuaccugcacaaaaucaagccagucaacauuuccaacacagaguggggaggaggucaugggcuccccucccuccuagcugaaaacuauagccaugagugguuggcugcuggacacaggugugcggaauaguuuucuuccuugcugugguccuccacuggacggccacacaucuaugcagauaugggcagcacaaagaggacacaguggauuaacaaaaagacaacuuugaagggggugggugauggugguggaccaaggcagagacagggaguaguggagggugaauauaaucauagacaguguauaaugugaacaucucaaaagauuaauaaaaauguguuuuuuuuaaaaaagcucuuguucugaccacccauaacaaaaauaaguaaguaagugcuaucucuugaaacuuucauaaccauuuccgauuagaguucuggugacagcauuacagaacuacguuuagaauugauauuggaguuugccaaucagggugauacuuuuauuacaacauauuuacucucaaacucuaagguucacaggcccagauuuaaacuagccuccguccacugggucgcaagagugcuucccugcuacacggaaacacuaaucacuuggggcugcaucuuacaagcuguguugaagacacaccuucauagcaaggccugccucucucccuguggaggaugaggauguaguaguuugagugagaaaugucuaguagcuucaaguauuugaacauuugguccccaguugaugaugcugucugaggaagcauaggagaugcagccuggcuggaagaagccaaucauggugaugggauuugauaguuuauagucuugcccauuuccaauucacacugggaauucauauuuacggcaaaaggugugauuuaucagcuuacugcccuugcugaggcaccggcaccucuaccccaacagcaaauuagacucucgucccuguggagucauaagccagaauaaacccuucucuccucuaaguuccauguggucaugguguuccaucacagcaaagcaaccaauacagcacagagucccuaacugggaggaaguuggcccgccccagcagcugucuccucccucuccugggaaggggguuucauacagugcuguuaauacacccucuaguucgugcuuucucuuggacucucaaugccauuacuucaaacaugauccuugugguucaaauagcuagaccauuuucuuuuguuuugggcugugugucucugugucuguguguguguguguguguguguguguguguguguguguguguguguguguguguguguuuagauaggaucucacucuguaggccuggcuauuuugaaacuuguuaccuagaucaggcugaccuugaacucacaaagauccucuugccucugccuccuaaaugcugggauuaaaggcauaggccacuauguccuauccaccuugguuuuugagacagggcuuaucacuagaacccgagcucaccaaucugacuaggcugccuagccucugggagccuccugccuccaccuucccaguacugggguuauaagcaugagccauugugcccagcguuuugcacagguguuggggaucaaaguguagacccauaugcacuaucucccuaucccuagccggccaguuuuguggugccucuauggaaguaucuccuuuuacacacguagaaagaacucucuuuucuguuucgguuagcauagaggaacugggaauggauaaauaccuacaguaugagaaagaaaacuaucaaaagcgaauaccaccugugugaccuggauuagauuggauuaguuuuaauuuguauaccauaaugcuuaccaguuuuacguguguacuuccaugaguucugaaaagugugcaguaauauaacugcuaccauaggcgaaaguuaagccaaauauucccaguguagacaaguuucuucaugaccuucagcuaaacaccccuuaagaugaaucaacugaguuguuugaucagcauacguguaccacgcccuguaaggaauugccaaacugucuaucuguguggcuuucauauuuuguuuuguuuuguuuucuguuuuugagacagggucucagcacaucucccuuucuggcuaucccggagccauaccccuauggcuuuaccauuuugagucauuuugucccuuaggccuuucagcuuuuccauauuuauuuuuuauuuuuuuuaguaucucucuuuaccucaucgcaaccccaggagguccugucccuuacagugugugugugugucacucuagccaaaaaagagccaaagugguuuagaauauacaugggaguuggccaagguccacggccauuacuaaaaaagaaauacuaggccuaagugucuguggccccaagcguuaccugcuaaugaugcuaacaguugccauguuguggcuucuacguugcuguaaccaguggcuguguaccaacuucccugcuucccagcuagccucugagaugacuuacuagagggggguaacuaggaacuaacuggacaggaauggggauggagcccugccagcaggucauguacucuuucucuuuacacagaagagagacaaauguucccuuuuacagccuggaagaggaaagaaggggcgugugugugcacacucacaagcugccacacacacacacacacacacacacacacacacacacaccauccuccuccagagucagccuuccugccaggugccaucuuucaucuacauccucaggcucucaugcucuuggcucgcacugaggaagcauuccaccuuccugccucuguguucccugugccugggucuggucucauguuugguuaaguugccccgccccuucuuucugcucuccuccccccacucuugcuuccuuccuucguucugcuucuguggauauucuguaggcuccuuuguuccccagccugcuuugcauguuuguaagaugcuuuuaagauggcuugaggggcugaggagaugguccaguggacacacacacacacacacacacacacacagaggguagaagggcuaagagauggucccgugguuaauagcauggacuacuccuccagaggacuuugguucgauucccagcacccaaguagugucucucaaccaccuguaacuccagucccaggauaucuagagcccucuucuggacuccgugagcaccagacacacaaaaggcacgcagacaaaacacuccuaaaauaaauaauuguaauaaaaagauauucuaaauaugcugaaaagccauucaagaagauacccgugucaaucucugaccuccacaggcacacauacagccaugggcacacacacgaagcaacaucuccauucucaccaugaacaugaacauauaaaauuacuuucacaaauauaccauuacauuuuaaggguauuuuuuaauauauuagauuuauuuauuguauguguauaaauauauuagauuuauuuauuguauguuuauugccugcauguauguauaugcaucaugugugugccuagugcccaugaaagucaaaaagggcaucacauccccugaaacuccaguuacagaugguugcaagacaccauguaggugcugggacuugaaccaccaugcgagcgcaacaugugcuuaaccaccacaccaucucuccagccccugguuuugacuuuuaagaccaguuggcuauauagcccacaaaaaccuugaacuuacuaaguagcccaagauggucucaaaugcuuagccucccaagugcuggguucaaugugccagcuuucccugugacugucagcauuuuaaaguauaaugugaaugcuugcaugugucauucaggaaugguaugaguagaaauuccuuaugacaagaucugugugugagaugucaaaagagacacuuucuuuuuuauuaauuuauuuauuuuauuuuuccccuguaguucugaguauugagcucaggccauucuuucgcuuguuuguuuguuuguuuguuguuuuguuuuuugagacaggguuucucuguauaguccuggcuguccuggaauucacucuguaguccaggcuggccucgaacucacagagaucugccugccucugccucccgagugcugggauuaaaggcgugcgccgccaccgcugccaccccccacccccaccccaggugacacuuucuuuuuuaacgugaauguuuuguuuuguucuauuuauuaggaaaagguagugauuuuuguguugggggaugggggucuaagucaccauauguggcagagucauuagucaucacacccuugaaaagggagaacucucucuucauccgacuugucaagaugcaagauucagauucagcuugcagagacaauucgucuuaauugucagggagugcgugccgugcaucuggguccuuacaggcagaagccagacgcucaguuaaggcucuucuacuuggggaccugauccuuaaaggaaagcuuuaagugagcuuucagguaaaaauagcacaguggagagcacggugggaagugggugguaguggaccaguccuuuacaacacaagugcugcauugugguacacacaugugaucccaggacgcgauggguggaagcaagagggacggaaguccaaggucaucuuuggagacauaaaacuauaacgcaaaacaaaacugucuagauuaauauauuucaaaaaaucagagcuggguaugguaacucaccccucaguuccugcauucaaggccauucuggucuacuuggugacuucuaggccaaccagagcuacguagugagauucugccucaaaacuagaauuaaggggcuggcgagauggcucagugguuaagagcgccgacugcucuuccgaaggucccgaguucaaaucccagcaaccacaugguggcucacaaccaucuguaacuaaaucugaugccuucuucuggagugucugaggacagcuacaauuuacuuacagauaauaaauaaauaaaucuuuaaaaaaaacuaggauuaaauaaauauauaugugauauauauguauauguaaccuacaaaaauuauauuagauauauaugggaugcauauguacauagaaaccacagaaccucuagaaguaguccucagcagggaccuuuuuccguaaguauguuugggaccacaauuccuucacauucccggcuuaaaauaguuauaagucuguucaaaaauagucugagaauguuuguuuucacuuacauacaugcaggcaaaaacacucaugcauauaaaaaucauuuuuuaaaaagauagcugucuucaucugucauuuuuauaaacuccacacuuuuuauugcuucguguccuaucuaagccuucccaucccaggacuaaauaaauauuuacuugugucuuuucuuauucucuuuaggcuucagauuuuacuuuugaaacucauuuguuucgguguggggaaagggaaucuagcuuuugaaaaagagauuuauuauuuuccaugugcagguauuuugccagugugcacguuugugcgugacauuuaugcagugcccuugaaggccaaaaaaaggcaucagauccccugggacuggagugacaauugugaccaaccugugggggguugggacugaaccugcucuucuggaagaacaaaugcuuaguuacugagccuccuuccagccccacgucuagcgguuuuccuugcacacagcugauguugaguuggcucagcaucaucuguugacugagucugcgugugcucaucuucaaaguucagcuuuccugucaccacccuccuauguaauaccucaucagagcucaguuggucagaacauggacagcuucaguucucugaaagugaucauuucgauuuucuacauggcaucgucuagcuuguugaggucucagcuaaagaaguguuaccaucuuuuccugggcuucagauucugggggaguuuuuuaaggcuuauuuuuaaauaugcaugcacauauuuguauguagguuugugcacuugggugcagugcccaaggagaccagaagggcaggccugcaguccuccagagcagaagagagcagucucucucuccacugugcuguguuuacguguacacuuuguuuaugucaccugagcgugacguaaaugacagauagauggguggaaagguggacgaugggaaagggagaaaaccaaagagcuuuggguuguuuuguuuuaaguccuucuggauauaaagugcuuuggagauagagggagaaauuguuuagguuacccaagacuggcuguuguuccuccucaguccagcaccauugaccaggaguucagugguuggggcguggacacaaaagugaacucacgcuaaauguucugcagugcugggcauaggagcguuuuaguguaaguuaggaaaugcagauuuuucucuuauuucuuuuuccucaagauuuuauuauuuuauguguauagguguucugccagcuaccuaucuaugcaugacauuaaugcagugcccuugaaggcccaaaaauggcaucagaucaaaucucuagguugggauugcugccagaguuaacauaaaaaauuacuaauucccacccaaacaaagcaaaggacaccauaguuuugugugccaccagcugcugucugugacauucuggugacuucuacaugcaguauauccaagagagcuugucaccaacuccucuuuugucauugagcccacucaguuauucauccgucccgucccucuuagcccagaacugugaaaugaagcugcuuucuuucccuguuacuguugcugugacucuaauccaggauccucacggcgugcuucagcacacagucugcacuacagucacacuugccuccugggcagcuuguucuccacaacacagccagaguggccuuuuaaaacuacugcaucuaggcuggcaagauggcucagcaaguccacuuaguugccucuaagccuggugaucuaagugugaucucuuggcuccacaugguagggacuaugaccuccuacugccaccuuggugugugcacuuacacaucaccaaugaauaaacauguaaacacccgugcaugcacauauauguacgugcaugcaugcacacacaugcgccaggucugaucaugucagcucccugugauaaagaccguucaccaacacuguccacauguggcuuaucuguaaaguggcccaguucaguuuccgucaugucuccccuuguccuggccuuuucccaugagaagggagugguguaaaugccucgcacagucgcagggguaauuuucccuccugagaucucccuaagcccuuccugcccucagcugaggucauacucuauuuucugcucccaugugauaugaguuggccguguagaaucuccauuuguguuguuauuugauuguagucuguuuccgacacuacuguaagccccgguagugccauaaccacuccauuucacucacauuauauugccaacacaggacauacuuauauuuuuguuuacaaucuacccuaggaaaaaaaagauuucauuuaaaaaaaaaugcauuuucagagaaagagcaguggugccaguuuuuuucaugugugugugcguguguaugugugugggugugagugagaguggugugugggugugagugugcacacacaugcaaaugaauugcagauacccagagaggccagagagggcauuagcuauccugaagcucaaguuucaggggccucauagccaccuagcauaggugcuaagaacugaacucagguccucuggaagagcaaccugugagcuaucacuccagcccucgucugucuccccucacccccaaaucuuuauaguuuuaucuauguauuaauaaacccuucugcagcugggcgaugguggugcacacauuuaaucccagcacuuggaggcagaucucugugaguucaaggcugccugaucuacugauugaguuccaggacagccagagcuugaaaaaccaaaauaaaauaaaauagaccuuccuucaguggaagguugucaucuccauugaaaacagccuuccauuugccucacguggagccugaagagaauaaacaucuuaaaaaugauagaauuuaucaguauguauuuuguuuaaauuuuauaguggcugcguuucauacauguagcucaauauguuuguaggcuuauuuacugcauauuauuuuuauuuuggaaagaaaaauauuuuuaaaaaaucauagauuuacuaccaucucaaaugguggcuuaccucuuguccuaucccaccccucagggcuagggauucaaccucauguguccuaaguaagcaugcuaccagggaacuccuucucaggccucuuuugcucuuuuuauguuaacuuuuuaaacugccguaaucauaauguauaugacauuuugcauuuuuuuuccuccuacaaaagccuuaccuguugauugaucagcguaucaugcugcguuuggcagggaugauuagccuucuucacuuugcucacugcagcgagcacuuaugacgcaacacaauacugggcuccauucuuuaugccuugcaccauucagaacaacagccagucugguugauugacaggauagcaauagaacugcaguuacaaagcucccaguacugcccagcuguauuucuuguaggaagcaaaaguuaucuccacuuccuuccuaaauucuuuguuuauucaguaacuugauuacuuacuaccuccuggaguugcagcaauggauuaagaaaggucuaucuucuagaacacagguccugccuccucuugugaaugaaugauggaugaaugagugaaucaggugaagaguugaaguuuuuuuuuaagaacaacagggaugaauaagggcauagggaaaacaccugagucguacauuggggcagauugcuaaauggagcaaggagggcgcuguggggcugacugggagagggucuguuccuggcagggaucgucagguucuguguuaguuacuuuccaguuugcugcgacagaccaccacaacccaggucucuuagucaggguuucuguuccuguacaaacaucacgaccaagaagcaagcuggggaggaaaggguguauucggcuuacacuuccacaguguucuugaucacuaaaggaugucaggacuagaacucaagcaggugagaaagcaggagcugaugcagaggccacagagggauguucuuguuuccccuggcuugcucagccugcucucuuauagaacccaagacuaucagcucagagauggcaccacccacaaggggccuuucccccuugaucacuaauugagaaaaugccuuacagcuggaucucguggaggcauuuucccaacugaagcuccuuucucugugauaacuccagcugugucaaguugacacaaaacuagccaguacaucaggcaacuuauaaaaguauuuuaaaagucauagauuuacuaucaucucaauuaaugaccugcuuuuuguccucccccuaccccucagggccagggauuugacccaggaccucauguguguccaagugugcuucuauaaaagagagcauuuaguuggguuuauaguuucagaggguuacaauccuuaagaguggcacaaaggcauggcagcagauacaacggagaauccacagccugaucccaaaggagaaggcagcagaacaagccuggaauggugcaaggcuuuggaaucuuuaaagcccaccccagugacacaccuccuccaacgaggccacaccuucccauccuucccaaacaguuccaccaacuggggaccaagcauuuaaacaggagccugugggccauucucacucagaccaccacaaagaccaaagcccugggauccacugugcuuugugauuucaaguagugaagaacuagagugaggggugaccgggagccaaggugacagggugggugguaaucucacuaugcaugugagccucugacuucuccuggauaaggugagacaguagauagguagcagauagugagcagccugcccugccugccacacccucugucuucucugccccuccccugaggcccaauaguccuuccuuugucacccccaggacuagugaccuugucccagaguucgaagacacaucauucccacgcauaaauguaaaugagcuucgcuguggugucacagcuggguucuguaaccagagccaggcacauuccaagcauuugagaaacauacaacuuugaugucuuauuuccuuaccugguccucauuggaggaaaugguuuucugaaaacagugaccaaauacauuuuuggaccugcuuaggacacuucaccuaauacggcacccugucgcucugugguuauuaaacaaucuggaggccagcuuucuguuuauuuuuggaugguuuggaggggaaaggcugaguauaauguucuuugaauugcuucguggucagaucugucaaaugccagagaugaucccguaagcaggcuugcuuuagcaguucacuggugggagaauuagcuguuacaaauauucauagugauugauuucuuuuguuuuucuucuucuuguagaaagaaagaucacagcuuucccagccugggagaaaaacuauggaaugcgguguaccacugacugaccguaaccaaacgaacuguaccgacaguaguuugaaagccagcaguuagcaguuucuucagacuucaacacuguccagcgcuuuccagagcagacucacuguuuacaagaacucuuggccucccgaaguuagcaaccucagauuuuguuuauuuaaagaauuucugugaaagaaaaggaccccagagcccauuuuccaaaauggccauggacggguaucuguggauggucauuuuggguuucauuauugcuuucauccuggcguuuucagucggugccaacgauguugccaauuccuucggaaccgcggugggcucuggcguggugacccugagacaggcaugcauucuggcuuccauauuugaaaccacuggcucugugcugcugggggcgaaggugggggagaccauucggaaaggcaucauugacgugaaucucuacaacgagaccguggaaacgcuaauggcuggggaagugagcgccaugguuggugaguagccucccuccauuggcaccagugggacguguaugcacuuguguguacacgcauagcacgugugcgcacucucucccuugcucccauggcuauucccacaagugccgucuuuaccuguuuugaagcuggcuuuguuuuuugugucuaccauaccauuuucauugacuguacuuuguguauuuuuuuuuuuuuacaagcaaacuucuagucucucaaauuuuuagccauuuuaaaguauacuuggcacacagguuaccccucguagaauauugaaauguuguuuuagggauauguuaaauuuauuaaagaauaugcauauucuuuaauauaucaugguuuaaauuuuuuaaccuauaaccaaccuugcaauuuuauaauuuaaucuauaauuucauuauaauccauuaaaauugaaaauuuucucauuaagguaguaguuuuuaaccugugggucccauuucauggaggucacauaagaccacugaaaaacacaggcacuuacauuaugacucaugacagcaacaaaauuacaguuaugaaguagcauaguuggggucaccacaacaugaggaacugcacuaaaggguugaagcauuaggaaggcugagacccacugcuuuaagguauugugagaagaaguguuaaaacucugggagaaauagagacccugacagacuugaguccuccucaguagggacucuuccuccuggggagcccucgugggugauuuucugcuucucuaagaggcccucugaguccccacagagggaguguggcgucccaccgcugucaguccguguagcuguccagucuccacuuuuuccauccucggccuuuggcuccuuauucaaaaaguaaaaggguuuuguuuuguuuuguuuaaaccucaacuagauuuuggguuuaccaaggcaauuugaggguuugucugaauaacacgaucucuucgguuucucuccucucugguuuuguuuggggguggugguugcagcucuuguuuccuuuuugguuugugguuaggggaauuucaaagcucacuugguugggaauuuguaugacucgucuagaauucaaaaacugaauuccuuauuaguaggauccgugugaauuucagaugucacugacccuguugagaauccugaccccucacugucccgugccucugauugccccuccauggggucucccugcucucugucugucuccucuccucucccugcauucucuucauuccauuuccuucuguucuguucuaacuagaccuggggccuccauccugcugucgggguggaguagaaucugcuguuacugccaccuaagcuuccccaacagaagacccuuuaagacccuugcuuagcccuauagaaaaucagcccacugcauaugaggcuuccagaccugagaauuccagccugggcauccaugcucuccuguaaauacccacaucagcagacaagccuugcuuccugccaucagaagaagcucacuaagagcuggcaagccuccuccccuccacuuccuguccucacucagcaccugcccuuccucauaccucccccuaccccucacuuaaucauccagacagugccucacaccucaaagaagccugccucccaucuccucccguucacuugguaucuuugucccagagucugucccuuucugcuuuguaggauaucuuucuucaguuuccuuuguaugacccuguacccuuccgcaguuccaagagugaggcggcucccacgcacugccugacucccaugcagacacacuucaugcugcuccuucacucugucccucugucucuccuucuucccacaacccccaccucauuacaauguauaaacucagcaagaaaaaugaugggggcucucaugagggaaaguagaguccacgugugacagggugaguuccaagcauccgcccacaccaccggguucacuuuauaggaccguuauaaaaccauaaaguuaacacucuucuuccauuccagcucugcgcuaggaaacaggauccuaacuguggcuuuucguggaagucagccaguuacugcuggcccaggucgcagagguagaguccagggaacuguccaauaucccaaagucuugccaccuuacgguagcacaugacugguucuaucuucauucaacacacacuucagagauguauauagcuccccacccaaccuugacucaaaggccggcaugcccggccuuggcugaagcagcuguccacuuugccucauacacuaggaccuguguggccuuagaugacucucuugcugcucagauaucuuugaagaaaaggccaggggggugcuuaaggacacugugcugccaggaaaccugauuuucagaguuaacauuugggauuaacaguccacuuuaucagccuagcccuuuuguuguccuguguucuguuugcccuuuucagcaacugcugcugaaaaggauaucucccagcugacacucagugcucccuguccagcugacacucucagugcucccugcccgccugacacucucagugcucccugcccaacugacacucucagugcucccuucccgccugacacucucagugcucccugccggccugacacucucagugcucccugcccgccugacacucucagugcucccugcccgccugacacucucagugcucccugcccagcugauacucuuauauaugcccugcuuauaacaaugucugcagugacuauauagccuagaaaaacaucaagccuagaacacaaggccagacugagagcuccacauauuacaagcaagaucugagagcagacgcccagcuccagguuaacugucuugguuauguuucacacaagaggcaaaaaccaaagggcaguagagcauguuucucucucuuacguggacccauacgacacgguugaucucugguugucucgugauggacuacaagacagaacaaaacuuccucccauauacucuuuuaaaaguguuauugugcgugguggcuuuuaacucccuuccugguguggcccggcuucacagcagaaugacucaucauuggcacaggagagcugucacucacuuugaguggcuacaacaugauuaguguuuuguaaagaaaacaauucauagagaauuaaacucagggguacauugucgaugcucuccccugccagguggcuaagacacuguauuuugugucuggaguuuuaauugaucucuccgcccacagguucagcugucuggcaguugaucgcguccuuccugagacugccaaucucggggacucacugcaucgucggcuccaccaucggcuucucacucguggcgauuggcccgaaaggagugcaguggauggagcucgucaagauugguaauggccgucuucuuuuaccuuuggccaauacacuucuccuuugcuagaggagguuuuauuaagaguuccuuuuauaauauuuccccccgccugcccacccgccccagaugguaagguuuagaccuggguuguauaggcaacggagcaaggccacuguuuacaugucagguuuaacgccacccuuucaaaauaucacagcaucaucuagcugugaaaaucaguacuuuauuuguucuugccaagaaaagaaaauuuaucaaauugaaucaauguaauggucugagaaagacuaggucuaggcccacgugaagaagagccuuacaucccaguaucuguguucauggucucggcaaagcucagaaugaagccaguguucuuuacaacgcugggucacagcugcccauguccgcccucuggggaagcacugccagguuccuuugguugcaggccuccuaccacccccaggaguccaacuacacuuagcuagugaugaguccuccuggcggcccaucugugccaguccacucagaauuaaaaagaccaucucuguccugcaugcuguugagacugugaugcuagaaccaucauacucuuaggagcuacgggcaauagugggucccuggccugccaguuaggggcacaggccaccgugaaaaucaccuauguaugucucaagcuucuggagaaacggcucucaacucuagcccaguagaacuaccggaaggagcaauucaagugcccacaccccgcucuuauucuguaucuccagaauucugacgcuggggcuggggccagggcacaggccagagcaucacugguguugccaaaugcccagauaguuucuggguguggcacaaacuuggaaccacccggaagagguugacgcuggagauuuuuagucauuagauauggaggaaugagagcagcaaacuggauguaguuaaaggagcauagcccaccuuauauauaaccuugcuguugggacaccaggcuccacauggauagauaaaagcaagugagaggcccagcacagcgcuucucuacccuccugaugcugagacccuuuagugcaguucucaugcuguggugacccccccaaccauaagauuauuuuuguugcuacuucauaacuguaguucugcuacuguuaugaaucauaauguaaaucaagaaguugagaaccacuugccugguaggaacuaaucuguaaacucucgguggaugggaaccucagucaccuagcagcacaaccagccgugugugaccguguuuguucccggggagagcgagggauuccugagcucugacgcauggcaaacaguucugaugagggguguuaacauaugugaugcguugccccuugguguguugcaagucuuaaccuucacugaguauuccuuucauuccuucagucgccuccugguuuauaucgccacuucuuucuggcuucauguccggcgugcuguucauacuaaucagaauguucauccuuacuaaggugaguguggcggcuucucugguuucuggguuguacuaaguuuuagaacugauucugguucuacucaguagaagcuaguaccaguaccaguggcucggcaggagaccuguacuuucauugccaggacucaccuggaguuugagucacggguguucaggaagggucagaagccucagggaacggccaagacucucccgggccuugcacacaagggcgcuuccagccaggcucuauaauuuacuucguuagcccaagcucccagaaauugggcuuagaccucaagaaugaggugauuauuuccugguugucaaacagaauauaauaaaauaagcguuaagauuuugaaauucgaccaauaauuaaaaucagcugucuagucuccuaacucuguggaaaggugcuguccuagucagggugaccacagcugugauggacacugauggacccgugaccauagcaacgugggaggaaggguuuaucacacuucgacuuccagucacaguccaucacugagaagucaggacaggagucaagcagggcaggaaccuggaggcaggagcugaugcagagaccauggaggggugcugcuuacuggcuugcuuccccuggcuuacucagucugcuuucuuauagaacccaggagcacagcucagggauggccccacccacacuguacugagcccaucccagcaaucacuaauuaagaaaaugccucccagucuugccuacagccugaucuaacagguucccuucucccaggugacagugcuugugucaaggugauguaaaacuagcuaacccgagugcuuuuacauucuuuuaauggagaaacacuggguuaauuuaagaggauuuaaaaaaaaaaaaaaaaaaaaaaaaggaaacauagaaacucauuuugucuuuaaaaaaaaaaaaaaccagaacauugaaaucaaauuuggggcaugguggcguaugccuuuaaucccagcacccugaagauagagguuggcagguauauauggggucaaggccagccugaucuacacagugaguuccauuaagagugcuuauggcuuccccaucgcugugaggaaagaccuaaaauaaacaacuuacgaguaaggacauuaucucaggucaggacuuccaagguuuugacccaugauuauuagucucucuugccuugagccagccagagcuccaagcauccugcagaggcggggcuuucaccugggcccuugcuauaugucuacccugucuaguuccagggcccuccccucacagccugauguccucccacugugccgccucugagaagcucucucaccuccuguuagugccuucaggggacacaggauccacauuggagccgaucacuucccugcuaacucuauauuuguggccgauaccccugcucucuucacucuucccuccuucaucccuuccugucuguagggaccuucacucuauacuuguaugugaucagcuuuuggucugcagauaaauccacugcauugcucuccuuucugugcucagccuacugcuacauagcgaguguccucuaguucuacccggguuacugggauccuuucauggaugaaugauagagcuguaauauugguacaucauaaugauauauuuauauaucuauaauauucuauguuauauguguuuaucauauuauauuuuuagcucuuuaauucaucuuugaacacuugguugaccuauugaaauauuugacaagcuauaaggccuaccauuuuuaacuuuauuucagugugugugugugugugugugugugugugugugugagugaguguguguguguguguguguguguagggcaugugugcacguguguguggaagucagagaacaacugugugaagcugguucucucuacugcuaugugguucccaggaaucgaacuuggguugucagagcgcauacaaagcaccuccacccacugagccaucccaccagcucuuaggccugcauucagugguuguguugcacacuugucuuccuggucacaguuccacauuuugcuguuuucugugagagacauguccagauguggucugaaaaugcucaauggaaaguuccacagaugagagcugugcacgcuuugcacugccucuacacgaguaaugugauaaacucacacacuuccaacagcagccagcacggugugaccuccccugcccagcacauccguguugcugaucucuuagccaucucugauacugcaauaucugugcugaagaaacacuucuguggaagcccagugcuucauucgccuuucuucaugcccucacauggggacuguggcaucucucaucauuagaggaagaagggcaagugugauaaauaagacauugacaaagcuaugcauguauauugucauauagcgcuguuauuguguuaucauuaaucucuuccugugcugaauuguaaaucugccauaggagugugugugcgugugugugcacaugaguaugugugagagugugugcaugugagagagugugugcaugugugagugugaguguguguguguggacagaagagcugcucgugcacacucaauacauuaaggacaugacuuccuuccuccguguguuccugucgaccauuaaagguucauucuccugaguaagcauaaacucggucuucagugucucagcauccuucgucugggcuaggauuggccacauuaaguuagcuuacaguuuggcuaccagccuucaccggccaguacugcugcuucuuccaccuggacuuuauccucagucagaacccuccuauccagcuuccuggugucauuuuccaggacaucucuccuaucccagaguuggcauuuuccuccuuucugcucuggagugugcugcccucucuuagugcucgguagugugugguguguuaucucuuccugucugccugcuugccuucuaugaggguggagaccaugggugucuuagucacucuuaauuccagagccuucucuugugcuuacuaccuuuaaagaugcuugccagcaguuuguuaagagaauguagugccgcugagcaucuccagccgaaccagacucuaauccuacugaagaccacuguggucugccagugagaggaggcaaguucugaaucuagaaucucugguaucuugugguuccuucucccucccuuauucucucccuccauaccaccuugccuuucuuucuuuucccuccccaauucucucuauaauucauacuaccaugaagguguauucuaagacuccagauacaaaucuauuggaccugaaaaguguguuuguaaagaauggaaaaagaaaagaacaggaaaaugcucauuuucugaagagagauaagauucaaaucaauuccuucuaaaagacgguuuuuuaaacguaauuaucuuuucaugggccuuucagaaucuccacagauaaugcuucaacagaacugugguauuaauaccuugcuggcacacaagacacaacacacaccaccccaggcuauuaccccaaccaccacccaagugcacccuacccuauccaaccauagcccaccacccuagcccuuuccaccccagcccaaacagccucagcucagcccagcccagcccacugcacccuauccaagccaacuucaccuccccucacccaauccccacuccucccaaaauggacccaagcccaguuucaaugcagagagcucaguuuuucugcaaacaccauccacaggcugagccagcuuccgccacuaccgccccgccuugccgacugcacguuuaaaacaucccacuccuccucagccuuccuauuugcucacccagaugcucugugcuguucucaacacaaacaaaauaucagugagagggaggagagggagaggauauguuggauguuuggaugagugacaugccaacuggauagauuggaaggaagaagaaaaaaagaacaggaggaggaaagggaggguggucucaaggagucauuugucuccuggcugucuaccuccuuagacagccuuaguucccaagaaaauagugcuuuuaucuaaagacagugacaggcggcaccugcguggccucugguuucauuccagcagggacucuuuguguggugcaucucagguggcaugcuagcuugucacccccuucuccagcucagucuuuuauuugcuuuccugugugccccccccaccaccaccaccucccugccuggucugggcagagcucacacacagcaggaaccuuuucagucccucuuuuacauucuuugcgcuucacuaccuucaacacaagucuuuggaccagugccuguggggacuugaggcauuccagaagaucuugcugagcugugccuacuccgccagcauccuuccugugguuacaacucugaaguagccuucaccuucucuuaccacacaguucaucugggggggagggguuacaucuucuuuuccuuugaucuugacagguggccuauucacccacaugcaucaggguauauuuuagagaucagucacuuaaguagcaacuaugcaguaguacagcuuugauguguuucuagccuacauuauuccuuuaaaaauguucuauagaucugcauuucuagaggcuagacagauggcucagcggguaggagcucuugcuguucuugcagaugaugcaaguucaguucccagcauccacauggaacuccagucucaggguucuaacgcccucuucuggccuacgugggcacugcaucccugugaagaaggcacuauaucgguuuggaagaagucauggccaaacacugugcuuggggccucagacaugggccucccaaacagcuuucugucucugugugugaugucagcucaggugacccuagcacucucaugcuggccgcacacgugggcuugcugaaccugcaccuguguagaaggugccugggccggagcagcggcucacugcagcagaacgaacgccacacugcuuccccauaacugggacucgcaucaugaggguuguguugcuaccagaugcucaccugcugaccuccacuuuacucauuguuacacaggaggacccuguuccaaacggucuccaggcacugccucuguuuuaugcugcuaccauagcaauaaaugucuuuuccaucauguacacaggagcgccagguaagaacccgccauggaauccuaagugcacaggaagguauuguaacugaacagcauugacuagcuguggagcaaguccugguauuggcuaauaguaaaaggcauuguucacagucauuaugguauaguagaauaauuauaauaauaauaauaaauguuuuuccuuguuuuaaauaccaagaagauacauaaauugcaaaaaacaacaggcuuucgaguuaaauuccacucagccauuacccacuauguugucccagcagccagcugacagccuuggagucuuagagcuuguucucgagccauggggguggucaggaggaauguccgguuguccaggaugggagaggcgggucagaaguggucuaccgcugcaagccgcagacucccagggucuggugaugauugcuccugcuuucccauccuggcuuaggugugggauggggagaaagagauguguguaccuguagucccugcacuugggcgacugaggccaaaauguugcuugagucaccagguccaggaaagccuggcaauacaauaauuaaugucaaaaaaugucucugcgugugucugguccuuuggagucacgagcacccacuucucuugcguguaagugaguccuauaaaaaccugaagugagaguauuuuccuacaaauguagggaaacuuagaagacaggauaucacacgauuugcugucuaucacauuguagguacugggggccaugcccugcuccauauguguccccucacgaagcggacugcaguguccuuaccuagucauggguacuuuuccuguuaguuuguuugggguuuugguuuuuggagacagguuaucucuacauaucccugguuguccugaaacucacuauauauacugggcuggccucccaagugcugggaucaaaggugugugccacuacaccaggccuccggguauauucuugccagaacaguugcccaccccagguaccagcucugguugguacugggacuacagaauaauaaucugcagaccuguauagacucuuaauauuuccaaugauguaguaacacucagcauguaguaaauauagagauaggccaucaaaauuauuagaagacauauuuaagagaauuuagagaaagaguuuguuauauuccacacgugccagguugcuuaagcugucauacauaucaaucagcaaaugucauaacugagacauuagguccuagacuaggagccuagugggaguucugguccuucgcuuugcuggucaaauuaacuaauacugagggauggcucugauagauccaucuaaagauccgcuccauggauuccugugaucuauuacucacaauugugaagcauccacaguaucuguaaugcgucaccaccauauaguuucguucccccagaaugauucgcuguaccagcaagaugguccucuugggcaacauucagaacauguguaguaaaaugauagguaagagagcaggaagacagguggauguaaacacuggaagguuuaugauaaaaucacggcugucuccugacauuuggaaaaacuaggaagcaauaguauugagcagaaaaagaauaccgcacagggacauaccacuuccaagucagagugagggccacaggcuggcugcauccgcaucgcauguggugacaucagaagcagauugucugguguagcgcugagcccgguccucugcagucuguguuuccacagggccucaugugacaguucaggguccguaacucugggcgcuuucucgucuuccucuuuugaggcaggaucuugcuauguugcccagaauuucugugauuaaaugauccuccugaggaacugguuccacaggcgugaagcaccccggccgaucaccgcuucugccgccagcaucacuucacuauaguguuuaugugauggugccccuaaaaaguucugaccaggggguuucacuccauuuaugaaagugugugcacaagugcgugcgugugugugugugugugugugugugugugugugugugugcgcgugugcgcgcgcguaugcaggcgcacaugugcaggcacacacauccuggccugggagcuucuguaauuguccugucccucucucagcuuucugcuauaggacugccggguuacagaugcuugucacuacagcccggauuuuguuuugcuuuguuuuguuuuguuuuguuuuguuuugaaugugggauccagcaugggaugcagguugcacagugaguacuuuuacacccaccccucccugagcccuaacucuggcccugcucgcuccuuucuaucagcaaaggaguccuuaaauacaacccagccugaugucuagcuuugcuagaaaaaacucguucuugagguauagcugccacagcagcacugcuccuccuuccucccuccucuuccuccuccgcagcauacucucuccuccccuacuuccuccuccaucuccuccuccaccuucaucaucuucccguccaucuucuccuucaucuucugcuccaccccuccuccauccccuccuccauuucuuccuccuccauccccuccucuuccuccaucccuuccuccuccauccucgcuuccuccuccaucccagcaccgugaacacuaguagggggugaaggcucuagguagaccccggcuugacuuuaccacguucagugagauguguaggaauugucuuuagcaaaagccuugacaguagccugaauuuaccaagggggcaaaaguucugucaucucuccccuaaaugaucuguuuccagggggccccuuuggccaacagcacaaugagauauaacccauucuuggcacugaugaaugguguccguuggggcugucucucccucauuauuuggugacuccauuuggacuucuuucacauagauaaauguuuuaagaugcuuugacuguaguagguuuucauaugaccucagauggcccucgguguuacuuuuccuucuuuguaugucaccccacacacacccacccugccuuccaacucuuagucaugcucucccagugccuagaaagauacaugcucaauaaucuaccccuucccuggaaaguguacucaguggaaguggugcugaggacauugcagauuuguacgucauacagcucgcuguggucuugauaauauuguuuuugaaagcaugcaucacgugcaacccugugggaccugcguugugucagugagaaggacggguguagggagggguagguaagcagugggaagaagacuggccuggaccaaagccccgcuaguuuuaauaaguuuauucuguacauucuguugaugauuaucagaugcaaaacaacgagaugcaaaacaaaauagugucagugaaauaaugaaaaguucugucaucucuccccuaaaggacugaauacgcuucuguuccuugggggguucggaaaagagcuaagaugucugagcuuagcacagaaucgcuacuuaucaugucuuuguuguuuugaaaccgcgagagaggagcaugagaugagaaagcaucuaguggugugagcugaaaacaagucccaggcuugcauugccggcccuggcagccacuucuggcugagugaacacaagccauucaagcugugcccuacuuuguccauccacagugggaaacagcuacagugccucagugccccccugaacuugugauuauuugaaacaguucaagagccuugccaggaggacaacccaaugugaaguauuuuaccacacauuugaugucugugaagcagcccgaaguauuguauuuagaagaaauuuuugcucaguguguacauugguucaagugucugccuuguuuuuguuuuuuguuuuuuguuuuguuuugcuuucuugagauggcgucugguggguacacagagccccaugauagaguuaccuuguauggugauugagcugcucuaggauuggggucagggucagagcuggagaggagcuaggcugagcuaaggaguuagcacagcacagccugaggaggcucuaaacccauggcuccccgcuguuccuggaguuugggagucaguccaucuaaauaucuaaacccuagcagccaccugcuagccauaagcaagucaagggaggugugggguuuguuuuuaauauuugugaacauucauucagaccuccuguguauguuauucaucuuuuagccucuuacugcuauaaaaguaauaauugagcugaccuguuuacagaauaguuaagacaacauuaguaaagcugucuuucaaaauuaaaagugcuucuaauuuacacaaaugacauucguaacuauguauuuuuuuaauuacuagcucugugugugugaaaugaagcccugcuggaaaacacacucaggccucuggcuucccacuacuaguccugguucacacacacaguuccacauuacuucuguuugucucuaaucauaaguaagcaaacagugcagcaagcuugauggacucaucaccucagagcucauucuaaccacauauggcuuccucgugugcaggacugggugcuauagccauuucacauuucguaagaguucuuacuguuagaaacaguccuggggagagauguggagagcuggcucaaaggucagagcugggcugcucuuccagaggauccgaguuuaguucccagcacccaugucaggugacucacaaccuccugucuucuuccaggguuucuacugcugcagugaaacacugaccaacaaauaaguuggggaggaaaggguuuagucagcuuacaccuccacagcacuguucaucaccaaaggcagucaggacagcaauuaagcaggcaggaaccuggaggcagagcugaugcagaggccuuggagggaggcuguuuaccagcuuacuccucauggcuugcucagccugcuugcuuauagaacccaggaccaccagcccugagauggccccacccacagugagcuaggcccucccacugcaaacacuaagggaaugcccuacagcuggaucuuguggaggcauuuuucucaauugagcuucccuccuuccagcuaacacuugugucacaaguuuacguaaaagauagugucaaguuuacaacuagcuggcacaugccuguaauuccagcucaggaguauccaacaccucugaccuuuacaggcaacuauacucaaaugugugagacugcauguguguaugugugcaagcacacacacacacacaaucuuugaaaaauuagagccaggauaagguauucauucaugucuauguauguauaggcguucaugugugagcauacauguuuaaguucuauauagauauuucugaacgguaucugcuguccuagggacagaaaagaaacuagauacagcucauagcugagcuacaaagacugaagugcuaaguagcaguccuguuacuggaccaccugcagcccccacccuaauugcuacucauugcaauacuggcuccuguugggaggguuuucuggguugugagucuguaaauugacauuuugagaaaguauuacauuugaggggggaauguccuuuaaacaaacuuguauaaggccuuuccuguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccgaggcgaaggauaauucuccuuaauagggacgggguuucguuuucucucucucuugcuucuugcucucucuugcuucuugcucucucuugcuucuugcacucuggcuccugaagauguaagcaauaaagcuuugccgcagaagauucuggucugugguguucuuccuggccggucgugagaacgcgucuaauaacaauuggugccgaauuccgggacgagaaaaaacucgggacuggcgcaaggaagaucccucauuccagaaccagaacugcgggucgcgguaauaaagguucccguaaagcagacuguuaagaaggauucaacuguaugaauucagaacuuuucagcuggggaacgagaguaccagugaguacagcuuuacgagguaagccuggccuugaacuuucuaaggaaauucaagacagucuaucagaaguaaaguggaauauguuuggccuugaauuuuuucuaauguuagaagcccuuuuguuccuuuucacauguuaucaagugguuaagauagggcggauucuggaugaaauucaggacaagcuaucagaaguaaagcggggagagagaguaggagcaaagagaaaauaugguacacaaaauaaguauacaggccuuuccaagggucuugaacccgaggaaaaguuuaggucagguaagaauaccuggggagagauuagaaggaaggaaaagaaaaaagaaaagaaaaaagaucgauuagcggaggucucuaggagauacucgucacuagaugagcucaggaagccagcucuuaguaguucugaagcagaugaagaauucuccucugaggaaacagacugggaggaagaagcagcccauuaccagccagcuaauuggucaagaaaaaagccaaaagcggcuggcgaaagccagcguacuguucaaccucccggcagucgguuucaagguccgcccuaugcggaguccccgcccugcguagugcgucagcaaugcgcagagagaugcgcagagaggcagugcgcagagaggcagugcgcagacucauucauucccagagaggaacaaaggaaaauacaacaggcauuuccggucuuugaaggagccgagggugggcguguccacgcuccgguagaauacuuacaaauuaaagaaauugccgagucgguccguaaauauggaaccaaugcuaauuuuaccuuggugcaguuagacaggcucgccggcauggcacuaacuccugcugacuggcaaacgguuguaaaagccgcucucccuaguaugggcaaauauauggaauggagagcgcuuuggcacgaagcugcacaagcgcaggcccgagcaaacgcagcugcuuugacuccagagcagagagauuggacuuuugacuuguuaacgggucagggagcuuauucugcugaucagacaaacuaccauuggggagcuuaugcccagauuucuuccacggcuauuagggccuggaaggcgcucucucgagcaggugaaaccacuggucaguuaacaaagauaauccagggaccucaggaauccuucucagauuuuguggccagaaugacagaggcagcagagcguauuuuuggagauucagagcaagcugcgccucugauagaacagcuaaucuaugagcaagccacaaaggagugccgagcggccauagccccaagaaagaacaaaggcuuacaagacuggcucagggucugucgagagcuugggggaccucucagcaaugcagguuuagcggcugccauccuucaaucccaaaaccgcuccaugagcagaaaugaucagaggacauguuuuaacugcggaaagccugggcauuuuaagaaagauugcagagcuccagauaaacagggagggacucucacucuuugcucuaaguguggcaaggguuaucauagagcugaccagugucgcucugugagggauauaaagggcagaauucuucccccaccugauagucaaucaacugaugugccaaaaaacgggucaucgggcccucggucccagggcccucaaagauaugggaaccgguuugucaggacccaggaagcagucagagaggcgacccaggaagacccacaaggguggaccugcgugccaccuccgacuuccuauuaaugccucaaaugaguauucagccggugccaguggagccuauaccauccuugccccugggaaccaugggccuuauucucggccgggguucacucaccuuacagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggaaaaaucugcaggaccugagauaaagaagaugggcuccucaggaaaugauucugccuauuugguuguaucuuuaaaugauagaccuaagcuccgccuuaagauuaauggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccauugccuugacgugggaauccucugaagggcagcaagggaaauucauaccuuaugugcucccacucccgguuaaccucuggggaagggauauuaugcagcauuugggccuuauuuuguccaaugaaaacgccccaucgggaggguauucagcuaaagcaaaaaauaucauggcaaagauggguuauaaagaaggaaaaggguuaggacaucaagaacagggaaggauagagcccaucucaccuaauggaaaccaagacagacagggucuggguuuuccuuagcggccauuggggcagcacgacccauaccauggaaaacaggggacccaguguggguuccucaauggcaccuauccucugaaaaacuagaagcugugauucaacugguagaggaacaauuaaaacuaggccauauugagccaucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagagauaggcccagauuugccuuuaccauccccucuauuaaucacauggaaccugauaagagguaucaauggaaggucuuaccacagggaauguccaauaguccuacaaugugccaacuuuaugugcaagaagcucuuuugccagugagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaaaguccaaauuucugauacaggacaauucuugggcucugugguguccccagauaagauugugccccaaaagguagagauaagaagagaucaccuccauaccuuaaaugauuuucaaaagcuguugggagauauuaauuggcucagaccuuuuuuaaagauuccuuccgcugaguuaaggccuuuguuuaguauuuuagaaggagauccucauaucuccuccccuaggacucuuacucuagcugcuaaccaggccuuacaaaagguggaaaaagccuuacagaaugcacaauuacaacguauugaggauucgcagccuuucaguuugugugucuuuaagacagcacaauugccaacugcaguuuuguggcagaaugggccauuguuguggauccauccaaacguauccccagcuaaaauaauagauugguauccugaugcaauugcacagcuugcccuuaaaggucuaaaagcagcaaucacccacuuugggcaaaguccauaucuuuuaauuguaccuuauaccgcugcacagguucaaaccuuggcagccgcaucuaaugauugggcaguuuuaguuaccuccuuuucaggaaaaauagauaaccauuauccaaagcauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuaguggucuuagaaguuuuaaaaaccuuuuuagaaccccuuaauauugugucagauuccuguuaugugguuaaugcaguaaaucuuuuagaaguggcuggagugauuaagccuuccaguagaguugccaauauuuuucagcagauacaauuaguuuuguuaucuagaagaucuccuguuuauauuacucauguuagagcccauucaggccuaccuggccccauggcucuggaaaaugauuuggcagauaaggccacuaaagugguggcugcugcccuaucauccccgguagaggcugcaagaaauuuucauaacaauuuucaugugacggcugaaacauuacgcagucguuucucccugacaagaaaagaagcccgugacauuguuacucaaugucaaagcugcugugaguucuugccaguuccucaugugggaauuaacccacgcgguauucgaccucuacaggucuggcaaauggauguuacacauguuucuuccuuuggaaaacuucaauaucuccauguguccauugacacauguucuggcaucauguuugcuucuccguuaaccggagaaaaagccucacaugugauucaacauugccuugaggcauggagugcuugggggaaacccagacuccuuaagacugauaauggaccagcuuauacgucucaaaaauuccaacaguucugccgucagauggacgugacccaccugacuggacuuccauacaacccucaaggacaggguauuguugagcgugcgcaucgcacccucaaaaccuaucuuauaaaacagaagaggggaacuuuugaggagacuguaccccgagcaccaagagugucggugucuauggcacucuuuacacucaauuuuuuaaauauugauguucauggccauacugcggcugaacgucauuguucagagccagauaggcccaaugagaugguuaaauggaaaaauguccuugauaauaaaugguauggcccggauccuauuuugauaagauccaggggagcuaucuguauuuucccacagaaugaagacaacccauuuugguuaccagaaagacucacccgaaaaauccagacugaccaagggaauacuaaugucccucgucuuggugauguccagggcaucaauaauaaaaagagagcagcguugggggauaaugucgacauuuccacucccaaugacggugauguauaaugcucaaguauucuccugcuuuuuuaccacuaacugggaacuggguuuagccuugauucagacagccuuggcucugucuggacagguccagacgacugacaccauuaacacuuugucagccucagugacuacagucauagaugaacaggccucagcuaaugucaagauacagagaggucucaugcugguuaaucaacucauagaucuuguccagauacaacuagauguauuaugacaaauaacucagcugggaugugaacaaaaguuuccgggauuguguguuauuuccauucaguauguuaaauuuacuagggcagcuaaauugucaaaaagucuuuuucaguauauguuacagaauuggauggcugaauuugaacagauccuucgggaauugagacuucaggucaacuccacgcgcuuggaccugucgcugaccaaaggguuaccccauuggaucuccucagcauuuuccuucuuuaaaaaaugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcucccccugauauaugguuaucuaugcuuaggcaauaggucgcuggccacucagcucuuauaucccacgaggcuagacucauugcacgggauggagugagugugcuucagcagcccgagagaguugcacggcuaagcacugcaauggaaaggcucugcggcauauaugagccuauucuagggagacaugucaucuuucaugaagguucaguguccuaguucccuucccccaggcaaaacgacacgggagcaggucaggguugcucuggguaaaagccugugagccuaagagcuaauccuguacauggcuccuuuaccuacacacuggggauuugaccucuaucuccacucucauuaauauggguggccuauuugcucuuauuaaaagaaaagggggagauguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccgaggcgaaggauaauucuccuuaauagggacgggguuucguuuucucucucucuugcuucuugcucucucuugcuucuugcucucucuugcuucuugcacucuggcuccugaagauguaagcaauaaagcuuugccgcagaagauucuggucugugguguucuuccuggccggucgugagaacgcgucuaauaacacuuuccuuuguuugguuugggguuuuuugcuuguuuguuucguuuugggguguuuuguuuuaugagguguaacgaaaugauccuccagccuuugcugucccauuucugggauuagaggcaugcgcugccguacccaggguuuuauuuauuucuaagccaacuuuuaaagaaguucauguacgugaccagggugcaacaggauccgugugucgaugaauguccuuaacuccaucagauauaacaacagaacugcuggcaaaacccagaaaggcagcacaagccugcagggucugcagagccaccguuuccacuagcaggagggcagucugugaggacagaagccugggagcgccacacuugugcagucagcuuagaugccgacaguaaagugucaugccagacuuccuaggcugacagugccagaaagguagcauuucaauaauuaauuccuaacgagcagaaauuuacaagacauacuaugucugaaacacaguccugcugucugcccccagguguggaacauguguggcuugguuucauuugcuugagguuuuugucccauacaaauggagguggcuugcuuuagcauggaagaagagaugauaaguugcuuugcaguaccaacccugccgcucacucugucugcagugcugggccugucgcuccccaucugggcaauagcgcucauauccuucggcguugcucugcuguucgccuucuucguguggcuauucguguguccauggaugaagaggaagauagcagguaagcagucuauuucuuccacauugcaaagcuguucuugauuccugagccuucccacauaaacgaacaaguaucuuuaagaguagaggaaccggagguggcaguggucaccugggacacaggcuccugccucuggcucaacacuuuucucucuggcuccuguaguuccuuggucauuuugugaccugcgugaagaucauuauuuguuaagcauaacccuaaguuaacaaauacagaagagaaacaaccaaccagccagagccuucaggcagggcugagaguaaagcauagcacaagagacaaccuggccauaugcacuggccauaaacauucuuugaaccacuccuaggucuuuccccagacuggaauccuccccuaacauauagauuauccacagaaaaugaaguggugacuccacacuccagugcucagcaguaacaagaacagacugccacuucuguggccuggaugaguggcaaaggcagugugcugagacacacuucaccuacaagacguccugaaaaacgcaaaaccaaaaguucggagauaagacgagugcuugucucaaguggggcugggcagacucaaguucugacugggagggauacaagugagacucggggacuccauacaucccguuuguccccauuguccccauugcugugguccuuguaaacacacacacgaauagucagcuuacagcacccauauugagcagcucacaaugccuauaacucccguugcaggggaagccaaugccacuggcuucugcagacacugcgugcaugcaugcacgcacacacagaacuagaaauaaaaaagaucuggaaaagauggcucagagguuaggagcacaugucgcucuugcagaggacaaagguuugguccccacaccgacauggaagcucacaacuaucugcaacuacagugccagaggaugaggccccagcucccugguuucuuuugggguaaacgggaucucuuuguuucucuugagcaaaauacaguuuacuuauuucauaggaucugauacgauaaaagaaaucggagaccaauaguuauuaacgaggaaaaaagaccaaauauacuagauaaauaccuuggaagacaagcaugacaaacauuucagcaacucuaaggccaggcuucuagaagaguuguagauuuagacugucagcccugggagagaccuuggcaaucacauuuaacugucuuguugguuuuggauguggucauaacucaggcguaaguacugaccaucaacugucuucaagaucauugcuugaaguuucuauuuuauuuucuccauauagcuguaauguuguguuucugaggcaaauauuaacguauaaagagagguguucacauucuuaauauuuauuuuaaaaaggaaagaaugcauuucccaaacccaugcuuccuccuucuuucucuccaggcagauuagagaaggagagcgcucugucccgcgcuuccgaugaaagccucaggaaaguacaggaagcugaguccccuggcuucaaggagcucccuggugccaaacccagcgaugacagcgcugucccccucaccagccuggcuggggaggccgugggggccucagaaggcacgucagcagggaaccacccccgggcuuccuaugguaaggcuaaccuggagaacuuggguacaccccagaagaccuccucaggagguaaccagcaggcugagcauggguacaagaguccccagauuucauguuguuguaugguuuugauggaccagagccucgugcaugccaagcuugugaucuuccaccccagauaagcaucuucuaaauucuuuucaggacgggcacuuuccaugacucacggcucugccaagucacccaucuccaaugguacauuuggcuuugaaggccacaugaggaaugacggucacguuuaucauacuguacacaaagacucggggcucuacaaagacuugcugcacaaaauccacguagacaggggcuccgaggagaaacccacucaggaaaacaacuacaggcugcuucggaggaacaacaguuacaccugcuacacugcggccaucugcggcaugccggugcacaccacuuucagagccucggacaccuccucugcccccgaggacagugagaagcuggugggugacaguguguccuauuccaagaagaggcuccgcuacgacagcuacuccagcuacugcaacgcaguggcugaggccgagauugaggccgaagagggugguguggaaaugaggcuggccucugagcuggccgacccugaccggccucacgaggaccccacggaggaagagaaggaggagaaggacucggcagagguccaccugcucuuccacuuccugcaaguccucacugccugcuucggguccuucgcucacgguggcaaugacgugaggucagugucuuaauccauuauacguuaagagucugcgugggcugagauccgagucccugccgcugggcgaaggagagcauaggcaagccagcuagcauggaaguacgcacagaaggucuagugcacaggaaggaguuuuucccugugagagugagggagccacuguaagggcugacaggcccugccauuuaacaggaccacucugcgacugucaugaggggcugggaggacaguuaggaccuuacuaacaaugauccaagaaaagggcagagagaugcugcaguagccagggucuggaaauuuuauuuugauuaugggaauuagucaauauagaauuauaaauauagaauugauaagcagugaagaccagcaguccucugccuccauaacacugccccuuaacagguaacuacauuucagcuccucuuuuggggugaccaccaaccauaacauuauuuuguugcuacuucauaacuuucauuuugcuauuguuacaaaugguaaauaucugauuuguagauggucucaggugacccugggaaagacccacagguugagaaccucugaauuagacaggucugaaagaaggaagccugcuccaacaauuuuggcucgggcaaauccaaggaugaguugucacaccagcaaguacaacccagaaagggcugguucagggguaaacaguuagacaucaaccugucacacccaagugacagcccaguuagcagcccacugagugugucugaggucaggacaaucaggcugggugcagacgagggccuaugccccaaagccaguggugcuggguagagaucccgggagugagggaagggaaggauggaagcagagugcacacccugagcccuguagcuucccagggagagaugggaaacaucaggaagacgugucaagccggguagucaggaggacuucccagcccagcuccuugugacauuuagcagugaccuggcagcgcucaugccucuuaagucuuugcgcgguuuuaaauaguugauuucaaagauguuuccaaacaucaaacaaaagauugaguaccuguuagacaucggcauguaaguuuccagaccuagagagaugaauagaggagugugcugagcacagaaauaggacaggcguaucacugagaggaaauauuguauauuuaacuucuuugggguggggcuugaauucugugaaccucgcuugccucgagugugggaagccaugucauaacagcacugcaguuacaacaacaaaaacagccccugaaagaucagcaagacagugcuccccuuauaagauuggcccaguggcacgugguccccauccaucaccugccaccguccccagaaacacuggugacaccgauaaaaucaagagcagcacaauguucucugcaucugggcaggagugcugugggggcccugucucgggacgccucggagggccucuugugcagggagagccuggagguccucaggaauagacacugucagcguccagcuggcacugucugacggagcagggcagcucucagugugguaaagcagcgggcacucccuccaugaacaaagcuuuggaccuucaaacucuggcuagagagaucagaaaaacaugcacaaaaugacuauccccaaagcgcagugagcgcuuaaggugacagaguaaccgcuuacaacucagagacucacugagacuuugaaacagugucaucuaguuuaaaaaaauaaaaauuaaaaaagaaaucugacagcagagucgucuggggacaggcuuaucaagcccugucaggacucaguccagaaccauuugcaauuuaccaugagccugucugggacaacccucggagcuaggcaagugggguccuuccaacacgaguccaaagcuaagagacaugagguuucccacccagcacagagcagagcugacccggaagccaauccaugcggacccucaacacacugucaaccagaguagggacgagaucuggagagaccugaaaaccacgugucaaagcucuggccagaccucgagaggccugggaagcagcagugucggggguauggggugggggagcacacgauggucuaaacaguguccgcaggagcaccguggacggugcccggcuuccagggcaguuguaagaaugugccaucagugguggccaucaccgcacagugugaggacugacuugucucuccagcuagcagcuagagucaggagcugagauggcaguggacauggaaagggauuugagggaaagauaagagagaaagaacucggugcucagauuuacucugagugguuuuuuuuucaaguaccuuuucagaaccauguaauuguacugaacccugccuaacucugccuaagaugguaagauggccagucuucuggagugcuguuuauauucacuuaaugucauuuaucaccguagauuacauaagcuacaaauacaauacgauuagcuaauuuuaaaaacugagaagucacuauauauuguguauacuguugugccuauauauaguuaacuuuuuuuuuuuuuuuccccagcaaugcuauugguccccuuguggcuuuguggcugauauaucaacaaggcggaguuacacaagaagcugcuacuccagucuggcugcuguuuuacggaggaguuggcauuugcacaggucucuggguuuggggcagaagagugauccagaccauggggaaggaccucacgcccaucacaccguccaggugaggaggcccaggugaggccucaggaggccgugcuuaggagagaggugggccuuacugcagaagucagccuaucagaucuuccuccugcuccucucacgaagccgauggucaugugagaaagcgcagagggauuccucccggccucauuccccaccagcaagcuucuuccccauccuaucuccccuuggccaggccaucuacccugacggagcaagcgggaaggcaaacuagggggcugcuguaguucccagucuauccgcagucauucuaaugcagugugacacaggcgcaaacuagagccuggggccggccuguuccaaacucccuagccacauccacucuccuacucuuguuggcuuucugugccaauacaaaacacccaagguaugcaguucugaauaggacagguccuugugguucgugcuuucacagguccguuucaguuuguccuccuucugcaaccugggucauaggaaaaacaagacaaacaaaacaaaauccaccucauagccagcaagcaaaagcaaacaaaggaaaggccagaguccuacaccccucaaggauaugccccagugacccagacacccccaccuaaagauuauaucacuucccaaagagucucacaacaucccauggaccacacuuugacauacgggccuuugggggcacaaacuccaaaacguggccccugccuaaccccagauagucaagcccugagaccugccauccuccaggguccuuaggacagggcaugcacaucugagaugucauguuagucauccuguggagcagccuguggcuguguggcucaagguuagcuagcagaucucagcugacagaauacaacuaaacuucagaacuaucuguuguaggaaaucuuuuuuucuccguguuucuuuuuuaaacuuauuuuagggauuucuguucccuuugguuuccaauuuucaguuccccauccuuaagauccauccuaacaaaagguuauuuuagaagacuagauugaaaaaaauuuguuaucugaagauugcuaaauuggucaucugaagauugcuuuuuuguaauacguucacacguuguuuaaaacaagcaccuagucuuuccuuugccccaguagaaaugaguaauuuaucaucuuacugcacagcaggaauuucugacccaguugcacacuucagguuggaaaacaugcuaggaaaacaaggucaugggcgucagcugcacagcccgcugcccugcugcgagcaacagagucuuguucuccuaauggucaucuggcucaggcagccguccacaaccagcuuacagaauguucuggcaagacuucugcagccacggggugucggcaaggccacacaaagagcuccugugacguugucuuccugucccccccacacaguggcuucacuauugagcuggccucugccuucaccguggugauugccuccaacaucgggcuuccugucagcaccacgcacugcaagguaggccccugccagccagagacugccauucugagggguggcaggucggucugaaaagaagcagcuacaccgugugguuggugugggacagccaggccuguuuguuucccuagcacccgccucuaauccuucccgguccccagcaaggcaccuggugcugaggcugugccuccucagcaccagugagagcuuccacucgccugugcccucacugugcccaccugcaaguuccccuugaagucgugugugcacugagccugacugcagguucccaugggaugugcccuccgguuccugccacugcgcagaacugaccucagagcaggacagaaacagaaggaaacaaaaauuauuucagagcaauuauaagauguggcugcuucugguucuccccucacaugacgcuuaggcugacucuugugccuuagagucuauuccaaaugagggucaggagguagcuccugaugcugguaugguguauuauguccaguuguucacaggguccuccuaauuguaaucaaucaguagacaucaccauaccaaccaaccugacucugauguaugaggcgacccccacugggcaccgcuggaagugcaacgggacguugacccacucacaaacugcaaggacgguugagauagcacuugcccagccucacagaugagggaauggaggcagagagagguuaagaagcauucccacccagggcuggcauggugcucugcuguuccccucccucguacacaggaggaaggccagcagagacuggcacccccacugcucacccacggggacugcuccaaugucgggagguuuuaaaauaaugaaagguucuugggcggcucauaaugauagcgugugucccuagcacaacugagauccugaguucagccaauagugccacaaaaaaaugaauacaaauuaccaaagaagcacggguucacugaaauacuuaacaaaaaacaggguggccuaugaggauagccaucucccuguucuccacgcuuacucugugccaaggaaaaggcagcuagcuucucaauuucccauuuacucauucacugugugugugugcgcacgacauucaugcgguggucaccaugugggugggucccaggguugaacucagcucaucagccuuagguggcagcugugugggugagcaccuuuacccaccgggccaucucagcugcccacuuuccgccauuuuguaggcauaaacagucacaccugcccggcuucccuagcuguugucaccuauuagccaucuucuccacaguaauggaauauaagucacauggagaggaacuccugccuagcaauuccagccucucuggaaggagacuugauuaggaauauggaggccagugaaaggauagcagagaacaugaagacccuguguuauguggaaaugucacaguaaaaccauuaugugcacauaggugcauauacuaacuuucaaacuuaacucucaagucgggcaugguggugcacuagggcucaagaaccagagggagggcagaaucucuugagugugaggccaaccugggcuacacagcaaguuccaggccagccugagcuacauagugagaccccugucucaaaaaaauuaauuaguuauuaaguaaaguaaaauaaaaucaaacuuuaauuuuucaccuugaauuauaacuugcucgauauuuauagcauaauagggauauuuuauuaagauauuuauaucuaauuuguauaagaccuuaauaaauauguauguuacuguuaccaaggugccugcacugagcacauagucaauucuguuuccgugauacaauaaguaguacaaggaagagcuguugguaugagcagguccugcgcgcaggaccacagugggacggugugugcagcaaggccagacaacuaacagagagaaacugcccacauccaaaugaaaguacagaaaccuccagcuugauuagaaagugugucaaaugggggcagcacucgcggaaccugcauagcugcaggggggcacagugauuuuacaauaauucuaguaggaaacaaggcucucgagguggcuucgaugggggaaagguguuugccaccaagccggacauccugagugcuaggacugaagugguccucuggucuccacacaugugcuguggcgugcacacacccgcgugcaguaaauaaauaugaacccaguuauuuaaaaacugaaggaggaucguaucuggcaaagacucaagcaucugcugacagguagaaaggaagaugugguagggagcgugcuaugcugcacgacuggagaagaguuucaguccucaaacgcagcccggcagaaauguucucagaacuuuacagagagaaaccagggugagagcauaaauuaugaaaacuauaaaaugaucuccauagaaaacaaauguggggcucgggucacaugauacaggcugaugaugucuuaaacaacuaaaagucgguguuugugaaagucuccucuccucugcgucguccuuuaaaguagaccuuacuccuacugccaugucucugcuccuccaggugggcuccgugguagcugugggcuggauccgcucgcggaaggcuguggacuggcgccucuuccggaacauuuuuguugccugguucgugacugugcccguggcuggacucuucagugcugcuaucauggcucuccucauguacauauguggucucuuuucuuccagucgguagacggcuggagggauguucugacguggcuaagauacucacaccucccacccuugcuuucccugacacaugcacacccuuccacacgccuuccagauggcuucgugccggcccugcuuacccaggccacagcucaucuuccagaauuaaccuaccuacuguacauaguagcauacaucgagcugaugcugugauggcaugauguggugcgguuacuuacaguagauguguauuguguaccuagaauagguagcauuuaucuccagcaaacuaagaacgaaagcagaggcauugccuagaccgcaagacucuguuaauuguauauaaugauuucagugguggcaaguguagaguauaaaauccuuuuuuaaauacacuguaauauaagugagauacaguauacuuaaugcaaaccugggcgagugcccaggcccuugagugacugcacaacccugggacagguguucacaagugcucucucugaagaaugcgcuccugagcugggucugaguuacugucaugugucacaauggcuucaacgguaaacucaaacuacuuuuaaccgucugcuuccuguacaccuuuuugauuggagaaacuuggaaaguaccaaagaaauaggggauaacgugccaguguugcaucuucccauugcuuguccccuccccacgggccacgacagugaaccuggugacaccagcagcagccagguggcugccacaccagguacugguaagcuuguucagcggccuuucccugucaccagcguggauggcguacggcaguggggguguagaguuguacacuacauacauaucaagucccacucggugucccuccccgccgugcccugcaaccugaaaagcagaauccuuguugccagcaucagagccagugagcgcuugaugggcucggaugcugcaaguucacgguuagugggaggcacuggcgaggacacugggcuuggggaucuuagaggccuuuucucuguaggacauccgagguucuccuguggagccgcuguucucuucugacggugggagagagucaggaugacuaaaauguuaagggcccgaaaccauggaaaugcugcuaauauuuuuauauugacauacauuuucacgguacuucauuguaauuuuuuucauuaaucaagcauauuaaauuuauaauaaaaaaaagugccccucaaaaacuuac

SEQ ID NO: 4345 - RNA, 3774 nt, Mus musculus
uauugaagguccgguaaccuucaauugguguagcucugagacuccaagccccgauuggaggaugaagacagucggucauccagucacaaagggccuccggggagcuagaaagugaccggaaagguaaaaugauucccgggaugcuucuaauuuaaugcaucacagauaaccaaucauaacuaaccuccauuacacaggugcacuuaaaaagcgacugcuugccgggccuguggcgcaggucuuuaaucccagcacucaggagacaagcagaaguaucucagugaguucgaggccaaccuuguugucuacacagggaguuccaagccagcgggaaagaaccgggaagaauagaggaaaggaggggaggggagaagacaagagaggaaaggaagggagaaaaguagagacguaguggggaggggggagcaaggcagagaaagagugacagacagacagauaagacugacuucuccuuccagacucucaguucccagauccgauaaugaagguguuggggcaggucuuugaaaccaccuuaaauuuaaagagaucacagguuacugugacucgggaaagugugaagcagagauccgauggaaauuuuaucuucaguuagauuaaaaugaggcauucgguaagaugaagugugaaggggguugcaaaaacugcugggcacacuguaagaugaaaugacaaacugcggugaugacggucgugccaaucuagaugagucuccgaaaggucucuggcaguaccuaaaaacaagaggcccuaccucaaaucagauggaaggugaggagugauauucugacuccuacaaguguuuccaugcacaaaugcaaacgcguaccucauacaugcaaaaacggguguguguguguguguguguuuauuuucccuuucguuuuguuacuugagacaguuucgcugaacaauucuggcuggccgggaagucuccagaucgggacagcuuugaacuguuucccucugccucccgccuccggagugcugggauuaaaggcuugugcugcccaccuggucgcuacucacccggggccgggcgcgcgcgggggaggggugugagaagaaauuuuaaaaauaauuucaaagcuuaaaaaaaaaaaaaagaacgauuugugacauugccucauacgucccguuugaaauuacagaagaaauagucaucaaaugagaagauuuccggaggaagaaaagagauugguccaaaaaaaaagaaguuuucaaauaacauacuuaguuucuaaguaguuauuuagauaaagauuacucucagaagcaaaccaaaccucugcuuugcaaacauuugucuacugugugccagacccagcugcuuccuguucaucaaauguggguuuuuuuguagcuagaagugaagaccagaaaaacuuccucugucaagucaccuccuggguuuccuuuucucugcguggcuuacuuagcauugccugaguguuacagguggccuuuuuaucauuugagaaugaguuuucaaguuuuguuaaaaguugacucagugagaugugacgcagcugccccagaauucccuucagcaucugccuuuauuaaguacaauguaaggaagaccgugaccacucccucccacagaccagacgcggaaaugugacuuuguauaacucguccuaugcuccucagcacacagacaccagccuauuuuucucugcacacuguuccgccuucucucucuugaucuauucucuuaggcuguacucccccccacgcccaguuccccagacagaucuuguaagcuccaucuguccucauucuaggauuccucagacagcuuauaggcguguggaccuauaagaaccucccaacucccaaauucacguggcagccaaagauuuuuuuuuucuggcgcuauagauuuuuuuuuauuuuuuaaaaaguuccuucauagaauagacaaaguaaauauugagaauuucaucaaaaauacaaguucuuugaaagugcauaaucauugaaaauaaccaucugaaacacaaaacaaaucaucuugauuguuuacauaaccauucugucuuuucagccaagaaagcucuagcuguucaaaugugaacgccacuagaaaagcgacaauagggagucccacggagcuuuugcgcagcggcggacugggcagugcgcucuuggccacggaagguggcgcugcugagccugcggggacaggcucucuggacccaaccauccuggcuaaaaaagaaacuugcggcuuccacagugaauucccgggggugacuccuuucuaguccaccgcaaaggcgggaaauaaagccggcccccgcggacaaagcggcgccuccacccacgcagcugcggggagucgggaggguaggggaggaggcggaggaugguugccauggcgacgagccagcaucugaagccgcugaauggacucuuuguuuugaagccagcugacggguggugcgguuucuaaggugcagggggaggcgggucucgccggagucacucggguugcgcugcggggaccaucggcucccacgcaggccugcccugggauggcgccggacaccugcuuccuguccacaucgacuccgcuaaggacugggcgagcaggcucagggaagccaaacagaaucaguuugccggaagaaaaacagaaagggagcuccuuacagagacuagaaguggccagcgcuggccucucccuugugaaaguuggucccuggggcgagcugaagggguagagauuucccugaguacucaauaaucaguauguaugguaugggguagcgagugugagcgcuggcguguguauuugcauuucaggaagugguugcuuaggcagcugugagacuagcgguugggaaauggaaacucucagagcagccuguaguuuucaguuuugccguguguacuaagcgcuauguguaaagcaaaagcaaaaguuuaaacaaguuuaaacaaggaacguccguguguuggaauacccucugucuaccuaaugggcuuuggaacacuggagagcacccgaaacuuuauuuaauacuugaauuuuaaaaaauaugcaggcauaaacugauaccacuagccugcagacaggucaucaggcaaacggaacagcaaaaccugccguccuucucaucuuguaggaugcggaaggagaucgucauuauugaagaagcucauugcauaauucagccauaacagcguucuuucaccaaaguucuaaagaagauuuauaaguagggaagguuuuucucaaaaguuuggguccauggcuucuugguuuagggcuuguggccacaccugugagggaguacgcugaaggagccucuacuuuggauauuuucaucacggggaagcgaagacugagauaggauggggguccgaguuccaaccccccuucaaaaacacacgcucaauuggcuugauuccuucagcuaucuuucaacagcaucagaggcagggggucaaaccuuuugggauguauaugcucagaucuaaacuauaauacugcuaucuauuguaagaucaaaguagccacggggacccucccuaaauuaaccauauacagacaucauaucaagagcaguuuuucucguaaaaugguguauuguuaaugaaacaauuaacuuuuaaagaauuuaagaaagagagagaucuugagguuggguggguaagaagauggggaagaucugggaggaguugggggagggggagcauaugaucaaaacggaaaaaaaaauaaaaguaaugauguauuuuacu

SEQ ID NO: 4346 - RNA, 10794 nt, Mus musculus
cagcagcuccauccugcuccggcucuccuugcgcugggcccguggucagagccaggcacuuggccgaccagcccgagcccaguugucugugccaggaccuccagccugcggccaccugcacuucaagcaccaaguuggcucuggaagaccucaggauggucugaccuaggaacuggcagguacauucacagcccuacucccuuccucuuucggugaaagacagccuuuagcuccucccacagccuggagaaguccucaggagcugagcucuuuagggcuuuguacauacugcuaacguguuucuauugguuugcauaguauuuauuguuuucauauacacaaggcugauuacuguacaguuuacacuuugaacacagacuauuauagaaguacgugacgauuuagaaaaccucuuccucuauugaacaugcuggugcaauccucggacagccacaggcccuuccccagccgagaacuuugagaugggacccuggcucccucugagcccuacagcaaagccuaggggguccuugccucagaucuuaaauuucuaacacaaggaaccccgaaugcacucucaaggugaugauuucccacuggaagaugaguaauacugaaacugagagacaacauaaaaaaaauaauaaauccaguuuauccauacagcgucgucaaaggucacaguaaaaccaguguagacugagugaaggggaggccugcgcaugugcaccugugucaugucauucugagaagagcagucccuucaugggggcugggggguaggguggggugggguggggugggguguuacaaguggcauguggcgugugcagguacaacgaggauguaggacaaugggcuaaacugauuucacgccguucccgguuuccucgguccagaaagauuauguguauuucuuacaaaugagguugaagucaaaaaaucaaaacaaaaagcaaacaaacagaucaaccaucccggccacaguaaagcccuuauuauucgugucugcacccgugugcucuuuggggcuugcuauccucucccuucuucucucccuucucucgaggccuuuguccugauucccacagagauccauagucgcuagaggcaggacugaagacuguaggucaugcgucuacagccagucauucaugcgaauaggagacuaaaggaaacuccuuacagaggucaugccggggagcucagaacacgugcgacccuucaguagcccucugguccaggucucuucccgugugcaugacagaguguguggaguucaggguuuggguguugaggugugauccugcagggcacagaaagaaggagucacucgggagcucugugcuuccguccagggcaagccaccaggagaaguaguguccccaagcaaagcaguaagcugagacugcaguagcagaggcuagcccagaauaccacccacccaucuuugaugucuacccagauguuucagcucacuagcugccccgccuccacuguuuaauguagagaagaugagcucucagcagccuuccauaggggauagggaagguacuguguugccaggaggcuggaagggggaggggaucuucagagaagaaucuucugcuuagaaaguggcuuuuguuuuuuccugugacagacccuaugcugggaaaaaggcgaggcuaggcagacaugcccugaugcucucaguucaggugggccuacagcacagaugucugcucugugcccacccuggacaagaucgcuggucucaggaagucaugaccuugaauuccauagacucuuacugucaacuaucccuggcucccguuuuugcaugccuaguggugggcuaauucugugaugaagagaaggaaggugcauccucucuggaauaguacaucuuaaacugggaagcagcagcuuugcaugugaaggccaaaccugacagcccgggauucucagcaagacaucauucugcuccuauagccccuauagacugcugugaggccggccuccuuccucuuuccuuaaaaaaucucucugugucugucugucugugucucugugucucuuucugugucccucugucucucucugugucucugucucucucucccucucucugugacagagucuuguuaugcagcucaggcuagccugaaacuuacaaccuccugacucugcgucccaggugcugggauuucagguauguaccaucacacacaaauaacuucauaucauccagcaaacaccaacgauucuaucaauaggcaccuaggagcugguggagaagaaaagggcauuccuuuauuuuuguguguuuuggguuuguguguguguguguguguguguguguguguguguuuuguuuuuuuguuuuugagacagggacucaucuuuaauccagucuggcccagaacucauugccuaucacagauuggcucugacuucauggcaauccuccagucucagcauccugagugauggggugacagaugugaucuaccaugccuggcugggaaggccacugagaugaagagaguugacggugcucugggaagaggcguaaagguuggaagucauucugaggcagagcuguucccaggcauagagcugucccaagcucuacaggugacagagccguggguauauugagcacaaccaacaugacucaucuccaugguucccucggggguaugugggggacaaugccaaauguuuugccugcagcugugaagauuaaaagucaggcauucuugcugggcagaagagagcugccauuugagagaugagauucugcccuuccuaggcuaccuucuccucuaguccuauugcuaggcugugugcucauaugcccccuccccaacgcugccaucuucucuccucaacuucuguuccugccucagacuugcccuucacuucaggcuguccuuucccacgacuacccauuggcuaagagacacauaaggggcagaggggucaagagcaggaauucugaagcuagacuguucagguucgaacccugcuucugucuuuacuggcugccuagcuuuggucaaacguacucggcugcucuucagcucuguuugcccugcuugugagauggggccgcaguaggacccaucacugugaugugugcaugugcugagacggguccguggaggacggaggggucagggagcauccagggagcaugcuggacuuaacuugugaguaucuggcucuuggaaagugcugcaccuaacuuguuguuuauuuauuuuucuaaccagcuucgcaguugcucuggcuggauuaugagcacuggagggugggggccccuucuccaaauucccuacagugccuaccccagaauuaagcauuccucagagagacaacaugaaagccgagauucuagauacacaggcugaguucccaccugcuuacggccagguccuugagagggcucaagcuucagagaucacuccggaguaagcacccccucccccccuuuuuagaggugagugguaggcuaagaccuaaguggaacagacacagguccagcuggagcagcugguggcgcagggguggaguaacacgagccuucaggcuacagccaggauuucuccaugccaucagugccaccgggccuccucccuaagccacucucugaaaaaggccaguccucucaaagcuuaggagaugacaccccaaagugcucagagccccuucgccuucgcagccaggauccucguuuucuccccaugcucgggcaccugcccccacaucuaugcccguggcucucaccagugacccuucgcuuccuacucugauguccuccuucaaguggcugcauaggauaacugauucuagcuuaaaacaaagcgaaacaaaacaugccuuccuacuuccucccacugaaacgcuagauuuuucagaacagucuaucgucagaacuaauggaagucucugaagcacacuguuuguguggaaaguguucucuaaaaggaaaacagacuuucaacaugcauauaaucacagggcuccuccuuccucagcuccugggagaguccuggagggaacagccaugcacacacagaggguaucaagaacuaguacccuucccagccagacuccugguacccccagggcugcaccauagccgaugcuccagugcccuuagcugcucgcugcauccaguuuucccagcaguccugguaccuuaacacucaggcacaguacaagacccgccagugccaaugagccuugaccucucagacagaaaacagcaauuuucuggcuucuucacucuaggacuuuccagugcaaggggagacuggcaggaucagaacaaagcucagcaaugccuugcucaccagaguguagaguccucuaaacaaaugcuccucauccuccacuuuagccugcuuuuagauaugauucuuguacuaugccagacgacgugagaggaguuugaggagaagggucaaaauccggcauaacaacucgacuuucaccaugcaucuaaucccagggacggcauagugacggauacugacauccuggguuuuaacugagcagaacugcagccgagaacagcagcucagucucucgcaggccugcaagcuucuaugccccggccccgggggucuguaucuucuuagcaggauauggacuacgcccugagaaagagcacugucgacccucgcacucuguaaagcccuuccucaaaaauaagagcaucugcuaccguacagcaguuccacaaggaacgugcuggcauuauugcgacgcguggguggaaacgcugaggcguaggaaagucaauugacuugcccugagucacacuacaaacaacaccugucacugaugggacgccagaguguauacaccuuuacuccucacgacacgacaccucucauaguuucuauuugcgcccccacuccccugccacacccacgcuggggcuggaaccugggguuucaggcaggcugagcaugcacucugccgcugggccacacccuguucugcacgcauuuuuuaaauugauaaguaacacauauccaggagagacuaucuccaucuuuccuugaggcguacaaagcuggggauaguugagugacuuaaggucauaccauuugggaccagaaugggggagccaagucuugaaucuggacuccaaggcuaguuuuuacacuuggaacauauaagaugcuuuucauuauucacaguaguccuggucuauaaaguaugagcgugggauuagcgaauacugaaucaccgcucccaagggacaugcaaggucaugcuuuccucagccagcgacuccaucagcaugcugcguguguauuucuuuuugaggguggcacaucgcauguaugcaggccauucacucgugcucaccccauugccaucaacacagugccucaggaagacuuagaacucaucuuccccggacagacagaacguccacacaaacagugaaacaaacgaugaagaacuuggaaaugcacugugucguuaaauagauuaaaaauaaagggcagcaugagacccaggaaaagguggagcuggggacggcacaugcccaucacuuuguggucaccuuugucugugugucugggaaugacugagcacggaaggacugggugcucauuuuuggauuucaagaaagguuuagggcguaggcaaaucggaagaggaaugacaaggaucggcuggacugccuguggggcggggguugggggcaguggugguggggacggagccugaagcccuuugguaacuucuuacugaggaugggccacucuugcugcuccacaaccuggucagaccugggcaggagccugccacugcacgcucuucugcccagucacuaccccagucacccacccucugucuuuuguuggcagaggcuaaguacuguccaaaccaggcugcucagaauuccugacuccuaaacucaugaggucugguggcaaauaucccccuccuucccuuucucccuuucucucucucuguaguguguaugugagagaguguauguguguguguauguaaguguguugugccuguguguguauguguguguguauguguguuguguuauguauuuaguauguguguuguguuguguguguguaguguguguauauguagugugugugugguguguguguguguguguguguguaaguguguugugccuguguguguguauguguguuguguuguguauuuaguauguguauguguguguguuguguuguguguguguaguguguguauauguaguguguuguguguguguguguguguauguguguaguguguguguguguggggggguguuggggcaggggcaugccggguacaguaaauuaaugaaacacucuacuucugcccuguccuucagcugccuugccguugcugccucccauugaggcccuggauaaagucucagccaacaaacacaagugcaaguccggcugccacuguaagaaagauagggcugaagaagacauucucccucccucccuccuuuaaaaaugacucgaaccuuuggguuguuucccagccgggaucaagagcgagucuuggccuuuaaaucagcagacaugcaggacccuccuggcagugcugggguuaacacugugaccuccuuacagcugcugaggagucagggcuaauuuuacucuccuaucgggcucugcccagccucauauuguccaagugcugagauauguugggaagcaucaagucagcacuucugccggcccaggaggcugcgcgggcccugcuuuuugcagaaggcagaaaaccagugacugccugcugcucggcucuggagcugggcccugagaguucaggggugggggugggugggggaaggggcaauaacccaguuagugcugugcaugggcagaggcugugaugcuggcuuguuccccguugucucccacccugacgcauccuguacugagcugccccgagcugagcacagugaaggaccucggggcagcucaguacaggaccccucagggagggcgagaucagagcuggcugcugaggcuggcucuugggcacugcagccugcugaagaucuucguugcguagccuggcccacccauccuuggcccccgcccugacgcacaccccucacacacuaguacagccguuagccaugaagaccuuccucacuuccagggaagauucuaccuaugccuugggucugcuaacuuaguuccuucucagacaucaagcgagcagccuuguucucagaacaguaaucgaauuaaagcuauggcagguuaggacuccagugagccuuaagguuuaugucuggcgugcuuucugaccauguguagugagauaggcucagacuguguuuugagcacuacuucaaagcacuauuuuaacauuauacugguacagucaggcauggugcugcaugccuuuaauuccaguacagaggcagcuggaucucuguggguucaaggccagccuggucuauuuagcaaguuccaggacagccagggcuauauagagagacucuguuuauaacuaaauugcacagggacugaagguguggcucagaaugccuaucucuggucccaccccccuaacacagccaaaaaagacaaaagaaaauauaaauaagcaaaauaaacccaagccccugauuuuguguacucuccagcagacuggugucaacagagaggcacaggucugaagaggacguggaggggcagagacaguggcuaguuugaggagugggauucugagagucugguuuuaacucugaacugagcuaguagugcaaggaugggguggguugggagcagcaagcagcuaccucaucaaggaccaugccagcaaggacgagaaagccacuguuaccucccaaggggcuacuugaggagaggucacugcuugccccuuuucaggcuggcccgcuucacuaucugagcccccuuccugcccucuaucagguccggcuggaguccacucccucuuagcuccaccuggagacagcaucagagacagaaaguaggaaaucacacaggcagaugagcaagcucgggcaggaagugagaagggucaggacagagaggaguaggaggaggaggaggaggaggaggaggaggaggaggaggaggaggaggaggaggaggaggaggaggagaaggaggaggugggaacaccaucuguccgccagaaagguagccaggggcagcauugcaaccuggagcaaaguagaggugaggcggaggugaacuugcugcggccuccaggggccugcagugccuugguaccuuaguaaguuucauaaaggacucaauaucugcuuccagauccccagggucugccaggggacccucgacaaucaccuccucgugcugcugggugucgauggcaccagacgagucuaccugccggacgacuuugcgaaugaucuggaaagagaggggaagagaaggagagauggucaagucgucaggacaacauuugagaagaacagggcuccagcagaggcaccaggaggagaggccauggcuuccugucccccggagccaagaagaagccuuucucugcugucaucuauggggaaugucgguggggcuuggacuggggagcacggcuggcagggcuucggcaaacauuggcuugggcacgcgcagcgcugccucagcccuccgccaucccacucuguuccuuggaauggauggaaguucggucugacuaucgugccucuacagugccuaaggacagaggcaggcaacccuucuauccaugugcgucugcucuacucaccuucucuguguccauuuauccagaaugggaggugaacauaaaccauggcuuaggccuuuagggaggggcaaggacagacaggggccaucauuccuuaugugaacagugguccuagugaguggcacaggcgcgcacgcgccauguccugcucucucccauugccucauggggcaauguccgccaagcagcacaagcuuaucauguggaggucugcugccaguuugaugaguucuuacagcccuucuaagggagcccccaagaacaggucccuguuuucuaacagcuccuucuauggccaggcuucacaggacuagggcuguguguuucaugggagcuggaaaugggcagcuggaccucuucauguugaguuaagcuuuaaggugacaaggcccucagauuguagaggacccagaggucucagcucuccugaguuaccccgaaagcucugaggugggggggaggaacagccugcccacccuguuugggcagcaguaagaagcugcucuaagcugaaccccuccacuuuucuucuuuagucucacccaguuucuccucaaugcagaggcucugcucuuaccuucuugguaacaauguugcccuguucaucugugaauuguuccuccgucaccugcucuccuggaauauucugaagcucaucccccuggaguuagaagaagggaaagacccagacugguaagugggguuuuccuaauaagagcagaagagaaggagaggccagggagcggcagccacagccgcauccaaucaagcccgaaguucagccaacagccccuccacccccaauccccggccaaacaagggcucccaugcucucccggcaccauguugggucaugagcccugagacaggcuggagccaggacccacaggagcuuugugugccugaucacugcaauggcaacaauacggggugauuaugcaaguucccagagccccuccccugccccccagagaaguaagggagagaaugacaaagacaucacagcccuggaggugucuugaguucugacguugguuguacacguggaauaagagcagacauccuaagucccagagcugagcuuccgccacuacccacugcuggguacugggucaguuuugagcagguuccacauguggcuaugucucccagcaggcugcagcaaccaaagaggccucccugcccuuauaugcuugccauuucuccugacuugaguugguauucucucagcaucaccaugcaugagccacagaccguccucuggcacccgagguccggcccccgcuacccugccgcuugccugguguuaccuucaggaagacccgucggcggaccacccugguagagauggucuccucgucaucgcucaggcccucgcucucccccagcuccuuguccaguuccugguggaugugcuucagcacaaagcacagggaacccuugacaauaugcaucacauucugacagcugaccaggaagaagccuaacagcaccagcgugaccaggagcugcgugaugaagguccacauccuccucuccucucucuccucaccagccuggcccuccagggacuggggacaccaggggcccagcugcuguggagauccaguuucucauucuccucuccgacgccugaaguccccagccagcccuuccauuccgucucuuuauccucuuuucucuuuaucuccuguuuauucuaaacgggagaccaaacggucucuccugcgcgacucucuuagcugggacguggugacccaaauguccuuccugccaaacggcucaggaucucuccucacaccccagaggacgucagccuuuuauaauuuuaguaauuuuagcucucgagccagcugcuagagcuguccaacugggaugagaggagacagcaggugcuguaucuuggucucaggaaacacaugucaaagugaccguagagagggaaaccgggcuugucuagggugccagaggaaaagucucucauucagggacuccauaaaacaagguguccca

SEQ ID NO: 4347 - RNA, 442 nt, Mus musculus
uaaaacgaaaaagacagcacuaucaaggaugggauguauaauugcaacuccuuguaccccuaguggaaaaacaagauucaauauaauuuagaaaaguuguuugacgaaacaugaaggaccucaaagucaucacaagacacccugagacaaaguucucagcauaaagauuucccccaaagggacaaaggacagggaauaagagacaaagacaggaaauagaggacaaggaagaaggggaauagauuauuugucccaggggaaccaaggacuaccucugaauagagagaagaccggcagggcccauaggcaaauggcaguucauaggaaagugggggaccuuguguuaggaugaguugguugauuuugauugggcauguuaagacagccaaaggggggauggguuugaugcuggaugucaauacuuugauagcugggccuugga

SEQ ID NO: 4348 - RNA, 11239 nt, Mus musculus
guuuuccugucgacgcuguguuuggggaaaggagcgcgggagcuguaccgcugcuggucgggucugugggccgcgggcuuuccgcgcgaucuccggcgcccaccgcucggggagccucaguccguggugucccccgagcgugccggcuaggagagaagggaagagggaucccugagccguguagccgcuuugagugccaacugcgaggugagcgcuggaguguccaagcgaccccgggucaguugcagcugaggacgcgaugugccgagcacuugacacgaugcacuuuucucauuugaaccgaaugggcuccugggccacugaggcaaaacgcugcuccuggcgacgacaaggagcauugcgguuuagugugguaucugcccagguccaggcccaugcagcgggaaagauuaggagagaaaccgaccaagggacuaaacccaacacugaaaaaucagucucugauuucgccaucccuggccagugcacccccuucagccccaauaaacuugucccuaaaugccuuuucuugcaaguaagugggagaagcuuuucaggguguugguuuauuuuucagguguagguucccgguugagaaacgaugacggagguucuggaucuccacggacaggacucugauggggguagugaggagaugguccuaacuccugcagagcucauugaaaagcuggagcagguaagcaccccaaauaugucccguguucuuagcucuuaacuuacuccaggugugcaguaccacggcucagaaaauaaggaaacagaagauuuguuuccaaagagcaguguuuguaacaucugcauaaaaauaggaagccagaaagcagggccuucuuuaggagucucaucuugucagucuucaaggauggcuaguaaaaguaggcuuuggacacauguaguagaauguuucacaaagcaaugcucugcugugcuauuuugaggacguaaagaugugugugaucuguagagaagcaugccauuucucuauaguagucucuuccucuguuuccucccccauuggaagauaucugcucuaacaagaaauugccaucccuuuuggucauaauagcagugauuauuucuugcauaguuguuguugucgucgucgucuucuucuucuucuucuccuucuccuucuuucuccuucuccuucuccuucuccuucuucuucuucuucuucuucuucuuccccuccuccuucuuuuccuccuccuccuccuccuccuccuccuucaauaauaucuucucaugaaccucggguaguuuaggaauucugaacaugcuugggguuuuuuagguuuuguuuuugcuuuuuguuuguuuguuuuaaguuuguuuuugagauagggccucacuaugcaucacuggccggucuugaacucucagaguucaccugccucugcccucugugugcuggcaguaaaagcaugcacuguguugcccuauaaguucugggacauucauggcguauacuauugaguguucuuuagaggacaguugaccauggguacccaccuccaguggauaccucuacaacauagccccuacaaccaaggcucagggaacgccaaagaagagagagcaggaagagacagaggaccaggacaucugcugcaggguuauccucucuauaugucagggaggcugugcccaugagagcucaggaauauugcugcuuagacaggacccaaacaaugaaugacaauggcauuccaacacggauggggaaccucacaaggccccaccccuaagugagcugcagacgaauaacgacagcugagagaggaagauuauuagucuuccucgggaugaggucccuaaaugguuauccagugccaaauggccaucccugaaaacagacagacgagcaacaccgcaugaauccagcagguucuaucuaugcauuuauuuguauauauagguaacaauaauuuaaaagaggccaugaauuuugagauggagucgggggauaugguuggcauuggagggaggagaggaagaggggaugauguaauuguacuuugacuaaacuuuaaaaaaauaaaagguucauugggucuuucuuacagugcagaguuucucauuucggugauuguguuuguuugguuggacuguauaaucaaacagaugaguggcuuccccaggguuuuacuguguguaagaggcugaggucaguguccuggcuggcuggucucuccuuggccugugguggcugucuccggugucuucgcuuguucuucucucuuggcugugucugugguaacauuuuguuuucugaaaaggacgccagucaccgagucaggucccauccuggugacuuuguauuagcgcccucacuuuuucuaaagauacaguagcaacaacaaaagaaaguauuuagaaagaguaaguguaagucagggguggcgggcggccagucugcucugcauagccaguuccaggccagacuacacagugugcugucucagaaaaggagaaagaaggaagaaacuugauggugccgggaucgguaaggaaguagaaagguguuccaguugaugcucuuagaugacagguaaggcucguguaucauguggcauuacugagaacuuaccauagugaugaaagaaguaagucaaauaaucuuagguugaauaaaagccccuuccuaagagaagagaugggaaggcugccauacaucaugagcuguccccagaguauucguccagcagagagccuucuacgugagacaccugcagcuuucaugggccugggagcugucucuagugugcuuugcuccauugugaggaucacucauuucuccuguauugcuuuuuaggccuggaugaaugaaaaguuugccccugagcuccuggaaagcaaggcugagauugucgaaugcgucauggaacagcuugagcacaugguaagaguaacuugucucuggacugcagaggaauagagagcugaaagcauuugaucagcaaggugaaguguggucuguuugcuuggcucagcccaacacuuuaaaauauaguuaccagcuaucucagucacgguucucuaaaggaacgacugaaagacugaaaaucuauguuuauuaugguggcugacagguuguggucuggcuaguccaacaauaccugacgcccagcagaaaagccaagaaucugauaguaagugguuuguuccaguaggguagaugucucagcucaucuucaguauguguuaggaucguguguccugcuacuagggaaauaacaccucaagagccggguagaugaacuugccgucaagagugagggcaagcaggcaaaaaucaagagccgccuuucccuguguccguuuauguaggcugcccacagaagguguggcccagauuugaaagucaaucaguccaccucaaaugaucggaucaagaaaagucccucacagcugugcccagcugcuuggguuccagcugacuccagguguggacaagauggcaacuaagauuggccauugcaucaguguuuauaaacuacaagaguuccuaucacauuuuuggcuuaauuuuuauuguauguguaugaauguuuugguagcacagauauuucugugcugaaugcaugccuggugcccacaaagcccagaagagaggauaucagacucucuggaacucaggcuacagggggucauuagcccacugugugaguacuaggcaccagaccuggguccgcuguaaaagcagaagcgcucuccacugccaagcccucucuagcccgaguugcuauaaacaccagcauggcagcuuccugugaacagucuggucugucccugacucugugucuuagucaggguuucuauuccugcacaaacaucaugaccaagaagcaaguuggggaggaaaggguuuauucggcuuacacuuccacauugcuguucaucaccaaaggaagucaggauuggaacucaggcaggucaggaagcaggagcugaugcagaggccauggagggauguuacuuacuggcuugccuccccuggcuugcucagccugcucucuuauacaaccaagacuaccagcccagagauggucccacccacaaggggccuuucccccuugaucacuaauugagaaaaugccucacaguuggaucucauggaggcauuuccccaacugaagcuccuuucucuguaauaacuccagcugugucaaguugacccaaaaccagccaguacacucugcaucucuacgugagaggguuugccccagcagcuaaguaucaucccguucacugugcuguccuguuucccaccaucccuggcagcucuccugucuuacauccuuagccugccugacaguugaguaugugaucuucagcuuagcaugcucugagcuuaggucauucccaccgucagagcagugcagugucuguguuacagcuucuuguagugugauucucaggggugugcacaugagugugagggucacaggacagcuuuggcugucaguucuccucuuccacauugaagcagggucuguuaguugcucacugcugggcaugucagccuagcuggcccaggaacuuccagaauuguuccugucucuaccuuccuuuguuacagcauuugugcugggguuacagacacgcacuaucacuccuggucuaacugagguccucaugcauccaguaacacgcacuuuacccacggagcuaucucccaaguucccagacuaguguuaugacacugguuuaugggcccuuagacauuucugcugugugcuuuguuauaucuccuuuacaauuggaucggaguucuguacccuuguggcugaccguauucagauccuauucaaacagccaucuuuaaaacgggugguuaugaguuauauaacuaagaguguucuuuguuuucgacuuugccaaugcuuauggugcuuaguguuugaacaucgugauucgaauuucucuucuaauaggaagaaaaucucagaagagccaagaagggggaucugaaggucagcauccaucgcauggagauggagaggauccgcuauguccucagcagcuauuugcggugucgacucaugaagguuugaugggccuugcacuggugcaguaaagucgggaugugaauagcacgggaagaagcugagggccugaagauuauaggagccuagcaucguaguagccagggacugaggcgaguccguucugggacauguaguggaaacuguaggugagauaagcccaggaaaaggcagcgugccccaggucugacuugcuugauguuguggugcuugcuggcgguggaaagagucagucgugaagauggaggucugugugagacagcugccuggccaguuccagucacugagaaucugucaggacgaugaagacuugcuauucuauaguccucugaccucaacaugcacaauaauagacauuguaaaaagaaugccugcugaggugggcauggucuuucaugccuccagaauguuuguguguauauaaguguuuugccugcauaucuggggccaugugaaugcacaguaccuucagaggccagaagagggcaucagaucccuggaacuggaguuacagaugcuugcaaguccccaugugggugcugggaaccaaaccuggguccuccaaaagaccagcaaguacucucagccauugaacaucucucccaccuauuaaauguaagcuucuuaaguugggcuguuauccuagacucugaauccugaucuugucacugaaaauacuagcuaucuuuucauaccuugucaucaguuuugaugcauaugcaauaaaaauuuauaucugacuuauuaauaagacugagccauuaagaguauguuaccagaaacuucucucagauagacaucuauccacuggacaauaugcuuuuuauuguuuuugugggguuuguuuauuggagggcggggaguaucuuuugggacaggucuuauuauguaccccuggcuaguguggaacuugcaacacagacagggauagccucaaacucaaggauuuuccugccucagauuaccuagugcugagauuaaagaugugaguuaccacgcuccgcugcuguuguuuuuuaauuacauaugucuauuuguggaauuuuuuuuuuuuuuuuuuuuugucguggguuuuauaaagcauaggcuggcuucaaacucacuauguagcccaggaagacccugaccuucccgagugucaggaucauagcaggcacuccauacuguuuucucuaaugcuggggaucaagcccagugccuuguucauucugccagcugagcuacaucacacacacacacacacacucacacacacacacuuuuguuuaagacaagcguccacuguaguccccgcugaccugaacucaggauccuucugccccagccucagcaggcauucuuauuuuaacguuuauuaguacgcauguugaggucagaggacaaccuguggugauaaguucuuugcauccaccaugucggguucauggaaucaaauccagguccucauguuucaaggcaaguccuucaccuacggagccagcuccugagccagggcugggaacugaacucaggaccucacgugugcuagguggccugccauggagucuccaucccucaaccaaaacccuucauccccguaugaaagguuuagacagagagagccaaaguuucagcgcuugcuuugcuaagaccaggucccugcauacaagaaaaaacucaaagguagauuuacaguuuuaacggauggucagcgcugccgcgugcgugcgugcgugcgugcgugcgugucugugucucugucccugucccugcuggcauugucagguucguaccauuuccuugaucaggaaucacagugcuugcuucacauugcaggccaguccucccaggcugcuggguccauaccuuuuuguggggguagcauuugucguuuugguuuauuuuugaguuugcucuggucuuguugauguugaccuuuuuuaggucucgcuacuguuuuccaagcuguauauuucauuccuggagauacuccaacaauuaaaugucauuuuuguaucuguguauucuguauacguauuuucggcuuuuuauagguuucagcuccugggaagauaccucuacauuaaauauuaagucauagcuucucucuuccuuggcaucugauauauuuauguuuucugaauuucuuuaccaaaacuuuccucuuugaauugccuuucuuuuggggagucuuagaaugucucuuucuuugaauucuuagagucuugcuguuagugggauuuauuuuuuaaccccuaguacuuggggaucuggaccuugcacaugcuagacaggugcuguaccacaaagccauucuccuggcuucuuguccauuucgcugcugcugcugcugcugcugcugcugcugcugcugcugcugcugcgaguguuucacuggcauguaggucuagucacggugucugugucugguguccguggaggucagagcgucaugcuggguuccacagaacugaaguuacggaugcucugagcuaucauguggguacuggaaauugagccccguuccuuugcaagagcaauaaaugcucuuaaccacugagcaauuucuguagcccuuuguugucagccuucgaaucagcaacaacuucauucagcuugguccaggccaggcagagacaaugucucaaaaaucagggucagcgauagcugaggaagugcaagguugucuucuggcucguucacaugugcacauacauaacugcgcucgcacgaaugcacacacacacacaugcacacgcgcacgcaggcaaauacacaaaauaaaacugggucuaggcuagcucagugacagagcuagcauacgcacgacaccgagcucuguccucagcacugccauaggaaagcagaacacaggcauaugacuccugagugauagaucuucgugauuuuuauuucucuucacagauagagaaguuuuucccucacauccuagaaaaggagaaagugcgcagugagggggagccuuccagccugucuccagaggaguuugucuuugccaaagaguaagugaucaggaaacguagagccccgucuccaguugucagccaguaccuugcucgcuccuguuugugcacaccacagccauuggaauucuuuguuccagguauauggaccacacggagacccacuuuaaaaacguugccuuaaagcacaugccucccaaccugcagaagguggaccucuugagggcagguaagagaucaggaucguaguguggaccccagacaucuucagagaccuagaguccucucccucucaucaguauggaaaaauagggaggcagagaagcaacagagcaaauagaaguaacgaggguucugguuaaaaacaaaaguacccggagaugucaggauuacuguuucagcaguguucuguguccugagaguuggacagggcucuuacgcagauucagacuccucccuuuauucagccucacgcugucugagccgcugccgggggguggggguccugggcccuucugagcuguagggaagcaggccucccagaccucauagguuucaaaauucauggcuaagacggaagcuaggaaauagucuccugccucaggaaagggcucaucaguucuguugugacgaucagccaguugagugugugugaguuguccgugaaugcauauccaucugccacagccugauaugauacaguuaagucuaaugagaccaaauugccaagccaaagcaaaccuuucucuaacccagcucccaccuuguuuacugaguucaguguuccuaggccacacacagagcagugccccgagaacuuaucccuugcccuaacgugggugcuacaccaggaguccuguaguauggaacgcuguccuguguuucaauagcucacauuuugggcagcuggaaggccaagaccaaggcaccagaagauuugguuaggaagaacuugucccccuucauguuuccuucuuuguguucugcauggccaaaggcaagaaguagccucuuuguaaggucacucaaacccaccuguguuuuaguauccucuuaucagaacacuggucagauuaacugagggcuuaccccuucauggccucauuuauccuuaccuaccuucuuaaaagccuuccuccacagucucaucccagauaccagaaguuauagcuugcauguaugaauuucaaagaaauacacuuuagccuaugacgacuugaaauaaaccagacccauaccacuguguagaauuuuaaaucaacaauuucacuauaucugccuugagaacuccagagguagaggagccauugaagcccagcccagcuugugacacaugcugacaugcugaccagugguguagaaggguggcagcauuccuuagccuuaaucauugagcaacuacauaagguuaagaccaugguccucugucugguauugaguacuguccucguguaacccaagcuuuccuuuauacaagggucugcucaugcguaauucuaccucagucuucucguggcaucccaaccucauucguccucucuaaagccugggcuuuucuguaaagcucacaucuguugcuuucuuccacaucacugaauguguuugccacagaugugaggcuucaccaaccgcucagcaccucguuuggaacgacacggcagacuaauucauaucucccuuaaugugcaguggcucccacucaucugccuucacuuuucagugugugaccugcagucacccauggccuaagauauaaaaucuagaaauaacuugcgaguuauccauaauaacaugcaggcaguguacauacauacacucauacacauaaaauaaauaccuaaagaguacuuuuuaauccugcacuguugugaccaguaguguaaaaucucacuuaucagauaacuaacacuauaccucagacuuaacguuaaagugguggccaaaguuuuugaguaauuuacccccuuccucauguaggcauuauauccucucaccaaaagcaggagggugggucgaggacaguaacagaaaccaucgacuuuauuacauaauugcuccucaaugcuacuguguguaguguguguguguguaaaugauacaguacuauucacugggguucuugaaauggaucccuuucaaaaucggaagcugcugcccaggcgcaugcccuaggcaugguaaggcuguggcauuuguuggaugagcaguuccuguacaucaggagccuccagagcauugaugcuaguggcuuuagucaagucgaacaugccagcugcuuuugguuacgcuuuuguuuuccuggcaguucccaaaccagaccuagauucauacguguuucugcgagugaaagaacgacaagaaaacauacuaguagaaccagaagccgaugagcagaggugaguagcguguggcccuuccccauggagaaucagcuaaacgccauacauacaacuguucauccuuuuucagagacuacgugauugacuuggaggugggcucacagcacuugauccgauacaaaaccaucgcaccucuuguugcuucuggagcaguucagcuaauauaaaacaaagcaagccugaggacauggaguggucacagacaauauuagaaacgccaucuuuugugucuaauagugaagucauguuccauacaguucgucagcaauguguggaccacuuggacguagaaaggcgccgaugcagaauucccuucguugucacagccuucuccuaaauuccuguuuaaccagcaccaacagaugggcccgugcucugaauacucagcaaauaaaucaaccgucaggugugugccuuuuauuuuucuacuacuuacugagcucaggaggggucucgaagaggcuucccugcccugcccacgacggccagauggacugggcauaacuugaugauuacagaacuccuuuagcuuuccugguggaagaucauaagcaguuguggucugcuucuauacagcguuaauauguggccuaaugauuuggaaccucaaauacuaagcuuaaaaacaaaugucucaaaugucuuuuuuuuuuuuuuuuuuuuuuuuuuccuuucuuuugagacagguuucucuguguagcccuggcuguucuggaacucacuuuguagaccaggcugaccuugaacucagaaaucugccugccucugccuccugagugcugggauuaaaggcguguaccacacccag

SEQ ID NO: 4349 - RNA, 16101 nt, Mus musculus
agguuuuuuugcgacaggacguaagcggcgacggagguggcgcgacagcugcuggagggccgaggaggcggguuuguguuuccagggccgaaccaggaugugggggggcgcggguccugggcuuggguagcuuggagucccucggcuacagccaugagugaaggggaucggcgaggggggaggccuggggcgucuuugggcgguggguggcuccgaagggcuggcgggccggagagccggcucuaggccggccaucugaccccgugucuugcccgaacucgcagagcggcggguccuguccucgccaugaggccgcagcaggcaccgguguccgggaagguguucauucagcgagacuacagcagcggcacgcgcugccaguuccagaccaaguuccccgcggagcuggagaacaggguaugcagcccggcuuccccugcuccuggcccugcuccuggcccugccccuggcccuggggaggggagagucccuggagcgggagggagugucucacgguucgggagagcaugagacgucaggauucaugggaaaagauauacgaaggagguacggucuaguauuuggagaaagaccacuaaggcuaaugcucagaguacagugaucauauagaacuuuuaggaugcuggcccgcaguccacccaagaguguccuuaacaggaugccgacacacacacacacacacacacacacacacacacgguacuugacaccugguugaagcucacacacacacacacacucacucaguuauugacaucuugaugaggugcuaauuccuggaacuccaggccaccucauaccuccugugguaaccuauauccuacugccucagacacgcgaaagacagcgucauagucaugacugguaucuguggucacugugcuggucauacuguucagcugaaaggguuuauuagggaugugcucggcaguccagacaggccuucuuggaaccugaaaaacguacacggucccgggcaggaacggcaaaggaacuuguagcugaaccaacccugacucccagucauuaucacugggaacuuccuguuugccuugcauaucaaaacggucauggggcagagguccuuugggcaaccuuguaaacaaagaugagauuuguguaccauuccuucagauuuaaccacaccaaaaaaaaaacaaaaaaaaucuacucgucuacccaaugugauccuccuuuuguucuucagcgauauuacucagauucuauuuccuguucauaaaucaguuucugaaggaugaggaacuuggaggguaauuaagcaugguguggguguggggcuaagaaaugcugcuuguggacuagguagguggagaugaguguguacuagagaaaugugugccagccauuuaaaaucagaggggugguuuguaggcuggguguguggcuuagugcacagagccuguuuuuuccagguugaaggcccagggaucuauccccagcacuacauacuuacucaggccaacuaccagcuacuaggaaaucuaaggcuggaagacugcauguuccaggccagccuaggcaguuugaaaagaccaugcucugaaauagcuuggaaaagguggugauccugagauaauucaaugguagaccacuugucuaggauguguggggcucugguuucaaucccaguacugacugauuguuaggcuagaaaauucuuuauuucauuaccuucuccuuaagugggauuuauggcuguuggcaaguuaguggcacaguugcccuucuugaacugcaaauuaaagaugaagcaagcuuugaaaagauacuguguaaacaguguguggucauggacaccuguaaccuggcgcccaggugccagaggcaggaggauccugaguccuaagccaguauggacugcauugcaaaacucuugucucagggagagugaggagggagaggauaacagguuuugauugacuuguuugugacaugccauuuaaaggccucuguugguuuauaagucagacuucucucuuuauugagccaggcacguauaugcgacaucaggcauucgccuuucauuguggaugguagaaccuuuccuuaauaaucuuagguuuaaaacccccauguagucacacacaccuuuacaggaaauugaugcugcugaacucugccguccaaauugguacuugauugacuugcuaaaccgcagaauggguaguggugugugugugcuaugugccuuugacucucuuacuguugaguuaaacacuuacguaaaccacuuggggaggcuuuuauggguaugugcugaugauacguugacguucucuugacuuugugugauggggcguugagaggcuuauuucucugcugaccuagaaguaguggugcugcgcugcgcugcgcugugcugugcugcgcugcgcugugcugugcuguugccaggucuggcuuucaguccgugggaacaucacacucgccagugugaugagaaacuaaugcacagauguccuauuugacaugauauuuaaaaaugcacgcaugcuauuugagggcacagaauugugucagcugagcacuguacuccgcugccuguuacagugugaugcuuugaugccugagagcccagcugccccagucguucuucaaacgaaccuuuguuguuguuuuagcuagaaugccaauguuuuagucccccuagucuucugggagaagaaaauccaaacggacuguaguagagacgaauucuacuuaaucuagucagcaggaauaaccuuugacuuuacgauauguuugugaucgcuuuagcuucagcaguguguauuucaucaaaaacaaaacuucugagaaaaccauuccuagguccauuccauuuuaaaugguguuuauugggccauguuuugguugguugguugguugguugguuuuuugggguuuuuuggguuuuugagacaggguuucucuguguaguccuggcuguccuggaacucacucuguugaccaggcuggucucgaacucaaaaaucuacccgucucugccucccaauugcugggauuaaaggcaugcacuaccacugcccagcaugggccauguuuuuuuuuuuuuuuuuggggggggggguccauuuuugcauaucuccaaauuuccaauacaguuucugaauuacuauccaaagaccuuuggaggacugaugacuaucuuaaugugccuagacacaacagauuuuuaaaacuccuggauuuuuucucuagagcuuaaguccaguugugucacuugaucacauuaaaauauagcacagacauaucauguagucuggauuuuuaagcgacauuaacagaauaguuuguguagagaaaccucaaguuuccccagcugugccaugaguguaucugcauauacucuggguauugucagaggcaguggauuugugagcugucuggaacuaaaaauuagaauaaaaucauuuucuuguauuacaaaaaaauauauauauauauagcacagagacaguuuauugugcuaacgcuguauuuacacaagccuugagugugggccugcaggggugcagugcagaagagugaaaacagugguguagacagugugcagacaguaguguagacaguguguagacagugugcagacaguaguguagacaguguguagacagugugcagacaguaguguagacaguguguagacaguaguguagaugauguguugcagugaugugucauacugucggcaucacucacugcagcugccaaguaccggcugucuuuguugcacuucugcaaaguggacgauuaggauuauuuguucugguauuaccacaagcagggagcgaugcauugagcugcuggugacccugguaguaggcgguaggaauuuccaguuccauuacagucuuaggggucuacugucuguaugcacacccagagcucagaacauuauggcgcccauaacuguuagcacuguuugcuccuaccacauucuuuucuauuaacuuuuuaacaaucacauagacugcauaaguacaugcccuaagguuggcgcucagggcuuugugcaugcuaaguaaaugcucaaccacugaaaacucaauuuucuuguaauaugcuuuuaaacgacuuuauuccuuuccaucuucauucuuuaaaaagaacuggccacagcuuuguuuauuaaccugcccuagauuugccuccaucuugcagucugugggacucugagaauaauuaguauuucuaguucaaagagcaguuucuagauccagaagagcgauucuaaucuggaagagauaagguaauccugauuggaugccauucuucugaaugacacuguauaaagaaauguaaacaauagaagagugucucagaucacaggauugcagacaguugaaguagccaugagaguuagauguucaaugcucacugaccaccugaagcguuaguuaguucaggcaucacugcacugugcuuguuuucaagguaggagcauuauggcuuccguccucagugaccuuuuuuucuuuaaauguguguggggauggccguuucgagacagggucucacucuguagcucagacuguacugaaauucacuaugacgaccugccuggccucacucacaaagauucaaccgccucugacucccaggugcuggguuagagguguacacucugcccagcucucagugaccagucuugacccuggcuuggagucagagaaaaauagugggaagcgggccggcucucaguguccuuguccaccuggcccuggucaugguaacuaagggcaaacaacgauuacaacugcuucugaccugagagcuuuuaagagcucaaggacagggucauaaaauacuaucuacucucaaauuuacuucuuggauuggagaugcggcucaguguagaaugcuugccuaggacguugcucugggucagaagggccgugucagaugaaaugcucuacuacgaaugggcauuuuaaauucuaggauaacagaaauuggaagucugcaaaauauuguuagaagaagaaaguaaaaacaaauaaguuuuuagaguccuuggcuaaugugcaggaagccauggguucuguccccugcuccacauaaaaugaggugugauaguuuaugucuuuaauccuugaaagauggagacgccagaaggaccaggacaugaacaucauucugucuguagcucuguaaggaguuugaagacauccuggagugcaugagacccugucucacaaaaagaaggacaaaggcauggcuggaguaaggaacaggauggcagcagcagaauugugcugucacuuaaugcagggacguggccugagaggugguuggaaggcagcugccuucuccgggcagcauguguuacaucuuugccaugaaauuagugauacaguuucugggacacacaucgcccauccuuaacuaaaaucucuccaagacaaauagccaguguguuaguauuaaguagggucauggugucauuagaggugggauggcuuuacuaugaagcugggucaguuagagauuuuugcucuucucaguaauaugagcaucaagucacaaaaucugcugcugcaaaagaggagcccgagaaaacaacagagcuugccacuugacagcucugcuuaaaguagucuuugcucagcguucagaugcuuguuuuaggaauacagacucucaaucggaaaugguggugcauaccuuaaccccagcauucagacagccaaggcauggaaaucacaaguaugaggccauccugggcuauguagugagacccuguuuggaaaaauaaaugaauaaauacucuuccaagguaaaaggaaccucuaauugugugcccuuauaauuaaggaggugcauguauaaaagacuagccauagcauuauaggugcucagaauacaaauauccaugauuagaaagacuaucauuagaauuugaguauagagaaguaguauuuugaaccuucacaauauccaguaucccauaagauggauaaaguuaaacucuaaguaauuguauuagugucagaggucuggacuuaguuacaugaaaaguuauuugccuuaucuuuugggguuuguuugauuuuuaagacaaggucucaugaggccaggcugaacucacauuuacuauauagcuaaugucuuaauuacuguucuguugcugugaaggguuacuuauaaaagaaagcaauuuguuaggggccuuacaguuucagaggugaguagacuccaugaccaacacgguagggagcauggcagcaggcaggcauggcacuggagcagucgcugagagcuuacaucugaccugcaaguuaggaacaaaaaagcuaacgugaguggccagagucuuuugaaaccuugaagcucacccccauugacaccuucaacaaggccauaccuucuaauuguuagcaaacaguuccgcaacuggugaccaggcauucaaacaugaauguguggggccauucucauucaaaccacagcccagagugaccucgaacuacugacccugccuuggcauucgucugcuggagucacagcauauuuccuugccuguucuauuuauugucuuuuaaauuuggaaccuugucaagacaacaagguaugucugguagcaaacaaugaguuggccaucuucgucucuagagcuuacuuuuaauuuuuuuucuucccuacagauugacagacagcaguuugaagaaacaguucgaacucuaaauaaucuuuaugcagaagcagagaaacuugggggccagucguaucuugaaggcuguuuggcuuguuuaacagcauacaccaucuucuuaugcauggaaacucauuaugagaagguauggcuacauuuguguucaguaaaaucucuaaauaccaugaaagaagauaagucucuacauauuaacaguugcuuuaaacuugagaaaccucuauauaauucagauuuuguuauugcccuuacuguccagagcacacagaaguggguccuaaguguuugugaaauaggucagcauguacaagucugcuuggggugacagggcagaguucagacucuacaugcaaaguuagugcggaaacucaguauggcuccaugucuccagcucuuuugagucuuuuuucuuccccccuaaaguuuccguuuucggucauagccuccaacuugaguccuucucucugcagcugccugccagcuggaggguugcuguucgucagcuuguaaugcugagaauggaaacucgcaucuccccauccuguucaguagccccccucucugacugcgagacagggagcuggagcauagcugggaagggcugcgcuguuuucaguuguccccuuuguuaucgugucucuggcgaugcuccggcuugcuccuagccuguccagugcuguccuaacgcaucucuccuugcucuuugcuuuccagcucgcuucccacugucuucagaaagcacagccuuacuuccucugccacuccuaaguccugaccuccuccuuuccccaguuacgacuggaucaggaaagauccccugaagcugauguccaguugccucucuagcuccaucucccacaccauuccuccauguguuucugcagacaggcagcuggauuagaaguguagaucuuaucucuauagcagcagccacucagauuucacgcagagcacagauaucagaaagcaaugauucuaaguaggcuuugggugugugggaaaagagcccgagagagggaauggucgcacaagugagggagcuccacagaagcccgagcugagucugcucggauuaggagcguggcaguuugggaggaaggaaaggaaugauuucaaaggauaugcugaugcuagaaccaggauucagggaggagccaacuuuaacaagaagaggaaguugaacucccauagaaagaacauggccauccagccacgcucuuacggaagcauguuucugguggaguuacauccuuuggagugacaguuguaagagggaaguaguauugaguacccgacaagugauucuggcuauaggaucuuggauacauucauuucuuggaaaucucucaacuauaaaauagaucuuggaauuaauauauagccuugcauauaguaaauauuuaauaaauauucccuugaaguagauuuuaaaaauauuuuuauguguuuauauauuauauugcacauauacacaugccagggcaccaguagagaccagagaacaaccucgggccaggccccuguccuccgcugugucugacugagacuggcuggcucucuuucuguuguuugccucuguguugucccagguagcuggcacucaagcccccugucucccgugggcgugcuggaccauagaugcuugugcuucuguuuccagcuucugcaugcgcuccggggaccucagcucaggucaccccaucccauguccgcuaguucuuuaugaaaaggcaagaaugaauccuuuagacaccaguguuuuaaacauuaagauuucuuauucuacaaagaguaaaccagauauaauguuuacacuuuaucauguggguuaaauuucuuaaaauugccaauaauccuuuuaaagcuugcuugaacaauuauccacuuuguuacuuguaauaugcuauuuauugauuuuuuuuuucaguaaagauaaagaggauaguguuaguucuuaacaauugggcuuggaggagguuuuccucacugucugcuuuguuuaucaacuagaaugcaucccuucugccugggcuguaauuagaacacuuaagucuuuucugaaaaugccaaggcucuguccucagccuggcucgugcaccuuucuugcagcccgucuagagccccguucccggcagggacaguugucuguucuggaggugucauaaugguucacucuguacucuaggugagguuguaguggguguuuggaaacaaggucauuucguuuaauacuuugguuuguuugacauugcuuugcacuguaagagccggugagauggcucaguggauagaggagcuuauguguaggccugaugcucugagucugagcccuggauucugcagggugccuggagagaagugacucccgauaacugugcucuguccuucacacacaugcccugccucgggcacacacucauacacacauagacaugaaauguuaauuuaaguaugauuaaaaugucaucugaacgucuuuggggacagaagugucaggugcaguuuggaauagcugcccaaaugaacucuagggcauuaccagaguggaguuacuaggaauggagagucuagaaacaacuuuuauuauuuucuccaaaauaaggauuuggaauuuuccuuuuagagagggagggaguaaagggggagacaggagagagaaugagaauggcucauuuguuucugaacuaauagccagaugcacauaaaugguucuaaaauuuaaacaggaacuuugcccaauaaaguuaggcuuaaaucaaauaaaaggaaugucauucuugcuaaugaccuguguccaagaggaaagcuguuuuaaagcagccauuccuaaagccauccaugcauccaugauguguguccaccacugcucuggggcugaggcagacauggucucggguuucucauucuggugcccaaggaaaggaaguuggaaagaugacugaaaguccugagcugagccugcuuacgggcuccuuccuuccacuuguuaauuuaggguuauugacaaacugggaagauaaagccugagggguuugcucauaaugaccaggaauaguucagauucuucuaagcugaaaauaagacacugaugcucacauugcuucagguaauuagacuucaaaaauugucauuuuuagaaauacuguuuuuaauucacugaagaaccauguagauugcucuuucaauaauauccauucacaccagacucuaaauagcauauacauaaauaguuauuuauuuccuuucaauaagaaaacuaaucaaaccucauagagcuuuguauuuuaagauaguuuacacuaaaauaucucagcuguaacaucucccuccuucauugccuauccuguauguuugucuguacucguauccagugcucagcguggggcacaucagugcccuuaguggacgcccgacaugcagugaugcuuuguguuccuacauugcuuuuccucucucuguugugagcaaguuuguacacucaucauuuucucacagggaaagucuaaggaagugcuggguaacuuagccguccucuggagugaggcucugcugacuggaaccugaaguagagcauggagccccugacggcagagaacaccgcugagauacuuucucacacugucggaaccgcccuuaguaaagcugacgauuuggcuguuucucaaaguuccuuuguguccuaucuggguuuugucuacauuuguuuugacuuuuacaagcuuaauacuaaauuuauaauuugaaguuccugucuaggaaguaagagcaaaacuacggcguaucaguguaugcaaacauagagaugauucgagacaucugugccccgaggcugccccagcacugauaucugugugcucuccacauggaaugagcaucccagcagagugacagagcucccuuuuguuacagaccaagccauuacuugaaaugcugaaaacacacaaagggagaaaagauaguucuuacacaggagaccgagagugagccucacuugagaagaggccgucuuaacugauggcagcuuauggauaguaggagauggacguguguguaagcagcuuagucccuguagcagggcagaggugaggggaaggguggcuucucacugaauguguguguguuugcacuguccugcgcuccagcacaguacacagugugucccguguacagcugauaacugugucccguguacagcugauaacuguguccuguguacagcugauaacuguauccuguguacagcugauaacuguauccuguguauagcugacagcagccagguaacccagucucuuguuugcuuuacagaaaucaacaugacuugcauugaaagccaacucacugaauauuuugagaucuagcuaacaggucagauggaauguguuaaaagcugugguguuuccucuggcaggucuugaagaaagucuccaaauacauucaagaacagaaugagaagauauaugcuccccaaggccuccuccuaacagaccccauugagagaggacuucgaguuguaucuuuuuaguccagcucagaaggucuaaauauuucuuaaaaaaaaaaaagucaugaugguauuauuuggccuuggccagagagaauuuaacuuuuacuccuucuuaggugugucuucagaauuguuacgugaaugauauaccauaggcaucccuuucccagcauguucuuaaaccguggcuuucugaacuuggcauugucugggucucuggacuguuuaguguucugguucccaucuuccuugguucugacaacaucuuguaauagugaagcuuguaagagugacaugucccagcugcaggaacucugcgcacagagccccuugaagugugcagugagacaugccauccaaaugaacugcagucuacagguccaucuggccaguugcaagcuguuacagcugccaguggaucaucucaucgucuucggcucaauguccguaguguagaggcaggaggccuugagaaauuaaguggauuuaguaaauuggaaaaacugcauuuacuuaauaaagugaugauuaagugauuuuaagcuagucacauaauccuaggcccugcggugauaauuuucgcaguuuuaauguacucuccagcaaugguucuuuuaagggucaugaaccuucucccacacaaauauuuucauauaauuugagggcauuuuugagucccucgaucucucugaguucucaguugugagucuacuacuagcuacacauacagaauacuucccaggggcuagagagguggcccggccauuagcgcucacuggcugcucucgcagacucuggcuugguucccagugcucagugacagccauaauuccaacuccagggcauccaugcagacagagcauauuuacaaauacaaaagaaaauacuuugcagauuuuuuuguaaaacuaguguuuuaaaaguaacugcucucauaauugcagguaauuuauuaagcuuucuguaaagcagaaaaagugaaucugcacacagcagaccgugcagacugucuugcuguagucugucugcuucguguguuacauucucguguuuucuuaacggccaugcuguucagauugaaaucaccaucuaugaagacagaggugugagcaguggaagauaaaccacagaguuacaggugagugugaaauccaugguuuauagaucaguuuuaaaauguuaguuaugcacagcuuuccccccugcuuguaaauaacagguuaaaucauguacgguagucuauugauuguguaagcucaagcuaaucacagguucauuuuguauuuuaaauguauauguagcccaaaucuacuugguuauacacuuuaauuuuuaguuuccccuguguguucacuuuaggcugguucuuacugugauacuuaggaguggauuuggcuugcuuuaauacuuuagaugugcucuagccucuuaaauguuggguguuacauauaucugagccagcccagagauguuugucuuuaugccuuguuuuuaaggaagccaggggacauuucaagagggagaguggcuuagagccuuucaaaggaacuuaaccuggaggguacaacauaaauuucauuccuuugguuagaauguuaauauucuuguauagccaggugaugcccuuuaauaaauagaaaaaauuaguuacugguaauaaaaaccugcagucagauaugguagacuccaugccuguguuuguccagcucucaaaggacagaaaugguacuuccuguucccauccaugucaguugcacacucugcugugccucacgggugcuccugguacugguuaacaagcagcacaagacagacuggguaaagcacacacaucuucuagggcaacaaaacgagcaaccacuauuucagggcuccuccucugcuggcuauacuaacuguuuaugaaucucacaaggucucuaguucacagaugaguaaacugagauagaaauaggcagagaucaaggucacacuacuaacacggauuggaugagcucaaggccccuuguauggcacacuuggccucagugauuugcagcagaagaauauagagaaaggacaaauuguuccuguccuaauguuagccccuuccuucucaguggcuuucuuaagaacccauuuugcuccuguucacuuauugauuagaccagucucucagcauuccaaacuggaguguuucaguucuaguucaugugucaccuacaguuuugaagccagaggucucaauaaugaccuccacauguuuuauuuccuuuucaucuucauuuugaacacauagcauuaguuguccauacauuucucauguacaguuuccaaacugauauuucucaugugaggcacugggaacuugguuuuuguuacaugccacuggaauaaguuuaucauuucuagcugcaguggcacggcacagccauuuguaacugcuuugugcugcuuuaaugaaauguuuuucugaggugguguaaaguugugagcaauuauagcucagagccuaauguaucuauaguaagauaacagugaauguuugagaugagaaagcguugcguuuagaacuuuuaguuaguuucaugaaugcaaauauuuuuguucaauacaguguaguuuucagaguucuauguugcucacuuccaggaugcacuguuggggaugauuauaaacuagaacuuacucaguuugaccuuuuuaagaaagucuacgaggucucuguagguugcaguauuauuaaaggggaauuagcaugaaaucagaaaccaugggaggccauuaguagaacuuuaagaaaaaacuaugugcccuuuucuaauauugugcauccauauuagacacauauguguucucucuaagauugucuaugauaaagaugaaguaggggcuggagagaugaccggcugccccuccagaggggacuuggcguguccccauggcuggagcccucuccuggccuccacgggcauugcaugcagguguuacacagauagaggcaggggaaacacugguacguguacaguaaagguuaaagaaagaggugaauacacuugccgucacaguaagucaguggugacagaaguagcugcauuugucagcauugcgugcggcacguucugagugacuaaucaucacagaccuacuaaagucaguaucagcacagcucauuuguaacacgucuuagaggguugggguaggucggguuuguuuugguuuuuggccucucuaaagugugcuguucccuucuuacagguccugccuccagcugggaccuucgucuauccacuggccgauggcagagugucccuaccuccucuccagagcguuauucucuugucucugcugccagagccacggugccacaccuggagugaccgcucgucacucagcauccacuuugucucccaguuguguaggacucugugaucuuuugauuuguuuccaagaaaauaaaggaagcaauucucuuuauaaauucaaagccauuuaaaacacaggcaguuggccagcccaagacagagucguuuucuuaccagauaccagugucacugguucuccuugucccuugggucaguuuccuagguggcuuuaugaucccacaagucaugucuuagcucagucccucccccagauuaguagcaggcuuugagggugugugugccugugguccggcugacccgccgcccgaguccccaagcuaccagccuugacgugcuucagaucuucagauugguuucugcuguucaauuucagaggcuccuugagagaauaauauauguuacuuguuuuaguguugcaguuauuauuaaggcaguauuuaugcaauuccgguuguuucuuugaaagcaguucuguuaaugugcauuaccucgagauguuggggagauguuguguguguugcuuguucauuccacagauaaguaagcacaaugagcagacccucagccaucagcuccaccugccccagcucugcccgguguggaagaagcaaguguccuaagcaccuaacucuaguuuuguuacaaguauaacuuaggagaaaaaauugguagaaauaauacaguauguugcuaauuuguaaccuacuuuaaacucugauuuauagccucacauacaguauucagggcacagaaaucuuuugauugacucaaguaaguuuuggcuuccguguaacuucaaguuaaaguuaauuuuuuucagcucuucuuuaucucuauacucucuuaguaucggaauuucuuauguucuuuuaggaauuugagagcacuguguuugggagaaguuaggaaacauaaggaaugaaugaagcaguugaacuuggagauacuguaggugcuaauacuggaucuaaucuuucagauuuaauuuguuuucugggccuuguaguuacucaguaaaccccuuagaucuguguaauaauuuaauuguauaacgcucauuuguuccuuuaaagccuauucuagucugucugccuuuuaaacuuguugcaauaaugucgccaagauauaaacacauuaguaaaacuuuucuuaaauaaacccucucuugucuuagucuaugugauuugauaaagggaaugcuauggcaucuuauuuggaugacaauauuggaauaacugauaaagcauaucuaagcauuuuuaauuuuuuuauuuagccugugcgugcaugugcgugcucugugugagugugcacaugccaugcaugcacauggaggucagaaucauaucuuuccuuccaccaugaggacaccagggaucaaacacaaaucaaguuugguggcaggagacuuuaccugguagcaucuuacccacccuuacuuaauaugaauagauaguuuucauuagaaaagaguuaucagaauuacuacuguaucuuggaucaucugaugacuu

SEQ ID NO: 4350 - RNA, 2277 nt, Mus musculus
caggagcagggccaggagcaggggaagccgggcugcauacccuguucuccagcuccgcggggaacuuggucuggaacuggcagcgcgugccgcugcuguagucucgcugaaugaacaccuucccggacaccggugccugcugcggccucauggcgaggacaggacccgccgcucugcgaguucgggcaagacacggggucagauggccggccuagagccggcucuccggcccgccagcccuucggagccacccaccgcccaaagacgccccaggccuccccccucgccgauccccuucacucauggcuguagccgagggacuccaagcuacccaagcccaggacccgcgcccccccacauccugguucggcccuggaaacacaaacccgccuccucggcccuccagcagcugucgcgccaccuccgucgccgcuuacguccugucgcaaaaaaaccuagccucucccgaacaccuucugugccgcacguugacaccccgcccccuccggccguaaagcgacgccuccgcggcugcgcguugcggugaggugcgcgguggcugggagagaagucuuccuaguguaggcgaaugaaacccuuccgggcggaagaagaugaugaugaugagguggacgugaucgguggauccgggaguuccgggaaagacgccgggguuagagacucggaauucccuguugguuguggugaagugguuugugggcacaggaauaguucccuucuugauuaagcguuccagcuuucacgugggcuaacccaccucgcuccacaaaaacaaccgucacucuccaauuccaacagacacagauauuuacaacuacaaagcgcacuacuggggaugcauuuggccccuggaacccucuugaacgagagugaggagaugguauuccuguucugcauuauccugcaucccuucuccaauucuucuugagguguugguuuuuuucgucccagagacauguacaccagcuauacccgcuuaggugacccgacuggaccaacaacaguucucucucauugguccccacuuuacugacuguaucuuugcaagacauccaggaaaaucccuaugcacgucuggugguggcgauguucuaguacaacuuuuuaguauacugauaauugauuagauacuugaucaguugucacgauaauugauuucucuuuugggguuuuaaaaauagcauuaaaaaaauuuccagcauagggcgggggacagggcagaggucguccacucccuggugaucucugaguucaagcccaccccaguuuaccuaaauaguaccaggccagccagaucgucauggugagacccugucucaaaaaugaauagcuuuaucccaauaaaggguguauaguaaacccacucauuuaacguggacauaauuuguuaacuucuaccacguccaugcccuuaaaccaucaguacaaucaagauaauaaacaccaccucuaaaaacuuccuuacucuuuacagucauaccuuucagccauucagcagacccccuuugcccaguacuaaccuuucugucacuagaaacaaacuuguguuuucuuaacuuucacuuaaauugaaucagaguuuuucgucuccuucuuauuguauagauucuacugagauuccucuguugugccauacguaauuucauuucugugacuuuccccauuuauucauucacguacugccucaggguuuccauugcugugaagggaaaccaugaccaagacaguuuuuuauuuguuuguuuguuugguuuuuugagacaggguuucucuguauagcccuggcuguccuggaacucacuuuguagaccaggcuggccucgaacuuagaaauccgccugcuucugccuccugagugaugggauuaaaggcgugugccaccaccgcgcggcuacaaggcaguucuuauuaaggguaacauuaaauugggguuggcuuacugguucugagguucaguccauuaucaucauggugggaagcauggcagcuuccagaaagggauggugcuggagaaagaacugaaaguuccaaaggcaaacaggacaagacaagcuuccagguagcuaggagaagggucuuaaagaccaaccccaaaguaacacaguuccucuaagauagccacacccauuccaguaaggccacaccuccaaauagugccaaucccuggaucaaguauacugaaaccagcacauuaguugauagacaggaaauuuccaguuuuagaauugcaaauaaagcuucuauagaauuagccua

SEQ ID NO: 4351 - RNA, 1257 nt, Mus musculus
gauggagcacgcugaggaugcugcguuccugucucugcgaccagaccuuucagcagcucggaccaacugugcuagcgaugcacuuagcaauuaucugcuggcgccgacgccccgccuccugcucuugugauuggcucuccagucccgggcaggacugcauuggucucggccgaccucacucauugcuuuggcuucuacuauuaucuaagccaucaaaggaaauaauuccauguuucauugacaaccuguaagguucuccucccgccaggugucgaggggggagggggggcagaacugggaguccagagaagggaggggaggacagucgaaaaaggugggggugggcgagaaagagaccggggugggaggugcgaggagaaagagagagaggaagagagagagagagagagagagagagagagagagagagagagagagagagagaauaugaacugagguucuuaguccagcauuuuaacuuccacaaaacaaagcccauugcaacaauuaucuggccuuauuuccucauuucucccccuuguugauaaauauuccugaggcuugugggaaucauaaugggggguuucuguuagugucagaaggcuccagaaagcagaacaagguucagggcugaaaaaacagaacgaugcuuuuacaccuuggaggucaucugaaggucauuucaaauuguucagggggcauauuauaugcuuugucuuguucgugugccuaauccuuuucccuaaaggucgacaaacugccccaacccgaggucccaaguucccuuggaacucuaccugaggucuggaaggagcuguuuccaaaguccacaaaagucugggaugucucaccaggggucaccaggggaggcccaaaugagcaggcacguuggaucuaagcaccugccaugagccugguguuuguuuguuuguuuguuucauuauucuauccuacuuccuucuguuaauugcagucucacaaauuaucagccaaaagggaaggaggagaaggaagagaaggaggaagagaaggaagaaggaggagggaggaggaggauggaggaggaggaggaggaggaggaggaggaggaggaggaggagaaggagaagaagaagaagaagaagaagaagaagaagaagaagaagaagaagaagaagaagaagaagaagaagaagaagaagaagaagaagaagaagaagaaagagccgaccuuccuccuacaucugguaaauguucagcuucacucucagaaguaag

SEQ ID NO: 4352 - RNA, 2889 nt, Mus musculus
aguguguccuauuaaguuccauguuugcucauuccaguauuuuguaauuaggacaagaugaagguucaacuagucuaagaaacugucugacucaaacauuuuuuuuuaaugcugaucauauaccugacuuccaccuacaauuguuuuaaagauaaguaauuagucagcuuaaaaggcaguuggggcacagggcuaaggauucccaucaccccugugcaugguacugaugagugaguuaccuaauggugaacuggaccagcuagugagucuucucccagaaggccuugcagcuccugagguacaccagcuagaagucagucauugccacaagacguaucacuagaagacacaauucaacuugcuaaagggggggaggggcacagaagggcagggcucagaauggaagggcugacgcacacaaggcaggcuagaggcaccuuacaagagcccugccuuguuaaacauagucuaggugaaagaggaaagugcugagaguguucaggcguggcuaggaugaccuuagucagcguauuguaaagguggauucuuuguuggaauaguugguguuucucuuauauuagccuuuucacaccagagccugcaucaccaaguuauacacagauuuaaaguauaacauuuuccaauuacauauaagaaggcacacacauguauaauauauacauauaguugaugaacauuagaacugaaacacaaauuucaaaaagaagcguucagcaguguguaguguuauguuuccuauucuuacucucucucuucucucucucuucucucucucucucuuuucucucucucucucuuucucucucucucucucucucucucucucucucucccucucucucccuuucucucucaaagacaggugguaaaucacaauaaugacacugugucuaguggccacagcucaaagucugaaaagccacugaaccauuuuguaaggacauucaugaccuaagcagagaagaacuguggaaugacagaagcuccaacucuaaggccacuauggcaaugacuugagauuacucugaaagucccuucgacuaagugcagacuugccucugugcaucuucacaguucagaccaugcagucacgguuuuucuccuuccuccguaccauuguccagucuccaacacuugcuuucccacacaccucccaucuucucugaugucuccuaaagaaacaaucccuggacuucuuccuucacagucacgggaugaugcaacagaagcuuccagaccacagcagugggaggagauggucacugaaagaaaugaugguccugcuggacaagggguggagacucugggaagccuaggguagacaaaguauaucagaugcaugcccaggacacacaaccucucuuagaagcacugaggggaaaucugugaguuuaccauguauugauucacgaguuugagaacuaaaacuucaagugaguuucaugauggcugucaaggcuaagugcuucucucuacagacaaacaugaguuaagacagauuaacacauagaagauguuccuggaaaaggacugaauuugucuuugguguguuggcgaguucagagucacggggagauuagagcaaggugugcuacaccguggguccuuuucugagcagaggagguaccgcacacucucugaccuuuauuuguuuugaaaaaugagcaccauuuaccagcacucugcccuuuagagcgcauugaccuucaguuccuuugcucuucguuuccuuuuuaaauggucuuuccauccauucacguugcguuugccuuuuuccucccaaguuauaauacaccacacauguucucaaaccuugugaaaugucauuucugguuuauuacauucuaaguuuuaccguaaauuauuuagaaaugacuuacauagaagaagucuuucagucuuuaagaauauggauugggguaaauauggugggagccaauccuguguuuugucauguagauuugcaaaguggaaaugucugguuucuuuggagacucgguuagguuauaaugauguuuugcugaagcagacacagagggagggagguuuugcuaaagcaaacacguuaaaggaugcaugacgucuagaaagaauauaaagaugacccccccccacacacacacaccccagacaguggaaacucaagcauugguucacuucacucggccuugcucgucuucgcuggcaacaugccauguaucaaucaguuucccuuacauugaguuuccgagcuucacuucuggggacuucauagagagaaacucaccagagaacuccucaugagauuccuguggcuucuugcugcuuccacaguuucuagccaacuggcgagccuggcagucucuucuggauugaacugcccuugcugauucauguguggugucugccgaguggacuggacugcagcugcugguuuguuugcuacuggacuggacugagaacaacaaagauuggaaucgccccaaagaacuaguucuccacuuccccuguauccuaguaaccguucuuuuccacuacuucugguaggugguagggggagguugaacccuuauuuuaaaagguugugaaauauacuugccuacagagugguaugacugaccugucagaucaaagcgagugagacauuuuuucaggggacacaaacugguuugagagcccuaccaacaguuauuaucauuuuaagauugugugugugugugcaugugugugcaugugugugcaugugugugcaugugugugcaugugugugcaugugugugcauguguguguguguaccccacauguuuguagguacucacagagaccagaggaaagccuccgauuccccugcagcuauaguugcaggugguugugagccaccugaugua

SEQ ID NO: 4353 - RNA, 67319 nt, Mus musculus
gggggggguugcugcgucagugccgcgcgcgugcucgccgagggcgagcgccccgccagcccgggggcccccgcgggguugcaaggaugaccgaaggggcggaggcggcggccgcgcguugagcggaaccugccgaagcccucgcuauggggccgcgcgcgcucucgccccuugccucucugcgacuaagguggcugcuggcguguggcuugcugggcccaguccucgaggccgggcgaccaggugggugccggacgggaaccgugcuguggggagugagugcuggguggugagggcugcgaggcggacccugggcuccggcuccccugucagcgcugacccggagcccgguggccggcggccggcugcacuguggcggugcgcucgcuacucccgggcugcagcgagugcuuugcggguggaguggcugucaccagcucugggcugggagauggaacuuuugcuucagucuaucaggauuugggguuugacguucgccgucuuggacgacucagcaguagguccacagggaucccgauggagaagagggcggguuuuccuugggccguuuuuuuuuuuuuuuuuuuuuuuuuuuuuguuaguaaggauacuuaaaauaauaaaaucaacgaaacgcuacguuucuagagccuguaguucaaucuaucuaaaucuggacaaagaaucucugcucuguuuaacccaggggauuaucggaaagaauuaaauuacuguucgccagcacaucugaauugugaaacuucccguaaauauguaagauauuuauauuguggaugaugaaacugaaugggaacacacuagguucuuuuuuuccuggaaauaaguuauuuauuucauccuuuguauuaaauuaguguuugcauggcuuaguuaucucuuugagcuccgggaacacuauggacaauagaaggcuuuacaaaauuguugccuucaaaggugaugaguguagauuugaguucaggaccgcugaccuucacgaaacuaauuacagcuucuugucuuuggcuuucuccuuuuuaauuaaguuagcguccuccuggaguuuauaaauacugacaaauuuucaaugggaugcuuccaggacgugucugaugaaacgugcuguucuaguuaacaauaucgcuaugaaaggaacugaaauuuuaauaaucucuaacuucuuguguuugccagcaaaaaccagauuauauuuuuaguacauguauauguuuguuguuacacaugggcauaaaaaugaauggaauauccuuguguucuucaguugcugcugcaaugggccagcugcucacauaggcaugaguauucgcuuuggaaaucuauccagccuucaucaggaaggaaacccauuccugaugcuuuuggaggaucuaaagggugaccauguggacuaagauauaggagagaugcugaaggguuuuuuuuuuuuuguuuguuuguuuuuguuuuuuguuuuuugguguugugugugugugugugugugugugugguuuuuuuuuuuccuuuuuugaaagugugauuuuugaacugagcuaaaagggugagagaauuucaacuuaaaaagaguggagggauccauuauaaacauaaggagcuuuauuuuuacccccuccaagaguaagugguuauaaaagaaaacaacuuguuggaaaagggugagaguguuaaugugugguuagguagcuuguggaaagagauccugggagggaaagccagguggacuggcaccacggaugagaccugugcuaagcuagggagucacagucacccuguagguugguuuggggcaugaagauuucuaaggagugugaccaucagaguguugguuaauagguuaauacacuauggggguuggacucuaggagaguggagagagcgaggcggagccagguuuugagguguuggcgguggggcugugagucaacucaaauuuccugaagugaaugaucuuccaaaaucagcugaguuuuuggaauacaggauguuuaaagcaugaacugggacauccucccauuagccauguugggagcuaagcuggugugaggaggauuuuaaacuguuguuuauaguauuguguccagaauaaguacagaauaauuucugaguaguggauucaaaugauuaaaaacagcaacaacaacaacaaaccuccgggaucaacaaauauaaggaaaucagauauuugaaaccucuugauuuguuuuuuucuugcauaagauagcaaauacaauauguagacgaaaaaugauuuagaaacacugguguucuaaagaagaugaauuugaaaacucacucauggugaauaauuggaaaaugaaguagauauaaucguaggaacuuaggucucaucuucauauggcugcagauuuuuaaaauuaauuuuaaaaucaguauauaagaucauggguuuucuuaggacagugucauguguguuuaucaugguacuuuuucacuuagcucauucucuucucguguucucuuucuuuuuuuuuuuuuuucuuuugguuuuucgagacaggguuucucuguguagcccuggcuguccuggaacucacuuuguagaccaggcuggccucgaacucagaaauccaccugccucugcuucccgagugcugggauuaaaggcgugagccaccaugcccagcucguguucucccucccaucauccugucucuacucuuaugucacauauaugugagagaaaauacauuucaguugacaugguagcugccagugcuacuaccggguuuccugcugaggguacauuuuguucuuggugacugaauggaauuccccugugcguauguacuccuuuugcucuauuccuuucuuuguugcugaacaucuaagcuaauuuuguauuuuggaaagaacagauuaaaacacauuuauccauguuauaaaagaaaauguugucuuaaagauauuuugguuuccaaacuucuaaguaguaagugaaaacauaccugguugauagguacaaaauuucuggucuuugaaaacuaguuuuauauuuugcuuuucccaaauuugguuucaaaucuguucuuuugcuuguuuugcuuuuucaagagagcgucucacuguguagcucuagcugcccugaaacucacuauguagaccaggcuggccugccucugccucgagagugcugggauuaaaggugugccccaccaugucuggcguauauuuauuuauauguuauuaaauauuaugguuugcuguagaagguuucagaugauuuccuaagggguaacaugaagugagagacauaaagaugggacguaguuaaccucaugauaccuccucuuccuuguuaaccuggcacuguguauacccuagcgccuuggagugacucuagcccuugcuggcacugcaacaacuguccuuacugucaucuuugaagggucugaaguggacccagcuaaggcuggaucgcccugccugguuuaugugcucagagaucauuuucauguugugaugggagaugggaucuguuuuagucgaucaauuuccucaaggugauuauauaugggaugcuguggcauuuuuaauuuuugagaauuucagacaguguauuuugacuaucuccacccucaugugauccccaaacucugcccagauucaccugccucucugcucucccaacuuccugucucgccauccaucuuuuaagaguaagaaaggaggacaggaguggaugagcacaagcuguaaugacauuuaugaggaugccaagaugaaacuuguuacuuuguauggcaacccccaagauagauauuauuaaaaacagaauaaguaagggagcuagccugaggaauucaugugacuuguucagucaccacacucuucucugccucccccucccucucuucacccucccucccccuuuccuuccuuuuccuuguagauacaagguuucuuuuucuaccccuggcuggcuuccaacucacaggagcuuugccugccucugcccucugagagcuaguggucagugcuuagcugugcuguuacguuuggauuuguugcuuuuaucggaacuuacuuaguaggaaguuaaaaaaaaaaaaaaacauaaaaguuaaaaaaaaucacuacaaaacaaguuauauuguaggacaaacucgguuucuaaauagguuuuucuuuucccuuucauaaauuguuccuguaaugagauuuuuuucauaguguaacucacuuaagcaugacuuuucccuuuccuuuugguagaaccccaggcaggcagagcccacugcuuauaaaccugcguggcacagucagaugugucacaauuacacuugaccuaaaaccuccaauccuacuuuggagaggagagcuugguguuacugauaaaaauguuugaggggccugcagauuugugggaaaaaaauguuaauuugaaaaagcagguucacuguaagucucucucuuucuguguggcuauugacugaagugugucugucugucugucugucugucaguggcuauuggcugaggauacauuuucucugucucucccugugugucugucuguggcuauuggcugaagauacauuuucucugucucucccugugugucugucuguggcuauuggcugaagauacauuuucucucugucucugucucugucucugucucugucucugucucucucucucucucucucucucucucucugugucuguggcuauugacugaggauacauuuugcucucucugucucucucucucuguauguguggggggcacuguggcuauugacugaggauacauuuuaucaagugcuuacauauucauaggaaguagcucccucuuucucagcacuuuaaauuccuuucuggaggaacuuaaauucuuaagggcauuacauuuucuaaaugguuggaauuuuucccagugggguacugugagacacaaauagcauuuguuuuuuuauuuggagauaggaucucugcuauauaacucagaaugaauguucuuuuuuuaaaagauggauaaguaaagaugcauaagucuuaagacauguaacaauauacaacacaguagcagaaauuacaucaaacccugggcuugaaggagguaguagcggaaauacauuuauuugggauugguccugugacuaggugaggauacauaguuggcaauagcaguuagggucuaauuacagucauuucccuucaguacuugaggcaaaggauuaucucacucagccugaauguggaagguuuaucuucuauagagaaaguacaugaagguggcuauuugucuagguaauaagcaggaaggaaagaagaaaggcucacccugaccuggcacucccguuuguuugucuuguaauuaggcagaauucuuuaaaagauauuucucucuaccacaguugcuuagacuuccuuggaaaugcauaaaaggacccagagagucuggggagugaagaacugcuaacacccuuucauuuccuaggucucagaguaaguuucugggucaccuuugguuuuucuucaguucguguccccuccugucgcuauauuaaccguauacguauucucucaaauucuaauaucaaaguuuguaugcaccacaguuuauuaaggucuuuacuuuuauugugaauguuuauuccugguguuuuaauuuuaacuaaaaaaccaaaacguuugagacagucuuuugacuucauggcccuggcuguucuggaacuugcuauauagaccaggcuggccuugaacuuacagauuucaucucccucugccuccugaguucugggauuaaaagcuuaaaccaccaugacaccuagcauuaccaguaauuuuuuuccaacauaauaucuuuauuaauuguuuggacuuucacauaugcccccaugacacucacuucuaggaccucccagguccaccuccccacccuugugaccccccacccccauccacaaaaaagcaaaaaaacccuaaaaaacucaagaggguugguuuuuaauuggagguaguacugcauacuacaccgcaggcauuuggaacacucugguugucagagcuagcuggguuugggaggguaggagccaggggugcuacugugcaccccacagaaugcacaggauaacccacaaccgaggaguuuccagcccagugugaugaagguuaaaagcauuuccuuuacaguaauaugagagaaaugauguuuuggcucccacaggaagcaugaauuagagaaagauccaugcagggugugaauaggagauaagaaagaaaccagagauaagacaggaguucugaaaaaaaaauaggaaugaggauuccuguguaguuaguguguguuacuuuugaaugacucucagucuuugugcguggcuuuugugcaugguuugaugcagaggcggauccccucggucuuugagagaagcuggugucagaguaguguguccuauacugaguuucccucagggugcuuuaauuuugaaaccuuaaaaauacccaaaacuacagcugauugugacauuuguuuuacaaaacuauaaaacaagaacaacaaaaaaaucuuuuaaaauggaaaccagugaacaucauaccuuaaaagaaaaacaggcgaacaaacaaaacaacaacaacaacaacaucaaaaaacccaaacaaaaaccaaaaccagggucucacucuggagcccuggcuguccuagaacucucuguguagaccaggcuggccuugaacugacagaacucuaccugccucugccucccaguucugggacuagaggugugcacuaugccgggccuacccucuguucuuguauccagcuuuuaucaucccuguagccaucccgguaaaaggcugccuagagucccuagaagacagaacacuugggaggccaggcuguaugcagucacgugaccugcuuuagccagacagcucuugaacuaucugacugcccauuagaaccuuacauuuuguccuuuugaaguguuccauuuuuuucccccucugaguucacuagcaaugaaaauauuuucauuuucuugccuguggcuuagccccucucuccugugacagagauccugucagcauauuuguucuugucucuggugaauuacuuaaacuucuuugaaauaaugagucacaucaggaaguuggagaaaagugugcuccccucccccuuuaagcucgggcauuagcucaggcagccuucaaacugccuuuuggcugaggcugguauugaacuugugcucuuacuguauauccccccccccccccccccgcuaggauuacagguguguccuaccacaccuggcuucauccuaguuugcuuuaaaaaguuuagcauauucucccccaaacccucccauauccaccccaccuuccuguccccucacuucuugucacauuuuucugggauuuucuaacuuuugaucacacaggacuugccccacaacaguacuguguguaucuugccacaaucccagagugauggcucgcagugggaccgguugccacagaguaggagguguuuaaggguacugucuaaaccuguguuuuagagaggacuggaagucauugaaaggcuuauuucaggugaagaaagagccucaagccccagcuaacuuaggaugaugggggguucugccuaguaaauuguguuucaaaagguuuuauuuuuuuauuuucuauuuucugacaugguucuccauugacaaaauaucuggaugguaguugauuaugguaugagugguauggauaggagauugaugcaaaacuguuaguauauauuauauguuauuauauuuuccugucggugucuuugaaauccugggcuagaguuuuuuauacagagucaacuuagaaaaguuagcgcaguacuuuaucaagcuaugugagaaagcugaggggcauggguaguuaagugagugaaagacgguggcgugagaggacaggggugugucagaggugagguagugaaggccgcucauugauagagccuuugcuuggcaugucgugcaacuccacgguugaugccgagcaucuggaaaacaaagucagaggugcuagauaaucagguacagugcuugagaagggaaucgugaguuuuacaaaaggaacacuuacugcuuuuuuaacuuaaaagguaauacaauggaagcaacauacagcucaaaacaacuuagauacuguaggaaauagacuucuuacugcuuccugguucugcuuaacgugggacauauauugaacagauugguucauuggaucaugcuauuuauauguuuagcauauuuuagagucucagcuugcaauauguaaauaguauuacacuaauuugugugugcucaggggaggucagaauauaacuuuugaaagucauuucucgucuucuaccaugugggucccaggagucaacucagguggucagguugggcagcaagucuuuuaccagccgaaccaucuugccaacccuaguacaguauuuuguaauuagaguuguaugcagaaaaaguuuuagucuuuuugucaucccugcccuguagguagccaauuaacuauaucauuaucgaaguuuuuaagcauaaacaagaauagaaaaaaguaauaaacuccuguaucuucauuguccagguuuaaucuuguuuuauguguauaucuuuucucagucacuguauaaucuuaauauaucuagacauuuuaucauugaauagucagcaugaaucaugaaguuacaaaaucuuacacacaguaauaauaauaauaauaauaauaauuauuauuauuauuauccaagcucgucagaaguuugcucagugucugaauuucacagauuaucucugaguuauucaucaggucauugauguuagcaggaauucaaacaggcccaugcauugcauuuggugcuaauuuuauaauuuaugaaauccccaacuuccuuuuuuuugugcuuaaguagaugugucugugcuccucccucagcacugagcucugaaaguccauagauggugaccuucucugagcucugaagguccguagaugaugaccagugaccaucuacugcauuagacuucacugaaagaauguuuuacugugggugugguggugagcuccuguaaucucaacacuuggcccacugagggcaggaggucaugaguucaaggucaucuugaauaacuagugagaucuugucucaaaagcaacaaacaauaaagacagcaacagaaaagaauuguuaugcccuuuguaaugauacugaaagagaaagcuauuuuguguugggcucugagagacuauauccuacuacagcauuguuccuggugguaguuuuuuugcuuuuuguuuuuuuuuguuuuuuuuuuuuuuguuuuuuuuuuaaagauagggcuuguuauguguuacuauguaucccuggcuggcccugaacucagagaaauccaccugugucuaucuaccucccaagugcugacugagauuaacuuggacuaucaggucuggccccugguuuuacagauaacuuuagauucucagggugcaugacuggaguucuuaacaguaguuuuugugcaaaagcccuugugauggacucgugguauagucauuccagaugagauaguugguacuuguuaguauauacuagaguugacccauuagauauuaaaagcauccuacccuucuuaucaacucuguccagcucuuagggugucauucaaggugcauagaaaggagggagagaggguccauguaauauauauauuuauagucaguguaugugaguugucuucagucacaccagaagagggcauuggauuccauuauagauggcuaugaaccaccauguaguugcugggaauugaacucaggaccuuuggaagaacauccagugcucuuaaccacugagccaucucucuagccccaaucucauguucuuuuguuugugcuuaagaguuuaauacaaaaagauuuguuuugagaaaaagggcuagaguauacagauauaaaauguuugaaauauuaaacacacacucacacauauacacacacacacauacacacacacuguucaaauuggcaucuuucaguauuuucacccuuaucuuuacugaggauuauauaugaacaucauucgaggggcuaaagagauagcucaucggcuaagagcacuggcugcucuuccaaaggacccagauucaguucccaacauccauauggugguucacaacugucuguagcuccacuuccaguagaucugacauucuccucugaccucugugaccucuguggguaccaugcaugcacaugguaguaaacagacauauaugcagacaaaacacucuuguaaaauaggauaauaauaacaaaugugaaaauaaaaaaaaucacaugaguauuagguagguuuuucagucauuuaaauauuagguuuuguuuguuuguuuguuuguuugaaggugggggucucauuauguagcucuaaccauccuggaagucacuguguagaccaggcugaccuggaacucacaaagagccuccugccacugccucccaagugcugggauuguuaaaguguccauuccauguccauugcucccaucugaacacuguuuuuauuuccaguauuuugauacuguggaggcucacucugcuuuauuguuguucuuuuugcugcagacuuggaacagacuguccaucuuucuucuuaugaaauuauuacuccuuggagauuaacuagagaaagaagggaagcucuggggcccaguucacagcagguaagucaucucuugagaacuaugaacgaauauacucaaguugcaguugcaguugcuuuucuuaaugaaaggugguacuugcacaguggucaguguggggaguaauuacuauaugcgucaccuuauggcauugguguccagcggacauuauucuaauaagaaaugacagaguaagcuucaguaucucugauuuuaaaguacaaaacacucaaacacaacagaaugaagggaguggaacucuguaguugaguugggacucuggcugccacuucacucugacaaugagaauacccuuuacuuaauuccugauagaauauucaaguauagcaugguaaugcuugggaauauuuacucaaaauugaguuuuaauagcaaauaccuuauaugcugguuuaaaacauuacaacauaaaugguuuaacuauaaggaaaucgggugcuguuuccuuauuggaggaaguugauucuguuguuaaccauguuguagcuguguacaugugggcccauuguaccucucaagagugugcuuggaaccaagcccuugaacaugaccucuucugaacuccaagggcaccugaugcaugugugguacgcauacagacuggcaaagugcucauauuuguaaacuagcguaggaggcacagagaccccugugcucauagauaagcagcggggagaccaggaauguuagacauaggcugggggugcaggugguuacuggccucccucgugaccuuucucuguguaugacagacaccauaccagguccucccauaggcccuuaagauaacacauguagccuaucuauagaacccaucuucgugaaagaugucacauguuacuuuacaaagaauuuccagguagucaugucuuaagcuuuauugugugugugugugauugaguuaaucaucaccaggaaaccuuuccccaaaccgugcuguccuuaaauaugccugaaauaaacuaccaggugucaaacugcaaguuugagccaggaccugcuccucagucguguugaaccagacugccuucuugccucuugaagacugacauucuguuggcugugguguuugcagaaacccacacaagauaaaauaacuagaucuaaaacaaauuaaaaaagaguagacacacauauaggccaguauccaugaucagauauuaaaggccagagauggauagaauaucuguuauguaagaauacaguguauaaacaguuguagucagugccaaguuguguuaauuuaggaucaacuuuccugccuugcaugauagguugaagaguaaguuacaagguuguguuuuauuauugcuuuuuucccccuucucugugcauuuagaucucuuacgucauccaggcccaaggaaaacagcauauuauucacuuggaaagaaacacguaagaaaguucauuuacuuugcccuuuuaauuauguuuuccccucaacaguauauugauuucuuuucuaguuagauguugcuuagcagagccugagcucuggcaucagcagauucaguuuuugcugacccugcugcacagugguaggccugcagcugaaguccaggaggguuuaugcuggggccggcaggcugcaacuucuguagaaaugugcaggagcuuaauucuuuucagguucaccuuuagggagagugaaguauguaggagugagugcgcgugugcaucuguguguguguaugugugaaggguguguaugugugugugugugaaggauguguauguauguguguguauaugaaggauguguauguauguguguaugagagugugugugugaaggguauguguguguguaugugaguguguaaagggguaggguguguguguguaugugaguguguaugaaggguaugcauaugugagagugugguguguguguguguuugugugucuguuauagcugccagugccccaauggggucagcuucuggaaagacucaauuccauaagcucuucugaauacuguucccaaaggacaucacagagacacagcacacaggggcaaagaaaacucaggagucagagguucaagcauuccagggucuuuucuuggccacaagggauuugcuaccacaaggcuuccuguauucaggggaccagagagaauuucaccaaggguuucacuauaguggucauguagcuaaagucagucagagugagcagugggccugggggaagcuaucagucuguccaucucugaacagcacagacaguugguuuuggguauccucugacucuuuggaacuuuaucaagcacagugcacccugaaccccuggauuuccacaagcuuggagaucaccuccgagcuacugugaacaguguggaagaaccuugcuuggcccugguuacacaacuguucccuuggcaugagggggaaacguuuccuuuagcaauugacagcagccauuugucuucauaagucgguuaaagcagugaguauuucguauuuacauaguacucgguaggaaagaauagaaaauacuuauuuuucuuauacaaauaugacagugucaagcagccugauuuguuauuuucucgugauuuauagcagaaaaaguuaagaauacuguuguuaccaguggacauuuugugccaagaaagcaaguugcaucuuuacaucagucggcugcgguucaggcuugaguguguugauuagcuuuuaguuuuauaguaacucuuucuuuaaaaaaaaaaaggaucguauaaaaagcuuuuuaagacuuauuucugcuccucucuucugggaauaacuucuuaugagcugugcccuaggcugucgauacuugguacauuuaaaugguuuguuuuauuccucuuccagagaccuuuuaccuaaugauuuuguaguuuacaccuacgacaaggaaggcucccuacucucugaccaucccaacguacagguaauuuauuuucuucuugauacuuugagaauuuaaagcgaaccuauauaaaguguguucuucucagaugcccuguugcucgccccauuggacaccuuccauauccuuacaggaugccucuggaggaggcugagcuuuacuggguagcucuccugcacuuaguaguuaggauuuguauuuaaaagauggggugguguggugggguggugauguaguuggguggucauguaguugggugguguggugggguggugauguaguuggguggugauguaguuggguggugauguaguuggguggugauguaguuggguggugauguaguuggguggugauguaguugggugguguggugggguggugauguaguuggguggugauguaguuggguggugauguaguuggguggugauguaguuggguggugauguaguuggguggugauguaguuggguggugauguaguuggguggugauguaguuggguggucauguaguugguggugauguaguuggguggugauguaguuggguggugauguaguuggguggugauguaguuggguggugauguaguugguggugauguaguuggguggugauguaguuggguggugauguaguuggguggugauguaguuggguggugauguaguuggguggugauguaguuggguggucauguaguuggguggugguguaguuggguggugauguaguuggguggugauguaguuggguggugauguaguuggguggugauguaguuggguggugauguaguuggguguaguuggguggugauguaguuggguggugauguaguuggguggugauguaguuggguggugguguaguuggguggugauguaguuggguggugauguaguuggguggugauguaguuggguggucauguaguuggguggugguguaguuggguggugauguaguuggguggugauguaguugggugguguggugggguggugauguaguuggguggugauguaguuggguggugauguaguuggguggugauguaguuggguggugauguaguuggguggugauguaguugguggugauguaguuggguggugauguaguuggguggugauguaguuggguggugauguaguuggguggugauguaguuggguggugauguaguuggguggugauguaguugguggugauguaguuggguggugauguaguugguggugauguaguuggguggugauguaguugguggugauguaguuggguggugauguaguugguggugauguaguuggguggugauguaguuggguggugauguaguugguggugauguaguugguggugauguaguugguggugauguaguuggguggugauguaguuggguggugauguaguuggguggugauguaguuggguggugauguaguuggguggucauguaguuggguggugguguaguuggguggugauguaguuggguggugguguaguuggugguggugauguuuuuugaagauugaagguuuuacuguucugauaaaauauuaguauuuaaaagcacaccuuccuuuuguuauucacguccagcaaaaucacauuuguuuguuguuauguauucugauguucugauguuuuugcugacauuccugaagaagugugguccucucuguaucagggaacacagugcccaggguuagagcugggcuggagucuccgauuggcaggugaacuuggccuugcggugucuuuucuuggagcauaaacauuucuagcuuugcucaggaggaggaguguuuuauaauccccuuggcacuuacacauuacagauuuuuuuuucgcaguaguuuuuaugagaagucuucauucccaucgacuguauuauuucacuugaacuuuguacugccuugcuagauggaaucaugugugucaggagaauucuucaaaugaacaggaugcaaguucuuuaguuugcacuacacaaaaaacauaaaggaagugcugacuuuacccugucuauuucuaguccgcuaucuguuccuuuaucuuaguauaugagcauuguuuaauaaaaagcucauggaagagauuaaauuuacauuguaguauauaccagauagaagagaaucuauucuuucaaccauccagagaugucuaugugagaagccacagaccacaguugauguugagcguuauuguuccuucuuagagucuucuucucuccauacagacacuguuaggcuugaauucuggcucugguucauugucuggugaaguuguaucaaccuguuuguacuucggcaucgacaucuucucucuaaccuggaauuagcaguuauaacuucucggaguuucuaagaaacuuuaauaaauuaaugcuugaguguuuacaagagacagucuggcaauuuauaaauaaauauaacuauuauucauuacugagguacuaucugcuuaaaauugcaaaaauagauuucaacuguguagaaacuccaauaauuugacuuuuauagaaugguaguauuuugguagauguuuaaaaacaucagguaugaauaugagguauuucaguuauuucuugguuauugaacauuguucagguaaaugaaagagugucuguagguuuggaauacaaaggaaaacuuugaugcucccauuucuuugcauguagcuagauugucccuuauaauaccauaccacugccugcaguauguuguuaauuagcauauacauucauaaacuuuaaauguuuuccucuaggauucuacuuccuaagauugaaacaauucauaaagcuguuuucugauucucacaaggccauuuuuuaauaauaauaauaagaauuggcuugggacucccuagaaaagcucacagcuagcucuuaugcauggaugcucuaacuccucugacaacagauugcccaaggcucccugggcccuggguaguguggcauggucuguggucgguuugcuuugcugugcuugcgcguuuccaguugugugcuucgacacggcacacaccaggcauuucauuacgguagccuuguagucugacugccacuuuuguaaacacaaacaugacuuguaguguuuuugagaaguaaugcuggggacgggagaauuucucuccguucucuggacguuugcuggaaugaucugacagauuauuaaacagaugcagauuuauuaacacacaaaaggagaaggacggcagacuguuagaaaaucaguguggccacagcuagccuacacagcuagccuaacaugcuuucaagacucacauuggggagcaacauggcaacauggcaucuccuaacuaacguguaggagaaucauacaggcuuggaggacacgcugcgaccugggacaaaguccacuuggccuuaggacagacggugguuuguuacaguuccucuguggacugaauagagagcaggguauggaacgacagaagucugccuaaauguguugacagacugcagguuuucaucccaugcaucuucucuggguaaugaaauguuaguaaaagugaagguauugggucuuucuuggcagaccuggccacauagauaagguaacugcagcagggcuaaauugaaugcuguggaaaugcuuuauuaagucaaguuguuaagcaaaugucaucgacuggguagauugcagggucaccuguuaggacuggccagcucugcuccuauucagugugucguaugggugacauauuccacccagaguccugcugcguaauuguuaacaggggucaguaacuggguuaggcuuuggcuucuggguuuuuccucuggaaagucacuacugaaaaagguccuauuuuuaccuugaaauuuagaguuguguaaaucuccacucucagguuuuuguauguaguuccaggguuuaacauuugcuucagaucugcugguacugugaggguugucaugugaucauguucgcuuguguguaucgguguagauucaaggauucuuucucuccauacaugugaggccguuuguagaccuucuguccuuuguuggauuuucuacucaguauuuaagacagugacucucagccuuccuaaugcugcaacccuuuaauacagauccucauguuguggugaaccccuuuuccaaccaugaaguuauuucauuguugcuucauaauuguaaauuugcuguugguaugaaucguaauguaaauaucugauaugcaggaugucugauggaggaccccaguaaaggguuguuugagccccaaagggguggugacccacaggcugagaauggcugauuuaagagauauuuauauguaaggauaguaacucuuuguuaauguaauuuacaaauauuucuuucuggccuuugucuuucuuuuguuguguguguguguguguguguguguguguguguguguguuugagggccuuauguuuauguuuagaguccuggauggaacucuagcuccuccggccucggccucuugagggaucacagugcucuacugccaugcauggugcguuuagguuuugggcgauaggcagggaggucuucucucuauccauccaccuagguuagcgagacacuuauucacauuuucuugaacauucauauccuuucaguuuucccauuuugauuuuugauacaucuggaauuuguucuuauaugauagaauuguacucuuuuccacgugucuguucagcgaauagcaggaccuauuuuuaaaaaugugucuuugcccagugugcucuuacgugcuaguugguaaagcccuauauguccuugggucuguugacagacuugcuuguuggcccagaugucagugccauccuguuuccucuccgggccugauguguaucuucaugucugguaggguagggaauuccuauccaugacuuucuaauacgguguuuugggugucuuacaggugggagaaaugucauugugcucaggaguuuuucaguuguggagugauacugacuuuugcauuuuaguuaguuaauuucuugccccaaauuaaggguaaaggcacuuaguccuuauaagauagcuacauaagauguuaguguaacuaaugugccuuucggagaagagagaaacuuacuugaugcugacagccauccccucugcagaucggcucacucucaaugcauccuucucagucuucaacacgguccucacucacugucuguugacuuuuccugagccaauugugacuuaaaauguuaacuaugcuguuucugggcugaaaggucacggggagagcuguuugucgcuggcauccgguguguacuuacucaggugauagcagaucaucuccagguaguccggagcaugccuucggugguguuuuguagguuaucaaaagucaggauugcagugucuugaugguuuugaggagcacagcaauauuugaagagcguguguguuucucauuuagagccauugucacuaucgaggcuauguggagggagugcagaauuccgcgguugcugugagcgccugcuuuggacucagguaagaacucucccauuuucucucccugacucccugcccuugcaucuccucucuguuccaagcuuagucauuugguguuuaacagaguuggauuuuccuuugauguuacuaaagaucuucccagccaugcuucagauauucuugggauauuuguuuaggaaaaccuaguaauugaccaauuauaauauccaaugggagaaguuaauuuuuuuugaaccuacaaaaaaaauuugcuguuugaaacaaaauauauuuuaaauuucuauagcaguuuguaaauuuuucuccugaauuauuucauguaguucucacagugacauaaaaagucuugcuaucgucauauucagaaaagcagacaaggguuagagaagucccaucccaugccaguugaaguucuaguacuguuguuguuguggagccauccugguugcuugauugcaccaucuuguugaacaaauagauacaacuuuucaucccagaucagcuauacuugauggcucccaugucuucauuuaagaaacaacuccuacgugguuaugaugugccaggcagcagucuuaaguauuuuaugcaucuuaaauaauuuaaugagaacaguucuggguagauugugcacggaggcagaggauaaaugaccugcugagagucucuguagaaaacguacucugggcucagaugcagugccagguccaggcuucccucucagcugcucuguagccuccugucggagcuaaguacgcggagggucaaaaguugacauuuauguuugcuggacucugcgcuggccuauagcuuccuucuguguguuagaaacuaggaccuacauucagugucugauucuuguucucuguuuccuuuuccuuaacauuggucugugucacccaauguuuagaggcuugcugcauuuggagaaugccaguuuuggaauugaaccucugcacaacagcucacacuuugagcacauauuuuaccccauggauggcauccaccaggagccucugagauguggagucucuaacagggacacagagaaggaaggcacacagggggaugaggaggagcauccgagugucacucagcugcugcgcguaaggagcaauagcacucuucugggcucaggcuguuuuuaagaaaucacccuaaaacggugauugcugucuuucuccagcuccauccauggugauuggaaccaggguaugaaaagaugagcaauguguagcucuggugacugagaggagggcagucugaaauuuuuuuaaacaaagauuuguauauauauaaauauauaaauauacauacacacacacacacacacacacacacacacacacacacacacacacacacacacacacacacacauacacacacacugcagcugucuucagacacaccagaagagaacaccagaucccauuacagaugguugggagccaccauguggucgcuggaaauugaacuuggccucuggaagagcagucauguugaggcaucucucccagccugggcagucugaauuuuaagggcuuaaaucuuaggcaguaauccuauuagguguuucuguguagucauuacacucuggcuuggagcaggggagguuuuacuccgauaccucaggcucuaggguagaccagaagggaggacaggagggagggagggagggagaguggggaaagagagauggagacaaagauauggagacaaagacaaagugucagagacagggaagggagggauggaaggagagagagagggagggagggagggagcuauugaauugaagauaauuauuaccucggauaccucaguguccucaaggacacucaggccccuguucgggaggcuucucuacaggugcccuggcugcucgggauguaggccuguuaggguucccugggccagcuuaacucagcuauaggguucuccuucacugugggcuacgggcgacgggugacauggugccacaugccacaugcuggaugcggcaggguauuuugcuuguuuguuuguuuugagauuaagaggccuuucccauggugcuggcauaaggcguauuuuaaaucagcugacacuugaccaugacaugacuucaucaccuuuucuuccccaaacucgucaacaguuggaaagcucuuagguguuugcuaaaucucuuuguauggaugucuguaaaaggucggaaggaagccauguuuauauacuggcgacccuguuccaccuuuuccucucaggauucaggaggugucuuucuuucuguauuaucaugguagucacauuuccauuaaaaucuuuauguguauguuaauuuuauguuuauuuuaauuaaaaauaaaacaacccagcaauacugcugcuuugaagacuuagacaacccauuuuaucuuuagagcuuuuaaaauagcgacuaacacuuuuuuguuguauugacagagguaugcuaagugaaacaaucuauacugcuuauagaugugaaaucacaugccuagcucuuaggucugaccauuauucauacaggacaugucuggucccauaacaauuucugcuuuauggugcuuguguuuuaacagagaagaagagcuguucuaccacagacccgcuauguggagcuguucauuguuguagacaaggaaaggguaggaaccgcugacuucuuuucucuuuugcaugaaaaagcaguugagaaguaacuuaugaaggaaauaccaaacacaauaguuauuucgacuaaaauugugcauuaauuaauuagucaauuaauuugucuacagggucuugcuaugucuugagcuccuaaucuuccugccccagucucccuaguguuggaauuaugugugugcauucauggcccuuagcuuugucuguaacccuaaaggggacagagcucccugcucuuuguggugacugucuaaugcuggguuugucacauagccacuuagggucuugagggcuuuucagauuacuuaacaggcugaggcugcaaaccaggacaguuggcagcugccuccugagguagauuugcuuugugcucuucagagcacaucuuccucacccuaagaggcggggccggggagcuagcaugcuuuagaagcacuuaguauuuccaggggacaggagagcaacagcacacucuauauuuguccuuaaagaccaagcuauugcuuuacuuagagaugcugcaucuucagcuacuacaggaucaucgguuucugauguggcuccuaaauaauuuaacauauagauaauugaaaauguccugggcagcuuuuaccuuuuauguuuguauaaaaaacuauuuauaggaacucugauuggcaggucuuuucuuguaagccauagagaacauuuugaagauuguuuuuccugguuuuaaaagucccuuacuguguguagguugauaagagcccugguuagucagaggcacacauacacuggguguguuaggaucccgaugguagaagggagaacaagggaaggagagccagcaugaaccugcuccagcugugguugcaaaguucuguagaaugucuugggcaagugguaaaaauagagauuaaaguguuuuucucuaucauucucuccagauagacugguuauauucauauaugaaaugguucagaauaaaaguggccccauuuucaucaagcucuguuaaaugcaggaucuugcuggacagaugcagccacagauucuguuguuaagacauugucacggagugacgucacaaacucuguaagacuuuuguuuuuguuagcaaguagguuaagauaacauuaaaauagacaugcuaauuuagccagauauaaaaauauaggcugcauaaaauauuuuguuuaacaugguaaaauuucucucuuuauauaucucuuuuucuaaccucauacaaauuuugagcuagugagccugaacuaaucucucauucuuacuuucgaguagggucuagaaauaguuuauuguugauaucauuagccuaagagauaagagaguaggaaauuuauuaguuuuucauucuuuuaucuaagcuuuuuguuuaagauuauaccuuugugaaaauuugaaaauacuuugcauuaaaaucaguaaaaauagcauugagaagaaaauuuauucuaaaguuacuaaaugugucccuuaguguguuaauuacuugcuguuucggggcaaagcacccaggcuaaggcacccuacagaaggaguauauuuuggcuuaugguuccugaggguuagacccauaaugguggggacagcauggcaguagguggcaggcaugguggcuggaucagagccgagaccucacaucucuacugggaacucaaagcagagagagcaaacuggaaauggggggaggauuuuacuuacagagaucaccucaccuccagcgacauaccuccuccagcaagucuccacuuccuuccccagacagccccagugccuggggaccaaguguuccaaugcccgagacuaugggagacauuccucauucagacugccacauugggaucggcucauuugaaaugcugcucuuuugguuccaaggaaauccuugggauuugcucuucaguguaggcauuguaggcggcucuacugcgucguugcuugcgaucaugcuuucccuccuucgucuuuucaguacgacaugaugggacggaaccagacugcugugagagaagagaugauucgcuuagcaaacuaccuggauagcgugaguaguaguucucuucugugcuggccuucacacagucucagagcagaauucaaaaugugucauuucugagcucugucagauguauaaaugucaguucuguaaguucaaauaauguuugaaaauaaaucagaaauguagauaaaaggagauacaagauauuucaugucagucagggucuacuguaucuucagaguaugucggggaaggugaacugacaguuaugaauacaccuucgcuuuccucaauugaaggacuaguguuuuaaagaaccccgccuccuccuccuccuccuccuccuccuccuccuccuccuccuccucuuccuccucuucugcugcugcugcugcugugugugugauauauagagagacagaaauagagagacagagacauagacacagacuaugaaaaaggaaagccuugucauacaauuuacucaaagcuuuuaacuuccucuguuugucagauuuuacagugggaauaagacagaguuugaaucuuaguucucuguccuuaaugggugaaggauagauuuuucauucugggggagggaauccuguuuuuaauuuuauuggcuauauuccuucauaaauauuuaaaguauuuuucuucacuggauguggugacacacaucuguaaucucaggacucuagugacugauggguucaaggucauccuuagcaacacagaaaauucaaggccagcuuacaccugaggccucucauagccaacucuccauuuugugucacauucuuaauauaauucauguauucaucuuauuucuguuuccuccccagauguacaucauguuaaacauucgaauugugcugguuggacuagaaauuuggacagacagaaauccuaucaauauaauuggaggagcuggagaugugcugggcaacuuuguucaguggcgggaaaaguuccuuauaacucguuggagacacgacagugcacaguugguuuuguaaguggcuuuaaggaaaugcuaugaauggagugaccagaacaaugacuucugcuacuuuaguugccguguuauuauauucuuuuagagguagaugcaugugugucugacuucucccugccuuuaccccaggucuuuuuccuuuucucaucuuguuacagcauauuuuauaauuauuuuuugugaaagauuauaugaaaggaaaaauauuugauuucuugcugaagacauuuucacagaauuagcauagaauuuaaagaucaucucaccuugagcucugauuauccuaacucacaucugaggguuuugucccccuaguguuuuauaucuguuuuagacagauuggcuagguauaaaauucugggcacaguuguuuucucuuuacaaauuugaagguaauccuuugugaaaauauuuauuguguugcuguuuuucuugauuaacaguuguugaauaaauacauauaauacauuuuaagaauacuuuuaacccagaagaucacuaccaccaaggaacaacccaaacauggcuuguguaugcaaaggcaucaucauuuuuaugaaagaaauuuaaagauuauguuuguaaugcuaaccucaugcucucaaaauguuauuuauuuuugucauuucucuucuacuuucuguagguuuugccaauaugguuaugauuacuguagaaacaggacuaauauguuucuuuuuccucaacuacaucuuauaacuuuacauuuucauuuaggaagaaaggcuuugguggaacugcaggaauggcguuuguaggaacaguauguucaaggagccacgcaggugggaucaaugugguauguuguucuuuaaguacaguuuuggguagaggcauuaggauaguccacagcgucuacugacucaaugcuccuccuucagauccuuacagcagcaguuguacauuuccaaggacgcaguaauaguagcauauguguucuuuucccuagagacuaggucaaauuuuuaauauuuauuacauguuauuaucuauucuaguuuucuucuauguugcugugauaacaccaugaccaaaagcagcucagaggaggaaaggguuuauuuauauggcuuacacuucagguccaucacuaagggaaguuagggcccagacucagagcagcagaaacuccacaggauugaugugcgcugacucuggcucaugcucagguaccuuucuuacauagccaggaccccaugccuggaacuacccacaguacaaggcuggcccuguagauucacugacaagcaagggaugccucauagacauguacaaggcuggcccuuuuagauccauugccaaggaagaaaugccucguagacaugugcacucccaacaguucuucagugagguguguuggaacgaccacggaauuaaccaggauacuaucuuuuuaugaaugagaaaacagguuccauuuuaaagaaaucaguuugcuuugucauaagcuacagggaauggucuguugaugccugauuaucagcacaugagucacucuggauucuugucagagugugugcauguagggcuggcacuggacacagaucgacauagaguugccauuguaguagacagauugccuuuugacaaaaaagaaaaaaucugacacagaaaacacugucuaacugcaccuuccuguguuuguacaguuugggcaaaucacuguggagacauuugcauccauuguugcucaugaauuggggcauaaccuuggaaugaaucaugaugaugggagagaguguuucuguggagcaaagagcuguaucaugaauucaggagcaucgugaguaacggagccuuuucugucuguuaguaugauuguguugaucugugugugugugugugugugugugugugagagagagagagagagagagagagagagagagagagagagagagagagagacacuguuuugucugucugucugucugucuggguagggcauauuacaugugugcagguucucaggaaaccagaggaaggcaucagguacccuggagcuggaguuucaggcagcugugaguugugcagugugggugcuggagacugaacccggguccucuggaagaagagcaagugcugcaaacugccccccaccucuccagccccagaucaguguuucauaagucugggguacugaugucuguguuuucaaaauaggaaaccuuguuuguuguucucugaaauagaccugugagagauccacuucuuaaauuucuagucauaccagagagcuuuacagguacaauuuauuaacuacacucuucugcaaugcagucaacagaccaaaaggauaugagaacaccaacaagcuucuugcuggguucagugcuguuugggugagacugaaggacacccagaacaguugccugauaaacacuugcuuacaguagccauucuccuggaucugccuccuagugcugggaccuugagcauguccuuugcauauagccagaccgucuugguguugaagcaccccugccagcacaguucucuccuagcuucaugcccuuaucuccuccucuuaaaaaaauacauggaauccauuagugcugcccguuugugcauggguguggagccauccagucucuggagcaugggccaccuacggauugcugcacccuagaagaaaaugcccaucccccggcccccagcagccauugcaugucaguagcuccugagcuagggggguguaggccuggaggguucuucccauuuuccuucuggaauuuucacugucucugugugugugugcauguaaugcagcuguucuuaguuuguaagagcgauagccaugucauauccggaagacaguguuucgcaguacucucucucugccucucacguuguuuccucccucgaggcuacuguguuuuuucagccucaggcuaagaguagggaugauacauugcugcaguuaggguguguaucaugaucaccuuuucucagcacguugaccaauuauaacuuuguauucagggcugccuucuacaaaaagaagagucguaugacgagauugagggcagcauaacucugugugaagccacuugcccugugaccucagaaccuucccauaaguggccuuugaccagguuuauaguguuaggcauguaucccuuucuuuacagcaagacaguaagccucacaccugacuccuguaacguaccugccacugugguacugguggacacaucuugacuggcagguggcugauuguaguguguagagcccaggccugaggaagacccuugggacuguuugccuguagcucccagagcaccuuccaccacuaugaagguuuuccacugggaggaaggcuuuaggccaguugcagcuugguuucucugugucccucaaccaaaaguguaugacgucuucagcgcugaauuucguuguuuauguguaccuuguuuucuugaucuguucagaacguucaggggugccauguccuugcuguugcgaaugaaguggcaguacuucuauuuucaguguuugccccuucccccagugacugauuuccguaguaccuguaccaguuuucucuccuugcaacaguauaugagcaguggaagaggcuuauaguaccaggcaggcuuucuuuccacuugccaaagccaaguccgguuagguagcucuugguuaccacuaaaauagaaugguaguaguguaccuucagggauaucuuugguguugaccauuguuuugugagucauacccaucacaccugggugggacugcugauugaaugcugaaccugaaccacugaaacugcuagaagaaaacacaggacgggcagcauccugugagguacagaugcaggacagacagcauccugugagguacaggugugggacaggcagcauccuuguccucugagcaggugggacuccccuuggggaucccuccaccguggcauuucaagucucuuugaggcuaggcacuuccucucccacuggggccagucaagguagcccaacuagaagaacauauuccaugaaaggcaacagcuuuugggauagcccccguucgaguuguuugggacccacaugaaguccaagcugcacaucugcuacauaugugugggaggccuagguccagcccguguacguucuuugguuggugguucagucucugagagccccaaggguccagguuaguugacuuuguuggucuuccuguggaguuccucucugucagggcuggcaauccuuccuccuauucuuccaaguucccuccacuguuuggcugugggugucuguaucugucugagucagcugcuggguggagccucucagaggacaacuuguuccugucugcaagcauaacagaauaucauuaagggaucuguuagggauuugugcuugcccaugggaugggucucaaguuggaucucuuauuggucggccauucccucagucucugcuccauccccagugccuggacuucuuauagauaagauacauuuuggguugaaaguuuggugagugaauugauguaucuauuaguccucaggaguuccugccuagcuacaggaggcugacuucuucagguuucauauccccaauguagugagucacacuaaggucacccagggcagccugcuaucccagggggaccuccauuuucuugcugccuucccccccugcccccccaccaucagaccugagacuccugaaccguacaguuagcccaucuucccugcuggcugagugcccugggccaagccaagcugcccugagcagccugcuaucccaggggaccuccauucucccaccaccuuuacuccaaccccaucagauuccugagccacacuagauuugguuucucucugcuguauguaauucuguuuucccggcuccaugugcugaagaugcuauguuuucuccaauguguauuuuuuggcaacucugucaaaaaucagacgaccuuauuuuguauguguagacuagagcacccugugucugggcccucuauucugucccauuaaucuccauucugcuuuugugucggcaccaugcuguccuuauaccuguggcucugcaugaagccacgcauguugauuccucuacagguauucuguuugugaaggauugcuuugacuagcuggcauucucugugcuuuuauaugauuucuaggauugaguuuucuguuucugucacuggaacuuugauugggauugcauugacucuccagcuugacuuuggaaggcuguuucccagcaugguucuuaggacccgugcaugggagggcuuuccaucuuacaguggcuucaauuccuuucuucaguauuuuaaaguuuucacuauacacagcuaucaugucauugguuaggguuauuguaauguaauuuaauuuauuuuauuuuuugaggcuauuguuaaugacaucauuuuuuucccuaauuuuuucucaguaugguuguuacugguguguaggaaugcugcuaauuuuuguauacuuauuuuguauccugucacugaaucuuuuuuuuuuuuuuuuuuuuggugccuugcucuagggucacauuuucaaacauuguuuaugagaaaaaugggguucaacuguugaauaggaagccucuuuaaauagccuuugcuacggagugggcacugcagguuguaauuggggacuuguguguaggguaaacauacgcuggcauagcuacuaugguugucuggugaauacauucuccugacagcguuaucccaugaucuggguggaagccacagucagugagaacaaggcagcaguuacaagccugucuuacuugauggcuacccguuucauaccugguuauccccacggacgucuccauguucgcugcugcuaacuuuccuguuaacuuagccagcuuugacuucucuuucauucucacgugcuuccuugaaaucaucgaccccucuuccugaucccaaggaugccauucugaccuagcgucuguggacuggauucugggagagcucuguuucagucuuccuguuuagcuagcagcagugcugagccugcugaugugagucaaaggauguguguguguuguuugcucucaagcuuagucacaguaacuguguuucauucaagagccauaguucgucguggucucuuccaucuuugcucagucucucauucauuuucuuacuacuucccugaagggccacuggcuuccuuaucaauccgagggcaugccuccugugccucacaguuuuguucaugguuuucuuucugucugugauguucuaucuccagauuuccaguuuugacugaagugucaugaugugugaagucuuuggauuggccagccucccauaauucuuugcuuccauuuucuccagacuaucaccaccuucucucauuccaacuaaauuauccaccaaaguuugcagccugcuacauucacucgugugacuuucacgggaaugguuucugccguguucaugguucugucccuugagcugaggagaguccugaugcacucagaucuccagcauguccuggcgucugagcgcaugcuuaguaggcucagcggcucccacagagcuccaagagcagcgaggaagcugcagaaugggcucuauugcccagaaccugugggggaauuguucuucccacaagucaguuucaccuuggcguuacuuuuuaauuauaugucuuuguauacacaugccugucauacauacauauuaucaguuauagauauauguacauaguggaaaauaauacaugguauauaugcauauauuauaugauacauagaugcauauuauaaauaacacagguaugcuauguacauuauauuuauauacauauaugugugugaauauauguauauguauauauauguguguguguguguguguguguguguguguguauguaauuuaaaaucuguaaugugucugggugggguuggcauauggcuuuaauucagcacucaggagguagaggcagguagaucuuugggucugagggcaaucagggcuacacaauaagacuuuguauuaaaaaaaaaguaaaauugaaauuuacuguuuuugagacagucuuucucuguagccuaggguagccucaguuucucucucuugcucaguuuccugaaugcugggauggugcacacuguacauacggugugcaauguuacuguugucaggcagauuaacauauccauugucccacagauuuacguagauuucuuuguugguuuuuuuguuuuuguuuguuuguuuuuuguuuuuuguuuuuuuuguuuuucuuugagacaggguuucucuguauagcccuggcuguccuggaacucacuuuguagaccaggcuggccucaaacucagaaaucugccugccucugccucccgagugcugggauuaaaggcccggcucuuuuugugucagaagaaccuagaaacuauuccaguacucaaaugccauguuuuccaagguagugaugucgguacucaugucgugcauguccccugcacuggccaauccugcacgucugauggcauuauccauucaccucuacauccccauuuacucccuucccgcugucuuaguuucuacucuuuguucaucuuuuucuuuucuuuuacaauuucacauaugauugagguugugugauauuuuucucuuuugugucuaguuuauucuacuaacauaaaacccucuagacucauuuaucuuguggcagauaguuugggucuccuuuucugaggcagaagaauauaugugcacauacauguauaugcgugcacaagcacacauggcaguagaagcacacacauguguaaugggaugcaugcaugcauacuguaguacguuuaucuguuuguccauucacgagcacucaggcucuuuccaggucuuggcuucagugucuaacccugaacaagagaauccagaugucuuuaugauggcgagcucauuccucucggguuugcagcagaggauggacuucuggcaucucuguuaguuuccuuagggauaccuugcuguuuucugcuggcuuugcuuuuuucacagccuuaccuggacuuuucuuuuaggguuuuguaacagccacuggaacagggcuaagggauggauggucugugguuugcauugcauuuccuuggugauuagugaugcuggccacccucuucauguaagcucuugggcauuuauugucuccaucugaaaaugugcauucauggccauuuucucauuucugagguauuuucuaauauugacuuuuccuuauacauuuaguuacuaacccauucucagauauaugguuugcaaauauuuccuaagaaggaacucuucccauauacgaaagaauaaaauuggaucuuuacguuuuguguacaugaugccaaaauguauuaaagaccuaggcacacaagacauaaaauggggaaaauucuuaauauuggccuuagcaaugauguuauauccagaguuuagguuaccagauagagcgauugguagauagacagguagaugacuaucccagauaaaauuuuaacaaaauguggguuugucaacaauuccuggcuuauacauacauuuccuacagauuuucaaaaguaaaaauaaucaacaggacucccugguaacauguagucauugcguguguggguugggugcacggaagaguccuucugugagcucaguugcuccucacguguccuggcuguuccucauguguuccucacacaggaacaaaaugggguugguuugaaugcuuuaauaauaaacccagagucaccagcauugggacagugucacaguaaggaaagaaaccaaaacaucucuccuggaugccuuucuacucagugagcccagaucuggauucucuauuucacgguguccucuaacaucccuggccgucuguagauuguacaaauuuaaaucugugucugcaugaaugcugucuuugaacauguccuugucucuguccuccugugucugucugaauguauacguguguagugcgugugugagcauaugucuguccuuaacaaaggauuugcucuguguuuauugaacagcauagaaagcaacauguaacagaguuuuagaagggauaaagucgcugaucccaacugacccagauaacaaacaauauuacaaauuccacuguuuaucuaauagcaucuguguguuccauucagcguuuauggugaauauucacuuagaggauucagaggauagagagagacagagagacauaucaagagagacagagagaaucagagagacagagagacauaccaagagaggcagagagagacagagagacagagacagaaacccagagacagagggacacacacacacauaugcacacgugcaugcacaugcauaccccccagagacagagagaaaaagagcaagagagacagacagagacagagacaaagagagacagaaaaagcuauucaaaucuaugagcccaugaggccauucucauucagagcaccacagugacuguggacaaucuggaaucacccacuuguguuuuucucauggcucccagucuaugccugggggaggggaggacaagucaugcuguagauaacaggacugggaagcacacaguaguuuccggcaguuggaauguagcauuuuugagaaauaaaagcucaauucugagugagacuagguaaguuuuuaaggucccuguagauugaaaggacugauuuugguuccguguauuaacaaaugaugugcuugaaagauauucucauggggcacagcacaguguaacuuuaauggugagcucuauuuacuaagugauuccuguauuuauuagagguagauguucucaucuuugccugcuuuaguuuauuuucugcuuuuuacaguauuuaccucuuacugguuaaagauauggcuaagagcuuuuaaagacugacugugaugugagaucucuuucuuacuauuuauuguagcggguccagaaacuuuagcaguugcagugcggaggacuuugagaaguuaacguugaauaagggaggaagcugccugcuuaacaucccgaagcccgacgaagccuacagcgcgcccuccugugguaauaagcugguggacccuggagaggagugugacugcggcacagcgaaggucaguccagucuuccggggaaggcugugggcuuucguggucagugaggcuggcuccuguguugggcguguguuucugggacuggucagcuccugggagcuuaacucuugaugccgugacuucaugcaagcacugugguuccuucuuuuuaaauuuuacuuauccaucucuaucuuuauuguagcuauuagauuguuuguuauuuuguuagguuccuuuauguguuuaccauucuggcccugcuauuaaagauguauuuguugagcuggauucauuuacuaagugaaucgcagcugacuaauccuccagcaucugucagugucugcauucuuccuccuguaagcacuuguguuggucaaccguggaucccacaguugacagggcccucagccgugcccaccuucacuguuacuguuguccagccauguuccucucaguguacccagugaaccuucuccccuugggcugccauuagauccgggacauauuuguucagaugugaggccuacuguguuagucucuguuuuuccuugccugaccauaagagaaaacucaaggucuugaaagccugccuguauccuaagagaaaaccauuuccuugucuuaugugauugauguauuccaugauuucugugaagccucuggagucuccuggccgacaacuagagaggaaauuucuccugcuuagaacuggggcguuguuagguaguuuauggcucuuggagggaccauuauugccucaagaguuagcacuuaauuuaaacuguguaucuguacaugcacauaacauaaauguuauauguaauuuuagguaagcauacaacaauacauccccuaugucuuuuccaaacacccucaguguguaucucccacucccucccucaccuucucucugcccucugcaugcugcccuuuccuuaaguuuucucugcgcauguccccggugucuaaggcugcaaagcaggcuucccugcaugcaccugccgugugugucuugggauauauguucagcucuuugcguuuauuggaaaauugcguuauuugcuacugaguugucuucuuuaucuuagauagauauuauuuguuagauacuugauuugcaaaugucaucuuaauaguucuccuucacuaauguacagagucuuagaagcacagaacuuugauuuugaugaaagccauuugucacuuuggccuuuuauggcugaugcuuuggcugcucccacuuuguacagauucuccccugggagguuucuaguuuuagacuuuacauuuagguccgugagccauuuucacuuagugauguguguguguauguguguguauguguguuuggaaguauagguuguagcucauuuguuauaauuuuugcuaugugauagacaugcuaacaacccugauuugauucauguacuugacuauauaaaauauuacaaggucucauagauguguaaauuuauuacauguuaauuaaaaagaacaguuaauuuuagaacuuuacuaugaaguaauuguaggcagauaagagguuguagaagagugcauagaacuccauguacuccccugccugucgccccaguggugacaacuuauaagguugugacacauuuauaggauguuaagauuacuguuuuuguauaggugucugugagugggagguuggaggugaaauguaacugucauggaacaaagcauggugacagaagccaaggaaacugcugcucaguauagagugugugcuuagcauguguauuuaguguguacacggcacggaggccaguccucaccucccauccuguaagaaaaggacuaguuugccuauccagagacaagagccaucccguggguaguggggcccugagcagggagagaaaggcauccauggguauuuacaugggcaucuguggugccucagaauucaugugucaaaccugcaaccugcaguguagcugcacugggcacuggcgucucugaggaauaggaggauggaacccugauccacuagggccuuuaauaacauucgcuccaguuccagcuaagagagggcagggcgcccagaguucucugugagaacugucaucuugcauuucuagcuuucagaacugggagaagauauauguccauucuuuaaguccuucagucuuugguauuuuauuauggaguuaucaacugucuugugaaauauguugagacuuaaauacuugcacuagagacugaugugucuuuuuuauuauuaauuuuuaaaauuauauuauuuaugccccagggaaggaggaugccuggggagugggguguggggagaugggugugucuuaaagcacagcuaggcgagcaggcugugucgaggucagcugaaaucacaggcagaagaagagcuuuccuaaugcugcugcucucaggggcugguuuauuuauccguggucuuuuucuguuugcaggagugugagguggacccaugcugugaaggaagcacuuguaagcucaagucauuugcugagugugcauauggcgacuguuguaaagauugccaggcaagaacuucuaccuaucaggggcaaaucagagaaggaaaauggauaucuggaaaugcauccucugagagcacugcauaccauuuuuaucagaauguauuuuacauuucacccacuucugugcauuuaaacugcacuuuuuaugaugaggggcacauugagcgaguuaguuuugggugcuggggauuaaaccccaggcuuccagggcuucuugcuugcagguaaacacugugcugugaguuauguguccaucucuuauuuucuugauuccccuuuucaaguaacauauaucuguuaaggaaaacuagaaaaauaucaaaguauagacuagaaaauuagggguuaauugaugaagaggaucugaacuagauccccaaaacccuucugaaacaaccuccgcccccaucucccaaaccaugguggcuugugcuggugauccuggcacagacccuggagcucucagccugguuuccuggccucaucucuaaugcucagcuaugcuggccauccccccacccccaaaugcauucaccgugcaaacgcugauuccaggagugcugucauccgccuaucggacugcuucugcaguguuccuuguguuuguauuuaaucuguguuuccuuugguuaccucauuuuauaauauguuugcauugacuguuuggggcuuuguucacuuuuguguuggaugauuuaaugcuugucauugggaacuuuauauauacaccaugguuccaaaucugauggcuuuguggaaauucuccugagauuccugucugauuugaaccucauuaccuuaguuccuuccaggaggcuccaugugcagagggaagaccagugagugugauguuccugaguacugcaacgguuccucucaguucugcccgccagaugucuucauucagaauggauauccuugccagaacagcaaagccuacugcuacaauggcaugugccaauauuaugacgcgcagugucaggucaucuuugguucaaguaagauauuuauaaucaauugauuugauuuuaucaucugcuugccuuaggcuuuuuguuuguuuguuucgagacaggguuucucuguauagcccuggcuguccuggaacucacuuuguagaccaggcuggccucgaacucagaaauccaccugccccugccuucugagugcugggauuaaaggcauacgccaccacgcccggcuugccuuaggcuuuuaaagaaggaaucagacauuauugaugagguucuuguaucuccauucuuccuccuucuguaguagucauggucaggaauuucuaugucugauugagugauucaguugaugcuuugugugucucucucccucuuuccacuugguauaacacacagugucuuaggguuuucauugcugugaagacacacugugaccaagaagccuuauaagaaauagcauuuaauuggggcuuacaguucaaagguucaguccauuauuaccauggcaggagcauggcgcauccaggcagacaugaugcuggagaaggaccugggagugcuacaucuuuuucugauacaaacaggagaagacuggcuuccagggagcuaggcuaagggucuuaaagccaugcccacaaugacacauuuccuccaacaaggucacaccuacuccaaggccacaccuccuaauagugccacuccccaagcuaagcauauucaaaccaucacacacaguguaucuguauaugcauacacgcagagguuugggaacugaggacuguaccuagaaccucacuuaugccaagcaagcacacuauugauugcuauguccucucccuccagguuucuaguucugagauuguaggcugcauaggucuaacauuugcaaucaucauuuaaaauguccuuaugauccauguauacugauacauuucuaucacagucuauuaggguauucacuaguuaaguggacccugauuaguuucucauuuguguguauauggaguaugucuuuguguaugggagugcauguaucuuaguguauaugaguguggaugcaggcuaguuggcccuugagcuuuuggggcucuucugucuuuaccucccuuuccucauaggagcacuggacuuauagauaugaacugcuuuaugugggcucuggugauuugaauucagguccuaacacuuucaugacaaaguacuucacccacuaauccaucuucccagcuauaaguuuucaguuguuauguugaugaguauguaguauaagcccucaggguuuuguuuuguuuugcuuaagcuuuucaucuuuauuacugcuccauacuuucaucuuuugaaauaauaacuuuuaccuuuugcagcugauuuuuugauacuuguucuaaguguuuauauguauauuccccccccccaggucuuuagauggccucuauaaugcuacucuuuuauucuuauguuuuuagauuuauuuuaucuucuguguaugaguuuugccugcaaguauguauguguacccuauauaugccuggugccuuuggaagucagaagaaggcauuggaguccuaggaauuagagauagggaugguugugaaucaccaugugggugcugggaaucaaacccagguccuccacgagagcaacaaguguuccuaaccacugauccaucucuccagucccuacuguuuuuauuuuuauagaugauaauuaauuuucauucuuugucuucauucaacccugacagcucauguccauacacaugaucauuuucuagucuucuuucuucaucguagaguaauuguaguguucacagcagugcauugagugcauugcaugguagccauguuaaugcuguucucugaacugugcaguacgguaacauugauuuucugccauucucuuucucucaaauaaaugauucucauucuuccccuuuccuuccaucccccucuaucccucccugucugccuuccugccucuagauuuguccccuuuugaugaguuugcaaaacugcuaauaguugaggucuauucugauauugaagugguuaaagacaucagcuguucuacugauuucaaccuguuuaaagaaaucuaaacuggaugucucuguuugucuucaguuuugacuuguucuuuguauuguugugcacgcacacacaugcacacacauacacacucacaauggauuggcucauguagcucuguuaucaguagaacugauggaggacuccuguucaggaauggcaggucaggacccagaaggaucuggugucccgggucaguuccagugguaggaacaucacaggugucucagccuggugucuguugggaaaaauucccuccuucuggucgugguuuguucuuuucaaauguguaaucaauuguuuaaagcacccaugagugcauucugcuguauuuucucuauucaguuaacuguuagccucauguaaaagugcucuuaguucagagucaaguauaucuuacaucacauggugaaguuaggauaagagagggaagaagacacacacauuuccucacagguguggucauaaugaaaugagauauggaugacaguuguaggccucagguuuguaacugcucuguggucauaucucacacgucagcugcguuuuaguccacauucuauuguuauacugccugcucuguguucucuuugccuucaauaaguuccuuagaugguuauagcucucaaccugguggagugacccaaacauucauuccugaagggccugggccacauguagcuuugcuggauuuggcuguuagacaggaugagguaaauacuuagauaacuccuguauuucaggccugcuccucuugcuuccauguaggguuauggaucugucaucuagccacuugcaaaagcuuuucucuguucguucagaaacaugaagagcccagcauaacugaguguguaguauauguuccagcccaguggagucauucuuguggcaucuaguggaagaauuuucucuuuggacacucagaccucuaagcuauuagagcacgaagucacggguccaggaagcauguuuuuguuagugagucauauugcuaaguguugccacucccauuugcaccccuuaagaucuguacaggggauugugguuguugcuguuggaccugauuuagagcauauguagcuuuuugaagaaaagaugcuccuguccaucaaauuaguacuaucugacuugcacuguaacugaguauccaguacauuucuacuacucuaacaagccaucuaauaaaaauaaaauacuguacuuagugauaaagauaggccugaaaucuaggaggauugcaaguuuaaggccugccugggcuacagagagccagccugugcaacuuaguaaaaccuugucucaaacaguaaacaaguguuaggagauagcucaguggcagaacacuugcccaguguguacaaggcuucagucacugguucuugaagaagugguguauaugagccugggcacaaagugcugucuuuucugugauggaaagggaauaguguauguagcugcccugguacccagaugcuggcugaugcucaggaaagggugccauaucagagacucaguggauuuggguggcggcagagguggcugggaaaagaggcugccugcaguucccagaauggguuuuccuuucuguugauuguuuuggcccaagcaccucaauuggucauaaucaugaacucuccaucuccuucccagcaaagugaaccacaaaauguucuaugggguuguugcagagagagcauugccacuguccacuuuugggugaugcuucuacaugcucagagccaucugugagaugcuuuguucuucucuuccugugucaacucuugguaggauucccagagugcucguagaugcuagacaagggcuuggggaacuguggacguggacuuguggucccucagcugucuucauuuugggucucauggugccggugaguucccacccccugcaccuguauggagucggcugcguaugacugaguccuguuuucagcacauuuacccaaguugcaguggccaaugauuggcacugaggauuucuacagaaagccuuccuagauuccugucuucccaccagucucuucuuuauccuugagucagcagcagcagcaaacacauucgacuccaucccucccuguauacugucugggaaaucuguaacuuucccuguuguucugacuuggcugggaacacugugugguauuuuuucugggcaggauuauggauaugucuccuccugcucacugcuucccucugcugcgcugccuccguucacccacauccaccuucuuuaaagcuaacugagccuuguaucaggcaugugggcuggguaagggaaucugauucaggagggaggaaggacugacgauuugacuaggaaauacuaacaaagucuuagggagggaagaaugaaggugauacuaaaaaugcaagaaaaugaguguggcuuauccuuugucacacggaguaggucucacuguauuuaucuaauguaagcguccauguacaauaaaaacaugcggugguccgugcuguaacugagagugcuggguaugugagagcagacagugagugccugcgagcugugacuuacugcacgagcuaguuacuauugcauggcugugaucaugggagaagaguucaagggagagacgcuuuggcuucugguuucggagagguucaguccauguuugcucagcccugugagcauaugaagaacaccauagugaugggacuguguggcagggaggccucucuaccucauguuggauagagaugggaagagaaggguucaugagaggacagaggcaagagcuuccagggcacauuaaccccucuccagcucccacugaccuggccuccagcuagauucuaucccuccccuccccauuucccaagaauccuaucacauuaugaacucaucagugauugaucaucuagaagaucagaucccuggacacaccucagacauucucaggcaggcuuauaaucugugucuuucucagugcaaucaagucaacagugcuagccaucuggcuguacaugguuccuaauuguaguaaucauguaaugauauuuguuauagucugagugcuuggauccaggccuuuaugugcaaucugaguuaugaaguguagaccagaggcgcuguauguguaaggcugaacauuuagaagugugcaguggcuccuacacgugugugaggaucauaugggauacuucugacuaaaguuaccaucacuuuuuuucucucuuaaauguugacuauugcagaggcuaaggcugccccaagagauugcuucauugaagucaauucuaaaggugacagauuuggcaacugugguuucuccggcagugaguacaagaagugugccacuggguaaguggagacaagggugaagagggcuaugagcaagggagggggggugugugggcccugaaguccucuccugcuccugggacugcugccuuccucuugcuucaagugcuuacagucucauaugcaacaugcacagcaggcuucagcgggaugugcugggagcaagcggggaagugauucauuuacaugcgugcacauuguggaucuaguggguuuagaaccuuguuuuauuuaucugugaccugcaggaagaugccugagugaauaugcccucuuuucuucgcacacucuuuucuucaguaaaacauucucugauucgguuguauauacagaacaucugcaguacuaauugggccucucauuaugucuuugucagccuuacaggaauuuaaaaggaugaaguaaaucuuguauuuuuauuuuuguaggcuggugagauggcuuacagguuaaaguauuuauuaccaaaccugacaacuugaguuugaucucugauucuagcaaguuguccucuagucuaccuguguagggauguguuuacaugcauauaaaugaauaaauuuauguaaaauagguaaaauaauaauaaaucaaagcaagaacacauaaucccacgagucuccccguuuuguguuugcccucggcaugucuccacacugcuguuuacucagugggggugacucugagguacuaugugcugccagugguggagcucaguggccugugguguuggcuaagcgucaucauuacuacuguggcauguguugucuucuugcuccucaacucugugggaguguugagucccacugacugccuuaguuacuguucuguugguaugaagagacaccaucaccacggcagcuuguaaaagaaagaauuuauugggucucacaguuucagagggcgaguccauacucaucacagcagggagcauggcagcaggcaggcauggggcuggagcaggagcuuacaucugaaugacagggaaagugagacuggaucucgcauuugauuuugagaucccaaagcccacucauggugacacaccuccuccaauaaggccacacccccaacuaaagccccaauccuuuucaaacaguuccaccagcuaggaaccaggcauucaaauacaugaguguaugggggccuuucucauucacaccaucucacugacugaccauuuucuuuccccuuagcuuugugacuuauuucauaaacuuauuucugcuucuuucccacaucucucccuuucauaagucaucucugagguccuucagcuaugcuagccuccuugggacauuuugcacagcaucucugaacaugcaguuucuucacugccuggccaauccuggucauccuucaaaacuugaguuccagugacuuucuuaagucaaacuucucccucuuuccuaacaacaguguauacacuucacagguguucugagugccaggugccucuuucauaaacgugacaugcucuguuuucaucauuguucguagauguccuaucauugcucaguugcugagaagagacaccaugacaacagugucagagguguagucgguuaucaucauggagggcaucaugccuccagagcaguagcugagagcuacaaccugaucgaucuguagacagugagacagacacugggcuuggcauaggcuugugaaaccucaaaacccagcccaagugacucuuucuccagcaaggccacaccucuuaauccuucuaauccuuacaaauagugccacucccuggugacuagcauuuaagcaucugagucuuggguccaguguuacucaaaccacuacaauaucguuuucuaauggucugcuucucccucacaucuccuccucuuccuuucauuagccaucucugugaggcuaugauuucucuauugacucgugagucauugaaaguuaauugauuaauuucuaaaauugcuuucuuguuuaauuuuaccaagaagacuuggaagugggagcugcucuaucuauaaggagcuuacugugcagugaggaggggcaggaauagagaaggaaacacuuuuguacugcucgccaucccaucuggugacugcgugguagccacagcuccccucuucucgcccugcuagauuuaaggauaaccauaccgauuuuccauugagauucccuccagccaagaaacagccuccaugucuacauauaaacauaagaacuucuucccaugguccccuggaggcauuuuauauuuacaguguuugucuugcccgguaggaacgcgcuguguggaaagcuucaaugcgagaauguacaggacaugccgguguuuggaauaguaccagcuaucauucagacacccagucgaggcaccaaaugcugggguguggauuuccagcuugguuccgacguuccagacccagggauggugaaugaaggcaccaaaugugaugcuggcaagguaaccuaaauauuuucuguuugcaagcaaaacagcuggaaaaaucuacacacaaaguugguggcuggccucuuccuggaaaaaaccccuaaauuugugguaucgauuuuagaaaauccaaagccacugggaagggacuugacaacuacuuguaguugugcccccuguguuucuucacagggauccucugaugucuuccauguuggaaucagcuguacauauuucuuguccuauguaugggcugucauuuguuagccagguacccuuccugggaaacuuaggugauuuccacaguucgugggggugggagcuggagucccugcgcuuuguguuugucugugccucugggucaguaagguuguggugcuugucccacccaggguguggcagcccauggcuuccagcccugcuuccguaugaguggauaaucagggccuaaggauugcuguaacagaaacaggugcuggcucuccagauuuaaacaugcccucuuuucucaagacucagagagagagagagagagagagagagagagagaauguguguguguguaugugucugugggggggggagggaaggagggaggaugagaauuucuguuugguugggacuuugagcauaccuccuuaaguguuugaaaugcaaccgccaugguuaaugagcugacugugugacacuuuuugaugcauaaucugaauguguuugcgaggaauauacucugauagcauguaguauuugguaacuauacauucaagucuuucagauucuuaauguguuaaagccuuagagacagaaguccuuuaguccacaguccuguccuguuuuaacuucucaaggaaauuucuuuugcaccaggaauguugcauuuguauugguuucuuggcaauuauauuuuaauuguagaugacaucuuuuauuaauuuaaaugcacauuugcucuacuuuaauguuuuuguguuaaauuuuccuuuacuugauauaguugccaucucucauacguggauuccugcuugucuggguccugguuaccucacccaggaugauugcuucuagccucaucuguuacccgcagacuucaugauuacauuuuucuuaacagcugaauuccacuguguaaauguaccuuauuuucauuagucgguuaucagaguguggacuuguaggcuauuuccguuuccuggcuguuauggguagaggagcagugaacacagauaaacaagugucccuguauuaggauagaguccuguggaucugugcccaagagcuggaucgugggguagaucuguuucuagccuuugaggcuucuccacacugguuuccauggugguuuccacaguuugcauuucccccagcagugaauaauuccucuuucuccacauacgugccagcauuugcugucauuguuuuaaucuuagccguucuuuuacuuuuuuagagaugccuuuuuuucauuaauuaauuuauugacuuuacauccugauugcacccccugcuucucaucugccugugucacaguccugcucccccauuucccauccccuugugcuuugguaaaaggaggaccuccacuaugggacccaccccaguguagcacauccauuuguagcaggaccaagcagauccucuuaaagugaagcaggacaaggcagcccagcuuggguaagggacccauaggcaggcaacagacucagagauggcucccacucuaauuuuuaggguacccacaugaagaucaaggugcaugucuggaacauauguguaaggugccucguucccucuaacgcauggucuuuuuuuguguuuucaguuucugugagcuccauugggcucauguuauuugacuccauagggguucuugacuccuaugacucuaccaaucaccccccauuaucccacaugacucccugagcucuguggguaucuacaucuauuauuauuaguaaauuuuuuaucuuuuauugguuauuuuauuuguuuacauuucaaauguugucccccuuuccaguuuccccucugcaaaccuuucccauuccccuucccccugccucuaugagggugcuccccccccacucacucccaccucucuacccuagcaucccccuacacugggguauugagccuucacaggaccaagggccuccccuccuauugaugcccgauaaggcaaucugcugcuauagcugcaguauccuugguugguaguuuagucccugggaacacugaggggucugguugguugauauuguaguucuucacauuguugugaagggggcugcaaucuccuucagcgucuucaguccuuccccuaacucuuccaaaaaaaguagcuugauauuuuacuauaucaauuaugauauaacaauuucagggagaauuuuuaauauauuucaauauuuuuauuuauuuuauaucuguuaugagcuagaauuucaagaacuuuauaaaauuauaaugauuaguucucauuuguaguggaaaguccucaucauuuuauuauuaaucaugauguuggaaaagaaauggcagcuuuuauuuuaaaauaaaguauucucucauuuauuuauguucaguggaccuguuuucaggucucucagcaauuucauguauucuuuccuuuuucuggagacagggucuaucuauaugucuguagaguguauuguggccucaaacucacguucauccugccucaguuucccaagugcuaggauuauagaugugcacuguuaugcccagaaugugguuucuucugauuugaaaaaaagauucuuugugaauauuuucuuuauuuguauacucguaucaaaggguagacuauaauuuaaucuuucuuuuuggccuucauauaauuuuugucauuuuaauuguuaauuuuauguuauuuaguuacugucacucauuuucuucauuaaaaaaauauaauguuggaauuaaccaugccucgagagcuugaagaauuccccaaugauggauccggggaucaagauggcucaguggguaaagauaccugcugccaaugcugaggcccugggcuccaucccuggggcagaaccaaugcucagaagucuugcuuugacuuauacacacacaucaugccaugcacauacacacacauucacaugugugugcacgugccuguaugcauguugacauguauguacacacauguaccuguguguguauauacaugcaugcacagacaucuacuugcauacccacacacacgaaauuaaaauguaauaaauuaaaaauaauaauccuucaaugaaauaaucaugauguugaucuuuuuccugaucuuuuuaaugucuccagcuuuucuuaugucacuuaauucuuugcuuauuuuuuuuuuucagauuugcaggaauuuucaguguguaaaugcuucuguccugaauuaugacugugacauucagggaaaaugucauggccaugggguaaguaguguucccuuuaguuugcucauaguuguauuucugagccaauagucuuggggagauucgugagaguuccuaagguuucuggguagauguuuggagaauuuguucauugguagauauuucauuuacccccagaccuguuccacacuuaauugcuggguguggugauguauguccacagagugaguuguaaucuagccagggcuacacagugagauauugucucaaagauaugaagagaagagagacagacagacagagacagucagucagucagacagacagacaggcagaggauauucgugauuuuguaugaacuuuuuagcuucccuuccggaguugauucagagcaugcucacaguuaacaagugguacuuugcuuguuuuaaagguguguaacagcaauaagaauugucacugugaagacggcugggcucccccacacugugacaccaaaggauauggaggaagcguggacagcgggccgacguauaauggcaaguacccuggagggcauuggugggccucacgcugcccuggccguaagguggcaucuguauuccuuucuucacuugccacacagcugugcacugaagcugcucgcugugccuccugcauugcuugcagacauuucuggaguuucauuuagcccguuucuuucagguuuuugcuuguccuuacugaugagccuggauuccugcugugcaugugcagauaauacuggccgucucugguccucuucuugcagcucuuguucuguguccugcugucagcuuagugucugcccacagcuauuaggacgauguucaaggcuuuagcgugacuagaugugcccugcaggaguucugcagcuuagcuuccagaugcauuucacugugccucgagcaagaaguaauccuucauuaucucugaguccgcuguugcucccacugaagucuucuguguuucuuauaugcguguuccuccuuacuuaccgcucucaaugagugugcucauucucucuguucuccuaggcugcugcacaacacuggcacuggaauugcuauuuaaaaacaucuccuuuuuauccccuuauauaauacaaguuccuggugagaggaugagcugucuccucuccggcgaacccuugauggaguaacuggcucuuggguuuaguauugccagagacugccagaucuuuccagaguggccauagcaguuugauacuauccgcaucacaugcugugguucuuuuguuacuugugaucaauuuggaaaaucacugugguucaucuauccagggugaccugaagugguugacccuguucugacucauugucagguagcaugccacuguuaauaucacauucucaguaaaaggacguugcaccaucucagauaccuucauaagaguuagugugaucacagggcaguaauauaauaauacugcgcuacuauauagagcauuauaauaugauauauuauauauaauauaauuuauuauaaaauaaugcuuuaauauaauacuggcuguggucaauguaucacuuguguugacguaugauccuuccacacauaguuuaucucguggguuuuuauggcaggauguugaguuuucuuuuuucaucucuguaccgugggaugaucccaugguucucuauucauguguugaugauauuuuauugauauuugcacuauauacugagcucuccuuauaucugagcuguccuuauaugcugaccauccuuagauccugaaauaauaccaucuuaaucauggagcauaauuuuuaaaguguguuuuaaaauuugacuuucaaguauuuuauugaggauuuugugucuguuuuuaugaaggauauucaucuauaauucucccccaccccaccucacguguuuucuuucucucuuucuucuuuuugcaucuuuacugaauucuguauaaggguaacacuagcuuugcagaaugaugcucgacgcuuuccuucccguuguagugcauggagaaaugugaggaaacagauuaaauagaaaaaugcuaaugugagccguguauaaucaccugguguguucuguguggagaaguugacagcuaauguaacugcccaucacugucaauccugucuuuccagcaaagagcacagcacugagggacgggcuucuggucuucuucuuccuaaucgucccccuuguugcggcugccauuuuccucuuuaucaagagagaugaacuacggaaaaccuucaggaagaagagaucacaaauguaugagugcuuaguuuuuucuucuuaauguguacuaaguaauuuagaauaauuuaaguaauuuaaaguaauuauuaaugaucuagcauagaaguuggcaaucuuaaaaauaggguucuacgauaucuuacuguucuucugaugugauggcauguaguggugaaucagccaugauggcguaggcuuguguaacgcacuuggaaggcugaggcaggaggauugugaauuccaggcuugucuggacuaucuauuggacaaccuacugagaccuuauuacuuauuuacuuacacacacacacacacacacacacacaaagaaagacugguggcuuagcucucagaccaggcagggaagggugugagcagccuauacuguaagcagugguccuuggggcuccuuuugccuuacacugauuuuuuuuauauaauauaucucuugaauuuauucuuuuuuaaauuaaucauuccauuuguuuauaucucaugauauuccacuucccgguuaccccuccaccaacacuuccaucccacauccaccauccucccuccccuuggccuguauucuugauagaugcaaaugggcuuuagggcuuggcauuugacuuagguuuucuaacuagggaaaacaugggauaaagauaagacauguguugggaaauuuccaugucuuccuuuaauggauccauucuuacauaggaaguuugaacucucaguuuugaaaccagauuuuaagaaauaaguuuugaugugaaaaggucuauauaauucagacaccugauauuuuuuagucaguauguugaauuuucagagaaauccaugucaaaacucacuucuaauauauugaaucaguguuuagcauaaagggcauuauaacuaggucaaaguucaaauucuuugucaacaguuugguaaaaaaugugggcugaaauucacauaacugaaucagggcuuauuuuguauaaaaugagaauaauaauauugccuacuuugugguuuuaauaguaacuaaauuuuuucuguuauuuaguaauuaaauuuaauuuaguaauuaaagauuaaaugaagaaagcucaacaaagcccagugcaggcaugugguucuuuuauagcucuaauaauaaugacuccagauguccaugcagacuguaggacccgcuugucccuuacuguguuauacuuucuuggagugugcugcuguaagcuucagagucaaaaguuauucugcccuucucucccuccucuuccuccuccuccuccucuucuuccuccccaccuccucuuccucacuggccaucgcaggucuaacuggccagucccugcagacuucugagucugagucggugguuuccuuacguagugagagcagucucccucucaugccugcgcggcagacucgcuggccccucaguggagugaugcguguuggugucauucuagccacugaacuuguugacuuuuagagugcuugcuucaaaugugcgugcagccucacaacuugcuuuuaauuuucuuugaauuuaagaaaaucucaggagaaaaaguuacagaucacuggccuuuuuaguugaauuuuacaguuucuuaggauuuucugguuuuugaauacugaaaugguguuaggaauccucucuauucccacaaggacaagauuugugugaauacuguuaaaaauacagagaccuuggcuaccucucugguugucacuaccagcaucaccaacguuuuauuuugcauuaaggaaaauugaagccauguauaauguguucuguacaaauguuuugucaugaauuaacuaaaaguaaucaugucuuucaggucagauggcagaaaucaagcaaacgucucuagacagccaggagauccuaguaucuccagaccaccagggggcccaaaugucuccagaccaccagggggcccaggugucuccagaccaccagggggcccaggugucuccagaccaccagggggcccaggugucuccagaccaccagggggcccaggugucuccagaccgccagggggcccaggugucuccagaccgccagugaguccuuugcauuuuucuccagucaccccaucuagagaugcuguacauuucauaaaaaaacugucuuuccuauuguguucaaguauuguacauuuaaagacauaaacgggagcuaggagugugucucaguggugauggccaucccuagcauacuuaggacuucagucauaagguuugaucuucagccccaaaaacaaaaaagaaagauuaagaaaugguuacagcuuaaacauacauaacuuuacuauguauuggggaauauuguaggugguccuugaacuaaaggaaccagcaaaguucuggcucagaggaugugagaaaugaguuauucagacuuuuuuuuuuugccuaaaaaugaggagugagcaccugggucugcuguuuucuuccugccaguucuuuaugguuucaguagcuggcaucccuuggaugugcuagcaaagacugggugcugagcacauuucugccagugugugauagggucuuaggaaagcguguaugcuuacugauacgcaauaaguauuacaaucuuaccuucuuuuaaacuuuuuaaaaaacuuuuauuuauuuauuuuaaacuccagauuuuauuccugucccaguucccccucugacuguucuacaucucauaccgccucccugcccccugucuccacaaggauguccucaccucccaucccccaccccaccagaccucuaaacucucuggggccuccaguaucuugagaguuaggugcaucuucucugacuaaacccagacccagaaguccucugcuguauauguguugggggccucauaucagcugauauaugcugccugguugaugguccagugucugagagaucuuagggguccagguuaauugagacugcugguccuccuacagggucgcccuccuccucaacuucuuucaguuuuccccugauucaaccacaggggucagcagcuucuguccauugguugggugcaaauaucugcaucugacucuuugagcugcuuguugggccuuuuagagggcagucaugauaggucccuuuuuugugagcacuccauagccucuguaauagugugucaggucuuggggccucccccugagcuggaucccacuuugggccugucacuggaccuucuuuuccucaggcuccucuccauuuccaucccuguaguucuuucagacaggaacaauuaugggucagaggugugacugugagauggcagccccagcccucacuuggugcccugucuuucuccuggagguggagucuucaaguucccucuccccaaugucgggcauuccaucuaagguccucacuuugaguccugagaaucucucaccucccagguuucuuauacaaucuggaggguuccugccaaccuccuaccucccaagguugccuguuucccuucuuucugcuggcccucagggcuucagaccuuuucccccacccaauaccagauuguauuacccucucccacaacccguccccuuugccucccaggacucucccucccuccccacuugugauugcuuccuucucccucccaagugggacugaggcauccucacuugugcccuucagcuuguugaccuuuuugguucuggggacuguauguuggguauucuguauuuuuuuuugauaauauccacuuauuaugaguacauaccaugcauguccuuuuggggcugaguuaccucacacaggaugguauuuucuagucccauccauuugccuacaaaacuuaggauguccuuguuccuaauagcugaguaguauuccuuuguguaaauaaauaacauuuucuguauccauucuucugucaugggacaucuggguuguuuccagcuuuuggcuaucacaaacaaggccauaguggaacauuugccccuguggcaugguaggguaucuuuuggguauauucccaagagugguauagcuggaucuuuagguagaucuauuuccaauuuucugagaaacuuccagauugauuuccagagugguuguaccaguuuauuaucccaccagcaauggaggaguguuuuacauccucuccaacaugugcuguugccugagguuuugaucuuagccagccucucugccccucugaagagcucccaguuggaaggcuccacagguggucugcuacagccagggccacaggccuacaggacaccugaaguaacccagggacaaaagaggcagacuccagaaagagucacccagaccagaaaacaccagggacaaccagauggugagaggcaagcgcaagaagcaacagaagccaauauauaugggcaucaucagaacccaguucucccaccaacaccaauacauuugaaaaucaggaagcugaccuaaaauccuaucucaugaagaugauagaguccuuuaaggaggauauaaauaacucacugaaagaaauauaggaaaccacagguaaaaagguagaagcccuuaaagaggaaacaaauaaaucccuuaaagaaauauagaaaaacacaaccaaacaggugaaggaauugaauaaaaugaucccagaccuaaaaguagaaguagaaacaauaaggaaaacacaaauggaggcaaaccuggaaauggaaaaccuaggaaagaggucaggaauuacagauguaaauaucaccaacagaauacaagugauagaagagagaagcucaggugugaagauaccauagaagagguugacacaacugacaaagaaaauucaaaacauaaaaaacuccuaacccaaagcauccaggaaauucaggacacaaugaaaaggccaaaucuaauaauaaucagaacagaggagaaugaagauucucagcgcaaagaaaaugucuucaacaaaaucauagaagaaaacuucccaaccuaaaaaaaaaagagauggccauaaagguacaagaagccuauagaacaccaaauaaaugggaucagaaaagaaaauccucuuguuacauaauaauuaaaacacuaaacccacagaacaaagaaagaauauuaaaagcugcaagggaaaagggcuauguaacauacaaagguagaccuaucagaauuacaccagacuucucagcagagacuaugaaagccagaagaaccuggucagaggucaugcagacucuaagagaaaacaaaugcuagcccaggugauuauacccagcaaaacucaaucaacauagauggagaaaacaaaauauuccaggucaaaaccaaauuuaaacaguaucuaccaacccagcccuacagaggauccuagaaggaaaacuccaacacaaggaaaguaccugcaccaaagaaaagacaagauauuaagcaucucacaacaaagccaaaaggagagacccacagcacauaaagccaccuacaaaaacaaacauaucaggaaccaacagucaucugccuuuaauaucucucaauauuaauggacucaucucacccauaaaaagacauaaacugacagacuugauacgcaaacaagauccagcaauuugcugcauacaagaaacauacuucaauaacaaagacagguacuaucucagaguaaaaggauggaaaaaagaucuuccaagcaaauggucccaggaaauaagcuagaguugccauucuaauauccaauaaaauagacuuucaacaaaaguuaucaagugugaugaagagggcacuugauauucuuuuggacuuuggguauuuacacacaaaucugcugugcuuaccucaucccucaucccagcuggggcccgugguuaucccucauuugucugcacuguugguacaguaccuagaacaucccaauagcaaacacuaccaucaauagauagucaauuguauguaccccuggccagcuaaauagaagaaaagaagaaccucagaaagaaagaauugucauguuucuuccauaaauaaauuauacguggggcgaguuaggagggcuggagcgauguugcacuuuuagaagacccaaguucaauuccuagcacuuacaugauggcuuacaaccaucuauaaccccaguuucagggauccaauaagcaucuagguacacacaggugcauacaggcaaaauagucauacauauaaaguaaaauaaauauaaaaaauggaaaagaaaaugauagcuguuuaagaagauaguuguggaggcuggagauggcacugagccaucucauucguccuuacuuggagacaggguuuuaauaaaguuucucaggcuggccuugaacuuacaauccuccuacacuagccuccugaguauuugagauuacacauuugugccacugggcucccuuuguagcuauuugaaauguacaauaggccaccuuaaucuagucauucucggaacacacuugcucuauaauuguaacuuauguguugaaaggacuccaguguguuuucuuagcacuuuugccaaaaaaucaguuuccccaggggcuguacagacaucucaggaguuaagagcacuggcugcucguucagaagaucugggaucuguucccagcacacucguggcaguuaucaccaucuuugguucccauucuaggguaccaauacccacucuggauccucggagaccuggcauauacaggguauucuuacacacaggcaggcagaacaugcacaaaguaaaauuuuuaaauccuaaaccaaaacaaaacucauugacuuagccugagagaugguucaguaagucaagugugugccuugaaaguuuuuuugagaccugaguuugaaucuugagauguaaaacugggcaugacagcagaggucuguaaccuuugugcucccaaggugagacuggauggagguggaaacaguguccaggagcacuggcagcagccagccugguguacccauugugaacaacagagacucuguuucaagauagggaaaggcacggaccgcuacccaaagaugcuuuucugacuucucuggcaugcacacaugcacauacacauggcacacaucacacacacaguuggucucaggugugugggguuacuuaacccaugcagcuggauuugaccgggcuuguacugaugguagguugccuuguuucucugagcauuucacugugugaguucuugaugauccaagucuccuuauucgugaagcaucugucuaguuuucuuauuuucccaccaaucaugauagguuguacguuucuacagauguauucguuucuccagucuuuucaauuuguugcccuguuauuguucauagcagcagcuuaaggguuguuuguauuucugcaguuccacucuaaugccaccucuuucugaacuuguauuuucuuucugauagucuugugccuuuguugcuuuuccuuuugcugugauaaaauacccugacacagugaccuaaggaagggacaguuucuuuuugacucacagcuccaggguacagccuguugagcuuggaacgcaaaggcaguuggaucuugagagaacugguuccacccagucaggaggagagcaaugugagcuuuuccucuuaggcagcccacaacucaagccuaaggacugguaccacccuccgucacagugggccuuccagcuccaguacucacgaugacucuccacaggcgugaaagccaguaucagccauaacgccuagauaauaggauuuggauguuaucuuuucagaacuucaguucuuauuuuacagauguuuucuguuucauuuauuuccccuccaucuuuauucuuucuuuccuucuauuaacuuuaucauuauauaauuuccuucuuacagauuguuauggguuaguuuaucuguacuuuucuagauuuuaaauuauugcauuagguuauuauuugauaguuucucuucuuuugaaauggcaugucuuccuucugauaaagauauuuauugcuauacguuugcuaugagcuaucuucagauucccucagauggauccuucaaguguuacuuuuuuauuuacauuuuuguuucaagagguguuucuguauuucuuuugauuucuugacccagugcuuguucagaaacauacuguuuaauuucuauguacuuuagaguuuuccuaaauuccucuuauguuuauucuagucauaccauugugguugggauacuugguacugcuguccgcacucacauuuuuuaagacuuguuuuguggcugcacaaauccugucugcuggagaaugccccgugcaguguagagcaacgaguauuugccucuguguaauggacuguuguuugugugucuguuagaccaguaguucacaucugaugucuccuuacugauuguucugacugcacaaccuacagaugauugaaaagagauugagcuuguuuugcuacucucugcugcagauuaauuaauacuugcuauauuucagcucccaugucaaggaagagucaugaauucugauauugaggauaguagguuacuuggguucaugguacccauuagguauuuaaugggcuugcuaauaaaaugucagaguauuuuauuuaaaauguauugguguuauuuacuuaauuuaauucaauacuauuauaccuuagaauuauugaauuuaaaaauauagccuuaaaauaaggaaguauaacauuuaguaguaaagaggaguuaaacaggaaaauaucuuuuucaauccauugugcuggagaucaagcuuggagcuuuauucaugcuagaaaagcacucugccucugagccgcacucugccacugagccacacuuuuggcccuuuuagccaaaguaguuaaaguaucagcacugccagucaguagugugauaagcauauuaauuacuuucacacaaaauagcuuaauaccuaauacagauuugugaccauacuguagcaguaaccgugcauuuuccuuucuuuacagccugggcauggaaacagauucccaguaccaaccuacgccgccaagcagccugcgcaguucccgucaagguuggcaggaaauggcucuagaugacuugaccauguuaaaauucaggagucaaugccuuacaguuucccauuuaauguugacuuagggcaagguguuuaaguaauuuggauagaacagaauuuguaagggaagcuuuuaaagaacuuuuauaugaauauuguuauauuucuacaacaccaggaagaaauccugaggaaaucugagucagacuguugccauacagauaauucagaaucaagggccuuuaaaacacugaguguaggaaaguagauggcuugugccugcuugugcacacggacuagcuagagaaacuagaugguaggaugcaugugcuuagauuggacagacugaggaggcagggaacugugcagccagggccgcaagcagaaggacauuuagagacgaccaaguuacagaugaaccuacuuguccugauggcaagugaggaacuggggguagggagagaggagcuuucaaggagcucggaggacagacgaggcaaaauuagaguucuagccaggggaagucccaagacaaacuucccaggcuuuguuuggggacagagggccagagauguucuauacucgauugauuucuacacagaagagccaggaugcaaguauagaaaucuugacuaaaacuaaaucauacaccaugaacagaaccagagauuuuuuuuuuuuuuuuuuuuuuuuuaguuaacaaucaucagacauuggcuuuaaaauaacugaucauguuagugguccagauugagaauuucagcaugguucuguaccauuaacaugauuagaauuauuuuaaagccagugucugauaggauuuauagaugguugugagccaccauccugaugcugggaagugaaacuaggucuucugaaagagcagcaauuguucuuaacuguugagccuucucuccagccccacccaacaucuacccauaauuuuuuaaauuaaaaaaaaaugaaguccaaugaaguaaagcaguaguaaaaugaaaaauauuuaccagcugaggaacgggaucgccccucccccaguaacuugcagcugccuauagcuccucagagaggggcuagguaccaugaauucuuccagcaugaaugagaggaugcugaugggauggguuuauucuuuuuguaaauaauaauaauaauuuauuuauucacuuuacaacccaauaccagaaaccccucaugcaaaucccuccccccauuccacuuccccuucucuuuugaagccagacaaggcagugcauuuaggggcaagggauccacaggcaggcaacaggcuuagggacaaguccugcucuaguuguugggggcccgcauaaagaccaagcugcuuaucugcugcauaugugcagggggcccggguccaggggauggguccauucuugauuagcucuuuucaggauaaccuccaggugugcaagcucuuauguguaagagccgcguuauauccaggagacaagaucuuacagcgugucuccagcucucaggcucuuucauagaugccccucccacucagagcugagugcucaggggucacguuaucuccgcauucuggccaaucauggcuauuugcauucaguaguccucacugacagcaaaguuuucugaccaaggcugagagcagcaugugggaauagacauaacucuggugugcaguuugagugugaccauuuaacagaaucaauuuaggcagcaguuuccccguuagggccccucacucccccagacaaagucugacuagguuuggagugggagacaugugagcucugucuguuuagaaagcaguugauagauguggcaccauugcuucagcaggcaccucuugcccugcagguuuauauugugccauugcagggucccugggugggaaggacuguugaugacuuuucugugccaguaguccacaaaacacacuccggcagaaaccagaguuaccuacaggaaugaagguuccagcucugguccagcuaguuuaccuguggucuguaaccucagugugugaugucuucaccuauaggguuuuacuaguuaguucuggucggcaagcaagagcaguggcaguaacuuagaucgccuugaaggccuuuuaggccucccugaccaagaguucauaguggguagccuacccuuggcaguggaguguuuuuauuuaauaacuguggguuuuagcaacaguaugauccaucaugccaggguacuuccauucaaacuauuuuuuuuuuauuauaauuuuaaguuagcuaaaaaguaaaguguccuuaggguucuuuuuauccacccauaauuuugauuaacucuuuccauugaucccuuccucugcccuuacccucuacugaaccuuuccaucucuaguuuuucccugcuucugcuuuuaugucacauaugcauaccaucugaauuaugucgcaugugcucuaucaucuccauuaugucacagugcucuaucaucuccauuaugucacaugugcucuaucaucucuauuauaucucagugcucaccaucuccauuaugucauaugugcucuaucaucgcuguuaugucacagugcucuaucaucuccauuaugucacaugugcucuaucaucgcuguuaugucacagugcucacuaucuccauuaugucacaugugcucuaucaucuccagugugucacacaugcucaccaucucuuuuaugucacacaugcucuaccgucuccauuacaucacaugucuuuauguacaucucuacuccacgcugugcccaauaaaauauuauuuaccuuagauuuuuaucccuuccugucuuccucccugccccccuucccuauuugguuuucuugcuuucuuucucuuuuucuuucucccuccuuuauuauuauuuuuuaugguacuaagaauagaacucagagcuucuauauuaauuaaauaaguguucuacauucaagcuauaucccaagcucccauuuacuuuagauuuugaauugguuuuauaauuuugagacuuuaauuguuaucauuuuuacuuucccuucccuccuuucaaacccuccuaugcacuccuguccacacucuuuucuuaaacucaugaucucuuuuucuuucauugcuguuccauguguguauguguuuaucuaucuauaccuaaauacguaaguucaaucuguuacuuguguguauguuuucugggcugaccauuugugguguuggauaaccaacuccuguauccuucccuggggaagacuguuucugagcauucuucuaguugccuaaaguucuuuaucugauggucucaugaggcuccccuuucauguagcauguauauggaugucauccuuauucagguuauauuuaggcagucagguugaucagacuucauagauguagcuucuaacauuuauaggagacacagucucacaacaaacuccuaauuccaaugccaugacacuuuaauacaacuccuuauguuguagugacccccacucauaaaauuauuuuuguuacuaccucauaacuauaauuuuaccacugcuaugaaucauaauauaaauaucuguaucuuccaguggucuuaggugacccugugaaaaggucauuucaaacccgaggggucacaggccacagguuaagaaccguggcucuagcucuuccauucugucugcuuccgccucuacagugauuccugagccuuggugcaggaguuguguuguaaaugaaucaguugggcaucgcguggagcuuguucuccauguuuccacgucaguguggcuuucuguaaaggucucuguguggugccagggcaucuuucuuugaugaagggugaggacuacaguaucaguggguguaaggacagauauuuagaauguuguuagggcuuguacuaguugaauaaaaugucauuugggcuucauacccacucugaaggauggaaaucauaccuauacuggaaaccuagucagcuacccauggcuaggaaagucauggaucuuggaggggaauccuguuucuuuuuaaugauugaaaccaagccucuguuucaagucagcuacagaaagccugcagacgagugcuuuuuuucuguguguaguuaauuuuaauuguucacucuuagagaauuccagacaucuguacagucuauuuggaucauaguggcccccccccccacccccagcuccucuagaucucuaaaaccacgccuccccuccucccucaugucuucuucccagagucaucuggcucagucacuggcugcuuugugcacuuagguccagggcuaucccuugcaauguggcugucucuugcagcauggcugucccuugcaguggcuguccauacaucuccauagcgugacagacuugcucacccacuucuguccucauguguccuuuacaaucugacuugaucauucagugggcuuuccuuuuacacacaaaaacugcaaccuucuuacuucaucgcuuauggagugacgugaguaucagguagugacaaaggcuggcagagagcucaggagguaacguuuuugccaggugggcaggaaggaccuaagcucagaucccuagcauccacucauaagucugguaggauccagugccugcaaccucagcacuggggaagugggcacagacagugagcucagaagcucacugccagccugcuacgccaaccugugggugucagagucaaaaauaagggugagagcaacugaagaagacaccuaacuuugaccucuggucuucauaugcacagauaugacugaguccuuuuagccauugacuuccauauagaccguaaucucagagcauacaguagaaagagcccuuagcugucaucagagagguugaggauggugucgugccaagcuuggcaugaauccagccauauuccauucaguucacacacucuaacuuauuuuuuuccccucacaggccaccuccaccacaaccgaaaauaucuucucagggaaacuugauuccggcucggcccgcuccugcaccuccuuuauauagcucccucaccugauaguagaauauuagaaucuuauuuuuuaaaugucuucagggaacugagcaaauguuuguuguuuuuuuuuuuccugauguuuucuugaaaagccuuucucuuccaaccaugaaugaacacaaaccaccacaaaacaagcuuuauuaacacaggagccuaguggggauugcgaaacacaggaaugugcaggcgcuccgggggguguaaagugaacguuuccaucguuagaauguuuucucuggccauuuguggauuuaaugcacuugacguggauuaaguuauucugagcauguuacuguaaugauucucaaauuaacuguauuaguguaagcuuugucacuaugcgcuaaacguaauccugacuuuuugaccccaguuaccauuaauaguuucugguugaccauuugaacauguauuaacuuaggaagacuaauugccaauaacgucugcauuuucaucuugcauggauuaacagccauuuauauggacuuaugucucuuaaugcacaaagaagcagauaucucgaaggagcuuacacaagaaccacaauuacuagaucaugauauacuuggaaagugugaaauaugguguguacucaguuauuggcuuccauuuuuuaugaucuuucaacuauaacaauuaugauagaaaucgauuuaacacaaucaguuaugggcuuccauuuucaaauaucuuuucaacuguaaugacuaugacaggaacugauucaacucucaauuuucuuuaugcaucaugguaaagcauugcagcaguguuguuuuguuugaagugcacacucuaugguacgagguguuuaguauacccaagcagauaggugucgaucgaacaggagcagggagaauacuuccaacaguugagguguuaccaaaccacuugagaauucaugagcacuuuaacucuaaacucugaauuucaaagcuugaugugaaguccucuagaauguuuacauuuacuaaggugugcuggguccugucucuuuugacuaauauuuucguaaacauuaggcuggagaaaggaaggaagcagugguuuccuuagauaacuacagaauuauacuggucucugggauuacucucucagcuguauuaaaaugaauuuguacuuugaaaggaaugauauugacacuaaaauuuuaaacauuuaaauuuuuucauaaucuuucauaaagaaguuuaauaauagguauauuaacugaauuucauuaguuuuuuaaaauaauauuguuuguguauauauacauauuaaaauaaaaacauuuacaacaaauaaaauacuugaaauucuugu

SEQ ID NO: 4354 - RNA, 4708 nt, Mus musculus
agaagagauggaugguuguuuauugcaauaagcaucuuugauccauguuuuccagacaggagaaugacucuuucuuggcacagugaaucuugaauuccugucucacagcucuuuuauagccagucgacuuuuguguaaugcuaagugcuuguauacugugcagccugcuggcccacuugcucuuugcuuuauugcacugccuguuaaaugaagucaugcacacaccagguggaacucuagcgucugauaagagccuauacacucacuagugaagagacuuaaaugugauuuuuccccccaguacuuacauuuuucauggaauagaaacugggaauaaagaaauugaaucagaggaugaauuguuggcuaggaauuuccuagguucuagaagaguuuagaagauuagauuuccacccaaaauuuaggguauggcuuuuccacugggcaagauacuauuuccagugccuuuggggucauuucuaucagccuucaaugaacugugcuaccagaaaauuauggccauuuccuacagggagagaggucauggcucauuccuaucuguguaacuuuuaucugcuagguaaauuaacccuguuuuuaauuagaaauuuguagcucuaagagacuaggaggcauuuuuuauuuaagcuaguuagcacucuguguccauaguuaaugcaaaagcaaaaacaggcauaaagcucuccgggugagaggaagcaugcucuuucaaaugugacugugacccugaaucuggugccacacugaagacuucugggcuccgugugugggagcugucccccgacuuugucuggccuugugauccugaugaaaagaaaaccaaacaaaaaucagugggcuucuuucucuuucuguucaugaucuugugugucucccauccccuaaaaaaaaaaaaaaaaaaaaaacuuuuguguguuuugguuuuucaggguucggggauuauuuauuuaggagcgaauaagguuacaaccuacuucaaaagucagugcccuuugucucugguuucagcuuaaaaucuuccccuagaaaauucuuuggcugcucaacagaauugcucaaugugaagaugaggaacgaaugaaaaauaaaucaggaacuccugaagggccucgaacaugcccuggcucaaggaaaugaggucaucuuuuggcguuuaaauugcaaaaucugucugucccucucuuagaaacuguuggcuugguuauuagugcugcaucaacggguccuuacagaaaguugagagguuucgguacacacucugagaucauguuaaacacaaugcgguguauauuaugcaaacaaaggaaaaguacaguuucagugauccuaaccagcccauacaugagacuugcaaguuagaacauuguuaauagcggugcccagaaaauauaauuaucuuugugaagccucaaaacauuuaaagucucaauucuuguuucagaauuccccuucugucuguauuuacacacauacacacacccuuuaaauuuguuuuuugcuagagucuugcuacggaguccaggcuggcuuugaacugauaauccuccugccucagccuccugagugcuuggauuacaagucuaugccaccauauccagccuaggacaguauuuuaaugugagccaaagauggugcauaaaccuuuaguuuucaaggugugauggcguguggguuugugguuaagcauagauuguggauaaauccgaagggauuucuggauuauaaaagauacugcauuuccuguguggaauaaaagcagucucugggguuggguccuucuauaaagcuucgaagguauuguucucuguagcugaaguauguccuauccauuacucuucaaugcuuugguggacuugcuuacucgggucaggugauaaucaggggaaaaaaaaaaaaaagaagcguguguuuuucauucuccgaaccacaccgaggauaugggagaccgcaaacuaaaguggcaccucuggucaaaguggcggagugacagcucuacuuccaaguagaaggcugccccuccgggaagauuuaagguccaucguccuaguuuacuggaagcaaacugguuugguuugguuuuccccuuucuacacaggacuuauaugacccucugaguaagcaguggacugguaauugagcgguagacuugauacuuguuuucagugucaaccaaauaaacagcuaucugguagcagacggcaguguuuuugaaauuaggcuucccaugucgccuguuuaaccuccucccccacccccaccccccaaaaucuguuuuccucagucccucguucucucucuguguuauugccugccugagucaauuauagucacuuauaccagguaggcguugaaucaagugaauauuuggcaaaaacacacagugugacugcugggcccucuguuuaugaagguguggcaugccccguuugagccaguguuugagccgugaaacaccuccugcaagcacugagcuuagugcauggaaacuccagcuucuuacguugugugagcuccuaauugguauguagcaaaacgucauuuucuaaaaacugguugguugcuuguuuuguaauaaaaacaugugaaauaggaaaucugguuguguguuuuccuggucagaucucguggccguggguggguggucacguuucucccuugccccaagacugguuuuugaguggaccccucccuucauggcuuugggguggguggcccuuguccugggauggcauggguggugggugauauauggguguguguguguagaagugagccagacucugaccuuuauaaaguccgaaggcuggcugaggcagcauccaggccaggaaaaacagucgaaucgacgaggucagggagcaagaugagcuuccagcgguugugggcugugcgaacacaguuucuccugcugugguugcugcuaccagccgugccuguuccgugggccgaggccaggagguccagagucucgcugcccugucccgaugccugcgaucccacgcgcugcccgacucugccuaccugcucggccggcuuggcgccgguucccgaucgcugcggcugcugccgagugugcgccgcggccgagggccaggaguguggcggggcgcggggccggccgugcgccccaaggcugcgcugcggcgccccguucucccgggaucccucggggggcgcguggcugggcaccugcggcugcgcggagggugcugaggaugcgguagugugcggcagcgaugggcgcaccuaccccagccuaugugcgcuccgcaaggagaaccgagccgcucgccagcggggcgcgcucccggcugugccagugcagaagggugccugcgaggaagcaggugagcggggcgcgggcgaaucuccugacacuucucuuacuuuucagagggagaugaagugagugcucuaacuucgcucgcucgcgaauucagugggccuuccuucgccaucucuagggauucaaccuguugugguuguuccugguguucuugccugguuaauuuuggucucuuuacuggcugccacugggcuucccuuucuccuuuucuucccucugguaggacagggaggguccuuucaucuccuggucuggagaaccuucagagaaagagggacggggagaugcuggggaauuuugagaugcgacaccugcauccagggacgcacucaccguggaccguuuauucacagggaccacaagagcagggcggcuccggagaaaguacaacuucaucgccgcagugguggagaagguggcgccgucugugguccacuugcagcuguuccgcagguaaaggucccaucuaggaucaacuaccucaccugcugguugccagauuucugaccauuaaaaccgcugugaggaaacacagauucaaagaguuggcugggguguaggugggcaguagaauuccgcaaagccugcaggagaccugacuugcuaagaguuauuucgcuaaagagcaaagagccaagcgcaaggauucuggcuucuaaauugaagcuacagcagugcguauuggugacugguguuucuuucuccccgguaucccacagcaaaacuaaaggcugacuguaggagcuaguagugagcauuuggugggcuuguuuagccuuagcacucgcuugcaugcaaggaaacccaaauggagagcaaacuuaguuuguucugagucacaacgccaguugguagugggaacuaagagcuagauucugaggcuguggcaguagugugagcacaggguuagcaccagguuuggccuguucgcugcagaugacagacacacagguucccacacugaucuaaaggaggagacaccauccuggacccagaucucaguuguguucagaaaagauggccaggacgagcuucaggcagcucacaaagcacauggaaguggguaaggcaagaguaaaugcaugagaaaacuggaaacguagcugauaaacgugaggcuuccugcgacucacacacaaaggcuggauucccugauuucccucccuucugcucacgcuacugacuuguuccggaacagaucaccucucaccaaccaggaaaucccuuccuccagcggcucuggguucauagugucugaggaugggcucauugucaccaaugcccacguccucaccaaccagcagaagauccagguagagcuccagagcggggcccgguaug

SEQ ID NO: 4355 - RNA, 63405 nt, Mus musculus
cgugcuccaagaagggccaggcaagcugggucagggcguuggcgacccucuuagcuccggggggugcacuuuagaccgcagggggcgaugcguuccucucuccaccccuaaacucccaacgcccccucgcccuccgggcagccgcgguuugggccggcugcacagugcgcagaaguaggcucgggacgugacggucgagcaccccaucgcggacaccugcugcagccggguuacaucccaccaaccuccucccccccgccaucccccgcugcuguccccucgaggucuccgcaccccucuccuccccccuggaggcccgaggagcauuguacucacauccggggcuggguuuugcuuuaaugugaaacgaaauuaacccggaaaaaaagagucgagagacggccuuggaggacagcugaggauaagggagaagugugccgcaggacaggcgggaagcgaagccccgaggcgcagagcucugggacccgaugcgacccuugcugcgcagagcgcggugagucgggcagagaggcgcaaggguccgggcgcggagggcagagaggggagcagggcggcuggguuugcuugguggcgccaguccgggugguggacggcgaccggagguggcccaaugggccaccuccccuagcucccaggaaagccccaaaugcagccccuccuccagugcacuggcgccuccugggugaccaaggucgccaccgccaggggucgggcugugggguggggcgugugggggcgguguccuguggagcugcagauucucacguuugcagcggcgaaacuucuccgagguucaagcacaggggugguagccccucaaggacugcccgggcagcggguaggggaggagcgcagagaacgucccaggcaagucccucaggcacgaguuggguguuggagccucuuccuucuccuucucacuccuuuuuaacuuggcgcgggccuagaaugcuacccuggggagacuccuccuuucgucugcucccgccaugggcuucugggauuccuggcaauggaggugacuugguggaaaacguaggucgguuccagguuagguaacccuuucgaggggaagccucaaaaggcuguccccuuuaacguccgcgcuucccuguucugcucagccauggagacuuaaaauuuaaaaggaaaagaaaagaagaaaggagagauggggccaggucgugugggaagggaaaaaaaguaucagggcaugaccagggcacccuuguacaccuucugcccugggcagcccugccccgagucuuucaccuuuaaggcuuccuuccuucgugaacaucuuccguuuguacuccuucugucccugauuggacucaauuaagaguuuuucagaggcgcauaaacacuagaggaggagcaggggagaacgaaccaguugcggcuccugggagcauuuugguuugcaguagaggcugaaguuccaaaauugugcuaguguucuuaaugucuuugauuagcugucccccaucccccacucuuucuuuguugccucccacuccuccacccccccaccccccuccaggaggaguauaacgcuuccagcaacagcuaagcagaagacacaggaaggguagaaguuuuaucuucaacuugguugcaucuagugacuuguuaauaauaaugauaauaacuugguaauaagaacguacugaguuagcagugggccagcagcucaccgggucuuuagggaguugucagacuagugaaggacccuggcugugcagagcaucaaacuggagucccugguguuuggagaagccagaggaggauuucugaagcauaaucaguggccuuggcagaguuuagcuuucccugggugcugccugaggcaggguucuaagaagaguagaguuuguugagcaaaugaaugaaagcuaucacugagaagaaacagaagaaagguggggccucagguugugucaggcaacguuucucuagcuauugucuuuagacugaugaguccuuuggcuguaucugcagaugucuuuuuacagauuacugguacccuuaguggaguuuuagcuggcuuacaugggagucuuaccuaccucuuaacuggcgaauuucuacccgggaucaauuugggaacugccuguccuuugguggagagauggcacacccuucucuucccuuacauuagugcuugcugcuucucccuugugugaaaggaaguagggccugcaaccucccucaugucaucccagugacgugaagagagcucagaucucuugggauugggguuuuuauugagggacacaauccauccuggacacacacaggguuugguuguuggcugcugcugaagcaacucugcagaugugggaaagggacagcagaauguaucuccagauagagagcuugccuugcaaagcccccccucaccugacccccccuacccuccagccccagagggggugagggagggagacaaguguuagcuggcccaccaaaccccaggagagcagcaguccugcacuugcucccaggugugugcuacaacacuagacgaccaaggagcaggaacacggccaugugugcaucccgcugauacuuccucgagucgauacaggugcacaucugggcgaugucccuguggccggcuagauggcucagauugaacuggauguagacugcugacgcuuuuugggucucagaaagcaaggaggcuuucuuuauucuguccccuccagggggccuugguugcuaggaguuugggcugggcacagcgcuccccuugugagaucucuccuccaugaacaguuugggcagucuuacuuucacuuucuugucugucuugguuuaagcgggauaggacucagcaaucuaaucugcuaggcuuuggaaaggaaggaagcagaacaaacauuauugcagugugacaggcuguggggagagaaaaaccccugcccugcccagcagaagccaguaaccaagagaaaggauuggcuagacugggaagaugggcaccauccuuugggggauuguaucuggaagaccuuugauccaaaucuuggcucccagaaucucaaaacacaugcuuucccaucgaacacacagguuuaaacagccccuuugccuccccauuccuuggcccgggguuuacugguuagcaguuaagaauuuccaacacauuauuuauuuaagucgucagagugauugucucuguugcaaaugaggaaacaaguucaggagagcccagcgguuuguccauguuugaacccagguucucuucacucuaaacccuuuaaagcuuccugugcuauggggaugggugauggaggucggcugauucuuuuuugguggucauggaucucucucucucucucucucucucucucucucucucucucucucucucucucugcaaaaguuugaaacuacaaauauugauccuugccaccugcuuaucuaagccucgccacacccagccuuucuuccuucccuaaaucuagagacaggguuugaacagacagacacacguaggccauaguguacacuuugcaggagggcaggcgagagaggggaaacacguaacuaugggugccuuccuucucaugugcagucccggaggaagauccccccaaccccccaccucuaccccucccacccccacccugccugcagugagccuguugcuuagugucuucugaguaggggggcuuucagguucugagcucuguggagcucagcuucuccaggcuauuuauaucccagauguggccgccugccugccugccugccugccugccugccuucucgcucaaggaccuuucugggaaggugaucugaugagccuuuauuucuugccugcggccccuccaacuguguuuucucccaauguagaugagaggagagguccagaagguuucagauaucucauugguguugucuucuuuugucuuccuuccaaucaauguucuuguccuuuaaauuuuucucccuggcucuguaucuuccuccucccccaaaauccugggauccagaggaggucaggcugucugagggucaaacuggcagcccucuuucugaaccuccccauuccugaagauguuugcauuccucacccaggcuuccgcuggggacacaggacccggggucgguacauucccuucucuucaggguuacuccuccuccagccacaguuuggaauuugcucuagugaccaaugcaaaaugugaggacacuguggcuggauucuggaaacucucgggcucugucuacccuguggccgggcuaagggauuaccuccagaguggcugugcugugugcucuuguuuucccagggccauuagcauuuauuuuugaggcuuuaccgaucugugggcacacuguauaugaaggcggcaugaucgugacugcugcucuuaccuccacacccagguccugucugagaccucugaugucauuuccuguacacuuucuccuuaugaguuuaacagauccaggucagagucuucacuacugccacuggggcugucucuccagaucuucugcucuuggaggacaaaaggggaggcaaauccagaaccaccaucuaagcucuuacuaguuauaauucuagaaaguuccugucuuauuaacauggacuaaugugagagaaaucucuaaauaugaacaaaaaaaagaaucuuaaaaaaugcauuuucuuacugaaacauuuuaaauacguuuacauguguguguauguguguuugugugugugugugcaugcccaaguguguguguguguguguggaauaggggcauguccacauuggcaaguauucuacagauaagcuacucucuggcccaaaccauaauuuuguuguuguuguugagaauuuuauucaugcaucuguguuuuguuuugaucaaauccauucccuucccuuuaauuccucccccucuuccccaacuucaucacacacccucaccccacccccaccaacugaauucacuucaugccgccugcaugcccaugaauguagagagcccuuuacuggagcauggguuagccuuucaguuauggcuacucccauaggauucaugccacaguuauaguagugggcauaucuuaccaggucagccauuguuguagcgaguaggguucacacugaguaagacugucggauacuuuucuuuucuagcaucaguagaaccuucuggaaaguuagccaguaaggaugaagcuuccagcuugauuuguccacauucuaugacucagguccauaguccuuuuuagcaauagguuugaaccaucaaguucuggagucaacaaagagcaucagccauggcuuguaaugucuacagggaccucauugaccaacaacuccaaagugauaacuuacaccugauguguguguauguauguacguguguguguguguguguguguguauguguguauauauauaaauauugcuauacuauggugucugagaggcauuaucucuguuauagggaaguuccuuuuaaacuguguguguguguggggggugcauacuuguguauuuuaggaaacuucuuuaguccuggccagcugccucuugcaucaucuaauaacucuauagcuuuguuucuuucgagacaaugucucauguagcccaggcuggccucagacucaauauacaguagaggaugacuuggaauuuuucaucuuccugccuccaccuccugagugcugggauuacaaaugugcuccuucaugccugguuccugugguguaggguugcaugguaggcaagcacucagccaacugagggacaucucuagcucucuguaaaauuuuauuuagaauguuggauugucuguccaccuuuucuuuggcuuguucagcugaauauuugauuaaagauuuuuagauugguuuauuuauguauaugaaugguuuugcuuucgugccugugggauucccuggaacucagguuuuacgugcuaaugggcggucauguaucuaaguuaggguuucuguuguugugaagagacaccaugaccauggcaacucuuuuuuuuuuuuuugguuuucaagacaggguuucucuggcucuggcugucuuggaacucacuuuguagaccaggcuggccucaaacucagaaaucugccugccucugccucccaagugcugggauuaaaggcgugagccacuaugcccggcccauggcaacucuuauaugggaaaccauuuaauugaggcuggccugcaguuucagagguucaguucagaacugaacauagugggacauggugcugugcaggcagacauggugcuggagaaggagcugagaucuugaucucuaggaagcaggagucugugagccacaccggccauagcuugagcauaugagaccucaaaaccugucccgacagugacacacuuuuuccaacaagaccacaccuaauagugcuacuuccuaugggccaagcauucaaacagaggaguccauggggccauuccuauucaaaccaccauaccacgucagugcugguaaccaaguccucugaaagagggacacguguucuuaaccaccgagcaagcuuuccagccccaguuuauuugauuuuaaaguuaauuugucagccagguuggccccaaucucuugcaucaguccucaguuucccuaguagcuaagacugcaggugcacucaucauaucugggcaguuuuuauuugauuauaguugguuuuuuguuuuuguuuuuuguuuuuggcaaggucucauguagcccaggcuggccucaaacuuacuauguagcugaggaugacuuuggucuuccagcgucugccuccaaguucugggaugauacacaagccccauuaugucugaucauuuacuuuguuauaucauuauuguaaugugugugugugcaugcucccuuauguagaugcauguaugugagugccuauauggagguaagaggacaaucucaagcauuagcauccuucaggcaucuuccauccuuccguuuuguguuugagacugggucucucgaugccuagaacuucgcagaguaagccaggcuagcuggucagugcaugugugggaucccccaucuccacuucauccagguugugauuacaagugagcagcuccauacuccaauuuuuuuucuuuucuuuucuucugagacaggguuucucuguguagcccuggcuguccuggaacucacuuuguagaccaggcugaccucgaacucagaaaucugccugucucugcuuccuaagugcugggauuaaaggugugcgccaccacugcccggccacacccaaauuuuuaucugguucucggaauacuaacaacaggccaccagaagaacagccauuuuuccuuguuaaaacuuuggaaagagcuggggagauuuuuauguggaucuugaacuuauaaguaugcaacacuugugagacaagcacuguuaaccacuaagccauucccucaacuuuacccguuuaucaacuccacuuccauauuucauaucuguguauguugacuguguguuacaugugugugggucauggguguguguugcauguguauuuacuggauguguguguguguauguguguguugcacggguauguguguagaccagaggucaaccugaauguuguuccuuggaugccauacaucucagauuuuuguuauguuguugauucauuuuuauucauuuucauguagcccaggcuggccucaagcugugagugaacauguguguguucauuuuuauguuuuguuacuugcauguuugucugggugccagaaguucacaauggguuucuucccuauuguucucuacuuuauuuuauuuuauuuuauuuuauuuuauuuuauuuuauuuuauuuuuauuaugagcucuggagccuggagcucgcuaagcuggcugaccagcaagucccaauauaugcuugucuguccccaacccuggggcuuggguugcagaugugaacuuccacacaagcuguacaucagugcugggguccaaaucauacuuacauagcaagugcuuuacccacugagccaucuccccagcucuacccacugagccaucaucuccccagcuccaccuucuguuuugagacugggucucuuauagggaccugcagcucacuaacuugguagguuggcugggcagggagcuggggcaugccugcaccucuucaccacugcugggacuagaggcguacaccaccacaacccguauuuuaagguuagaagauugagcucaucugcucacaucauaaggacugugcuguccaugccguugccccagcccgcucccaauuuaacaaggaaaacccaucgugcuuaugguggcuuuuggauguuuuuugcugugagucaagcccaguuuggccuggaccucagagcaauccuccugucucaguugcccaagugcugggagugcagucaugacucaccacaccugacucccuaggggcucguacgaggcuucccaguuccucucuucagaacaguggucagguauggaucaagauauuauaacaaaggcauaguccuuaguguuugcuuagacccaaggacguggacgcuccuaagaugacuacagaauaaaccagcuggggaauaaugagccucuaagaguccuuggcaguaggaaacaagaaacccaacuuuaaggguggagggagcguacccuuacagccggugucuggcuuugggugacuaagauacugauuuauuagacuggaguccaugaagcgcggaaaagcuucaggagaggugugcuuagcugacguuguguuucugcacuacaggggcuggagaggcucaaauccugcugcugggauuacccggcuuucuccucuaaauaaaguaaugcauaucuauuauagaacauguagacaacuguauacaagacuguauacacgcacgugcacgcgcacacacacacacacacacacacacacacacacacacacacacacacacacgugcauguguacggacacacacgugcacacacacaugagugcacacauacacacacacuuguacacacaccugcccgugugcccacacucacacauauagguagacauaugugugcacgcacacgugcacacacacaaacaugcacacaugcacacacacacagcaccccagaagaaauuacuugaaggcaguguauuuuuuuuuaacaguuguucaauaucuuuaauauacuugagugucuccgaauugaauuauuuauuacuugaucaucuggcuguuuggauuguuuucaacuauuuuguuacaaguuuaaaugcaguuuucaucuuucugcuucugucuguuuauuuggauagaauccuaaaacuagaaauacugggucaaagagcaggaacauuuuuagcugucuuguuccauacugccaaaaugcuuuucagaaaggucccagguguauaaaaauccuaggaccucccaccccgccccacccaagagagugauaucuguuuugagcucaaccuuccuggugccucugucuacccuccaggguguggucuacuuucuuaaggcucugaugcaucugucucuauuaggaugcaggccuauuaaaguuuaaaauuucuggguuagccuaccuagugguugaagaaauauuuuuggguaggagccucuggagaccucucauaacagggugaaaugggcggccuaggacuaucacaagugugucucacugccuagcaaguccuggucaggaauuccaguugaauggccaguuagccuacuucauucugcuuguuagucagcaacccagggaacucacucucucuaauuuuuacuuaaaacauuauuaaauuaauuaauuaacugauuaauuaauuaauuaauuaauuauuaaauucagggucuacaugaauaaacuacauagcccagacuggccuuggacucacagagaucugccugguucuaucucccaacuucuaggauuagaggcaugugccauuuuucaugcuagugugaacuauauacccuauuuccauuuauugcaaugcuaagaacuuaaauucuaccgaacaucuagaucagcauggaauucccugcuuagggaggccucuuugcugcucuuuaggcugagacaggugggucgguggugguugagggauugggggugggggugggagugaguguggauuggucaaagguuuaaaaugcauaaaauaagaaaccaaucugagcguucacccucaccagucgccauacauuucaaaguaggaacaguugucaaguagugagaacuucagugcauggaagaguacagccagauauggugguauaggcccacggccacgcaagccuuucaucccaacagaggcagggcaaucucugagaguuaauaacaacaugcuuuucauagugaguuucagcccagccaagucuacacagugagaaucucacuuaaaaaaaagucuaauaaugguaacaagaauugguuaucaguugcaacaaagauguuuagagagugaguuuauaauagguuucaauaaugcuaaauaaucacauagccuguguucuaaucacauuacccuuaaaaaauaaucuauuugcuuuuacuguguauauauuaaaaugugucuugcccgcauguaaguaugcaccacauggcgacugggaucuggauaguugggagcugccauguugauguuggaaaguaagaacagcgagcauucuuaagcauggaccauuuucuauuccccauauuauuaucuuuaacguguccuuuuuuccaugucaaaaaauggagaaaaaaaauauauggaaauauauacauauauauauauaauauaaaacagaaauaaaguuuugguauuauuuauaauagaaaucuggcucuagauucacuugcuuaguacuugaaaaaugauuagguaaaccauacuguaauccauacauuaauguacagaaaucauuaaaaauaguauugaugagcaagcgggauaguuauaacaauguuuccauguuugaguguccagccgccgccggcucccucccacaguuuuggugagcugugugacucagcugccuuaggcauccggggaccuccucccccucggccccccccccccaucaccacaguuuauucugcauguuguguacagagcucugcuuccgaucuuuccuucuggugcacggaagucccacccaguggauccaauccauacgcaugggcagucccucagcagaaggcgcguucuggagaaagaagccuuccccagccucuagcuugagggagaagcagaacugguaaauccugcaggcugaaaaggggaacuuugaaagccagcauucuuggacacuacacugcccagcuugccuuaagccaguuggcuuuguucacccuggcagcggaguguguucucuuggacguuacacugauagcagggcaugguggcucgggcauguaauccuagcucuugggaggcugaggcaggaggaucaucaagaguuagagaccagccugggcuguauuagcugagccagggcuguacagugagacucuguuucagauaaaagcugggagagauuucacuggcauagccagagcccuguggccucugggguuucuucuuccagagcuaugugggcgucugugggugggugucucuccuguccucacccaaagguucuguaccuuuccaugcucgguggcuugucuuucaacuucagaucccugcuccuugaacaggccacauguauucccaggcauucacagccucucgggccuucuucuacccaugacccagcgugugcugggccgacuccugaaagcgucuccuaacacuuggcuuuuuuauuucucagaacuuaaacuugcuccacuuugagacuggcgcuggggaacacuucaagaguaggugacaucacuuugugcagggugccccuccuccacccuccauggcccccacuucugcuacacaguuagcuuccuuuucaaaaccuccucuuccuacuuuggaucccuuucucaccuccucuuccgcuuccuuuuuugcuauggugggcuguucuuagcuguuugucugucuacuuuauucuucucaucucugcauuccuuaugaguggucaugagaucuccagauguccgcagcuucugucccucuuuggaauuggccagcacaugucugaacuggaauaucucuguggugugugugugugugugugugugguguguguguggugugugugugguguguguguguggugugugugugugugugguguguguguguguggugugugugugguguguguggugugugugugguguguguguggugugugugguguguguguguguguguguggugugugugguguguguguguggugugugugugguguguguggugugugugugguguguaugugguguguguguggugugugugugguguguauguggugugugugugguguguguguguguguguguguauguauguauguauguggcucuuguuucuuggugcacugcaggcucauuggaauguuagugaacaccccaccccaucagccaucacuuuuggagcaagccuggccugaaaauguguucccugcuaccugggucuuuguccccacugggcuuggaaggcugggguaguaguuucucagaaucuguguugggucauagggcaccuucaucagccaccucaaacuuuugcuuggcugcagagcuucuguggcuggggccaugguaaguccuguucugcugaagugagucagagcucagugguuggauguuaucuggcuuuggaagucugaaggugauauaacccuuugcaguccuguggggcuucuaaccuacuuccucauggcccaucaguccagaccagugucuuagcuauuucucuccucugagggcucuggggcucucccccuuuccuguaggcucuuagaguacaugcuggaaagaugaaguagccaggaccuguggcuauucucaaaucuccagaggcccuguucuggagugagggaagguccuccggguuuaggacuugcgauggcuacuuucuguuccuucccagcguggaacugagaugagucaagccaggugaggcuuagccagggauaaagcuugcuucauccucuuccucacuagcccccuucccucucccacacaggaugcuaugagcagagcccaggauuaugcacuaugcugaucugcaaacuccuuugguagcuguaggcauuugguagcuguaggaguagacuuggguugucauggccaaguaccacagccugagaacuugaacaguggaaaauuuauuuucuuacagucuggaggccagaagaacaagaucagggaugugucaggccuuucuccuucacuagaagauggguucuucaggaaccuaucacaguagcguuuaauccucggguacuccagcuucuuuaugucugaauucuuggguguguuuuauuguuguuguuguuguuuuuguuuguuuuguuuuguuugggagggaucuuccgggagagugucuccaugugugaagugaguuacuaucacuuccugaggcuuuguaaagaguaguaacuaguaaccaggaagugguucuuguaugccuccaacuuaacucacagcaaaaaaaaaaaaauccuguaaggggugguaccauaauuagucccacuucacagucauggaaaccgcgguguagaaagauuaagaaguaauuagugauggcacaggauaccaacuaaguugagccucuugauacacgagcacauacuagugcauaacgaagcuaauauccccuaggucacuaugcucagcacacaguagggccucaggaaaauuagccgaguggauucuaauggguuucaaugacuguuuagaguugguauacguuuccaggguccagugggguagacauuugguguccauggaagaaagcugguggcaaggagccuagcaugucacagagaugagucaaaccagggacaggugaggcuccuccaggcccucagacagggccugcuuuccccuccuucucacccagucucucccuccuauggugcagggugaugugaacagagcccaggaaugccuuauguggaucggcagaaccgaaucuguggguuucuggauauugaagacaaugagaacaguggcaaauuccuccggagauacuuuauccuggauacccaggccaacugccuccucugguacauggacaauccccaggugagaagccagaggggaaggggacagggcgacugcccuacccucugucacagcugggaggggagcggggcuuggguuucucucaagggaccucuguaagaaguaagagaccuuccgacacacaccagcaugcacacauguacaucugugaggagaacuuacuccaaagcuggcggggguggggguggagguagcggugggugggggagggugcucaguaaugugugaguuuaacagguacaagaaucuugauuuaauccagaguaggguguguuccauugggggaaagaagagagagggagaggagagcugaggagcagaucugggggagacggagucucuuagcucuagaucuguuuuucuuguacacaggaauuuaauacuuggggaaagucgggcagagucuuccggaccugacucgcuuccucucaccuccucggggcuguggccuaaugacugcuccugcucuuccagucuggggccccucccuagcagagaaugugaucugcuucccugaccuggacaauauuggacuucucuggucuccugaaucaggaagucagggaguuuuucgguuggcaaugaaugaccuucuaggucaccugguauagcuuccucaugcugcagaggcguccuggacguugcaaucuaccccuaggcaaagagaagugacugccuauuaucuucuggagaccaggcacaaagaugaggaaccaaguucucugucucucugucucucugucucucugucucucucucuccccucccucuacucuuuuuuuuuuuuuuuuuuuuuuuuuuuuugagacagggauucuuuauguagcccuggcuguuuuggaacacacaauguagaccaggcuggccucaaacucacagagaucuaucugccuuccucugcccccagagccuuaggaucaaagcugugugccacuaugccucuccuguccuguuuuacugcuaugccuuggcagaggugggguuuuuggugacugguaaugauuagucuuugggaacuuggaacuuucucuuuuuccaccgagagcugucacguuccuccuuucagcugguccacagcaguuucaugggaagcgaggcugugaagaacgguaugcaccugaaccgcauagugacagaacguggcuguacauggauaggcaugaauguugggggaggggcuugggucuguucaaaggcugaagggaauagccuugguguuagggauuggauaugugcuuuaagaugugagcuggaggguugacaagaugggucagugggugaaagugcucauuguuaagccuaugacccgaguuaaauccucaggguccacaugguggaaggagagaagcaacacuggucucugaaugccacaugcuuuguacuuguuuguaagcccccccccccccccauguucguccaccacaugaaugcaaacaaaaccaauguuuuuaaaaaagacaugcugugggcuggagagauagcucagugguuaagagcacugacugcucuuccaaagguccugaguucaauucccaguaacuacaugguggcucacaaaccaucuacaaugggaucugaugcuucuggugugucuaaagacagcgacaguguacucauguaaauaaaauaaaucucuuauuaaaaaaaaaaaaagacaugauauaggaaaagccaugugaccccccuggucauuacccgcaugcuagccuguugugggucuuugcugcuuauguuuuggguuugagagcugaaugaaaauacuauagacgcagaaaacauguaaagggggucaugugcuguguacugccugcuccaggaagaaugggacccuccaaacaaccaugcucacaucucaucccaugucuccaauaaggcagcugucgacuugcacuuaacgcugaacaucuggacucgaucgacccuuuguagagagaggcugcuguguccucugguugccuccuaccacccucaagucuugcucugccuucuggcuugcuugucacucuccugaggacuuucauccugauuuacugacuuuaugcuguucccuguguuugugcuguccugaaccaagacucacuuucuugggggagcccugcccugcugcuggcaaguucugauuuguaccucucaaccaaccugccuuuuguuuacauauauguaugugugugucgugcauguauaugugugugugugugugugugugugugugugugugugugugugugugugguagaggggugggggaagacguaugaauuugaggccagacuucgaugccgcuuuuccuugauugcucucuaccuuguauacugggguagagucucucccuuaaacccagggcucagucauuuugcuagacuaacuagucuaccugccuucgagaaccccuguuuuggccuccaggguacuugcuuacaggcagccaguacgcaugcccggcauuuacacagguccugggaaucugaacuuugguccucagguuuggguggcaagugcuguacccacugaacuacauacccaacuggacccuuugcucauacucugagccacagagagucuugcucucaaucaagaggugucaaccaugauguccucaucuugggucuugaauauugccagcucuuaggauucccucauuguaacccaccuucugacuugauugucucauagaccuggaaccuggauuuaccagcaauacauugcaugccuacuuuccuggcucuugggacugccccugcacuaguguccacccugcccagggcagccuucuuuccuuucugcuggagggcucuuugguugucauucuuccuggaagcaggagagcacaaccagaugggucuugcuaugacagugauggauggcucagaacaccucuucaguuccuguguuaguuauuggucauguugauggccaagcaaucuuuccagauuugggugaagugugguuaccaugccauguccaacucucugggcuuuugucucacucuagaggaaaggggugggcauggaaggugucuuguccucauucuggaagcaaggaagguggugugugugugugugugcgcgcaugugugacaugcccaguguuauaagccuguuagucugacucccguaccccugccuuugcuacucacaauaagccggcuaucuugagguggcuuugcgaggaagaaaagccuguaaaugaaguuucugguuaagcaagagaaggggaggauacaguugggagguggcagagcucacaugcucgagaugagcgacaugucugggguuggaugaacauguacuccaugcaucagugaaugaauaggagacugagagggaggggcagugaaugaagcugccugagaacugccuuagagagggaggggcuugauguugcucuccugggaguaggaacagaauucaaacccaggauaagcuacagccuggggcucccuggggauguuggccuguucuuguggagagccacaagaacaagggcacaguuugagggcccuguaauaucacucagccucgacaaucuggccaugggaugcaaugacuuucuuuuauagggaaagggggauucuugacgugguauuagaaugauuuagcuagcauuaaugaaguuuucagaacccaggagucugaucaccucccguuugaaugccugcauaucuugucuugaugagccugucucaacucuaccccuguuuccuccauugcuguugccauugaccucagucucuguuuccugagggcucacuggacaccaggcauccugugaggugcuuugugcaucucaguaaagccccugccuaaucgugagcccuugggacugaaauuccuuaauucaguguugagcaggcuggaaauguggcugcgguaaagcugaaguccuugauauucuucacuucugucuucucucucuccuucugagaguuuacuggcuccuggagauggguggggaaggugaaucaacaaugucucugcuucuaggaaguuucaaguugaggaaauagaaaugacaugcacaaccccucaaagccguaguaauguuaagccaucaggacaagacaucgcaccguucauugcuggugccagugccuagauaccaggguuuugguuggagaagacgcuguaguuuuccauuucuauugcuucuugaggaagagagaacacuaggagguggagucucauauggaaacuucucaggucugauagacaggagagcaaggcugcaaucuuggcccaucuucucaggugacugguguuuuaagcaaguccuuucuauucugaagcuuagugauguuaccuaacacguaugugcugaacuaacacauguaugucuaauguguuagaugccgaaguauagagacaccauaguaagcaagacagacuccccuccaucuccugugaguagggagauggaugaucacauagaauuggggagagaugguugagagccauaucuucaugggagaaguaguacuagauugucaucuuuuaauuuucuuaagccuuuuuuggaggcaguaucuuauacuauguaacccaggcuagacuugaauugacaaaucucuuacuuccauuuccugaguuuugggaugacgggcauaugccgccauacccaacugugggcagauuguggaggcugggugauauuagaggaaucauuacuauacauuauucagguuugaggaacauuuauuuuugacaucuuuuuauguacaaagucuuauuuagcuguugugccacuuugaccuauucagaguugaagaggaaugggagauagccauuauggggacauaggagugcaugugagguuaccuagcuaaaggauugcuuucgguuaggggcccccagaagaagugcuuaugaugagcaaccagguacccagacaaagauuuguagacaauucuucuuuaaagagaugcuuccucgggacuuccuagaagugaugggggcagcccuggcugagaaaggaggaaguuccucagggcugaguacuuaggugggagucagaagggaaggcucagccuggccuugagggagcucuugcugaguuaggcuuuaggguugucuggcucguauaugucuguacugacuaccggugaccacagcucugcaaauacagucagaauggcuucuaggaacccauggccaguccccuaagcauagugaagggaaacacaggagacuggccacagcaucugauggggggaccugaggaagagggaucugaacacaagagggccuagcugcagcuuugaacggcaguguuuugcaucaaugcgagguaaggaguuaagguuucaaucacagauauugguggcgguaaacuaaggauagaauccaauagguaaaacaguugcuaaguggaaaguaccaauguuauugauuagacaacugaauuggcuaauuuguuuaaaaauccaguaugcuggcaauaucaagcaagcaaaccaauaauucuuuuguuauugcaguaaucaucuuuagcaucuuuaagaaguuaggguauuuauaaaugcauaauagcauacugucaacucuagguacagaauaacaauauagaacuuacaggauaacaacucucucuaaaauccagucaucuugcaaacaaacaauaguguuuuuuuuuguuuuuuguuuguuuuguuuuguuugcuuaauguuuucagugcuagggguugaacccuggcucucgugccuguuaggcaaguguucuuccacugaacaccuuguaguuguuuugagacaagaucuugcuaaauugcccaggcaggacugaauuuguguuucucuugccuuaggcuccugaguugagcugcuggauuauaggcaagcaccaguguaucaccacgcuuggccaaugguuuuugaaacacugcccaaauuuccuucaagucaugauacuugcagagguguguguguguguguguguguguguguguauguguguguaaaugugugagugcaugugugcuauauguuguguauguguguaaaugugugaguguguguguuauauguuuuguguguguguguguguguguguguguguguguguguguguguguguguguuaguagugcuggaaauuaaaccaguacuuggcagauguuggguaaauaccauaccacugagcuacacucgggccuugacaguuuuccuuuuaacugaguguuggucccuaucacgauggagcagauagaacacuuaugggacugcucuacucuguagugaccuguggaugcagaccuggguuuugguugcucagccacacugguguucagcacugccagcauccacacacaggguuaauugcaaguucacauuguauggcucugaauaaguguaaaccaaagcauggacacgaugugacauuugaugguggcuuucgucaagauuccucaguagaguguaauuuuucuucuuguccaaaaaaauuuuuuuucaauacacuucuuuuacacaagccaacaugugaauuauggaucauuauaauauccuaaaagaucucaucucuccuagcaaaugugcgagcccaaugaaagacauuugcuuuguuuaaaaaccaaccaaccaaccaaccaaccaaccaaccaaccaaccaaccaaagacugaaaauaggucuuuucauuggccaugcaaagaacacaguguucacaguaggauggauacugggcucaucucaauggaaaggcuacagagugaggggaagaguguauuaauauguaccuuauaacaacguuaugauauauaaauauguaccuuauaauguuaugauauauaauggcauuguugccacaaagacuuagugaaaacaguuaagagcgauguuuuuacaucagaaacuuccuuuggaaaaguuugggcucuaucaguacuuuaauggcuucugcaucguuggcuccagcccgggcaaaugccaagaaccaggaaguaacuucauugaaaaugggcaaugccuucaccuggugcaaacuuaguguagaaaagaggagacaguagcaacaucucugcccucugucccugucccccagcuacagccucuuagcaggcagcaacaggacagcucuccccagugucuacuuaccaagcccacacauggacaggcaucuuguaaccuucaacucuuucucaauugguuugggaaagucuucuuuuuaauagucuuaaauuuuuuuuuucuuaaaucuuaguuuguguuuuuuuuuuuuuaaagauagauggacuuucugugguugauaacugacuauauaugugccuuaguuacuuucuuauugcuauaacacaauggcuaaggcaauuuagggaagcaagaguuuauugcagcucaagguuccagagggcuagaguucaugaccauuauggucaggauuaugguggcaggcaggcagacaugauacuggaggaauuucugaaagcauaaauguugagccaacaacuaugauggagagaaggagggaggggauggagagagagagagauaggagagagagaauaagaaugaaugaacaugaacugggccuggggugagcuuuugaaaccucaaggcccacccccagcaaugcaccuccuccaacaaggccacaccuccuaauccuucccaaacaguucuacugacucgggaccaagcauuuaaauauaugggucuauggggucauccccguugaaaccacuacacugcacuccuuggcucucaugggcuuauagccacaucauaguaaaaugcuuuuaguucagcuucaaaaguccccagucuuucagucucaagauuguuuaaaguccaaagucucuucggagacucaaggcaauuucaugacucuaacccccuguaaaaucaaaaagcuaauuacuuccuucuaacauacauugguacagaguauacuuuaccauuccaaaaauagaggaacacgaaaauaggaaaugcuggacuaaaacaagauuuaaaaacccagcaggggcaaguguaaauccuauaguucuaugucugauaaucaaagggcuuagcugacuucuucccuuucagcuuugggcaccauaacacacuucucucuguugggcugguuccacucccuggcuguaggucucccugguggacaucccaugucucuggcagaccuccuguggcucugguaaucuccaagaacuugaagucucugacucagcccaggcuucacuuuuguagcuguguguggcaugaugaaugaugggaaucaaggagggacagggcuccuggcugggugagggagaaggauagaccugggggcugacuguaggagugacauagacucaccaaaagugucacgccugcuuuugcauagcaguauucacgggugggccucuucauagucuaggguuauaaaaucauacgcuuuugugguucugggagcuugaacccaguguuuugcacauguuaggcagguacucuaucccgaguuucuucucuaguuugcuagaaaguuauauuaauaaccccaaaaaauuguaaugggaugaugaaucauaaauuuauauauuuuugaagccagccgggcgugguggcacacgccuuuaaucccagcacuugggaggcagaggcaggugaauuucugaguuugaggccagccuggucuacagagugaguuccaggacagccagggcuacacagagaaacccuguuucaaaaaaaccaaaaaaaaaaaaaaaaaaaaaaaaaaaacccagaagccauuagcauuuaaaaagcauuuauauauuauguaugugugcacaugacaaugcccauguuauugugugcccguggaggccagaaagcaguugugggaguuggcucuuccuuucccccauguggggucaagggaugaaacucagguugccaaacuuagccaaaaaaccucaaacguuuaaaguauaugcucaugccucauuuacauuucaaaucaaacaaacaauauguagaauuauacgucuccauauauaauucaaauugauaagcacaggauuauagcuaagagauggugaucuuggggagccagagggcguuauucucuuauaaaggaggagccauggcgauauagagguuuugguaugcuaauuuacagcagacaaauuuaagaaagaaaugugguaacaaagaccuuguuaaaugggucagugguggcgcacaccuuuaaucccagcacuccggaggcagaggcaggcagaucucugaguuugaggccagccugaucuccagagugaguuccaggacagccaggacuguuaaagagaaacacugucucaaaaacaaacagacaaaaacaaagacccugucaagugugaggagccggugaccuccugacacaggcagugagcgucuagcauggagcucgguaguacugagugugcuccagugagccugacuuaaguuucucuucuguuaaauacagaaauauuguuacguaguauguucaaggauggcuugaaacuucuguaauguuuuggggccaggaaaguaagaggugcuuaauaaguauuaguuaacugcaagcagcacguuaucugccagcucuuccccggauggcuggugaguguuucugaacuuacuuuauuuaguuucuuugugcuaaugaaauucuuuggugugccaggaguuauaagcugggagagcugucccuguuaggagacaguaggggcaaaacucuuaaacuccagcaucccugugcgcaguuugccaacucuuaaaagaugguuaaaagagacugaaagucacaauaggucgaugcaguguuccuucagcucagcuuuuaacaggauacauuguaguuauuuucucuugguuuaaaacccacacauuucccccucagggauaauuugugcaacuaguuguauuuuuaaaaaacaauacauuuugugugcuuguaagaaaacguuucauaucugguugacuggagaaaaguuaaggagucacugacaagagauguggaagaugggaggggugcgggcgagaagaggaaggggaaaugacauugaguuuuaggcaacguccgaggaagcuggguuaaaggaagggaugaaggaguuuaagagccauugagguuaccgauagccucagacucaccuauuucuaggcaucuaugaaguucaagcuggcaaucaguuuugagagaggggugcaagggauauggaaaccaacaggcuuuacacagaagagcccccauccuguguaagaaggcgcuagcacaugcagccaggacuagacuccccggaguguuaagccaacccugcguccuaugauauugacugcccaccagggcaugguuaaaaauacauaauuggaaccagagaaugggaaaagcagcuaugggcaucaugugggccaacaaguuuuuaacaggaagugaaucuacgggguggagguaaaggacugcccaggguagcuggugccugggagagcugguuuauauuuagccacucucucauuccaggagggcuguggaacgcaggucugggcagcuuacucuuuugccauccugccacaggugccucuuugugagccuggauggucuuggcuuuggcguugaaaggccaggagcagccaugugggcucaugcucugggcaugagauugcuaccuggauucucuuuucuucuacuggcaggcagcagcaguuacugaugccugcugggcuccucgcuguuggcugggcauccuucuuccucccuucccaccccucaaccucugcucuuuuggagcuuggcaccccacagccaguuggacuaguuccugcccugcccagcuugggcaagucucuaaggcccuacuuaguguaacuuuguuucuauucuuguauuuaccuuucauugauaaucaacucguagauaauugucucaggguguguguguggggggggggggguggcuggcaugaaggaaaguaccacaaagcaucuggcaaucuggaagggcuggguuuaaaaucuggccugacuugccaucuguauaaccuugggcuaguugccucgccugcuggaucuuuggcuucuguaucugagaaaugggacuguggagguaagguggcauugugaagcauguauggugcuucucucagucuuaccugucucugccuaguuucccaugcugugcucugccaaguacuagguuguugcugggaugacaagcucuguucucccugggcuuccugcagaaaccaaucaggggaucaugguagccaaagagcugucaguguugcugauagggucaacauccugcugaucgaugaaucuucaguuggaucuucuggccauuucuaugcucucugcuacucuugcuaggaagugggaaauggagugaaguucucuacuucagcauggagggcugcuguuucugcagaaggacuuaagguggagacaccggcuuugugggcagcucaguucuuucuuggucacgggagagaauaaaccaaagucuuuugagauccuuacuggcugaagagaccuugaguaaaaugcuagguguuggucgggucuuuuuaaaguccccuguuagugcacagauaacuguccuguuccagaaaauucacuugucuaagaaacguauaggcugcuuuuccuuauggaccucacgaaggguugccagcuaccugcuguuguucugggguuuccuuucccacccaacccucuccccagccucuaccuugaggacugcugcuucugugcuccuguuuccucucuaaggacugcaucggauuggauugucauacuguaccccaugauguaagaugacuaugugucaauuaaaaaaacuucccucagugguuaauauucacugccuucuagaaguguaagucccucauuccaaagugugagaguggcuguacaccucaguauuaaauucugugcugggcacucaugaaggaacuagcuucaaucccuagcacccuaauaacuagucaauaagguacuauccuuccugugugggggccaaaucugcucagugcuaugaaggcauccugccuuggccuugccucuugaaugcugggacuauuagaaccugcugugguggcuugaauagguuuggcccccauugauuuauuuauauguuugaaugcuugaccauacauaggaagauaggaaguagcccuauuaggagguguggccuugcuggagguguggccuuguuggaggagguguggccuugcuggagguguggccuugcuggaggagguguggccuugcuggaggcaucacuuuguaggugggcuuagaggugggcuucgagggcuuucgggcuccacccaguguagaaucuacucuccucuugacugccugugaaagacagucucauucugcugccuuuggaucacgauguagaacucucagcuucuccuccagaaucaugucuaccuggacgcugccgugcuucccacuaugaugauaaaggacugaaugaaccuguaagccaguuccaauuaaauguuguccuuuauaagaguugcuuuggucaugggaucucuucacagcucuaaaccccuaacuagcgucaugagaugccaagcuuauagugaguguaguaagaauagacuugauucuuagggaaauauacaguaaguaacacagcauccagggcuagaucauguccccuuucucagcuguucuuaaacuuaggucuauuuagggaaucacugggaguguuuugaaaugugugucuucuaacccaucccauuugauuuagacuacccauuuugaggaugaagcgugagccagaacuuuucuaagugagucuuccagggguuugagucuguuccaacauccaggaucugucugugaggugagagacaggagcuuguagcuggcuggagucagcaaaggccucagcagaguccugaguuuauccguccaucucuggacacaaugcuguggcuccucccuccacgccuggcauuugauguucucugggugcugauuccuggguuccuugcgccggcaccuggcugcucagacauuuuugugcaaccuuguuugaugaggaaacgucugccugggacugucugcgugccacugugacaaucaauggguucuugccaaugguagggagguguugccauuaaacuuguagauccaauaauuggagcagagucuaacucucuaguuggagagucuaacuuuggaugaagccuugggauucuuagggauguuucucccaguguuaugccuuuccccccuuggauggguaggagguggugggcaaacagcuuuucagacguucgccauguuuuccuggccuccugggauggagagagcauuuauccgugccucagagcagaaagggcggaguaggcaugagauuuccccacccucauccccagggucacucggcaggcagcacugucacugcgagugggaggaggcuuucucggcuacagcagagggcugacguccuugaaaucugaucuaccccugucauuacuugugguuuagaguccaaguugcucccccacuccacuucacucauaauucgagauggggcuccagaggcuucugagaugugguuuggggugagggagaguaguuauuuaagagcagcccuggacccugguguuugcaucuuguaauuagcucgguugagaagccaguggcuguucuacaccaugcucacccuauuuccauggaauucuccccgccaucaucuggcacaguuuaucggcugcauuuuauaggaaaggucuugugaugugggaaguauuaaaaaaugaacacaccaacuuuuuuggggugggggagaggccaugcucucaagcucuugcuccgccucccuuuucccuguccaaucacagaccuccucuauauuaauguaauuggacagggaaaaucuugggacagucuugacugcagucaguggugucaauacuacagugaaaucgcagucucucaggcuuuugcaaugagaguggacugcuccuagaagaccuggaagccuuuagcuccacaugcccggcaucuccaggccacagaaacacuauggagacaaaggcuugucucugcuccccagccgugcugcaucugcccagaguuguucauggccccucaggcucuugcuccuuacucucagagagugguggcuccguguggcuuugcuuuggggaaugacagaacugaucuuucuuaacacaauagggauuuccuucaaugaauuuuuagaagucaugauaaaauuuaggcagugcauaaauaaugccaaucugcaugcucguauacauuuacuuuugcagaacuuaggguaaccgugagggucccaugcauacagaacuuggggugaucaugagggucccaugcaugcucagaaaauauuccaccacugaaucgcacucucagccucucaaaggugcuuucucagcuucauauuucauguauaaauuauggcaauggagucuuuuuuuuaaggucuguugcugagauucagggcgcuuuuuaaauggcuguguuagcccuguuuccuuauaaacaggaagcuggacaaacugaauuuauuuuggagauauaaauuaaauuuggguaacaggcuagaguguucuccccaaaucuaagacauuuauuuuuuuuaaauuucuuuuaauaaaaaaaauuauuuuagguauaugguauuuugccugcauguaccugcauguaucuguguaccgugugcaccuggugccugugaaauuauagaauggcaucagagccccuggaacuggaguuacagacaguugugagccaccauguaggcacuaggagucaaacugggcccucuauaagagcagcaagugcucuuaaccccugggccaucucuccagcuaagagauuucuuaagggagucuucuagaaugguagaccacuucucuguuaauccuuagguaaauuuaccaacuuuucuuauccaagauuuuguucuuuucauugcuuagagauggccccguauagugggggcuuccacuguucuccuggaggaucauggugugaguuuuggagcugcaggcucagguuguggaagcagguucucaauggacucccaggauaauagauucccagggcucgagagauggcucagugguuaagagcacugacugcucuuccaaagguccugaguuaaauucccagcaaccauaggguggcucacaacuuucuguaaugggaucugaugcccucuucuggugugucugaagacagcuacaguguauucauauacauaaaauaaacuaggaaaggggauaacauuugaaauguaaaugaagaaaauaucuaauaaaaaaauaaaaauaaauaaaaagaauaguuuuuaaaaaaaaaucugaaagucugagaugaugucaaaucugcaauuuuccgaauguggaugugaugacaagaagaaaauucuaugccuggcuucagccgcauaugaagcagaggauggccuugucagacaucaaugggaggaaaggcccuugguccugugaaggcucgauucccuaguguaggggaaugccaggacagggaagcgggaguggguggguuggugagcaggaggagggaugagggcauaggggguuuucggaggggaaaccagcaaaggggauaacauuugaaauguaaauaaagaaaauaucuaguaaaaaaaaaauggaaaaagaaagaaagaaagagagagagaaagaaagaaagaaagaaaggaaggaaggaaggaagaaagaaagaaagaaagaaagaaagaaagaaagaaagaaagaaagaaagaaagaaagaaaauucuaugccuagccccuugagguguguuacagucagaacaggaggggacaaaaaucauugucuaaaguuaccguccguccuccggcaaucuguacaugaagcacaaauggaauucuguguuuagacucggguccaauccucaggacuucucauuuuuuuaauguaaaauguuuaagagcuugguuguaaugacaugcaucugccaucacaucacccaggaaaaggaacucucacuagcagaaaaggaaaagaaaaaacaaaccccugaaaucucaagcacuuugguuuaaauaagggcaucccagaucacagcaggggacccugggggucaguuaaaugguggugcauacccauccaaccccuguccuagaguaacucaucggaagaaggugagggcuacuguuagugucacuauguuccccuagauuuaucacuggugucuuguacauagcagggugacuugccugagacuacaauggcacagguuagaccagaacacugacccuaucucuuacagcuguuugggggccucacacagugcacaucuuaagaaaaaaucuuugucuuucagaaccuggccguuggggcaggagcugucggaucucugcagcugaccuacaucucgaagguaauguugguuuggcacgccgggaagccaugcucucagagcagguuuaaugucuaagcaugaggaagcucuacauccuggaggugugagccuuugggagcagucacagccgugacccuccgugucucuguuucucaggcugcugcuguuugguggugguaguggugguuagcaguggagaggguggcccacagccucuuacucuuuggauccgccggauagucgucacuccagaccugugggcacauuugagauacucucgacagagaaaaggguuacuuugggucacuguguuugagaucuuaguugugauuuuggggcagcacauuaugucagaagcaguggugggcagcuucuugccucauggcuaggaggcaaauuauagagggacuggauaccuauaaucucuucuaaggguaucacuaaucacuuaaggacuucccacguagccccaccuccuaagaguuccagcuguuaaccacuggccuuugggaagcaugucacaucugaaauaaaguaccauguaggaugugaccucuuuuuuuuccuuccuuccuuccuuccuuccuuccuuccuuccuuccuucuuucuuucuuucuuucuuucuuccuuccuuccuuccuuccuuccuuccuuccuuccuuccuuccuuucuuucuuucuuucuuucuuucuuucuuucuuucuugugauuggaacaaaaggacaaugacccugauccaguaaaggauucucucgaaacguacaguuaugagcagcagcucagaaaugccucagguccccugggauuuuaccaguucuccagacagaagcuuugaggauggagggcugaaaacaccaccccccaguaggcccuaagauauggccaggaccacacccaacaucuggguaccuccuggggagcaugguaggucccuggcagucugugcccucaccuagcauucauguaggggcaagagcagcucuuagucuucucugagaccugggggaguagggccagucaacaacgcucacaaaaaacugcugaauucggcugcuuuuagcagucccuccccagggcagccucugcugcugcugacccaugaugcagcccugauuuaaaaaaaaauaaaugaauaacuaaauaacgggaaaaaguggccaggggauuuagcuccucuucagaaagcaggagggaagccagguggcacccagccagauucaaagccgcagaaguccugucccccaugccuguccucaugagggcugcugcuuucuucccuggcuccucccacccaagggacuuugaggaccuagaggcuagggguugagcuaaguggcucccaucugguaacagauuuaagaucugagaagagcuccuacagacgaugggggucaagagaggugcugagaggaguggccaucuuuggcuggacgggcaggcucaucccaugccugccagcugcagcuggaccucagcaccgagggagagaagaugcugggcagugguugagcugauuagaggggagauaauggccucaggggaaggaugcugcugguuaaagcgcacagcugcaggcaauuugugcaugcccuuugauaagaaaugugggggccuccccaggccagggcagcccagcccagcuucugcccaccccccacccccccaaggggcccuuucuucucaucugcugagagcucauuaggucauuucuccagaaggagaauuggggggagggcaggggaagggggggagggaguggagagggggaaggcaggagagcagaaaacccuguugaagaugaaaacugaaaccgucuccugugugauggguuggggaagcauuuuuuuuuggcggggggggggggggggagggagcagugaauauaaucuccugcugaaucaugguuuauaaaugcagcccagaggaggcuuucaguauccucugccucuuuuagaaagggugaccugacuuuuagccagcccuuccugagacaggugagcccacacaggucuuugaaaaacccauaaauggccacuggguuaggucaccgaucgaugaguaccuuaccuccagcugacccacugccagaacaaacuaggcccucuucugucugucugucugccugccugucugucugucugucucucuuuuuuuuugucauccuuaggucacucccagggucaaguguuugcacagagugagacagauuggcuuguucugucccugaucucuggaagacuaguguauggggcuggcauguuaggggugggguggagggauggaggggugggggggguaaggggugggguggagggauggagggguggggggggguaaggggugggguggagggauggaggggugggggggguaagggguggggagaggugugugggggggugcuguccuccagagggccgacccaaagauggaaguaucugucuccaggacauaaugacaacagaagcagucugguugggcaaacuaggaaauaacugaaccuggcccaugguguuaucuuuucauuguccuucugucccaucccagaggucuucacacagccagcccccagcccuacuggaucuauuuuuugagggcuucugauagauaacagguccuccaaaaauacuggcuauuaacuauuuguguguugugggcuggguguggacggguagagagagagacuccaaaacagugauucucaaccugugggucgggaccccuugagguguugagcgacccuuucacaggggucaccuaagaccauaggcaaacacagagauuuccacuaugguucauaacuguagcaaaauuacaauuaggaaauagcaagaaaauaauucuaugguuggguagcaugaggaacuguauuugagggccacaguuggacagaacacaggguccccaaugaaggugauagagaaaguacccaaggagcugaaggggucugcagccccauaggaggaacaacaauaugaaccaaccaguacccccagagcucccugggacuaaaccaccaaccaaagaaaacacaugguggugggacucauggcccuagcugcauauguagcagaggauagccuagucagucaucaaugggaggagaggcccuugguccugugaagguucugugccccaguauaggggaaugccagguuaaggaagugggaguggguggauuggugagcagggggaggggagaggggauaggagauuuuuagagaggaaacuaggaaaggggauaacauuugaaauguaaauaaagaaaauuucaaauaaaaaaagcaaaggaaaggaaaggaaagaagagaagagaagagaagagaagagaagagaagagaagagaagagaagagaaaagaaaagaagaggccacgguguuaggaaggcugagagcuacuacugcucuggagagcccacugaagggcacugauaaauuuccagauaaauaugcuuacguauguaccaacuugaaaggccucugaugauuguguggguggcuuucuuacuuuguugcgggacagucuccucugacacuggggcaugcuuuugaguucuccaagaccuuccucugcuuuugucccgggugcugagaggccucacuuccggccaacggcagacaggguguggcuggcccucacggugucccgacgcuugggugacgcuuagguugcuacugcgucugauaaucgaaagcuccugagacuguccagcugccagguggcucuucugcgucacucguggggggccccaaggguauucuuuucuucaccccgacacucucucgauguuggcgugcucacaggaccugccagccgaccacuguugggcagugacucaauugugucugccuugugguaugagaauguuugugccugggugcccucgcuugagucagacuguuggauguccucacccaccuguggccacacugcuuccuguagggccugugcucuuccuguguuugaagaugguuguagccugacacugucaccaacggguggaagguagaugcggggggggggcaggggggggcuguccaagccucugggggcaggcugucagggacaggccaaagucagaguucugcaacagcccuucucuguggacguagccacagguggacaaauuaauuuuucgugccugcugcccugugucugugagaaggacauuuaccuucucacguugguguuacuaagggagaaacuggucuauggagguucuuaacccuggucuacagcuaaucaggacagaacagggaucaaucucauuaguuuggcaaugaauuacuuugcccaacaacacuuccaugcuaagccaugaggcuggggcacacuguaaaugcacaugcauguggacccuccgacuauaaagugcauauacgaauaugaacaagcagaaagccguguauggccuuuggaagcucugguucucacaauaacugcauggguagcauuuucccaggcugacuaaucagugcagugagcaugaucauuuguaauccacguggggucaaagggucagccaguggcacucuguucagccggugauaaauaggagucuccccaggaaagggcgaugcuacagacaagguagagaggaucuuagggaccaagcuucucaacuccaucaaaauugccagcuggaugagaaggaagcugggagguggguggguuccuagggccagaaaacagcagguccgugacacucaggguuaaugcaggaacccagccaagcacagcacagcacagcccaacccaacccaacacagcacaacccagcccagcccagcauacuauagcauagcauagcauagcauagcauagcauagcauagcauagcauagcauagcauagcauagcauagcauagcauagcccagcccagcccagcccagcccagcccagcccagcccagcccagcccagcccagcccagcccagcccagcccagcacagcacagcacagcacagcacagcacagccaagcauagcauagcccagcacagcacagcccagcauagcccagcacagcacagcacagccuagcccagcccagcccagcccagcccagcccagcccagcccagcccagcccagcccagcccagcccagcccagcccagcacagcacagcccagcacagcauagcccagcauagcacagcacacacagcacagcacagcccagcacagcccagcauagcccagcccagcccagcacagcacagcacagcacagcacagcacagcacagcacagcccagcccagcccagcauagcacagcacagcacagcacagcacugcacagcccagcccagcccagcccagcccagcccagcccagcccagcccagcacagcccagcacagcccagcccagcccagcacagcacagcacagcacagcacagcacagcacagcacagcacagcacagcacagcacagcacagcccagcauagcccagcacagcccagcccagcacagcacaacacagcccaguccaguauagcccagcccagcccagcccagcccagcacaguacagcacagcucgggcagaggacuggagguugccuggaaacauagaugccgagguucacagccaggaaaugaguagcugcagaccagcaacuggcuuggauuguaccccaggaaaacaaggugguucagggccaggacugacagucuccuaaaugcuaccugugaagcauggaggcaugacuacugccaguugucugucugagcucuucucauguuuuucagaaguuucuuaggccaccuggccuccaccucgcuucagaguuucuuugucaauacagugggaugaacacacacacacacacacacacacacacacacacacacacacacacacaccuacauaguuucugucucuucuucccuuggugauagucuggacagccuugggauucugcuaguaggaagucaucagcagauguaguccuucauccuucagaaacagggguaaugugacaucuuggguuuuaaauacuugucacugagguugauguaauguuauuuacauuuuaauuauuaacauugaaaaugccaugcguguuuuuuuuaaguuuuauuuuaaauuauuuauuauuaguaguauuauuguaguguguggugugugauuuaucgugugggugugugauuuguuuuaagauggggugggcccauguaacccaggcuagccagaaacuugcuguguagccuaaagucaagguccuuuugugucagccucccaagugcugggauuacagaugaaugcugccuugccugacaccauagucccuccuucaugaguagauucuacauggcagugcagccaggucucuugcuugcauugauauauuugaugcugcuguuaacuccauaggaacgugacugugauuccuuucuugacagaacaucuaauggagaucacacaccuaaugauuugagacugauuccaaaacaaaccucuacuauuuauccguuugauauuuuguagguaucaccccaguuccugguugaguauuuggggcaauguuauuuggcuaaggaaucaaggcagguaucuaggaagauuuuaggggcaagagcaagagcguagagaccagugugccaaucaugguuagaucuuggcaacugugagccucaaagaagcucacuucaagacuugaaucccugcuucuacuuucaagucccagaguccagagaggugaauaaggagaccugggaaagcuaggaaggggacugagaggccaguguccugggcaggaugcugacuguauguggauggguuccgugcuaggugcugcaucucuaggcaacccuaguaagugggauggguggaguguuccagcauggcuggaccagcauccauuugguggauaaucaccagaucuuuguaggcugugaugggaguaugaaucugagugauguagucuccuaugcagacccucagcaaaacccauacaagggacaggauuguaaaaacuagguaaaguacaccaguggucccgucuacacaggcccgucuacacaggcuuuugaauauacccaggugagcucacucaucugccagcugcucucugggcugcuggagaguugccucuguucaugggcaacauaaauagaccuucagauaagagcgccugcuguuuccuucugcuuugauuagaauuuguacgcccugagcaccuucaguugggagacuguucugggaaaggaguuagcucucgagagcauaguagaagccugcuggauugaacgggacucugcuagaucuuguggcucagagaaaaucuugucuggaccccaguggcuuuuagaguguucuugcagagacaaaaguuaguacagucaccaggauaccaguuauguggaugauagaaguucugccacagaaggguauagcgaguaucuaagacagcgguucucaaccugagggcugugaccccuuugggagucgaauggccccucuuacaggggucacucaacaccauccagcaugucagacuuuuacauuauaauucauaacaguaugaauuacaguuaugaaguagcaacaaaauuaauugguugucaccacaacaggaggaacuguccguuaaaggguuguuguguuaggaagggugagaagcccugcucuaaggaauaggacugaccguaccaguuuguuuguuuguuuguuuguuuguuuguuuguuuguuucuuucuuucuuucuuucuuucuuuuuuuugagacaggguuucucuguauagcccuggcugaccuggaacucacuuuguagaccaggcuggccucgaacucagaaauccuccugccucugccucccgagugcugggauuaaaggcgugugccaccgcuguccagcccgugccaguuucuuaagggauggaggaagacacucaauugucagucuucaaauauacauagauuugauaugcucuuuuuauguaugaaauguuuucaagguaaacguuuuccacacugaugaaagcacacucaugucucucuuugucuuuauuugauauaggugagcauagcuaccccaaagcagaaaccuaaaacgccauucugcuucgguaaguacugagccacaguggcuuuucgccauagaccugugcuaacuucauuuccguggaagacagcccugugaucccaugggaacuguauccuguaugcaugaguaguuuagauaauagggauguucugggugccgaguaauaccccugugaagauuuuuaauaacuugcgaccaggcacacaggggccagcagcauuuuagccagguuggcuucugccggccaucugccuccugaccuucuuccuuuuccuccuccccuucuucucuccccucacccccaacacugucaaagcugcccuggaacuuugcuccugcugcacccagacuccaaugugcugagauugugagccaagcuguauuucuguuuaagguggacagaaagcaucugauagaagucucugggagccuucacuuuagaacugagcagugguguacucaggacaugaugagguccgagaaaaguggggaaaggcagggaagcauuaaaaugaaggaaggcauauguagggucucaagauugccagaugaguuguaguugggggcugggggcuaguggcaaaggcgcagagccacuccaccaaugccucaagccugucuucaguugguccgugaaaccacucggcaacuguaucgauaaguagcccucgcucugagcaaaugcugaggccuuucuguguccagggaggcucugagcaggagcuucagggaggcagagucacuuccugcuuugucacugcaugcccucagcacauaagaugacugcuggcacauaguggguccucaacaaagaguuguuuauaugaaugaaaacagcgaguucuuugucaccucggcaagggcuucuugacuucacucucaggccagagggaugaagugacuucuuucucccaacuucagguugacucuucuuuuuccuguuccuuccaaauauuauugcuaaguuuagaagucacucuuaaauuuuguggucagcucacuuaaagauauauuagugauaaugaugaaagucaaucaaucaaucaaucaucaaucaaucaaucagagguaagcugugauuaagggaaugcccagagggaggaacagguugaaagugaggccaaggcgacgggucucagcaaguguuguuccauuucccaggcacagacaagaccagaucauacugguagaagcaagcccuauagggucccgacuaagugucuuacugguggcauaugaguagcuucauugucaccaauagagcauugaagccacuguuaaugccagcgucauucugguagcugauaaauguguugcaggggucugcugcuucugagcaugcaugugacuuaacacccuaggcggguucuugaucuucuaaauggccucaugggucuugucaccucagacacccuaacuuccuggucucuugugaucuccaaauccugacccgguaccuucuuucuccuucccuguuaccuuuauaguuaucaaugcccugucucagagauauuuucuucaagccaaugaccagaaagaucugaaggacuggguagaagccuugaaccaagccagcaagaucacuguauguauacccucuguucucucugguagggaaaguggggugucccggcucuugaccucaguggggaaggggcagagcucagagggcagcagggccuugccucagagccugugaagacccaucucuaucuaaccuccucuuguccacuggcggacaacuaccagugaacuugagaguuugagucugaacggaguucaagaggaaguuuguggagucucuuuugugcuuccugggagggcuucugucagucccauccugggugauugugggacacugcugacucauugugugggguuggaaaagggauugcuaacaagaagcagaggaacuggggaagcgcacgagaaggaacucaggucuguuucuuucuaguuugggggauauucuucuuaguugcgccuggaaaaacgucuucuaagagcuuugcaaacuuggaaacucguccacggauuguguuaaggacucagguuauccuggacaugacuaaugaaggaucgauuuccuauucccuaggaauauuuuuacaagaaacaaagaagaguuaaaagggaaggaaaaaaaaauguguuagcuucccagcacugugauaaccugcucaaaacaaucaaguuauaagaaggaaagguuaacuacagaucauggcauuuguuuuuugugguucaugggguuuaucccuguuguuucgggccugugaugaggcaggauauuaaggugggacaugcgguguugaagcagagaacaaaacaaggaggcacuggggucccacuauccccacagagggcuuaugcccaguaacccaacuuuucccacuccuccucaucucugggaaguuccucugcuucccaauagugccccaugcuggggaccaggcaucgaacauggggaauguuugguaaacggcuuuagggggaagaggaggacaauaguagaaagaaacucagcaagacaggcagagucuggucuaccacaguugcugaaaacuuagaaauucuguguuguacagucagaagugcuugucuucucgugacuuugaauugaaaugcccauugccgggacaaauuauucuuccagaaaccuuaagguuccaauggauguugguagauggaaucucugucuacucagcaucuguaucguugggcucaagcaggguuagcuguagcuguuuaagcaaugugacagcuguuuacuguucuggucaaccugcacagagagagcaugaggcaaggcuggcagaagacagguuucgcugugugcugucucugggauguugguaugacaucccacaggaaauuagcgaggguggccugaggagguagugauagcauuuuaaggaguaaaggacacaacguugaugaucuguguuuaccucauauguaaaauugagacaaucgugccccugagcuaagaggacgcaguggagagcugaacacuacacucuccauggcacugguugggcuauguugugcauugcuacacaucaggacacuguaggagaggagaagggugaauuucuggguugauuugaaaaggugguggcagaguacauacauauauauauauauauauauauauauauauauauauauauauacauacacauacauauacauucugccaugcccuguucauuuuucugacuucuuguuuugcugagaauuuuuguucagucuuaacuacuagcauauauaugaaugucaagaggacagggcuccugccucuuuguauucuaacuaggguuagcucauccuauaguuaugcaguaaguuuguucuguguguauguuauguauuuguauguguguguuauguuuaugugugcauguauaugugugauauacauauguguguauguguuuguguguguaagcauguguguauauauguguguguguguauagguguaugcauguguaucuguguuuauguguguauaucuauauguguguauacauguguauaugugcuuguguguuguauguguguaucucugugcacagauguguacauguauauaucuauaugcguauauaugugucuguguguguuauauguauguauauguauacuguauguguauaugcacauaucuuuguguguguauguaugucuacauuugugugcauguauguauauaguauauguaucuauauauguguaucuauauaugugugugugugcaugguguguuuguauauguguguguaucuauguguauauguacauauacguauaugugcuuguguguguuauguguaugugugcauaauuuaaaggaaguauguguguuuguuugucucuguguuaguaaauuagcuuuccauuucuccccacauccuguuugugguucugcccucuuccuaaguuuucuaucucuugcugaccauaucaccuuucuuccuagguacccaaagcugggacaguacccuuggccacagaaguucucaaaaacuuaacagcuccucccacccuagagaagaagccgcagguggccuacaagacugagaucaucggggguguggugguacaaacgccuaucagccaggugcuguugcuugggagugccggggggggggggggggggguggagggaggcagugaaggccuaugcauugugcccaaggaccugcacaaagcauuaggaugggggagcuagugaagaaggugaccaggaugauauagugcaagauggauguguucagugccaauguagaaguuggggacaugacaucaagacaucuugaggauguguggccucugggcuuuugcuuaagacccaggcaaugcacacucauaaaucacaaagacaacggggcugagggaggcagugagacuagacacaagucugcagucccauuuggguacuugugacuccuuuaguucuaaguagucuuuccuuccucuucugagucucucuagccagcaucauacuuuggggaaacacuagagcaucggcuaacugggggcaaagucagcucuuaguucuucgacugacauuauaucaaaaagaccagagguguggugagaaggcuggaaggaucccacagaggaaugacugggguacuaacaguguugcuguuucuacuguuuccuuguagaacgguggggaugggcaggaagggugcgagccagggacucacgccuuccugcgaaggucucagagcuacauccccacgucaggcugccgcccuuccacugggccuccccucauuaagaguggcuacugugugaagcaagggaauguggugaguccagcacaggggcuacaacugggguucuauuccugcuggggauccagugggcauggauguagcagaggagaaagagaggaagaacuguaccccucuauguugacugccauuggguuauaugguaauuacuuaugguaauauguuaacuagccauuagucccccagaaagcuugccuguagugguaaaaagccuuacugccuucaaacugaugcaguuugcacacugauggucagauuucccuccuauuucccaacucuugcuucgaagaugaugagcugauaguugucuuagucaguguuuuuauagcuucaaugaaacaccaugaccaaaagcaacuuguggaagaaaggguuuauuuggcuuacacuuccacaucaugguccaucaccacugaagggagucaggacaggaagucaagcagggcaggauccuggagcaggagcugaugcagggccauggagggugcugcuuaccgacuugcuccuucauagcuugcucagccugcuuucuuucuuucuuuuuuuuucaagcuaauggaugcaaaacuuauuuuguuugauugucauaaaaaucauacuuuuauguuaaccuuguuugugaaaaauccuauuaugauacuauuuacaaaggaaaaacuauagauuuuauguuuaucauuauuuauacuuuaaucaauuauuuauuuauucuuuuuuaaaaauuuuauuuuauuagauauuuucuuuauuuacauuucaaaugcuaccccgaaaguucccuauacccuccccccgcccugcuucccuacccacccacucccacuccuugguccuggcguuccccuguacuggggcauauaaagcuugcaagaccuaggggccucucuuccugcuuucuuauagaacucaggaucaucagcucagggauagcaccgcccacaauggccugggcucuccuucccuaaauuacuaauuaagaaaaugccuuacaggcuugucuguagccccaucuuaugaaggcauuuucucaacugagguucccucugcuccgauggcuuuggcuuguguccaguugacagagagcuagcccacacaguaguaucucguggcggcagcagagaaggacccucgggugcucuucacguguuaggugcuugaucccuggaaagaugggggcucagauggaggccugggacuuuccauuguuccaguucuuugucccugcugacgaugggagccuggcuuccauggugcugggucccugggcauuuucuaugacaaugccaguccugacucuggaguccugucccuguccuugacgguuugguuccuuauuugucauuucagcggaagaguuggaaacgacgcuucuuugcccucgaugacuuuaccaucugcuacuucaagugugagcagguagguaggucguagguucgggucccuccugagaggucugaguaacagagaggcgugcaugaguggaagccaggcccauacagacuuccaagccacuucuugucuuaucucuguccaaccugugucucuuuaugaugcgauuauacaaggaccuggacugcugccagcgucugugcacugagcuguugugugugugugugugggggggggaacagagcagcugcuguauagauugcuucucuguaauaauuauuuugaaaccaaguugguuuuaggcaauacucugagagagggguguugguggacuggcgugggucaccgggccauguaccuagcuucauuugcccaucuucugucuuuccuaucaggacagagagccucugcguaccauaccgcucaaggauguucucaagacucacgagugucuggucaagucuggguaauugccucuucuuauucaucuugaggagagccuugguuugucaucuuggaauuuucauugguuacccuuuuugaggcucuguugaagagccuucccuauagagcagugguucucagucugaggggaaucacagucccuuuggggggguaucaaaugaccguuucauagagguugccuaagcccaucagagaaacacagauauuuacauuaugauucauaagaguagcaaaauuacaguuacaaaguaacagugaaaauaauuuuaugguugcagucacuguagcauguauugaagggucacagcauuaggaagguacaggaccacugacuuaaugccucauaacugcucagaguuaaggucgcacuggacaaaguacccucuucccauuugccuacucuuacucccaugaugccugugugcugacucagacagcagagaauggcgcuuaggugccucucaggcaguagagucaggagucagguccugggugacagaaaugaaggaggccugacccuuccccuggcuucacacccuacccuaggcugaauuucucaggccuuuccucccuuguucuugaugugcccauuaacauaggggugacucacagccucccuguugcuaccacuugaagggcagaacaaguauuuuuaauuuguuccucuuuccgcuaggaaagacaccuucugagagcccugcguaagaugauccaggaguugacaggagaaugucccauccccguuccuaaauucagaugcuuguggaagugaaucuuaauagagucccagcauaucuuuuugggcauguguuuauagucuguccagacugcguguuuguaucucuucuugcuguaggucauaagggggucuaucaauaguagggcauccugcucuccagagaaagcauagcacagcccuacauaaacacacaugcuaugugauccagugaagcagggcagagaugcuguacuaagaguuucaaauggcaguugggggguggggugagcagaagacuggggaagccccuagggauaauuuguauuuugugaaaguagccauagauagacauugucccgaguguggcucuagagggcagaacucagcaugagagaucaugagagaugcccaauugcuccugacccuggagggcccauguagauaggaggcuacuuggacauccgaaggcagcuuggagugggaggauaauguucagccugagagucuucuugaaaacuccccuuaccucuaacuugaccugcgucccacugaacuugagucgggaggugaaguccgugggggaagguuguggcuuuguggccucagcucuguugggugguguagccucucugggaccuuuggggggaauucaggacgguuguaaguaaugaaagcugugcauuagaugacauugaaaacagcaugcaccuggggcaguggauggaaaggggacaggacucccuccuugguugacuuuaccucuucaguggacucugggacuuaccugcgcucgcaugaauaaucuagaagguuaaaacauugagcacuauguuagcugguuuccuauugcucuucaagacaccaugaccagaaggugaacugggaaggagaggacuuuuuugaccuacccuuccaugucacuguuuauuauugaaggacgucaggacaggagcucaaacaggccaggaaucuggaggcaggaguugaagcagaggccauggagggcugcggcuuacugguuuauucaucauggcuugcucaaccugcuuucuuauagaacugaggaccacuugcccagggguggccucaaccacaauggguuggacucuccuccauaaaucacuaauuaagaaaaugcccuacaggccugccuacagcccaaucuuauggaggcauuuucucaauugaggauuccuccucucagauggcuuuagcucgugucaaguugacagaaaacuauucagcacaagccuggaacagagcugucccuacucagacgcugagcaaguagaaguaauaguugguaggauguauuucgagugaucugugugguucgagcugcuuccgauggccuuacggaucugcuuagucagcaucuuuuuugucucuguguacccuaccuuggcuuaagucaugucccuccuuugcucggagggcaugucacucuguuuucauucucugacauuucugccugggacuagcccuuccuuggcacaagacucuugguuggcauggaaugccgucugaccugcaucuggucuagccuccucaggugcuuucuucuggugguaauugggccucgacuccuuagucccuguaaugacuggaugcacacagcuggccuuggccauagaagacacauucaguguguuuggaauuaugucagcaccaccugcuccuugcccugcaggagccaggaauucguuacuaaaacccacacccaagauuaaagcuuguuuuucuuuuucuuucuuuucuuuucuucccuuccuuuuugacacuguaaugauuacaacaucuucucuuccuccuccuccucuucuuccucuuccuccuccuccuccucuucuucucucucauucucucuuugaagcuuauuauuuuuauuuguuuguuugcuguuaggcacauuaucacuaagcuacauccuagcuccagaagcagauuuuuuuuuaaaugaaggaaacuaauuuuaaauuuauuuuacauuaacauacagaggaauagguuucauuacaccaguuucacacauaccuuauuuuugcugccccuuguuccccacucuuuguccacaguuauccccguucugcacccccccaucccuucacaguucccucucuuaaaacuuuuuugggucaguuauuugcuuauugauuuaucauuaauacauguggaugcaugugcacauguguggguguggaggccagaagacaacuugugggaguugguucuuucccucugccaugucagaugagguggcaguuagacaggcccuuuacccgcugagccaccuugccagcccucacaguccccuuucuaguuucacagcccucuauuccccccucacauguauguuuacucacggauaaaaauuggcaugcgagagaaaacacauuagccuuuucccagcucaauuauguugcuuaugcuaacaauuuccaggcuggagagauggcucagagguuaagagcacugacugcuuuuccaaagguccucaguucaauucccagcaaccacaugguggcucacaaccaucugucaugggaucugaugccuucuucugguaugucugaagacagcuacaguguacuuacauauaauaaauaaaucuuuaaaaaaagauaaugauucccaguuucuuuuauuuuuacacaaacuccaugauuuuuuucuuuuuccuuuucuuuucuuuuuaaaaaaagauuuauuaauuuauuuuauguaugugaguacacuguagcuguacagaugguugugagccuucaugugguuguugggaauugaauuuuuuaggaccucugcucacuucagucaacccugcucacucgggucagcccugcucgcuccggucaacuccacucccucaguccuugcuugauccggcccaaagacugauuuauuuacuauacauaaguacacuguagcugucuucagaugcacuagaagaaggcaucagaucccaugacagaugguugugagccaccaugugguggcugggauuugaacucaggaccuuuggaagagcaaucagugcucuuacccgcugagcaaucuugccaguccucuuuuuucuuuucuuuuaaaaguuauuuuuuuuaaauaucuauguguauguagacuaucuguguaaguguguuccacauaugugcugauaccuguggagucagaagagagugucagaggcccuggaacuggaguuacaggagguugugacccuucugauaugggugcugggaauugaacucagguccucugggagagcaggaaguacucuuaaacgcuaagccaacaccuuuauuuuucuuuacgacuaaacaaauucuauugcaucucacuuaucugcugaugggccucaagguugauccuuuuccuugcuauuuugaguagugccaguaauugccuggggugugcaagcaucacccugguaggauguagaguccuuugggcauaugucaggaguaguauagauggcucauaugauaguuuuauuuuuaguuucuugaggaaccuucggacugauuuccauaguggcggcacuaauuuacacuccuccccuuagugaguaaggguuccucuuucccuagccagcauuuguuaucuuucugcuguuucugacuggcgugagaugaaaucucaaaauaauuugaauuugcauuucucugauggcuaaggaugugaccgguuuccugggaagcacuucuuaaauucagcuucugauucucaguuucugauucucuucucagcuccuuguccccugggccagggcagcagggcagagagcaggaacuccgagcugugggcggagcagcugcuggggggcaggacaggguggaguagggaaagucacugcugggggcgggguggggguggggugaggacgggaggagacgggggggggggggggggcggggggggggagauauggugcuggcuuccuuagaaaaggaacauuuggacucaauggguucugaucuccaguaccucggacagacauagcauuuacagccgcugagccucgggcugccuuauccacaggaaggagaaagucuugaguugcauuagugggugaccgugaaaacuguaggaaauaacguggaaaaaaaaaguucucacaaugcuuaguguaaugguaucucucucucuccuugccuagugaucucuuaaugagggacaaccuguuugaaaucauaaccaccuccaggacguucuacguacagguaaauguccacccccagaccagcguuuccucucugugaaugugaguggaugccuccgcucccuccagcacccagugucccaucucauucuaaggaggguguugguuagaugcuucccuacccugggauacuacaagcaggucuauccgcugugcgggaggugcgggaggaugccagccucuguagcagcugcacugggcugcagagcuccaacuaagcagagaaaaggagaacugguggaugguuucacuucugcucuggaggguauuuauaagucccgccuauguauggacauuacugugugcagacaagacagaagcauagagggcccuuugccggcacaggugcacaggcagccugcacagagaaagccauuguuuggccucugacaguucccuuaccaggaccuuccccccacccccagaucuggagcucucccaaucccuaugaggucacagcagcuagcaaggcagauuuccaagcagcgcaaagacagcuagagccaaguccuccgccugggcugccuagaagaccacagagccaguacagggagaggcugaugugagauucugagccuuaaaauucgcagcuuucccgcgugggguuuuaggaacauccaucucccuuuuuucucuuuccccuacugaauuccucccacaaaaugauggggccucucuuccauuuuuuuuuuuaaguaacaggucugugucuucacuguuuucuacuuuaugccagcagccuugcugauagccuugggcauccucgagccauuuucauugagagaagcauauugucuaggaagagauggcagagaggaggcuggaucauggggagagggucaccuugcucuuaaaucuaaaauccaguuuucuccagugcuucuuccauuuagaugcaaggucuagcuugugcuuucgaggaaguuucuaguucuuuuuuuuuuuuuaaagacuuauuuauuuauuauauguaaguacacuguaguugucuucagacaccuguaaugaggcaucaggucucauuacagaugguugugagucaccaugugguugcugggauuugaacucaggaccuucagaagagcagucagugcucuuaaccucugagccaucucuccagccccagaaguuucuaguucuugccguugauauuuguaggguauagucaagggucuaggcauggccugagguuggguacauggaguuagacagaacugaucuugaagcuaagugucuuaguuaggguuuuacugcugugaacagacaccaugaccaaggcaagucuuauaaaaaaacaacauuuaauuggggcuggcuuacagguucagagguucaguccauuaucaucaaggugggagcaugacagcauccaggcaggcauggagcaggcagagcugagaguuuuacgucuucauccaaaggcugcuaguggaagacugacuuccaggcaacuaggaugagagucuuaaacccacauagugacacaccuauuccaaccaggccacaccuccagauggugccacucccugguccaaaaauauacaaacuaucacacuaaguaaucaggcagcugaaaucacauacaugacuaaaggauucaggaggagagggggccaggcaauggaacggcuccauggcaagggcccaggaaagagaauagcugcaagggaggcugcaaugcuaugggcagagacucacugcccugccugcuuccuuagcaagcuuauaucugguccauagaguugcagguaagauaaggacagaaagacacagcucuuggacucagacaauuuauuuaauauucagagucuccguauguguguaaaauggagaugaaaaacucaacccaagcccuucugauggcccugaagucuauuugaucccaggcaucaugaaggacagauaagaaaagagcaaugcaggacuaaacaggccaaugugaaggccguggcggacaguccuucagaagggcuuaccuuagauggaugagggaaagugacgaauuugagacauauggaagagguccacucucgaggacuugagaguugguugugugaaggggaagggagagacacauaaaucccagggcuuuggcuugaguuuugcacuggucggugacagcuaguaguuacuuucuugguaauauggaggaaaagcagcagcacuaggguguauugcguacucuucuguuaccaugauaaaauaccaugaccagaagcaacaagggagaaaggguuugauuuagcauaugguuccacagggauugaguccaucaggcaggaaauauaugccaugguaacagaaacaggaagcagagauaggaaaggccuaucccuaguaauguguuuccuccggcaagacuccaccuccuaaaaguccuauaaccuccccuaacugugagugucaccagugggggaccggauaacauuggggaccaaauggacaccauuucucauucaaaccaugccauagggguaaguaccgaguuuaccgugcuucuggaacauccauuaguacaccuggugaugaucauugccuagaugguacuugauauguuagugcuugcggugugaucauacucugaaagcugcacagaggguagugacuuggagacaaaaggcucaaccgaaacuguucagaagauauucuaucauccaagaggcaccagcacuuccccgggcccuuaccaguucucuauuccuucccuucugugcuaaaauuucuaaggaaggacauuagcaucucccugaguacauacaugagggaaggucaauccauauguaacacaugggacaaagagagugguguguuggagaaguauggaugaaaagcuagggaacauauuuguugauucacucagaagucacacuauaaaccugucuuaguuaggguuuuacugcugugaagagacaccaugaccaaggcaacucuuuuaagaacaaaauuuaguuguggcuggcuuagagguucaaagguucaguucauuaucauuaaggugggagcauggcagcauccaggcaggcauggugcaggaggagcugagaguucuccaucuucaucugaaggccgcuagagaagacugacuucuuaaagggucuuaaagcucacacccacagugacacaccuauuccaacaaggcacacccacuccaacagggucacaccuucuaauagugucacucccugggcugagcauauucaaaccaucuuaaaacccaugacgcauuaacaaaauaucuuguaaaauuaugauccuucauaauuucaagaguaguauugcuuucuauuucuguguaucucuuuaauggcuggcauaaaggccaacaugaaucccguucuuguuucagccuggagucuguguccaugugucacuuugaggaguuugaaucucuggucuuauacagauguguauuuggacgaagaaaugauuucaauguguccauuuauguuauucaggucugucuccucucucucucucucucucucucucucucucucucuuccucccccuuccuugcuuucuuccucccuccuuucucucucccuuccuuucuuucuuucuuucuuucuuucuuucuuucuuucuuucuuucuuucuuucucucucucucucucuuucucuuucucucugucucucucucuuccuuccuccuuuccuuuccuuuccuuuccuuuccuuuccuuuccuuuccuuuccuuuccuuuccuuuccuuuccuuuccuuucccuuucuuucuuucuuucuuucuuucuuucuuucuuucuuucuuucuuucuuucuuucuuucuuucuuucuuuuuuucuuaccagaacuugaaaaauagugauuucuuaauauuaggugcaauguggagucuggagccuuauccauacauuugccuaugcauagcuggguccauugaucaccauuugaguacauucuucuuacccauaguuuguacucaugcuuuggaaaauaccccucucacugaaccgcucucaccgagcugugcugaucccugaaauguugacauauguuauuauguaauauuuuuuaagucacacucauucauaucacuagcagagucuuugaguauggaaggaugugagcucaugcaaugagagguggguuuuaugaaauucuguuuugcuuuaggagcucaguguugguuguuagcaaaaagaaaugaugcuauucccuuggugucaccagcucauuuuugauacaaagucugcuaaauacuugccucuaaauaaacuagacucauaguuucuaugucaguggcuuguguuacauaaaaauaaccacacuuccugggaacggugggggagcucuuuugcuuccacaguuuguucuguagggccagagauuuguguccacugaaugcaagugacuuucugacccguguccucagucaugcauaguaugucugcaugaaccuucugucuaucaucaggaucuaggagagugagaccagcaagcagggcaaggcagagagaagagcucugggacuggacucugaugacccugauguuagauguuugggcuuaggcuuaggcucaaacuauagcacuuuucgauucaggagaagcagcugugauuaauuaggcaucucugagacacuggugagcaguagcuagcuggugguguaucgcuuaauacucuauaacccuggccucaucucuagucuguccacgaggagacagaaucuucaggcguaaauggaccacuuaggaucauaaacccaguuugagagguacuugguauucaagcaagacuugcuuguguucagaauggccaggcccagaaccuaagcuauagagcaguggucuuuaaccuuccuaaugcugcaacccauugauacaguuccuuguguuugcgguggcauucuuuuguuccuacuucauaaguguaauuuugcuacucuucugaauccuaauguaaauaucugauaugcaggauaucugauacgugaccuccaaaggggucacgacucacaggauaagaaccacuuuguagaggaugcagugcaguggacacaggggagugaauauagccaccaccagaaaaaucugccuuuguccagcuuauggccaccggguauguuggauaauggaucacgguguccagauccagguaguauucaggcaucaagauggguggagauggugcugcagcagccuugucaguagguagauguuucuaaguucggcgcaaguguucaagaugagaguucagagcugggaugcagcugggugguguggcacuuacuuuguggaaggcccuggcuucaauggccagcacuccuccaaagauaauucaacuuccauucuuuggaauacacagcaagguuucucucauaaaaggccuggaguauuggaguuuauaacagaguuuauuaacagagggcuagaaguuagaaccaugauaaaauggucuucagcucacaugucagagccacacugcugugccaagacaagauccacaagagagauucagagugcugcacuagaacucuuggaaaguuacuuuguagcuuagacucuagggugaaggguaccaccuaaaacagugguucucagccugugggucauaaccccuuugguagaaucaaaugauucuuuuacgguguugccauuggaacuaucagauauuugcauugugacucauaucaauagcaaaauuacaguuaugaaguagcaauuaaauaaguuuaugguugaggguucauugcaacaugaggaauuguuugaaaggguugcaacauaaugggaagguugaggacccaggaucuagcacuauguagugcauaauuuauacagucauccauuugggggcucuaucuaaagaugggauugguucauugggaagggaugaaguugggaaucaaaggaagcaguaacugcuguagauuuagggguaauggcaguaaccagcgguagaucuuggaugucuuuuauuggugucugcauguguguaguacuggacuccugauacucagaagcucauuggacugcagucaaaccgcugauugaauggauucauuucaaaaguuugucccucucuuuuuacaaacugccaucaaggacagaaaccagaauacacauaagaucagggcaggaagagagcaagggacacauggcauuucccucuuuaucugaucugugcugggcacauuuugguuuucuaggaagucaccugggcuggguagaccucaacucugaaauaauacuucuuucuuguauagaaucaccugcaacauuuguuuucuaaaaaugacuguauggauguguuguauguguucauguauauguagggcucgugccugugauguauauacagaggccagaagaggaugucaaugucuuuuucuauuggaugucugucucuaaaaucauuuuauuugguauauauggguguuuugcccccacaugcaugcuugcauaccaugugugugccuggugcccguggagacuaggaaaggguauuggaucaaguacaaccggagugacagacagcugugagccaucaugugggggcugagaaucaaaucuggguccucuggaaaagcagccagugcucuuagcugcugucucuccaggcccuccacuuuguuucuugagacaguuucacacuuagccugacuuuuggcauuuugccuaggcuggcugagcagugagcccucagaauccaucugucuguccccucuggggaagugcaggcuuuuauagguacucaggcuuuacacagguccuggagauuugaacucaaguccucuugcuaccgcagcagccuucuuacccacugagcucucucaagccccauaaacccaacuuggaaauaaaaaauguaaaacaguggcuaagacuacugaagauauuuuauaaaaguauacuuuauacuuucauaggauaucagaugcaaaucuacuuccuucauuacuuuuuuuuuuuuuuuuuuuuugguaaauucaaaauaacccuuucucuacucuauauauuacacuauuuguuccuuuguaaauuuuggcucgcugagucuagaacccagugcuuugccuguguuaggcaaauccucugucacugagucccagcccagccuaugauccuuugggguggauauauaugaaauuagaagaggagagcauuagauaaguccauagcugugaaauauauuguguuuggagauggucucacucccuagcccuggcuggccuggaaaucaauccauagauaaggauggucuagaaucaccggucucugccucccgagugcugagauuaaaggcauguguggccaugcugggccaugaugguagaauuucagguuuauuugcuucccucuaaccauagaauaguaaaaauagcagccuuacuaauacauagagggccccguggccugggcacuguucaaacagcagaacuucacaaguuacuugguucuucacuaggucugucuagggaacaugcuagcuuucauucugaucuuagaaaaaguuuggauaccuaauucuuacugccuucuuuggaccagggcugcauuuuguuuguuuguuuguuuuuugaaagcuacuagauugccaaguaaccagaaagagcaagcauaaauaaguuaucagguagcaggugugagaggcgugcaccacggguccucgucauccuuuuuaaccuagugccuauguguggcacacagauaaccaaggaaugaugggaagggauagcauuacaagcacugagggauaacaagaaacacgaaaucccagugaaaaccaaagcgguccuguuucacacacacacacacacacacacacacacacacacacacacacacacuuuggagcucagucugauuucccucuguaacugaguucacuugcauuaggcacccagagacgcugccuguuucacacacacacacacacacacacacacacacacacuuuggagcucagucugauuucccucuguaacugaguucacuugcauucuuccuuccagcggcugggaggcgcccagagacgcugccugaaggagccaggccccaucuguguucucuuuccauggagaggcugcugcccccuucuggggggaaguggauauuuuuaggggaaaugcuucaugggcuucugccgugguguucuucuuaguucucacuccaaggaugaaauuucagggcagacccaaguagcuugugcuuggagaaagaagcuguacacauaguggugugcgccuuggggguucugcagagggaguucgcuuuaguagaauuuaaaacaggagccucuuguuaugggagagacaaggcaggcggagucuagaccaguguccaacccgcagcugcagcacucugagccucuguuuccuaggaguuuggaggggcugagcuguuuuucagauggggugauggguucaguuagaagauggaaaacuaggcuguucgcuacuuuuauaccccccucugucuucagagcaccuuagcucugagcaguuuuaguuacugggagucaagaaugaacuuggcagggggggaaaauguccucaaaaguccgcaaggcgcugaacuacacggcuucugagauccuuuugaacucugaugugauuuuuaugaacuugagcccaaggcuuggaagcugaagacacgugccaaaaaauguguguauguguuguggauguuuugcaggcggacagcccugaggacaugcacagcuggaucgaggggauuggagcagcuguccaggcucugaagugccacccuaggguaagucacuuccucucugugccgcagcgucagcuuaaagauaaauuaucucugaaccggucguguuuuauuugguuauguaggcaggcagcccggccuuaagugcugguucacuuguuuuucucucucugcuaacuuggguacauuuucccccuucucucucucucucucucucucucucucucucucucucucucucucucucucucucuuucugguuuguaaguggacaugaagucggucuggacagagaugugaaguuucugauguguuccuacaaguccagcaucaggcagaacacugcaaacaugcggaacgagcucugcuuaguaucauuuuaaaauuuaugcauuuauuuauuuuuacaauaggguucucgcugugugguccagacuacuacugcaagccauccuccugccuuagccuucugggaaacugggacugaaggugucccuggcuucuagacaauuacuugagucuguagccagugucccuguuugaauugaccaucugaguggguucuugagacuuggagacaagcauuguaaggaaaaccccuuacuuugucuucucuuucuguguuuaggagccguccuuuucaagguccauuucuuugacucgaccuggaaguucuacccuuacaagcgcgccuaacuccaucuugucaagaaggcggccaccagcagaagagaaaagaggucucuguaaggccccuucgguggccuccuccuggcaacccuggacaccugucccccaggcugaggaaaagccguugucgguggagcaugcuccagaggacucucuauucaugccuaacccuggggagagcacagcuacaggggugcuggcaaguucucgagucaggcacaggucggagccccagcaccccaaggagaagccauuuguauucaaccuugaugacgaaaacauacgaaccucugaugugugauaugcagugcccguugcgugcaggagagccaggggcugugacuuauuuucucugccaugguagaggacagagucuaauggcacucacaguggaggggcucgucuagcuggcuuugguuuugcuauuauugacaccauuuauuuaacuggggaaagccacuagguuagacccacaggcauacucuauuaccucuugaauguccccauuuccccagguuuccuagugagggguuaguuuucauacuuccugucuggaggaggcuagaguccaguuucacccauaagcuuuucccucuuguauuucuuuuauagucuugguuuugcacaggaucucuggcuaagaacugcuuucaucuaccccuguuuauugacugaagucuggggaucagucagaccauuagcauccagacugacaggcaucgggugagacucagguuauacaguuccgauugggaucuaucugagagcggucguaagagucuggggagugaaaggugaauuuuugggauaucucccccaggcaguucuuucaggauaccucccaggggagcagacaggaccucuugugagucaugagggcuaauuaaacugcuauaaccacuuguaggaaucaugucguccucuugaugcuccaugaccccaaaugacauagaacugagugacagagccaccagucuauuuuccgugucaugucccgaggauaugcgguuaucagggucaaauguuaugauugcagagaccagaacagagacuucccuugaaacugaggugugugugugugugugugugugugugugugaaagagagagaaagagagagagagagagagagagagagagagagagagagagagagaaaaccacucauguuaggacaaucucucucucagaggcuuacauuaauauaaagcagcuacugagaagagauggaugguuguuuauugcaauaagcaucuuugauccauguuuuccagacaggagaaugacucuuucuuggcacagugaaucuugaauuccugucucacagcucuuuuauagccagucgacuuuuguguaaugcuaagugcuuguauacugugcagccugcuggcccacuugcucuuugcuuuauugcacugccuguuaaaugaagucaugcacacaccagguggaacucuagcgucugauaagagccuauacacucacuagugaagagacuuaaaugugauuuuuccccccaguacuuacauuuuucauggaauagaaacugggaauaaagaaauugaaucagaggaugaauuguuggcuaggaauuuccuagguucuagaagaguuuagaagauuagauuuccacccaaaauuuaggguauggcuuuuccacugggcaagauacuauuuccagugccuuuggggucauuucuaucagccuucaaugaacugugcuaccagaaaauuauggccauuuccuacagggagagaggucauggcucauuccuaucuguguaacuuuuaucugcuagguaaauuaacccuguuuuuaauuagaaauuuguagcucuaagagacuaggaggcauuuuuuauuuaagcuaguuagcacucuguguccauaguuaaugcaaaagcaaaaacaggcauaaagcucuccgggugagaggaagcaugcucuuucaaaugugacugugacccugaaucuggugccacacugaagacuucugggcuccgugugugggagcugucccccgacuuugucuggccuugugauccugaugaaaagaaaaccaaacaaaaaucagugggcuucuuucucuuucuguucaugaucuugugugucucccauccccuaaaaaaaaaaaaaaaaaaaaaacuuuuguguguuuugguuuuucaggguucggggauuauuuauuuaggagcgaauaagguuacaaccuacuucaaaagucagugcccuuugucucugguuucagcuuaaaaucuuccccuagaaaauucuuuggcugcucaacagaauugcucaaugugaagaugaggaacgaaugaaaaauaaaucaggaacuccugaagggccucgaacaugcccuggcucaaggaaaugaggucaucuuuuggcguuuaaauugcaaaaucugucugucccucucuuagaaacuguuggcuugguuauuagugcugcaucaacggguccuuacagaaaguugagagguuucgguacacacucugagaucauguuaaacacaaugcgguguauauuaugcaaacaaaggaaaaguacaguuucagugauccuaaccagcccauacaugagacuugcaaguuagaacauuguuaauagcggugcccagaaaauauaauuaucuuugugaagccucaaaacauuuaaagucucaauucuuguuucagaauuccccuucugucuguauuuacacacauacacacacccuuuaaauuuguuuuuugcuagagucuugcuacggaguccaggcuggcuuugaacugauaauccuccugccucagccuccugagugcuuggauuacaagucuaugccaccauauccagccuaggacaguauuuuaaugugagccaaagauggugcauaaaccuuuaguuuucaaggugugauggcguguggguuugugguuaagcauagauuguggauaaauccgaagggauuucuggauuauaaaagauacugcauuuccuguguggaauaaaagcagucucugggguuggguccuucuauaaagcuucgaagguauuguucucuguagcugaaguauguccuauccauuacucuucaaugcuuugguggacuugcuuacucgggucaggugauaaucaggggaaaaaaaaaaaaaagaagcguguguuuuucauucuccgaaccacaccgaggauaugggagaccgcaaacuaaaguggcaccucuggucaaaguggcggagugacagcucuacuuccaaguagaaggcugccccuccgggaagauuuaagguccaucguccuaguuuacuggaagcaaacugguuugguuugguuuuccccuuucuacacaggacuuauaugacccucugaguaagcaguggacugguaauugagcgguagacuugauacuuguuuucagugucaaccaaauaaacagcuaucugguagcagacggcaguguuuuugaaauuaggcuucccaugucgccuguuuaaccuccucccccacccccaccccccaaaaucuguuuuccucagucccucguucucucucuguguuauugccugccugagucaauuauagucacuuauaccagguaggcguugaaucaagugaauauuuggcaaaaacacacagugugacugcugggcccucuguuuaugaagguguggcaugccccguuugagccaguguuugagccgugaaacaccuccugcaagcacugagcuuagugcauggaaacuccagcuucuuacguugugugagcuccuaauugguauguagcaaaacgucauuuucuaaaaacugguugguugcuuguuuuguaauaaaaacaugugaaauaggaaau

SEQ ID NO: 4356 - RNA, 537 nt, Mus musculus
uuuucuuuuucuuuuuuucuuuuuuuuuuuuuuucagaauaugaaaauuuauuacuguguuuucauugucaaauuuuaugaucuuggccuuucuuucuugccuuuguauagagccaacagagaaacauuggcuacuuuaaccaccuuaaagcggacuccaguaauaucaccuacagcaugaccuuuucgaccaaauccagcaaccagaacuucaucauuuuccucaaugaaguucaggcagccaucauugggcacgaacgcugugaucuucuugccguucuuaaugagcugcacccugacgcacuuccugauggcagaauuuggcuguuuggccucaaccccuacuuuuuccagcacaauucccuuuguaugagaggcacccccaaacggauuggccuucagggcugugcccaagugggcuuucuuguacuguuugucaugccacuucugaucccgucggugacugcggagcuuccgggcaguucggagaccacgacacuugcccaucuugccggcgccacgggcccaagagaaagc

SEQ ID NO: 4357 - RNA, 7425 nt, Mus musculus
acuaagccuaggccuugacaagaugaagcuggcgagccccacuuagcgugcucuggacugcugugcuggagaaaugacagggucuuaacacccccgagcauucauaaucaccucugagguaggucuuagcuuggcgucugcccuacccggucaacccgagagcgccaagccacgcagcgggcagggagcaauguuagugggcggcaguucugaagcagaguaggggcgggaucauggaggggaagcccgccucccuuucaaacuagcaaaguuggaggagugggauagggcagagggcauugcuaccaaccugagacauugacggagaaguaggugguaucgcugccagaggggcugcuggucacgcaagcguagaggccagagucagcggggauggagucccgcaccuccaccuccuccccugugaugcggguacgguugcucuccaccagcugcaccccaucccgcagccaguugaugcucugcacaucaucgcgaagccgacagcgaagcuguagcaggucgccaggguggaccaggagagacuccacuuccacagggacuccccagggcugagcugcagcagccacccacaagggccaggaggaagagccaaguggagaaaggaggaggagaaagggaguuaggugagccauagggcgagccgagucguaggucacugcacuguccaggccuuagcuaaggcaagagagcuggggaccggaacguguaucagucggaaaugaugggcaaaccgagguccccagcucuucuccaccccgcuucuccaugagucaaagaagaaagaggcaaaguuaggaagcagccgcagcagcagcauuaagcaguguuucaacuuccacuguucuaaggggaagggucuccccgucucuagaaugcccccuuccccauaugcugcucaguucuuugccacuucccaccagaacacaccccagucggccucaccccucucccuagcgaaucaagccaaccaaccccucacgaacccagcaaccccaaugcccaagaugagagcaggcauuuggucaacaggggcucuugguacacaugacucagcgugggugggggccuggcccuccagcaacacagaugcguuugugggaaggacagccaaggaagaggucagcucaggggagccuccagcuaacagguguuaggcccaaggccugcagcugccaccacggcacauuugcucuggcaacagacauggcacacauaaagcccuccucauccaucgcuugccugggcucacccucuccugcaccccaucuuucuccuugagacacagugucgcacuguggguggugugacugagaauggcuuuuggauguuugauccuggguuggcagaacuguucugggacagagugagaggaggugucuuuguugggggagguguuauugcuaugaguaagguuucaaaaguccaugccagaccaagucugucugucugucuaucucucuuuuuuccuucccucuaacuuguagacagcagguaagcucucagcugcaguuccagugccuugccugcccgugugcugccaugguugccaccaggauggucgcggacucaccccucugaaacuguaagcaagcccccaauuaagugcuuucuuuaauuugccuuaguccuggugucucuucacagagacagaaaaguggcuaagguacacacacccuuacacauccccuucuguaucucaaccagaacaagaccuaccccccccccaacauccaacuauggaaagcacccauccugccuuuuuuuuaaauaaauuuuuaaaaaagauuuauuuauuuauucauuuuauguauaugagaguacacuguagcuguacaaaugguugugagccuucaugugguuguugagcauugaauuuaggaccucugcuuacucuggucaacuccagucgcucagucccugcucacucuggcccaaagauuuauuuauuauuauauguaaauacacuguagcugucuucagacgcaccagaagagggcgucagaucucaucaugggugguugugagccaccaugugguugcugggauuugaacuagggaccuuccgguagagcagucagugcucuuacccgcuaagccaucuggccagccccugcacccaccccuccuguggaugagcugcuuuagucaugugaucagaaagacccauauucuuggcacuaccaguagucagccauacugaccaaauaaauuaaucccuuugcuaaggaggaagcaaagaacuuucuggguuuuuuucugcacauuuaaaugaauggcuggccuggccuccuccucugaagaauguucuaggugccggaagucacgugugccugaaacucugaagcagcucccccaauccugcucugacuccacccuuugcuucucucuaggaguuuaccaucuaguccuagaacuggcagggaucucaggucuaaccaccaucuggccuccuucuugugucagggucucacuuugcagcccuggcuagcccagaacucacagagguccaccagcuucuucauccuccaugcugggguucaagguauguaaccaaccuuuacuuacaccgggacuuuuguuuuucugagacaaagucuuacuacauagcccagagugccuugaacucacuguauagcacagauggccccacagcaucugacacccccaucccuucuuuagcagugcuugggguggaagccagggcugggaaaaggcugggccacugagcgccuuguggcuccucucucuuuuagauuggucuuauuuuugacuguguguaucugcuugugucugucugugggcgugugcauguggggugugggucccuauggaggcgagcagugucccaucaacuaaagcagguguuacacacaguugugagccacgugacauggggaguaggaaccagacugggacccucccuacucugauccucuuaggagcuaccacucuagccucuaacuucucauuuuaaugagccucucucugaagugguccauugguuuugcacuagaagccuuagguccauggggguugaccauggcuuuucuuccaaggagcucacacugcaguuuaucaaccuaagggcucucucuucuaaacacagugccaucucaaguuagcaucugaauaccaguaagcuaauacauguuuauuuuuguguucuggucaaggagagcaccagaggggaacagaacgcacggcugauuaaaaauagcugcugcggacuauuccuuccauucuuagugguuuaugguuucgccaaaaggagaaaaacagccuggauuugacccugaaggaaaacagcaagcgucccuuccgccuauugauccgauuucauuuccccucaagugaucucacugauuaaauauuuugcugcucucgauccccaccagccacuagccacuggucaacaacagcgaagucaaauucucagagucaggcaucgcgcagucuacucacacaggucacagagacaaaacaguagcucccaaagaacucagcgaagagaacggaccggcacugcucccaagggaaggagccagcagccugcccuuucccauggucguaacuucuagcuggugcugaccaaugugggaaagaaacucaucucugagcuaagaaagccucggguaccagcauccuuguuucuacauuguucucuccccccccccccaacccccacugcugcagcuauccugggacagcacuacuccaagacccacccucuaguuuacauagucgcugucuucaucaaaaaaucuuacccuagauauaaaguaagacccaagucccucuuucuuuuuuuucccccccuuuccccccuuuaauuuuuugaggcaggguuucucugucuaacccaggaugucugggaacucacucugaagacuaggcugaccugcugggauuaaaggcaggugcaaccauugcuuggcccaaaucccucuuggccuccaaaggcuccugacaacccugucuuccuacuccacccaaaccuggcuaugccccugcacaacugcaccaucccccugcacagaaaacggacuucugaugacaccagucauaaccucccgaguucuccugccucaaucaguuagagucuacaggccagaaaaaucccagcagcagacauaccagucuacauagugguugccauccauauucaggacagacaaaaaaaaaaaauucugcccauagauucuccaucugugguugauugaucccacagacaugggagaauagcuguauauuccgaguuagaaaaccauuccaaaaaaucuaauuucagacuauuuuaccucccugccucaaaaaaauccauagucauagaacugaauccucauccccuacacacccuauagauagacaaacagacagacggacagacgucagacacacacacacacacacacacacacacacacacacacgguuucucaauagcccuggauauccuagaauucauucuagacaagccugcaccuugaacucccagagacugccugccucugcuuucuagguccugggauuauaggugccugccgcuacacccagcacccuuaccacauacuagcuaucacuguuccauguauuucagucaaugggaucacacucuguaugguauuuugugaccgugucaagaagaagcaaggcccuucuaugucagaguuguucuccacacuucuuucuuuuuaauggcugaacaguguuugggugcauagccaguaaccagagggcaucagggaguacugucccucagugaugacaacaccagggaguacugucccucagugaugacaacaccagggagcacugucccucagugauggcaucagggaguacugucccucagugaugacaacaucagggagcacugucccucagugaugacaucagggagugcugucccucagugaugacaucagggaguacugucucucagugaugacaacaucagggaguacugucccucagugaugacaacaucagggagcacugucccucagugaugacaaguacccauaccuugcuucuccuaagaccuagaaagcaacccagaccagaacugacucuuacaauuaacaccaggaacacagaaaugggucuuuuagaggacucauuaaucagccaaggggcgguaaaguauuaguggcuuucuucauugauagcagaggccuuagauauauggguuccccauuuacaaagcagcuauaaagaaagcuacuuuguuguggaaggcauggaaagguaacaaguuggacuauuaccuguauguuagagugguccugacauugacccuguuacuagguaacgcucacuagcaacucacugccuugguuaagaauuguguggaacuuacucacauauuccuuugacaagacguacuugucauucauagccucuucugagcuugacuuucucagucaagaccaauggccuggagcuacaguguggcagguuuaucagccgaugagagaacagcuaacugcuacuuucauuaaacugguugugaaggaugcaaaagggggucauacucggccaaugcugaaauccacauuccagucuugauagaagacuggauaggauagcaugggguagcaugggauagcaugggguagcaugggauagcaaggaguagcaugagauagcaugggauagcaugggguagcacaggauagguaggauaggauaggaacuuguugaacuaaagcacagagcuaaccagucagaucaauggugcaggggcaaggcccuugcugccaagccuuagaaccauguggugggagagaaugagcuccccccggccucacuacacacacacacuaaacaaacaucaaugucuucuaaaacugcuggguugguuuuuuggacaggaccucacuauguaguccuaucuggccuggaacucacuagguagcuggcuuccaauuuacaagagaucugccugucucugcuucccuuguauugagauuaaaagugcaucccuccaagcugacugaaaaacauuuuaagugggcuggagggauggcucagagguuaagggcacuggcugcucuucuagaggacccagguuugguuccuagcacccacauggcagcucauaaccaucucuaaugccagucccaggauauccaaugcccucuucuggccucuuugaaugccagguauacaugugaugcacugacauagaugcaggcagaauacccauacacauaaaaacaaaaauaaauaaaucuuuggggcuggagagauggcucagugguuaagagcacugguugcucuuccagagguccugaguucaauucccauccauaaccaucuauaauggaauaugaugcccucuucuggcauacaggaguacauguagaagagcacucauauacguaaaauaaaucuuuaaaaagauuauauauauauauauauauauauauauauauauauauauauauauacacacacacacacacuugggggggggggcaguguuucucuguguagcccuggcugucuuuaaacucagagaucggccugccuccgccugcgccccccccccaaccaguacuggcaucaaagcaugcagcuauaauaacaguagcaaaauuacagucacgaaguaaccacugcucuagaaggagggaaaacuacaugucaaccuuauccucuucaagaaaucagccauaaagggcagggaaggagaucuuuuucauaguacuuuuauguuaaagaacaugauaaaugugaaugaaaccuuuuuguccccuuuccuauuuguacccccaaauacuucagcuauugggauaacuucucaacaagccaagaggggccgcauuuugcuuacaccagagcaggccggaagugauccagugguuuagcagguuaauucuggucugaggaugucgaucagauccaucuccccacucgaaaucuggucucugacaugagcccuguaucagcgggagagcggagccuggaggcccaaauccauauaaaucuuauuaugcuuccgcuuguacagcagucaauaggagacagccauuaaagaaauccucgggggcacaccugucuguggagaccgccaaugcagcccacucgugacacaggaaucagcagagcuggaacagcaccguaugguauaagaucacuuccugggguuguaagauggcucacuuggcaagaaaacuuccugaaaagccugacuugaguucugccuccaggacucccgugguagagagugguagagagaacugacucuuacaaacuauccucugaccaccacaugugcacuauggcauauacacaugucccugaacacgugcacgugugcucgaguguaugugugugcacacgcacgcgcacacacacaccacuaauauaaaauaaaugcaauuuuaaaaacuuauu
